United States Patent 8,067,671 (METHODS FOR GENETIC CONTROL OF PLANT PEST INFESTATION AND COMPOSITIONS THEREOF) - sequence listing, part 8

SEQ ID NO: 6351 - DNA, 4772 bp, Heterodera glycines
ttttcactgacgaaatcactcactgacgaaatcacttcctttcaaaatcactcactgacgaaatcacttaatgacgaaatcaccgggaaccgcggcgatatttcggcggtgatattttgtctcgtccccatatccgaccaaatttgatttttcttgatgaaatgttcattggatccgatcaccttgcatcttcaacttttcttttaagaaattttgtttttgaattttattgttatactttaatgttagaaacaaaaacaaagtgctggagtcaaagaaaaaaatttaaataataataaaatattctttagaactaccaattttgcaaatggcctagtggctagtctccttgactttcccttcttctttctcttggtttaatctagagatcggaccggtcggtttttttcggtatttttcgattttcggtttcggtttttaaccgaaaaaaaccgaccgagaaatttttgagtttttcggtttttttcggtttcggtttttttcggttttttaaccgaaaccgttcgaccgaaatatttaaaacgtcatacgagtgcggagacccttttgacattattttcatcatttattttaaatttaaattatattttacatttcgccaattttatctttttattttgttttgcattttcatttgtcacacaattttctacaacttcgtctttgatcttttaaaaatgattttatattttgtcttctcttctcggcaataaatttataaaaatctatcgcttcggacccttttggtttaattgtttcagtctgcttttcccaaaagagcagtacttggcgctcctggtctacaaaccctcccaacttttggaacggccaacaagaagcactgactgaggattttgttttggatttggaaatggaaaatcagagcaacgcatcggtccatagcagatcagagcgcgaagaaaatggagcggacgcagagagaaatgcggaaaacggcggaaatggaggtttggatggtggcaatgagcatgcaccgattttgggacagaatttgaatcgaggtgctgatccgcgtcacccacagccgggacgtcaccgatacaatctccgaccccgccaaaacaatttgttttatggcctcaatcccaatgagtctgccgacagttttcagccacacggcgaaaaccgccaaccaaatcgaagacagcaagcacccattcaaaatccgggttttttcgaaaatgttgaaatgggaaatcccctttttgctcagaaccaaatcgtagaacaagtcgttgagaattcacattccggcattagaaatgaaatacagcatccaattggactcgaaattgagcggtacggacgcccgatcgctaattcctctccaatcaccagaatgggaagttcgcataacgagccacacaattcttttgaaaacgtggagtttgaagagataaggcaatttcgggccaggcaactttacgaaaatccacgcggatttcgtgaacaaaattttgtcggggaacaacgagaaaggatgaatgaatttgagcaaaaccatgctccggtcccaaattttgaaagaagaaatgtatttgttggtgatccgcacggaaatcagctaatttttgggaattttggaaggaacatggaacggaattttggacattttgaaaattttcccggactcgcacgaggcggaaaccaaaatttgaatgttgggggaccaagaatggaacaaattcgagacccacacagagaaagaaatcagtacgaggaacggcaattcatgccaattcccgaaccaaatatgaggcaaattgatggacaaaaccaaaatttggcttttcgacaagtgcagagccaaaattttcaagaaaacatggcgagagtgatgccatacaccgaaggaattcctgatattattcttgaacttcacaaagtcacactttcaaatcagtacgcaaatgtccttagagaaattcctactctttttggcactgaagggagggacaaaatcaacgattttttcaccactcttgaattgtgtacaggagattggagacccgagaaaaagttggaaattttgagagcgaaattaaaggggaaggcatccaaagcattgaatttgtccctacgaaaatttggtcaccaagtgccattcgaagtcattaaaagggagattaagaccattttacgggaaacggattataaagaggcaagcgcatttacggaattgacgcagtttggaaagcagaaagtcggtgaggatattgtgaaatttggtgagcggattcagcagctggtcagctgcgcgtactatgggatcgaagaagaacagttggacgaaatttcgaaaaaatttttcatttcgaatgttagtgatcccaatatgtcacgttttttggaatgccaaaccaaacaatcccagacattcgacgaattgttgatggtggcaaaccgattgagtttaattgagtcaaaacgaaacgtaaaccaatccctgaaccaaaattatagagaaaacaattcacagttttctcatccgcgaaatcagttcaaccaaaaccgttttttccaaaaccaaagttttgaaccaaggcctcaaaataatcaagttagattttttgctgatcgaaatttcacccgacaaaatttcacggataggcagcagccaaacacaaatgagaacagaaactccggctggaaccgaggcggctaccaaaattcaaatttccaaaaccggcaaaatttcccaaatactgataaccgaacccaaaatgtgccgaatccacagcagattcaatcatcttctggcacacgaaccaacacgaatacgattacagtcacggaaaagaaccaaaacgagcagaacgaattggttttttgcaataatatttctcaaaaagaagttcaggattttgaaattttttttaattgcctaactactaaagcatacgattttccatctaaaaatcccgcccaaccaaaaacatatgaatgtcttaaattggtaatgaaagtggaaggtcaaaatgcgaaaactttgggagactctggtgccgaaacgaatattgtcaaccccgaatttctttataatttggcgaaaaaattgaaattggatttgataaattggggttttaatccgaataaagggctaacgagaattccatttgatgttgcttcgttttctggttcaaggatttccattataggcgtaataaatatcccaatcgaaacatctggttttaaaacaaatgttccgtgtttgatttcaaaagaaagatttaattttgatttggttttgggcactggtgcgatggaaacactcggattttaccttgcaaactcatttacaaatgaaataacttatttcacttcaaaagagcaacaagaaatgtcaattcctctcataaattctgttaaagtcgcatcttttacggtcataccccctatgtcctcgtgttttgtcgattctagaattgaaaaccattctaatctacccaaaaattcccattttcttatagaaaactcggaaaaatcaattttattaaaaatgcaaagcgacgaagaccttatggactacgacgaaacagacaaagtcgaaatggaacggctgagaaaattggacaaagtggcggagcaaaaggaattggaaaaactgggaataattgtgccggagaccaacattggacaaaaatggaatggaaaaagagggcacagtgaaccgcccattcattgcactgatgcgaaaatcccagtgcatgaacttccgattatcgaaatggcgttggcaacgtcggagccaggttcatttaaaattttggttcataacaaaaatttaacgccaatattcctcaaaagtggcattgaaattgcaaaagcagaaattgttgaagaaatttatgacccccatatcgaacttcttcctgaaaggttctggaaatcccaaagattcattagaaactttggtgttcagaaaaatggagagcgaatttcgcaacttttgtctgtcattaaaccaaattttgggcctttaaataatgaagaaaaaagtctgttggaggaaattttggttgaattttctgatgttctagcactcgaagaatccgaattaactcaaacaaacttaaccgaacataaaatcgatactggaaacacacaagcaattaaaataccaccgcgccctatgccttttggagttagagcaaaagttaacgaaatgttggacgattatctgaaccgtggcataataagaccctcaaatagcccatgggcatccccgattgttttggcggtcaaaaaggacaaatcgataaggctgtgtatcgattatcggaaactgaattcggtcacaaaaagagactcgtatccccttccaaacattgacggaattttaatgtatttaggggaaaggaaatttttcagtacattggaccttatgtcaggatactggcagatccccgttgccaaagaagacgtcccaaaaaccgctttttcagtaccaaatggtcattacgaatttttggttctcccttttggtctttcaaatgcgcccgcaactttccagcgttttatgaactgcattttaaacgagtacataaacgattttgtgttcgtatatctcgacgacattcttatagcctcaaaaaattttgatgaacacattttacatcttaaaatggtttttcaaaaattgcgaaaaagtggtgtcaaggcgaaggccgaaaaatgcggatttgctcgagaaaaggctccttatttgggacacactttaaccagagaag

SEQ ID NO: 6352 - DNA, 3157 bp, Heterodera glycines
agagtcccgatccgcccagtctctactaattaccctttaccccccccccccccccccccccccctcgtcccgtcccgttcccccttaacctcccctctcttcctcggtcccatttctcccccccccccctttttggtcgcctgtcgccgcctctccgtctcacctcctctcttccacatttattttttaatttttttgtcgttgtcttaatttttgactgactttgcgctggcccatcaaaacaattctctttacaccgataatttcgcttgtctttttaagattttatcggtattatcatgtgaaaagtgcgcaattctgtcaggagaaaagcggggaaatgttcgccaacgatggaattaaattcattcgaggaattcgcgcagttcgctgtttttctatttcaaaataaaattaacgaaataataactgtcatcctcacgctattttgaaatttcctcatcgttttttttcgcataatctttgcccaaaatggccaatttgtcggccacgccttcccccgtcgtcccctcccatttcaatgcctcatcttcgctgtttcccaccgccacggcttttccctcccccgctgcttcttcgcagagtttggccactgctccgttgaatgcctattccgtggtgaacatttgcatttgtgcgccgatgcttttgctgcagctgctcactttgcccgtacctttggccattctttgctccgtttttctcgcattgtccgctttttcttcagattttccttatcttccccaattaccgtcgcaatgtttgctttcgcattttgttcacaaatggcgtcaccgactgtcttcagttggccccgttactcatcttcgccgtgcttaatctgatcaccgatcaaattcccatttggttccaaatggttgcttttcattttaattttgtttaatttcaatttttttttaatttggcaatttgttcttcagtttggcagcagcattgtgctcaatgcgtggaaccttctcgtcatgcagcactttttgctggccatcaaccgacttattgtgattttgcgtgcccgataccttggctcgaaattcattccggacgaggacaccgaagcgatgtgtttcaatgtgaggggcattttgaaaaaggcattcaatcacatgatcggattccatcccatttttttgtgtcttgtcactctgtactgatcagtagggctgtgaattttagtgactaaaaacttgcacaaatcgccaagcggaattttctaacacagctcattgttttcgaaagagtttaaaattttgcatgaaaatactttggtataaggcctagcatcttgccaaattctagaattttttatgcactcagagatttttaaaaaaatccgctttttccagcctgaatgccaagtttgtggtcaagttttgaaaacaggtggttttttgtaaaaaagttttaacaatatgaaaaattctgaaattttgcagggtgttaggtctcatgccaaagtattttcatgcaaaatttcaagctattctgataactctgaaccgaattacaaaaatcaacttgagcaaaatttaaacttttattcactaaaattcacagccctactgatcagtccccctctgatcactttgctgatcgtactctgtcatcttttttccatcttctgatcgcactgctgatccttctttcagattgcgcatgtgttctgctggacggtgtacttcgtcattgtcggtctccaccaaaccaatttgatgggtgggcttttccattccggcaccagccaattcgtcttcgacattggaaagccgtggactcagacgatgcgcgaagtgttcaaatatttgaccatcgcaatgccaatcatttgcctggtcatttacattgtgatcattgcatttgccaaactggtaaatcgttttaatttaaatgcctttttaaaatttgttcagagtcgcgctggcacccgccgaggcgacgactttaccaaagccaaaacgacggcgccgcttttgaacgattacgaacagcgactgctcatccaagttggaattggtttcttagcaccaccgagttcaatttgggaatgtttttcaattgaatttccaatcggtgctccgtccaattcactcttaacagttgcctcaggctatcattctgtacgtggtcatggctcttctgatcatcgcttggaattcgttcgagtcgtgccccaacgacatttgcatcggcaaaattttgggattaattcccatttcgctgtcccgttccaaccacacttttttcattgaggtctttcgttcgttcgttcgattcatttcggcactttttagggcctttggatggtttactgcggattgagcccaattctgtttttgacgatgaacaagtggacattttaattgcacaaccaaaaagattaattaattttttttaatttcagagagtttagaaaccgatttttgaaattgtacggattcaaaagggcaattgttttcccaagcaccggacacacaaacatttcgaaaagcaacgaaagcaatgacacgaaggcggacaacaaataagttggacggaccataacacaaaaacggaatcaatgaaataatgggggggggggggaaaggttctcagcagatggattattatcttaattaattaattaccctttagaaatacaaagtgaccgaaaaacatgggcacacgcaccccggtgacgtaatgatgggccgtcttttttttacagaaatcaatatgttatgatataataattgttctcaattttgaatagcaattataatataaccaagtgcatttggcccattttgttaattaagatttttattatgtcattaaactaaaattggattgattagtaacaaatgatttttgatcgtttcgtttgcctttcattttccttttcattgtttgtggaatttccttcggtaagtctgtttctgctgctgctgcagttgttgcgtttgggcttccctatttgcatttggagttttgccttccatttccctttttggggacgaaaggagaagcgcgtttctgctcgggcacggacaatactcggcttaaatggatgacaaaaatgccctcctctcccaattgtgccatcaaattctctccccctcccaatgtgttccgttacccc

SEQ ID NO: 6353 - DNA, 4123 bp, Heterodera glycines
cccttttccccttccggccccttaaaatgaatgttgatccaagcttcagactcggctgcttgcctgcgcaccgaccccgccctgcggcccctgcggtcccgcgtccccttggtctccgactgcgcccggcggtcccttcagtccgggccttccatgaacgagctttgcgtcctctcctggtattccctgttctccgaccgtcccaatggaccccgcttttccttgaggacccaactaaaacaaatacttggaagaggcaacaatcggtcggcagtttttacccctccggggaatccgggctgtccatctcgtccaggtacttaaaagatcattaataacacggtgaaaatgcgaaaatgagtcattaccgcccggttggcccttccctccgcgcattccccgtgggccaggccgacccggcaaacccaggggccccggaggacccattggacagtggaaacacttttccagctgctggacttgtgccagaacgtcttcagcagagacaccagcgaccccatcctgaaaataaaaataatcgcgtgaatccatgcccaatgattaacaagggggacctgtcctgctgcgccggcttcgcctttctctccgggtgccccgcgggggcctttcggcccggcgggacattttcgttcggcgcaattgcacttggccatcggcgattgttgcgtggcacttcggtctgtcccttcagcagaagttgtgctcccagtttccttttggtcggccgccttttctttcttttctccctccactccggcgcttttttcacccgaattttcagctgcgtctcgtcgcattcgccgttgcccattcacttcgattaccgtggcccaaatttcatccgattggacctgacaaattggcagttattttaatgaacaaccattaaaatagaaagttactctaaatagcagcatctcttcggctaattccgtgcggatttggctcatcttttggtaaagcattggcccgccaattagacaactcaaagtgcagaaaatgcccaacgccgcgcaagtggcagccgcaacttttaaacccatttaaaatttgaatttgaagacgaggaataagtgacttgtgattggcaatagcaaagccttttaaggggtgaggggggggggacaaaacataaaaccggatgaatttgcgcattttcggggtttgcgtggcgggagagagcgaaagaaacggtgaaggacgaattttgaattccaaccaattcaagtgaatttacagccctttcaaaggacgggatgaaaggaatgatctccggtttgacatcctttgtacgtcatatgcaaattaattgaaatgaaatgcccaatttcggaatttcaaaatgcaaaaaaggtcaattctaaaatttattaaattttaaatgtcttttgggtctcagataatattaaagtgaattgatcattttatcagcattcatcaaagttatgcttacgtaatttttgagctttttaaattgttatcgaatattggtatttttaatatttttctattagaaaataagaaattttttaaatttacatgttaatagaatttatataaaaatgctaatatttggcttattttaagggaattcgggtggatatgccgaaagtttatttattattaattcagaatgtcagaaaaattgtgaaaatcattaaattcattatgaaatatttatttgcataaatttattcatcaaaattctcgaccatttttaaacatttgcgtcatccgaaattaataattccgtttgaaattggatggattcgttgggtttcaacagcaaatttatttgcccattacgatttttgaattttgtttagaaatttcctccaatgtcttcatggaatgcgtcatccgcttcttcgtttattttcatcttcaaataaatttacagagaattggaatttattcgtcggatgattggccattaattttgatcgaattgatgggaggaataatttaaaagcattaaaatattggccaataaaatggcccccccccccacagaatcctccgacagttttcctcttcacattccgagcctttttctgactcagaaatggcccttcttctcgccaaattcgccctcgctttgtttttcattctttcagaagtgacaaaagggaacggacaaaatggttaattaaataataattaaacaaaacttcgattttgttttgtttaggataccataatctgatgtattaccacccccagcagcaggtgatcattgatcactcaccgattagtcgattttgctttttacccattttattttaataatgaaacgtcctttttttaaaagttgatcgtttagcaaaatgcgccgcttctcagttcgcttcagcagtgccagcaacagctgaacgatttgcagcagcaaatcgcgtcaatgcaaaatcagaaaacggtgggcaaaaacgaaagtaaaggggaaactgtatgaattaatacggcgattttgttctttcggatgattaggcgggaggggggggggggaaattgtgggacaaaaacaatggaaaaacgtttgtttagccaacggcgaattcgccctcgggcaacggcacgcaaacgcagcaggggacagacagcgcaaagaatcttttggagggagtggtggtggcgaattcgagcacgaaattcgtaaaaagcgcattcacatgaaaagggagacgaagaaaaagaaaggacagagagaaaagttaagggaagtggacaaaacaaattatgagaaataagagagaaatccattccatttttaaatgcataaacaaatgtgacactgtcagaatgtacgactcaaaatcaaagaaaagagcaatccccgatgaatttgccattatttggccatcgcctgcttttgcttttcctccgtcggcccctcaaaaaacatctgtcccaatttgcttttgctttcgattcgccgctgtctctcctccttttgagctttctcgtcggttgtgtttgtctgctgctgtgcgaaatacgaacctaatgaaaagagcaattaattaaagtttgtcggtgttgttgtacataatttagtattaattttccaacgtgaaaaggtcttgttagaattaaaaaagcaatcatcgtatttataaaaatgtattaatttaaattaataatcgttgtgttttccaatgaaaataatccattacatcatataataacacgataatgggcatgttgcgcgacaatgcgtgacgtttgattgaaaaataatgccgtattcgtattcagtttaattttgggaggatacgagaggtaataacataacgaacgtgaagtgccgtgtctgtttcaattcgaaagaaatcataaataagtggcaggaagtgaacaacgaatatttctttttaaataaatattttgatgcagattttctgtataggcaaaatttttcggcccaaagacttagtaaacaatttcctaaatttttgacccaatatactcatgaatatttttggtgcataatctattaacaattgatttaaattgaagaaattttcgaccataataattcttaaaatatcaaaaacaaagcacattaatgcaagtaaaatttgaatatgtagacctgggttcgaaattggactagattaacatgatactcaatagtcataacaagcgaattttttcgatttttggacttaattgaactaattaccagttttgatcagtgatcacacacagttcaagaaagaacgagaatcataaataacacaaatattttcatgcgaataaaaaaggtaaaaaaaatttctgaaggatttgccaaccaatttaataaatattttgtttttaccattgttttgttctgttgcgactgtttctccgcccgttttgtcattccttttgacatttaacaaattcggtagggtttccatttgcttttgttcaatagttccattcgcagttgattgtgagatttctctgctggctaaaacgtttttattataaagacaatttttaaaatttcattttgagtgtatttccccccctccacccaaaaataatattctcaaacaatctaaaaaacagaaattgtctttaaaattcaaatattgcgacgggtggaaacgaaatg

SEQ ID NO: 6354 - DNA, 1722 bp, Heterodera glycines
gcgatcggacatggacaccccccaatatggaaatttatcaacattttgcgcgagcaccagaaaataatcgacgtggacttcgaacatttcctcgccggaaatgctccgccgccgaaagcaaagcgttactgtgaagcagacagacgaattttgaggatcctggagcgctacaatcaagaaaaagagcggccgcaaatcgaaaatgatcaccaatattgtcaaaaccaaattaatccgaatttgattaatgaaatgcttaggggaatttccagcaattaccaaatgaatcaatgattttctttttaattgcattattatttatttgtattttcgttttaattaaaatagattttttataatttctctatgtacttaaccgaattcaatacaaatatcattctctcaaaaattgtattctttgaaaaagtgattcaaaaaatgtttgagacgcaaccggccccttaagtactaagacgcaactggccaagacgcaactggccccagacgcaactggccccagacgcaactgacccctaccgggaccgggccgggaattcccggtcatccgaggtcccggtcccggattttgaaaagctcaggtcccggtcccggcttctcaggtcccggcaagtcccggtcccggtttttgcaaaaattcccggtcccgtggcactctataaaaaaggatcaaacatttctatttttcctccggaggtagcgacaccgacggacccccaaacaaatcttattttttcataaaattggctcaaaatctcaaaaattggcatttttggtttggcaaccctggcactttttgaaaaaaagaagttatttttcaacaataaaaccgttgtaattgtgcaaataggtttaaaaagtcattaaaaaaatcttatttttgggtattttagttttagcctcgattgtccttattttgaaaaaaatttggcagctctattttcattaggcgacatgcctagtaaataagcgaaaatgcttttgctgcttgtcctcccataaatttgatgctgatcagaaaaaaatattaaaattaccaattaataaaaagcattttttacggattatccggagactttctgatcagtcctggcaatgtcgctgatcagcagggatcattttcatggtgaacaaatcagcgcagcaacagcagcatcagcagagaagtggaactcacatttgcacttttcttttgctaaaacaatattcccaatttgtctctatcgatttacttcgattgtaaattttcggctttttgcctatgccactaatggatagggcgcgtttaaattattactagagcacgaccaaaaaggcaacaaaactcgcgaaaaaggcactttaataggcaccaaaaaattgaaaaaaaggcatgttaaatgcacgaaaatcccaacatgaaaaaggcatttaaaattttttattaaggatttttagggagcaaaacacgtaaaagttaaccaaaaaacttaattttggtcatttaaatgattattaaaatattttataattattttcgaataaggaattttttaaagctaaaattttttatcaaaaaaaataattaattttttgcgatcaattttttagaaaatttttctattcttaatggtgtattttcccgattttattgcatttttaattgaatttttcggaaaaaacgccaaaaaaggcaccaaaacggcaaaatgccaaaaaaggcat

SEQ ID NO: 6355 - DNA, 4149 bp, Heterodera glycines
ttttagtgtatataaagcatattttggggtttcgagaataaatgcatattttgcattttagagcatatttaatgtctaaaacgctgcttagtcatgttttaatttttatacaattttggcattttttgagaaattaaaagcaatttttgcaatttttacggcatattttattgcatatttgggcatttttcgggtttttagggcgtattggagggatctttagtgcatattttatgcattgccattttttagtgcataaacttcgaaccctaataacaatggccatattttatgaataataaaaaaaatttaaataattttttaatttttcttacagaaaaaaatggtggcgttgtgcattactcctcaaattattgctgtggtgtttatggtgttgtttttgagtggattttttaacggtatctaaagaattttttgtaaaaaaaatatattttacaaatttgtcatattaatactcattgtaaaaagggggacatgaaattgtggagatttcaatgtcaacagtttcgtcggaacgaatctggcaaagttgggcgattttttcaattgcctttttgccgatagacccaccccccccccccttttcggcattttctccgctgaaattcaaattttgcctttaattaatttttaaaatttcaaaagaaaaagtgattattttaaggatttaaaaaaatttaattctgtgcaaaaaaaattttgttttttaaatttttttttgcctaaaattaaattggcattttttgctgcaaattttgccagctttgggaattaacaaacatgaaaatgtgatcattcatcgcttaactcaaattaggtggcgtaaattcgtcaagtggaaaaagtgtcttcctctcaaatgttcaacatccgccggcaaacattccgaagaattcaaatgccaatttgctgcagcaaattggcgtgactaattatcaacagcagcagcagaatgccaacaaaacattgaagggtaattaatgaaaataaattatattttttggtagctttcatttcagggaaaaactcgcttaaattttttattaaaattttcttattaaaaatttttttaaattttttgtgaaaaatttcgtttttaaaattttcaaagaaatttcggggtggaacaatacgggggcgcggaaaatgagcttctcctatgctcgagaacatttggtctcgatagggtaaaaaatttctcggaatatttgagtctcggtcttgaacttgggggtaagtgctcggcatttgtctggtgggttcaattcttcaaaattaaaaaatactcttctttcaaaaggttaagatgtttttgactgtctgacaaaattttgtttttactttaatatttcttaaaatttctcaaattaaaaaaatatatatatttccaatgaaagtttttttatgggaaattttgcataaaaatatatttttttcaaataaaacatgaccaaaaaccatttatgtatgacttgattcaatctaatttattaatatttttggtgatttttcatgaattcaaaaagaaatccgcgacatttattgtttttaattttaaaaaataataaaaaataaaaataaatttaccttttagagagtgatcgagaacaaaaaacaacgtaagcaaaaaaaaattgatactcatggccagcaggcccctaaccagaaaaaaaactttggaggcttttgcctctaaaatttttcccaatgtaatttttaatttttcaacttttcttggcccgcggaattaaactcgtatttttgaagatattttttcgcgaaatttgctaataaaatttttataaattcatataacagaccattttgaattacggtattatccaattaccgtactatctcattttctaaaaagtattactatacatacgcattgtcaaatttcatagattttgagggctcaaggggtaaaaaccacaaaaatatttacttagatgaaattcattgtcgtggcataaagcctcggtccaagtggtagtttattctagagaatgggctttttaaagaaatcaggaccagcattttggatgattgaactttatgactcgctcaggggcaattttatctgtgttaaaaagtgggccttttattctcctaaaaataacccattaattatcttatgtagtcctttttagtgaccagggtctttgttaattcacattaaaaaatggtttattttcattaagcctttctccggaaaattgccaaaatattggtgcgggagttgcgtgccatgttcaaaaaatttttgacaattttttgtctctatcttatgactctccaatgataggataaaacaattatgtagcaatattccctagtttgttttgaacattttgaatatattttgtcatttttggttgcgtttgaaaaaagttattcaaataaataagtgggacattacttatttgtcaccctgtatgctggttacgggcctgttgcccatgcgccaccctaatgaaacgactaattaggcacccaattaataataatttagcccctcacgcagaaagaaaaatggaaaaaaatcggacaaaaaaataaattcggctgcttctcttgtaaatacaaaaaagaaggaagaggagaagctgaataagcaaaagcatcagcaaaaaggcaaaaataatgggaggaaaaggaaggaaaagaataaatcgcagatgggccgattgggaaaatttatgtgagtgagagaatttgggggcggcaattcggtgctgttagttttcgacagtgcttgatttcaatcagtaatcttttgtttttttaaaaaacttatcctatatggtgcaagtctagttaaattttgaaaattaaaagtggagggcttttgcgattttctaattctgctacaagagcctccaggttcgcatcttggcactcaaacccggcacttgttagcaggactttcccacgcgattcaagaatcttatctacgaaatttgttgggtttttgagtgcttcaagaaatgtttgtatagaaaaaatgaaagcgataaatcttttgacaaaaattaccataaaattcattattacttaaattataagttttgtttatgcaaatatatggatattaatttaattcatatgtaagaaattatatggaaaaaagaatttaaaaccattgttcaaatcaactactgtcgaaaacacctgctggtacgagcaattcagagccaaatttgagcagcaaatccgattaatccccgttccggacctgggtctggaaaattccgaccggaaatttgtttcggtgcctttttgaacaaaaactctcctgaaaattcgtaatcttattcaaaaaaccatttttgtacaaaatttgcttgtaaataatatttacccaaatttgcatatgaaaaaattcttcggcgacgggccctcaaatttttttgagaaatataaaaattcaaaaatttggcaatttgtctgctgggcactttcaaatttgttgtccttatgcgttttaaggacaattatcattcatttgtacatgcatttttaccccttttttgtgcacaggttcactgtgttcatggtgatcagtatgttcgttccacaagttccgctcaatttggtgctccgtaagcatttaaaaataaaaattaatataaactcagtgtttaaaaattatattttctagagttgtacgggaccgcgaattttgagaaaatccgggaccgggacttttcggattgaaaagccgggactttttggctgggaaaaccggaaaaaccgagacttaggtattcagtcatatttttttcagtaccagtcccggtcccatacaactctaatattttccaatagaaaaaaaaagtttttttttcaaaattactagtaaaatattttgaaaaaaaatcaggcgatatagataatggaaaactataaaataataaaattaatttgatttttctttttttcactgttattataaattttttctgaattttgagcggattgacgcaaaaaattgaggtttttaattatttcaaacttactataatttgtttactgtatattgtaaaaaacaaacgtactgtaattttttttactgtatatttgtcggcgtatcaatttacgcttaaaatttcatttcatcattta

SEQ ID NO: 6356 - DNA, 3510 bp, Heterodera glycines
cctagaaattttcggaaattttttttcggacgaaaatgggagtgaaaaatatttttctggggtaaaataaggtgctgagcacgaatatgatgtttatttttcgtttcagaatttttggaattttttaaaaattttttattttttggcaattttttggccctcgggattttggcctaatatttgaaaattcatatctagcctaagggttgaccaattttacaggaataaagccttaaaaatagagaaaaatcaggagaattttatggactttatttggaatttctatctaaaaaaggaaaaaagttattccagaatttctggaaattttcgatttttcagaaaaaaattcgtagctgccttctgaaaagctattcgggaaaagtaaaatactacaaaaatccgcaatttttttctctataatataaattttattttacatttttatcacatttttaaaaaaagatacaaaaataaaagtgattttggcattcgggaccaaaggggggagcacatgatttttgagtggaaaatttttttttcacaaaattcttccaaaaatatgtctttaggggttatttgggccgctgatcacgaatacgtgatcagattttacttttgacatagtcaagacctcagaatccctgtgtgattggggattctgaggcatcattttgagggggggggggcaggttcggatccggacggtgtaaattatttttctatttatttttgtgttatttttaatgtttttaattcatttaaaagagtgtttgttttataataaaaaataaattttttaatttaaattaaattatttttttatgaaaaattttattaaaattaattatttttttaattaaataatttcatatatttttttttatttgagtttttcagaaattaatttcatttcaattattataaacttcaaagtttttttaataatcaaaagaggcatttattttacaatttttaaaaattattaatgcatttttgtacctcttctgccatttgttgtacctacttctctcttttaatcactgttgtacctcttctaggttggtaattaaaatatttttaaataaataaaacaaatgtttatatttattgcaaaatcttctttttctttaaaagacaattaatttaaaccaaaacacattcatcctttaaattgatttacaattaacggttcccctcttaaaagaacaatgacattttactgagggttttgaatttttacgaaaattaaacttttcagtgttatttaaaaatttaacattgccaaaattgatcggcaaaaactgaatattttcagtatttgtttccaggcccaattgaaccctaataataatttaaaattaatttgatttttaatcaaataaattttatttattttccctgtgaacggagtgaagaaaatgcagagaaaagtgaaaaatatgagagaaatattgtacaaacagacagcgggagaaaggcgttctctgccctaattgtattgtaaaaaatggaggacgtggaagaaatattgatttttaaattttttgtagaaaaattattcgtcattacaattttagtcctacgtaatcataattattttaaatttatattatgtgaatgaaaaagaaaagccagcgaatttctaattccaaaaaaaaaaattctaaaaaatctatttgggaattaacgacagagttttttcaattttcacaaggctcgaaaatttttttaaaaatcactgatttaagcgcctgagaattaaataaaataatttcttcgttttcctcatcccaaatttcttagttaaatggcattctttttttttcaattttatacccaattaaaaaaatattttaaatttttttcaaaattttcatcaaggtcttgacccttcaaatttttcagcattttttgtatatcatcgtaaaaatatttttaaaaaatgttggaatcggacactttggcccaaaatcagtcggcaagcgtttcgcccggatggaatgacccgccgccgttggccaacccggcgacaacgacagctgcggcacatgccggcctcaccaacggagtggctaacggcgcaggtcggctgcatttgcagcgacagcgaaggcccgtggacccgtccgtccaggtttttggggaccaattctggtattttttggcactgtaggactaattttggattttcatccatgaaattaaaaactcggaaatttttgccaaaaaatttttgttttatggcgttttgcttttctatggccccttaggcgtcaaaaaacccaaaattgtcggatgaattaatgctcattctccaaattggctttagagtgcggaaaactttgtccaattgagaggcaatacgtcgtccgcagcaaatttgcagcccgcccaaccgcaacaacaacagcaaaaccatgtaaaacactatttgaaagaatgcgggaggaaaaaatggcatttttagcccaatttacgacggattttgcacaaaaaatttatcccttctttttcttttgcctttcattttcggcattttctcaattttttcatttttaatttaccatgattaaaaacgatgaaatcaactatcgaatatcatatttaactttggttttcatattattcttggtattttatatttgcaagtaaaaaatttgaccaattttcgaagaaattatggactcaaaacattttgggatactcagtttttctaaattttgttcaatttcttttaaattttgggcgctatttaaaaagagtaaccttttgaattctatcaaaaacaaaaggggggacccttttgttttgcaaaatttttttgagataaaaatccatgaaaatttgttatccgagggttttagaggtcgctgatcacgaatctgacatctaattcgaggtcttggacccaaagaaccccagggaataatttttcatgactaaatattaaaaaattttgcaaacaaaagggtcccccctttttttgtgtttgctttttgataatttcaaaaaggccctctttgcaagtagcgccgaaatttttactagggtcaaaaaaattttcctctggtcagattttcttaaaattttgcataggcccatattttgaccccctctatcgaatcacagtttattttttagctgtctagtttttaactcgagatcggctcttgtgtttttacaagggaaaatcccctaaaaaatttaagtatcgcaaagttttggcgttctgattacaaaataaataataaacttatttgcactgggagcccaaaattgaatttatagagtcggataaaacacttttccttaggttttcggagtcgctaatcacgaattcggcatttattttaaccatttctagccccgaattcgaattgaatcgctttgtgcaaaaaaaaaaaaattgaattagttgaaaattgagtttttgactttttgttcgaactcgggttcggagttcgaaatgggtcgaaatggatgccgtattcatgattagcgaccctgaaa

SEQ ID NO: 6357 - DNA, 2035 bp, Heterodera glycines
  misc_feature (2015)..(2015): n is a, c, g, or t
tttgctagcaaaatgaaaacatttaagagggctactggaaaaacaaaaaacctacaatttcaaactttctttgctcgtttttcggaacaaacagtgtgagtcgaggcctacgagtttcattttatgccctacaaatttctgttttatacctaatttaaaaatttagcatttccaccactcgcgctcttttcctcaactcgccgctgccgctgtgaacaatgggtcaacgcctccgccgccgccactcgcagcgccggtgccacagcgaccgcctcgccatttcttccaaaaatatgtctttaggggttatttgggccgctgatcacgaatacgtgatcagattttacttttaacatcgtcaagacctcagaatccctgtgtgattggggattctgaggcatcattttgaggggggggggcaggttcgaatccggacggtgtaacattatttttttgtgcatttttacgttattttcaatgattttaattaatttaaaatattttgtgttttattcgttaataatttataaatgttttacatttaaaatagttatatatatatttctttttaaattaaattagtaccaatttcttgaaaatttcaaacaaaatgacaaaaatcttctgattaagaattttttttttggatttttcgaatccggaattggtcgaaatagattcagaatgcgggggggagaaatttaatacatccaccaaaacaaaatagtaataaatcgaaatttttgccgaggtttcaaaaaaaaacttgcatcgcttcttccaaaaacatgtcattagtggttatttgggccgctgatcacgaatacgtgatcagatttcaattgttacatcgttaagccctcagaatccctgtgtgattggggattctgagtcatcttctggggggggcggcaggttcgaacccggccggtgtagattatttttctgtgcattttttgattacttttgcatgtttaatttcatttcaaattaaataaatataatattattaattttcattttaataaatataaatagttttgtttaatccataaaaaataaaaatttttaatttaaattaaattatttttttgtgaaaaatgttttaaattaaaataataatttatttacttttattaaagaactcctgtattttttaaattagaatttgtaatattaatttcttaatttcaatttaaataaatattcaatccctgtacatttcaaactctctttttaattaataaaaggaaatttatttaatttttaaaaatttattaattacattcaatttttaatcttactttttaataaacgatttccttaattatttaattttaaaaccatgattgtaccctttttaaccattattgtaccattccaacaatttttgtacctctccaacaattattgtaccttttcgacagtggttgtacctcttctaatcgctgttgtacctcttctaatcactgttgtaccacttctaaccactgttgtaccacttctaatcactgttgtacctcttctaatcactcttcaatcgctgttgaacctcttctaatcactcttctaatcgctgttgtacctcttctaatcactgttgtaccacttctaatcactgttgtacctcttctaatcactcttcaatcgctgttgtacctcttctaatcactgttgtaccacttctaatcactcttctaatcgcttttgtacctcttctaatcactgttgtaccacttctaatcactgttgaacctcttctaatcactcttctaatcgctgttgtacctcttctaatcactgttgtacctcttctaatcactcttctaatcgcttttgtacctaatcactgttgtaccacttctaatcactcttctaatcgctgttgtacctcttctaatcactgttgtaccacttctaatcactgttgaacctcttctaatcactcttctaatcgctgttgtacctcttctaatcactgttgtacctcttctaatcactcttctaatcgctgntgtacctcaaaatttaaaaa

SEQ ID NO: 6358 - DNA, 994 bp, Heterodera glycines
accaattaagtaggaaattcgcctaaggctattagtgaatgccattgtgaaaagaatgctaatgatttatatgcaacagcacaaattgagtattttttaaatattttcgggattaaattggaaacaatggcacccaatttttgcacaaaaagagaaatacttccttgtgaaacaaaaaagaaaggattaaaagatttaatgaaaataaatggcatttctgtttcgagaaaggagagaaagattaagctcgagagtgacgggaatttcgtcttttgagacggaaattgaaaaacgaaaaacgaagttatgaagaccacttgccgaggtgaaaacattcattaatttttgaaaataacaatgaatccaattaaaatatacaaaattgttgttagccatttaaaatggaatcaaaaaagcgtaaaatttaaatgaacgacagacaaaagaaaaaaaaaagagtgtaattgttacgaaaaagaacaattgattgagtgttttgttgccttcggcgctattaaaacaaactttatccctgggtgaaaaaagcattttgaatttggttgggatttaaattgttgcaacgatttgggtcgggatcgaatgtcgggaattgggaccggagaaagattaaaaactgaaagatattcccactaaaaagttgatgggccggtgcaacgtggaccggagtcctaaaaagtcgagattccgtgggtcggaaccaagatcaagcttactgaagagcgggtccgagtgtttgtggcgtacgataataccccatagcttttggagattatgggaacaaatcgttttttatgccatggggtaataatttcaactgcttttcctgttttaaatggtctgtaaatgggctttttgctttgtcatgattgatgacggacggacgcggaatggcggcacttttgcccggagagggggtactacaaacttccgacaatccaaggcgtagcgccaaacctggggttttcgggggggg

SEQ ID NO: 6359 - DNA, 2119 bp, Heterodera glycines
ttttaagtgtatgttgttgggcaggccatcgtcgggttgtgttatccccgtgtcccttcccatacggcggaggggagggaaaatgtgaaatttgagaagcaatcgccgcttctccccgaccccccccccccccgagggcaaatagcacttttcacaatgacttggccatttcccctgtccccatgtcccatcattcattcatttgatgagttatgtaactgaggggggggggggcagaaaaaagcagattttgacaaaatgtgacaggaaattgttaacttctttccccgggacatcatgatttatttgttgaaaattgccttagtgcggctaaatgcaatttttttgttaaaaaattattattttttttatttttgccataaatattgaatttcaaattgttaaaattgccttagggattaaaatgggcaaatgtcaaaaaattggatttttttagtttcactttataaataaataaatgatacaaagaaaaagattagatttctcacaatcagtgaaacaaataacactaagtttaaaaaaggaattgctattaaatttattttaatatttatgactgttgcggtatttttttaaattgttaccttaaagcttaaaatagaatttataaaaaaattaaatcgccccagggattcttaacatattaactttaaaatatgcattttacaattttaggtacaaaaatttcgaaaaaattttccaaaaggtcaaaaatgcgccatcgccgctcaagaagcatttgcagatcaaaaagggattattacaacccccgggggggggggcttaaaaatggggtcgtcgttcattcgttcaaaaaaatgcagtcataatttttggcgttccgccacaccactttttgtgatggattgataatcccagagcagcagaagcagacgggcccctaaatttcttcttttttgtgcccgcccttgcccatcactcattttgttgcccccggcttatgcccccgggggcgggggattatttagtggcctctgggcaaggacacacgccgctttaaaaagagagagagaggccaataatgccggtttgggtggcattggccagccgcggaagaagcgaggctaaaaatcgaaaattaggaaaagcttaagctaccgagaatgtgttaactcttcagttaaattagctgaaaataaattgtcccccaattcagtcccggggggggggggaaagatttgtttgcgcagacaaaaaatataaataacaacagccagaatttaaattgcgcaaagcttcaaatgtccaagactttttgaagtagcttcttaaaaaaataaagcttaagctgctaaaaatagaaaaaaatatatatttataaaaataaaatggagggaaaaaagttgcggcatttcgttgacaaacaaagggggtggagctcatcagttgtaggaaaagttagaacggggacccatttgtgtggttaggtccgtagtcagggggggggggatttctagaaaaatggagcaaattttttttgaaaattttaagcaattttcttaataacgaaaaattttcccggcgcggacccccactttaccatattttttgaaaatttgactccaaaatggccaaaattagggctacaaattcctgctttttcacctcgggtctaattttttggcccgaagagcaaaaaaaaaagtcttcggatttacctctccgaaattttggtggagaagaaatttgcccgaaaaaaagaagcaaaaatagaaaagcggtaacttcaaggtaccctatttaatttcaatccgatcgtttttatggggtttaaaatgggtcccgcgatgattctcgccaactcaatttcagtttaagcccctcggggaatgggatgggtcaaaaatgagtgtgtgccaccccggcaccccctctcaaatatgggggagattaatgggctgttgggcaatgactgacgacgatgagtggggcgtgttccgtttccgttgctcttcgtcgagagtctcgagagagagagagaaagccccgggggacgacttacgtataaaaaataggggggagggtaaaggaaattgagctatgagcagaagcatgatgagaagcggggagggggggg

SEQ ID NO: 6360 - DNA, 2139 bp, Heterodera glycines
aaaatttgtctctcggcggaaaaaaaaagctaatacatttttagcccgggaaattctcatttttaatgccattattcacactaggaatcactagtttgatttttcgccactaaaataatcatgccactatttttggcatttcgtcactgttttttccactattttggattatttgagaaattttttaaaaatgaaaaaaagcaccgaagaattgaataccgtaaaattcataaaatgtgtcttagaatgccgatgcaatccttaagaatttaacgatttgtttcgaaaaatccggcatgaaatgtgcacaattttgtcaattctctctactgaatactgaatgtactgatgtcgctcccaatttttcccatttttcaaatgcctttctcatttcttgctactttgagaaaaatttccaaacagaaatttacaaaaaaaaaaaattcttcggaaatttttagtaagaaaatttcaagtaaaatttttgtttttgaaaattttcaacgatttttggaaaattttttgaaaaaacttagtagttcacctgaaatttttgaagaaatagctaaatttcaaaaaaaacatttttcttgaaaatttcttactaaaatttcttaagaatttttgtaaatttttaatttttcgggggggggggggaatgacctgctcccgcacttttgcaacttgcatcagtgaatgatttgcatttcttttgacatttttcttaaaaaacaaggacttaaaaaatttcatcattataataatttttcgccatttgccactatgttggcatttttttttgcatagaaaaagaaaagaattaaattaatttttgaataaattaaattatttttttaatttagcaattattaatgaaatgaaaaaagcaaagaacaaatttttgtcagcgcgcgctccaaaagcagtgaaaaaaagaccaaattatgcaaatttatcaattctaattaagcagagagggagagggatatatcaatgttaattttgacgtcgtttgttcttctcagctgtaattgtttcatttagcaattagctattaattgaccccatcttcatatttatggcaaaaaggtttcgggtgcaaggaattttttttttaaatgataatggaaaaatgtggctttttaagagccaagtttttttttgtttgttttatttcaagactaagcagtgtttttcctaagaatatcatgttaggattggggttacacgggcccgggtgtttggacaaaaaccgggtcaggtctttaaaaagccgggtatcagggtctggactcggtcgagcacccggacacgtgtaactctagttaggacactgagaaaattatggctgggtccgcgacctgtctgacaatgagctctaataatggctcattcaaaatccgttaaaacgccaattaaaaagacccattatcgcttcgcccaatccgcgtcagagtctggcgccgatttggcaacaatcatacaaaaatgataacaaaatgataaaacattgtccaatgatgcacaaatttgtttgtgcggcaatttgtgccggatggaatttttgccgccggcgtccgcccgcctggcgccactgtgccattgacgtaaaataaatttttcgcgcaataatttgcaccagtcatctacaactggcagaaaatgtgctagttgcttatccgatgatacgatgaacatagaagggatggaggagggggagaggatgtcacttaagcgcccgtcggtacccattaagccgcgccaaagcgaaaatttttatatgtgccatagtttgaatggaactattttgcaaaataaatgatgaatggcatttggaaaaatttagggtggcgccgtctcagttcctttttaagctggcgaaaagttcactatgaacaacagaggaagtaaaaatgtcgggaaaggagggattaatgagcattggattaagcaatcggtgccaagttcttaaaaagtaacaaacaaaactttgatggcctggccaggcccagaacgctcggaaaaaggaagctgaaaatgccgggaaagggattaatgactctggattattcggcccggcctaccgctagcacttttatggcaaagccctgccttatcgaataaaattcagactgagtg

SEQ ID NO: 6361 - DNA, 1169 bp, Heterodera glycines
gggggggggggctaaatggattgcatttccaaaaatgtatattacctaatgtaatgaaaaagggacaaaaactcaattaaattgtgggaaaatggtgtatgactattgtctgatgcgagtgacgacatttgacatcaaccatcaagcagtaaagtagcaaattttttggaaaaagaggaggaagaaatttgatgaaaaaatttatggcactgctaatttgggcaccccacataattacattgcgacataaaaagaaaccgcccgcacagaagagtcaatggcaactcgtacaatgaatttttttacaaaataaagcctaagcctatgcccaagcaagcctaggcctaaagcttaggcttaacctagtaacctaggcctatgtacgagttgccttttgtacaagttgtcatgacaccgcacagaaatggcatttttatggacagtttggcggcgacgcacatttttgagtgccaataaatatcttttttagacaattaggcatattttgttaaattggatgcctttttatcctaagaaaacctaatgaaagtttgctgccgcctgtccatccgtttgctaaacaaaattggcacattgtgtgccatcaactgtaatttctacaaagttttagcggcatcagcaaaagggtgagaagccaagtaggggaagacaaatggggaaatgtgtcaaattaaaaagagcaaaatgccatcaattaattcagatgtgccgtgccaacaacggcacacgtcttccctgcctcaaggggctgaaatacaattttcacaaaagtgaaagggcaaaagtgcaaatgtgtaaaagaagtgactaaatttggcatttcacttctcacaacaaaatgagatgaagcctgtcaaaaaagggctaacacgtgttttaattaaatgattattagccatcaaaatacaggcacaattaattatttcccctaaggcagaaatattacgaaaaacaaaaattctgtgccacccgcgaagcccatatgttcacgggattattaaatcgcacaatgtacgaggaaagcttggtttttcagttactaatataaaccatttctcaaatatcccaaattttaaaagggattaattaatgaaaattcaatgcagaaaatcagtcgagattaaggaattcagccgtacggtgtagga

SEQ ID NO: 6362 - DNA, 1708 bp, Heterodera glycines
  misc_feature (1626)..(1626): n is a, c, g, or t
tatgccagacattagtgtggtttatgtcagtcaaccacattagtgtgttctgtgactttgtgtgacacaataatgcgtgtcaatttttttgataaaacaatagtgtcacacagaagtgaaattagtcaaagttttttaaaatgtattgttatgtgatgacactattgtgcctttcatccataagacacaaaagtgaaatttgtcaaagctttttaaattgtattgctttgagatgacactattgtgcatctcatgttttagagataacgcatgagttgaatatgtcaaaagaatcgtttgtattgtattgttatgagatgacactattgtgcctctccgcgaagcggccgagccctccccaacggttcaacatccaaaggcacacaaaaagaaaaatactgaataaatttgctgaagttgaatcccagtgattggaatgccgtaaggttgagtcttgagtcccggtcattggaatgtcatataattgagtcccagtgattgggatgcctggggttgagtccaggtgatggaaatgcagaagaattggttagataagtccaagtaaatggaatgccggagaattgagttacggcgataataccagagaattgggtctgtaatggtaatgaattaagtgtccctgtgatgcagaattgttgaaataagtcccagtgattggaatgccgagcgtgtttaacaaatgacaagaaacaaaaagatcagtaaaatgttaaaattttgtgccaaagaaattgccaagagacgggtgcgaggccgcgaagcggccaagccataatagtcatttttatcattcataatacaacacaatcgtactgcctagcgggggatgcgccgaaggcgctaccccgctagttgagacaaaaattcaaatctttttggaacttggaggcaaaaactgaaacggtgtgtaaattaagtaattagaaaataatttgaatctttaaattcttaaaaataaataattagaactaatttgaatctgaatttaaaaacaaataaaaattcagtccgccgagagtgccacatcatattcaatgattgaggacattggcattgccactgtcacattgggaccatgggacaaagacattttggaaatgtttttgcaagagcatttttttaacaaattaattttcgacacgcaaaaaggcaagtttcactgttgtagaatggattatttgttcttattaatttaatttaataatatgggcaaacaaaaaaaaatgaataaatttataaaaaatgggcaaaaagtttttaaaaataaataaaaaataaaaatgcgaaaatgacattagcatcagcgagaaaaaacaggatacaggttaatttatataattttcttttatttttgctcacagtcaaataaatttgtgtgtcgataaggccccaaaaatttaaaaaagttatttctttccaaaaattgaaaattacctataaaaattaaaaaatataaagatagttagcccagttaaattttctattaatccgcccagaaaaaataaaatagttggcctacataaaaaaattgatttttgccagctcaaaaataataaattttgtgccccacctaaaaaaatataaaatattagttcatcctcctanagaaataaaaatttatggcaaattaagaatttatttcccacacatgctttaggcgtgccttactgggaaatgacgatgaaat

SEQ ID NO: 6363 - DNA, 2928 bp, Heterodera glycines
  misc_feature (1092)..(1092): n is a, c, g, or t
  misc_feature (2860)..(2860): n is a, c, g, or t
ctcacacccgatacagaaaaattgtgtatgcgattaaacgcttcacaaaaaaattagaaaaatatttttaaaaggcaatttaaaaaaagctaatcgaaaccgttaagtgagtgtttaaatagaaatttaaaaaaagaataaaaataaagctttcaaatttaattttacagagtcaaaggaaaaatttaaccattttctttttagcatttgataattaatttaattgtttttttgatttcctatgatatgatgtgtataatatttcataaaattgccctctacggtaaggggtaaagaatatttctttctctacttttttcggctcagcatgaggcaggaattttcattataaataggtatatatctaaaaaattatagccaattaaaaaagaataaagataaatgactagatgaaattttaaaaatttacgagaaaaatcaatattggaaattaattttcactcatgttccctatccaatgatagatttatcgattaattttcaactagtctaatactcgcattgattactataactatttgatttagcttataaaaaagatgaagcaaaggaagatataatatatgattataaatggttaaaataaaatccgcgcgggtatggcggtgcgcgctgacatcctcttttatgaattgctccctttaatcgaagacaaaagaaattgattggaaaattaaatgacaaaaataaatttaaagacccgaaaattaatgcaaaattaagtattataaatatattcgaaaattttagaaatttagaagaaaaaaatttaaacattgcaaaaaaatcaatattattttagaaattacattatccattcttgtgtattccatttaaatatgaaaaatggataaaaaagatgaagcaaaggaagatataattaatattgtaataagtagggctgaggatctttaagcgcgaaaaagtccaaaacaaggccttaaataagtgcgaaaatatcgcgaaataagtgcgaaaatatgcatgaaaacattccaaatttaggggaattttttaaattgctttttttatatgaaaataatttcaaattaaggctaaaaattttatccnttattgcaggtactaatagggtacatttcagattttcgggattaaatggtcgattcttcggaccggctcagttcggccccagcatgtttttgcattataacttttttctttgtcaaccaaattcaacattcttggtatcattcgaaagctctttacatactctattagccttacaaaaagcaaaaattttcaaacctggaaaaaatttatgaagaaaaaaatttcaaaaaaaaaattgattttttcagttttcatgttataacttttttgaaatttgtctgtttgccaagcaatagcttagaaaagcttctaaacacattaagctttgaatgatatcaagattgttggatttggttgacaaagaaaaaagttatagtcaaaaaatttgctggggccgaactgtttgcaatgtaattcagccaaccttgggtatttttggcaaaaacaattgttgcaactttattttaaaccaacaaatataaataattttacttagtttttcaaaagttctagccaaaaaacgggaaaaattgtcataacttttgaaaaacaataaaattttttgaaatttagcaggctgataaagcaattcaagggctatcatatgatatcaagattgtacaatatcggttgcgtctaagaaaatttatgagcagatttagtcaaaatttagcaaatttgcacttttttccttcgacccaccacgatgcgactctctcaaactaataaagagagctttctttcccctaaagatgtgattgaaagaactgcaagtgggttccctgtgtagctcagtggttatagcatccccgatgggttcgaatcccaccgcaggctgtctcatgtttccaaaaacatttgaaatataattctgtttttggacaaccttaattaaatgtttattcaataaattttggcttcaccaattgaggcaattgtttcgataccttcggattatatataaatataatgtatttatatattattgtataaattcaatcttataggggccgttcatggaaatatggatataaatcgcgaaatatggaaaaatatggaaaatatggatatagaaacccatcctaggagcttcaaaccaagctaaaaacatgtttttcgtgcgtttcaggcctcccaaagtccaggaaaaaaaatatggatttccatataatttcatgccatagtcatcatattcttcttccaaatgtcttttgacccaatccaattaataaaatgtgcatattttgaagtacagtatagtaagtacaatcatattatttggtaaatattacagaaggaaatgcttaaggagtttttggaatttcgaaaaaaaagattttttttgaaaaaagtgataaaatttaaaaaaatggaaattttggttttttacacataaaaaaattatttttatctacaaaataacgcaacatcgacaaattccgcgacgcgcgggcggaggcggtggcggtggtgtggcgggcgcaaaatatgcatgaactccatgctttgcagaaaaattttatagaaagcgtcgctggtatgcggccccaactgaaagtgttgtttgaaatgttataaattctgactttctgatgtaattctcgaccaatttacaacaaaagccttacctacctactgtaacaaaattaaattaaaagtcaaatataatagtctagctttctgaaaatgataaataaaacaggtcaaatcctcagaatattaagcaagacccagcgagggtcttgcgccattcgttgaagaatatatnaatatttttcatgccttgatgcttttattattctcaatttattagtgcaaagttttcatgcgattttt

SEQ ID NO: 6364 - DNA, 2668 bp, Heterodera glycines
ttggtataattcttatggtaatttgaatctaaaattattgaatgagcaaaaattgaattataatttaaaattggaaattgaacaaaaaatgtcaattaatgaaacaattttgcaattggcaattgacacagcgaatgaatatccgaaaaaggaaactttagacggaataattcgacataaatttgaaaagaaattgaaggatttgtttaaaaaggcagaagaaaaggcaaaaaaagataatccacggagagccaatgagataaatgatgacataaataaaatacttttgggttcaaaattcaatgactcatatacatgggtaagcaaaaattatattattatttttaattaaaattaaatttagttatctgacgccttactttcggtctttgtgaaaggaaatgtgacgaagtttaacaaattccttaagcgactaaaacactaccaagcggcagcattttaccaagatgaaagtgatctttgcattgggtatgagaattggcaatgtgacaaaatcggggagaaatttgaaggatatgaacagacagaaacccaaaaatataataaatatttggacataatattcgaatatttattcagacttaatgtccaaggtttgacaaaattattagggtttgaaattttattttaagaaaaagagtaaaatatgtacacaataaatttgtaaaagaaacaacaacagaattctcgaaatatagaagaaacatgtattcaaaaaggcctaatttgcatattttatgctatttattttttaaaaagatagcaattatttaagattatataaaaaaaaatttgttgaatttctcaaaaaccataaaatatattagaaaaatggaaacatatacgaatcgtttagaaaccagtcaaaaagtccctaattattagaaatttttgattttgaataataaagatttgctttttgaaggtaaaaacgctgaattggcatatcatttgccagcagtgaagccaatatttatgacagatgatggaaacgtttctttaattcaatttatccgaagccttaatgagaagttgaagtataaaagtgtagacaaattggatttggattatcaccctcgggtgaatatttatttgttaaatgaattggatttgaattatgcaattaaagaggatgaaaaaaagaaagaaaagccattaaaaaatgcattggacacaaaaattgccaaaatccgtgaagaatttgaaggaaaaatgaaaaatctttgtgataatgtcaaggaaagaacatcagaagaaagggaaaaatttgtagaagcattctattttggcactttcgattcgtcgccattttcataaaaattctctttttcattcaatgtttttcttatactttcctattcttttcccactctttatgcttctgtcttttttcttttttcaactattttatgtgggctaatttttgagtaagtaaaattttcattgctaacaaaagtagtgagtgatttgtcgaaaattataaaaagccacatggacaacaatttagttgaattccaaatccaaaaaaaagatagaacatctttgccccgttgtaaaagctcgcgtaatttcttcagttcatcccagttatttcccttcaaaaacattggcactagcatctcccgggccatttggtcccttctacaaacgcaaattgattttctcggatcggcagacttttcaagtgcttcgatttgcaaataagtgatcgattgatgatacagaatgtctctcgcagagacaataatcaaaatcgaaaaatgcttttcaaaattccacaaagtgctgacaattaacggttttaatgcgtttttgaatggatttttttcacattggaagtgttgaaatttccatcttttcccctcttctcgctcacgaaaattttccgtttttgttaaactctgagaaatttcctatcgctttttttctttttgtctccaacgactttgttccataaaatgaattaactgatcaggaagaatgaaagatttcgataataataatgagaagaaatgaaataaaatttaaattgaaaaatcattaaatgtatatttgtttaaaaaaatatttcctccgtctcttctgttttggcccttcaattctttcggcattttatgtcatctcggcactttctttcgcactgctgatcagagttagtcggtcgcggacgccgacagactggggccatcatctaaaaccgatacatagcaattcaaacggttctggcgttttgacgacatttagtggaggttccgtcttttgtatgagtcaagatccggcagatttggtgaattttagtgcaatctttgagcagatttggctgcaaatactgtcacacaaataatgcagtccatcgagcagcatgtatttgtgacatgtttctttaaattctgtgcatgttttggattatttggaaaattttcttcaaaaccaatttaaaaaaatttggttaaaatgttgcaaaaaatttgtgataaaaagctttatgaaaattttaatattttagattcttgctatgaacttttttatttcaaatatcttgggtaaagaattttgtgctctttccaatgggcaataattttttcgtaaaagatttccctacccccaaggaatttttttcaaaaatattcctaaattttttgactct

SEQ ID NO: 6365 - DNA, 990 bp, Heterodera glycines
atgaaaaatgggggacgaattttaaaaatgctaaattttttatcattttacatttacttatgctttttccaatttttcctcttcttcttaggcattttcttttgcattttcggcaatttcacccattttttgctcaaattgttcccaaatactttgaatgtccgttggtccgttcaattgtttatttttatcgaaccaatttttctcctctttaatttcgtaattcaattcctcttcatttaccaaattgatactccaaatatagactttttcctctttttcccaaaaatattttgaaattgcattcagccatctcacaatatcgattaaacaataaggactactatttccatacataaatattggcttcaccaatggtgacaattgtttcgacaccttcggatctttagcttaataaattattattattattattaccattttaataaatccaaacaaaccttcagcatacaatcggaataaatattcgtacaaaatgtccaaatattttcgatatttttggcattcttcttcaaattccttcccaattttatcacaatgccaattctctttcatctgatacataatgccaagatgggctttatatttttgtgtcaaatgcattttcattttctcaatttcgtataacccaaaagatatcattgtgttttcatcagagaaaatataatatcctttctctttctttagacgtaaataattcgaatattcttttgccattttaaaaaatttctttgaatttgtcgttaatcctttgacaaattccgaaaagaaagcatcttcagtctaaattttgaatttattaaattttcattgaatgttaattctcacccatgtcaattgatcatcgaatttcgatcccacaattatcctatgcttgtcatcatttattttggcactccaataaccgtattcttttgccctttcttccgcttttttgtacatttcctccaatttattgtcaaaattttg

SEQ ID NO: 6366 - DNA, 4220 bp, Heterodera glycines
atgcgcgcacggttgaagagctgtcgccgtccacaaaattgttggcgctgttgctgctgctgctgccgctattgttgctgctgctctcgtgcagcctcttccgaccccgggaggggatgcggttttcgcccgccgttgttgccaccaccaccattgttactgttgttgtccatatttgttgtcgacacactttttgctgttgatgaacaaattgcgttgaagtgaactgcttaaaatgtgaggaaataaataattgaacatttattaataaagtgcacaaaaattgaaggaaaatgaatgaatgatcagagggggtgaaagatggaacagaacggggttgagggggcgggggtgtctaagaatttcttatccgtttcctaatctactccttccatccacgacctttattcgaattcatgcctgccatccgttttctcatctagtctatagaatcttttgtagtcccaaacactggggctaaaatttgtagacaaaaaaaaattcttgaatatactcaaaaaggatgcgtttcgtgttttctcgttgtcgtttttttcttaatgtcactatttgctattttcttgtcttaatgattctagggacttttagcttttgtttgatacaaaggttctgcattctttgtatcaatttaaagcttaaagcatcagtctcggtgaaatgaatgcccagttacatatcttacatatctccaacacaaaatcttatgtacaataatttttcctgattttttttcacaaagtaaattaaatttgaatttacgcattgcttaattatttattggcattgtattttcttcaaatattttttgtagagaccgtaatattcaatcagccggacggtgccaggaaatttcgacagtggctgatttcgacagtggctgatttcgacagtgaccgatttcgacagtgaactattttcatttattttactgttttccgacatttccgacagtggctgattacgacagtgaccgatttcgacaatgaacaaaattatatttgtgtattagtcatttttatttaaaaaagtcactatttaatgggtgaaatttatatatgatgtagtaaaataaagcatttttcttttattttcaatgaggtaaaactcagttgtactgtactttggccgtaggccgttgatagtggaagggccggtcgttcactttatattgggaggtcaattttcttggaggtcaatttgataagagaattttgagaggaattgttttggtgttcccgaatgctgatggtcattctcgacttgtcattgctggtgttcatcatttgctgttccctctattcgtttttttccgaattcattgaccaatggctctactccgattcgcagagaccaaaacaaatcgtgggaaaattcttctatctcgtagcggatatgactacactttcgaggttaaaaggctaatttaatttcgtgaaaatgttaaacgaaaaattctaaggctgtttcgaaaactgaagacggaatggagtattggtgttgcccaaaccgtccaccttattgcccagggcgtgcttgtgtacaaggccgttgggaagtcgatgccgatgggtcgcgatataaaattggacgcactaccggacagcataaccatccacccgttttggggggtcatatggtagaaatttaaaatgtaacgggtgttaagtagctaattaggtgagacaagcatctgaacgtctccgacaagaggcgcaaagcgaattcccgaccacaagccgtaacatcatcagagaagttcggtcgaaccttagtgatgagattcgggcaatcagtgcaccctctgcagctgatatgaggcgaacatataattatcagaaacggaatcatcaggaagaggcaaatgataattagataattaaaaatataaatttaataagcaaaaataattttaaaaataaatggttaggtcggcgatgttggattggatatcttacccgcatctcaaatcatcataccggacagattgcgtgatcgtacgatttatgatcaaactgttaatggagaaaaaatgatcattttttgttcttgttttggccttgatcttttggcgaattatcagaatgaagtggcaatcgatggcacttttgaggtgaataactaaagggcacttttagctgatagtggcgagaggcatataaaatgtgccgctaccaatataccacaaaataagtaaaattgtttttatcttagacatgcccaaggggatttactcaagtctacacactggcagttgtcatcgatcattgtgcagttccggcagtttatggtttactgcccagcaaaactctcgccacatacacaagattcttcgaaacaattcgtcagtctgttggcaataattggttcccgtaccgtattatgagcgatttcgaatcgggagcgatcactgcagctggcaacgtctttccaaattccataagaaccggatgcttgtttcactttggacaagcaatttggcgaagaattcagcgattgccaaatttgctcacgcgatatcgtgacgatgaagttgtcagaacatccttgcggtctctacaagcgctggcttttgtccccgtcgactttgtctacaactatttttgcattgccatgtcaattcttgagccgactcctgagcttcaagagctgatcatctatttcattaacacgtggatcgggcctcgccgaatcatgcaaaatgaagaagttttggttcacgatgcaggcggagtagctgataattggattcgagggagaattgaggcgcttaatttggcacagactgacgctctttttccaattgaattgtggaatgtggtggacagagtagcagaagggcttggaagaacaaacaattcgcttgaagtgtggtgggatgtgaccattttttcatgtcttttcttcagggttggcattcaacttggaatgtgcaccttagggggaaccaacgaccgagttcatttgctcggaaaatgatcgaggaagatgaactgtggagaattcgggttgcagattatcagattgcaccggctgacggcattaaagggcctcatgaaacgagaaaggccaaatacattcgtcaagaccaaaacttggaagcacttgtgcaggattttttcaatcgtgatccgatccaatttcttcgcgcttgcgcttatcatctgcacttttaaacatttataggattttagcattgtcgttttacacaattttgtcgttattttcgatatcaatttgaagttttcaaatgttagaattggcaaagttaaaattttgttcattgtcgaaatcggtcactgtcgtaatcagccactgtcggaaatgtcggaaaacagtaaaataaatgaaaatagttcactgtcgaaatcggtcactgtcgaaatcagccactgtcgaaatccactgtcgaaatcggtcactgtcgaaatcagccactgtcgaaatgttacagcaccgcatatctttcctcgtatttctgggatttttttcagaatgtggtcatagaataggtgggttgaattatttgtattttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccattttttattttatttgtgaccgcaaatttttacatactagccattttttattttgttgtgaccaagcatatctttcctcgtatttctgggatttttttcagaatgtggtcatagaatagatgggttgaattatttgtatttttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagcggaatatcctgtcaatatttccctattagaaacgatactgtgaattctttcgcctctttaattcattcgtgctttgcttcggattagtctaaaaatttctggacg

SEQ ID NO: 6367 - DNA, 1507 bp, Heterodera glycines
acatttacattattaaaaaaaatttttttcttttggcctgttcattggctttatccgatggaatttttagaccctgatttacgcttttaaattaataaattaggaacaacaatttaaatcccatgaacacacctctaaaatcgtattttactttaaaagaataattttctaaaattctttttgttatatatttataaaattgcattatttattatttggcttataaaaatttaaataaatgaataaattacaaaattagtgcgagttttttccttgtcttcagagatgacatcatctcttattgaattttatgcccatattcataaaacatatatattttgctatgcatttttaagccctcgtcactaattaattccttttttcgtcatgaattcattacctttttatttttatttatttaagattattaattgtcattttaatgctaccactcattacacaacatcaaaaacaaattccattgtcttcgatcagtcgcggcacaactgtacagtttggcaatggaaaaagtaatcaaagaaccggacaatgctcaaagtgaacattttatgaaacaataatattaatcaaattaaaaaaacattccgtatcattttttaaatgttaaaatttttcccttttccaaaagaatttttgccttttggctattttcagttttttatgcattttttccattttggtgccctttcatctttttttaattttagtaccttttaggcgattttttgccaccaaatactattctagatgaggtcaaaaaaagacccaaggaagcggagtttatggaatgttcgacatttaacagtgggagaaaatgtccatattacggttttttaagcgaattgcttaccaccagcaactgctgctgttgtaagccatcgctgcagcgaagaagcggatgagcacgtgaaaaggccgatgaagtaacaaaatttataatttttgttgggtttttcttgaattttacaataaaataattgattttttatttcacctgaattaatcattgaaaagtgtgcccatttgtcagtgcctttatggtgtggtcgcgcgggaagcgaaagcgaatggcggcggacaatccgaaaatgcacaattcgaccatctccaaacagttgggccacgagtggaagctgttggacgaagctgacaagcgtccgttcattgacgaggcgaagcgcctgcgacaactgcatatgtgaggaatttgcattttttatttatatattttttcaataatttaaaatttaatttggaaaattatcaatgacatgaatatgattggaattgctttcatccaaaatgtgggcaagaatttctttgtctaaataaagtccgacgagaaattctctgattttttggctcttgagtctcgagcttaattctcgcgttgcaaaatgttcgcctctcaagtaccattgcatagaatctgttgcgagaaaagggatcggttccgttcggccttttctatcttaatggctttttt

SEQ ID NO: 6368 - DNA, 5242 bp, Heterodera glycines
  misc_feature (5218)..(5218): n is a, c, g, or t
cctcagctgcgggtaaatcaatgagtatcgggtaaaattcatttagtacgggttaacctgcagctgcgggtaggtttatcgggtaaagttacctcgttcttttggtacgggcccagaagtttttcctgctttttcggtaaatatttgtgcattttctgtaaaataaataattcaggtgcatcgtcccccccgaaaatttttttaaaagtttccaaatagtaatttttcaaaaaaattttcttataatctatgttcggttagaaatttttttttatttttcggggtggggggacgacctgcttcaaagataattctgtccctaattaatatttggttttccatattattaaagagcaacttaaaatagctgtttgattcagacaacagtatcccaactacaaataccggccaaaacggaaatacaaagcgcagtactgtagcagctacacatcggcgggaataaagcaaaagcaacaacaacagcattgttttggaggtgttcagcagcaacaaatgaattatgcagtaacatcaacaaattgtgacgacatttcaaaacagcggcagcagcaacgacaaattggcacggcaattggcgttggcatcggtgggggagacagcggaccaacaaacggtaacacagttggagaatactgtagtgaaaattgaaaaaatcagagaacatttgaagcgaagaatggggagggggctttaaaggagggaaaagaaagtgttttatccgctaaattaaaatttccatattttctcaatagtataaattgcccttatttcctcctaactcaaatttgctatgattctttattttcccattttaattaagccgaattgttgcactttccgccgtttgcatcggatgcgcaaaatttcatcgcactaatggcctcatcactgactccaaacccactaattacggtatattaaataacttagcccaaatatctgagtcaaaagatatttcttgttgaaagggcgtacttgaaaactagaaaatcacataaccctaaacaatgggagcctatttcaaagggtttaaggacataactttaaagaattcacgcggaagcttctgttctggtaagttgttgttccaactatgtccttgaaaataagacccaccccaattttctgggaattaaagtacatgttttcaagtacttatagcacccatgcagggctgcacgaaatttcgtgtcgttttcgtttcatcctacattttcggcactttttgagttcgttttcgattttaaaaattccatttttcgtctcgtgtttcgttttcgagttttaaaatttaaaattttcgtttcgttttcgtcagacggaattttgacgaaaaagacgaaaatatttacacccttaagaatgacttttttagtaaaaaaaataagtgatttcattgaactgttgtagtttagtcgtgcacacttcagatttttgttgtttttttatatgggttcgtcccatatgcccgcactctcgagctatcaaatttttttatatctggaatttttgtaattttttttgtcagcttgccccaacccattttgagtgtcatggaattgtaaaattgtttaattaatgaaaagcacaaacataatttaaaggaatcaacagttttaatggcacaaaagcagcaacaacaggcgcaaattggccaccaatttgatgagggcgcactgctcgaaaaggtgcaacgaatgatcagagaggaattgcgacgatttgatgccgaccgtactggcattgttgactatgcactcgaaagttcaggttcgacatattactggcaaagagggcatattgtgtaagagaaatctgttttttgttaaaaaaggggaaaaaatttaaattccaaattttgaaaattcaccgcgtcaaacttattggcgtttcacaaccaaaaaccacaatcagtagcaattttcttcaaaaaaaaaaattgtttttaataatagaaaaattgatagataaatcgaattagaggaaaacaataacatacctattcaggtggatcagttctctccacgcgttgcactgtccaatacaatgaacggtcgcgtgtccaaaaattgtttggcttcccactgtggtacaccggttattcgccaagaactgttatacaggtgcgctatttgcacaaatctcaaataaaaacttttcaatttattaaattgaaaaatttctcacaatatgccgagtttgagatgctatagcttctttcattgctgaccaaactcaatttagtggtcccttttttagatacgtccaaaaatcggtttaaaattaaatcccaaaattccattattttatattgaatcatcgagaaaatatataaataaatacccgacataggaaaaatatataaataaattaaataccaattaccgcttaagcgaaagggctatggcgcatcaactggcgaatgctgggcattctacggaggccatggctatttgaccattgggctgtcgcaagtaaaaaattttttttttttttgattcgtcccataaatttttgtaactttattagcgcatcaatgtgaccgcagtgtcttatgaacatttgccggttgaaatgtcgccggacaagcaaattcggagcgcaccgcgcaatttcctcgtttgggttagttgtttttttagtgtcgggattagatgatgttatttttaatttcccatctgactttcacccattataaataataaaaatgctaaaaaattacgaaatcgtaaataatttttaggtgttatttcccaatttcattaaaaaatacaaaattgaaaccataaaaaaattctttaaaggataaaaaaacaaaaaatttagggcaattatgaccctagtaattagagttaaaatttagagttaccaggacttggatgagctggacacccgacttttgcttggcaattttacttatgacgctgagaggggcgaaccattgcaaatgttcccagttcaggtaatttaatcaatgacttcgaatacaataattacaattaaaaaatgaatgcacaaattaagttacgcatcagatttttgacacagatttcaataaattttactttaatgtcagcaatgggacccacatggtacacaaattgttgagctggaaacgctggcaaattggggctcgcaagtcacatgtttgtaccggttcagagtgcacggagacaaaatgagggtgagtctggctgttaatttctttcccaagtcattaaaaatcatttttacgaaataacttctatggtaaaagctttataaaaatctaaataaccctaaaaatattttataatataaataaccctaaaaattatatgttttttccaacaaaaaatttttttttttaatttatgattatttatacaaacctaaaggaaattccggaagtggcatcggcagatgatttggcggcatttgactccgctaaacgatggcccgactcatcaaaacacaaagaaattggtggcggatgaacggactgacggacggacacaacgtcttcccgtggaagaagaactcaacataacaaaactcattatcagttttattaaaggatttttctttattttatttttccccaatttgtttatttaccatttaattactctatcccatttattattgttaaccaatttgacttctgttaagtcgcaattcactggttttctttgttatcattcatacatattaacctaaacacttatttaatcactgtagcaattaaaactttgttttgtttggagaacaaattttcctttccagcaatttggattactaaacaccacactgagtatagtctgtttttcccaagataattcgttttggttttttccctcatttcttggtgcaaagtttcgttgttttgatgacgctttctgcccctgctttttttgttttagctgctgcgcagcttaagtagtgattatatttatttatttgttctattttgagtttgcttttgcatgaccataactcaacaaaagggaaaaatggtggaggttcaaatccgcctcacgccaacatttttggatcaaaaaatttaaaaaatgacgcttattgaactttttgctagtagatgacatgaatttcggttttaataaaaaaaataataatatgccaaaatgagaggtgtatttttctctgcactctcttctttacgaaatacatttattattaatcatgataaaatgttattacccataattctctaatcaatttaaatggttgagtcattattagtcatttgattaatttttctatcttttgcaaatttacattttttctaacttgttaaatcattttaaaaagaaaaacccgacagaaatgttgccccacggctgtttcccattccgtgcctgtctcgactgtatccaagggccaagtctgacggccacacaaagttatgcgcagctgagagaagaaatgcgcactgtgcgacttgatcgcaaccacatgggtgtgttgtgcaagggaccgggaattttaggcaaaatcggtaccagaaaagccgggatcggtgcatgaattttcaatcgggaatttttccgtaaaaagaggggtgggtaccaggggtgtgacttgtctcagaaaagacgagagcgagagtttggcgagaggcgagagtccccaaaaagacgagagcgagagtttggcgagaggcgagagtccccaaaaacacgagagttggcgagaggacgagaggcgagagtttttcaattttttctgtagccttatttttaatttaaaaaacttcaaaatcgtatattaaattaggggtacgggcttgggtatttgggcaaataccgggtcagggtattgccgggtacagaaagccgggtcagagtcctagtttttaaaccgagtccaagtcatgaaaaatccaaacaaaaatctttaaaattttttcatgaaaattaaaaaatattttcatgaaatatatttattttagaaacaaactttattatttgtattttttccaccttttttttgcggtgcgtttttaaaacttcgggacagttggggggtccggggcgtggccggtaggcgccgccgaaaaaattttgaaaatgtcttcggatttgttaacagattttattcaaaaaatgaccaaaacttttttttaaaatttttttgtttttaagtcgctttttttttgtggcgctgttttttccaaaaaatttttttggaacatggngggggggggggggccccggcgggg

SEQ ID NO: 6369 - DNA, 2147 bp, Heterodera glycines
atccccttaaaaaggcgaataattaaagaaaatttcccattttcatggcgtcgcatttgaccatgttgagctgcacttctacaagggtggcgtgccgatttggactggtccgatcaaagcgtccgctgttggacttgttttctacccgtgtttgtgcattgatgagaattgtgttttggatatctgcttcagtgcggctaaatttagcccaaaagcgccattgggctatcaggagataatgtctgaacagacattgctttaatttttttggggcaaggacgatcccgggggcgggggaaaattcttaagaaaaaaaagcaaaaaatgatgaaagattttttttcctacgtttacctctccccaagccccaaaaactaaaccctagaaccatctctgtctgtggacaaaataaccagacaagttgccacaccgcctagcttaaaatgagaattaaagggaatttgtgggttaagttcgtttaaaaaatgccaaacttcatgcaaattgatttttttttaactcctttcattttttcaaaatggatttatatatattttataacaaaatagcataaggcttcttaaaaatttcagtatttttaatcaaataaatacaaattttacaaaaatccgcctgctttcaaaacagtgcgggttttgagtaaattccctatgctattaatgtattttgcttttttcaatcttttcatcatgaataccctacaccgttcgttattaaatgcataaaaattgtagaaatgtgaattaaatgctttttatttacacaaaatataatcaaattcacactaattttaaaataattaaaaataaaatcccgtattctcaaaagtacacaaaatcatcaatagaaaattagctaaggaattctttcatctcttcgtcaatgggttcattttttgagtttttaacatcgctttttgattcttttttgaaatccatttcagtccaaggtcgaggctcaactcgtaatgtcaaattgaacacagttgctccgacaacaagagacactgcggaatatttaaagattgaagaccactgaaatttaaaaaaagcatttaaatttatttgatttaattagtttcctttaaatttatttgatttaattagtttcctttaaatttatttgatttaataaacttcctttaaatttgtttgatttaattagtttcctatgttccacctcgatttgggaaatggattttgaaattgtgaagaaatttgtataaaaaaattaatccaaaaatagcctttttttgtaacaaaaaaaaagtttgtctatagatagaaccaaaacttttaaaatttcccaggcagcgctttcgtcacggatgaaaaaaaaaatgctaaaaaaacaatctaaatttgaccaaaattggtgccattttgtaacaaaaaaaattcgatagattgggataaaactttcaaattctcaggtttgcgcttatcatcacggcacaaacccatttttttaaactatttttttattagaaaaaacgctacttcatctacagtgttgtttggcgctgcccaactgataccaaacgggatgattctaaaaaacattaaaattaaattagacattgataaaacataaaaaaaaacatacaggaatatggtacttgtcaaaaaatattgtaaagaaaaaatcacatgggcaaattggcacgcgacctgatgaaaaaaacaaataattaaattctgagttaaaaaaatgaaaattagaattttatttgatattaattatgaaagcctaacaatttgagtgcattttgcagctccgatcagactaagtacgagactagcagtaatgccaacaaagcaaagctccatccatttcaaatttgtgatgccaaactttggcaacacagcaattattaagtagcaaagagcagccaaatacttaaagcaagcaaataaaaaagacaaatgaaagttcataaattataataaaaaaatattttcaagatattagttaataaaattattaaaaaatgttttgagattaatttaattaatgaaaaatttaattaataaaattgttaaaaatatttttgaatattacttgattaataaaaatttaaaaaatatatttttgaaggataatttaattataaaatttttttttat

SEQ ID NO: 6370 - DNA, 3226 bp, Heterodera glycines
ttcgaaacaatttacacaactcacagtgccaaaacgcgttgttcgtcctcctcccccgcctcctttcgctctgctttttcttcgtcgtcctccgtcgcttcggcaacaccaccctttttggcgacattgctgctgtccaacagctggacgaactgcttgaacttctttggctccaacagtgtggctgcctgcacaatgttgctgctgtgctgcttggcaaccagccgagcggaggagcgaagtcggccaaaaacgaagcggacgggcagcaaagtttccagggaagaagccacctaaaaaggggaaaatagcatttaaactgttaaaaaggaaatgaaggtgacaaagaagttaaatttggaactgttcactactatttatagcatgaaattacgtttattgggctgtttaaaacaaattaaccattccaaatcaattgaactttgtgcgaacattttttatgtcttttcgttgtttttatgctgtttttttaatttcaaatcagggccccaaaacattaaagtttactctatatagatgatattttaaacttattataggggtaatcgaaaaagttttggcgtgagcggaaaaagtcggttccgattgtatggacttcccccttttatggtggacttgataaactgtacaattagacaaatagataggtggtatatgcaatgtccaaccccatttcttaccatgttgtacaccgcgtctttgtcctttttgacgttttcttcccccgtcgccttttcactgccctcctttctcgcctgtatcattttgaccgcttcttccagtcgctccgctgactctcgcgccaatttcatgtgatttttcttttctaaaattcaaaaagttacaaattccccctcctccaacttttctataccgtttttattcaaattttcctcattcggttgaccctaaataaacaatattattatgatgaatttacaattccttttgtcaaccgtttgtttctgctgttgatgtttctgtttgatcttctcctttttctcacgtttctgttgcttcttcttttcttttttggacatcggcgacggcccaccgttttggtcacttttcggcttcccattttgctgattttttggtgccactttcttctgatcagcttttggtgcattcttttgtccagtttttgaaggttgtctattttaataaaagaatttaacgaagaattatgaaacattgaccacaaagatcttaaaatgaaacaaaattcgaatttttgaattcaaaaatctgacccaaaaaacgaatgtcattggtatcaaaccctcaaaaaacttccatctttagtaaactttgaccaacttttgctgtttttgcttctgatttttgggcgatggaatcggtgttggggcggcaccgccgccaatattggcattgccccaacttttcggcatgttcggacgcactggcgacacactgttttgttcttcggcaagtttcctgttaatgaacgtcaactcgttataagaccagatttagaggatttccaaccctatccccgaaattttcaaatttttgggttcaattggtcttgaatttcatttttttccaagatttgctacgacagaaatgcccaatgcttgtcaaaattggtcattacttttgcggtccatttatgactttgccggatgacgcacttccgttcatttttgtctgaaatttttgctgcccaactttcggcgtcgtcatttgctctgtcgacacttccactttcggcattttgtgctttctaatcgcactgtcattgctctaaaaaggaaatttttgcaccaaaatgagaatttgtaccaaaaaaacctctgattgtgagccaaaactgacacgacgcttctgtcccgggccgaaatgttttctctgatgacgaccacctgctgccgcagatgccgaattcgaatttatgtcaccaccgtttggcgtcttgagaatctttacaaattttaaaaggtttaaaacaaaaaaagattttgtttgtccttggtcatttaaattaaataattaaaggtttttaggactaaaacttttcatggagcgtaaaatggcaggaattatgagtttttgaaaattggggcatttgaaatgggttacagtgactctcggtcctagtattttttccaagaaatccactttcaggaatccattcccgtcaacaagaattcgttgttaccgaaaccatttcgagcaatcaacacccccaagaattgttggctaattgccaaaaatgagaaaacctaatcaccgattttatggccgaggccggagtttggtgttgctgatactgtctttggaacggctttctgggctccgattgtaccatccgtttgccatggttttcgtcgtcgttttggcgcggctttctcgtcatcggagtggtcattttccgaccagccccaccaccaccaccgccaaatctgttgcccggcttttgcctattattactccgattctctgacggcgttgcgaccgccggtgaagaagtggaggaaacgatattcagtttgaccattgaaaagaaagaattttgcctatttaactcttttctaaaaaaggaataattgttaaataaattaccagtaaaaccgccaaaaaatacaatgagaaatttactacaaataattcaatcaattcgagtaaagtgaagcggagtgagtctgagaaaaaaaggaacggcagaaacaaaagtatgtaaaaatggaaattctagtttttttttatttggcattgtgttttgtaattttataattaaattaaaaataagttctttccaggaaaaaattttttaattacatatgcccacccgaataaacatattaatataattattatctcccttttgtcaccatctattagtggccccgtccaaaatttcactgtttggaggaggttgacaaataaatagagccccagggaattaacagagtgaatatggtaacgtgtacaatactcagagggaatacggtatcgtgtgtgtacaaaacaaaatcaaaaaagtgggagcccagccgcttcatcgaagcaaaggagacgacactttattgtctgcatcatcgggacggataaaatcctccagtccgctcaccgacgcgtttcttttccatgcccgcgtccctccgcaattatcaacgataattatcctccaggcacaggctgccgccaccataattttttttgtctttttgatgtcgcctcg

SEQ ID NO: 6371 - DNA, 998 bp, Heterodera glycines
  misc_feature (39)..(39): n is a, c, g, or t
tgcaggtctcatatggccaaaaaataattattaattttntgtttaaaacaaaaaaaaatatttttaattatttcttaaaattttttcgccataaaaaattaacaaaataaaaaatatttaaaattaaagtaattaattaatttaaataattatttatttattattaccagccgccgacgcgacggcggaggctggcaccaaaaggccgggcgctttgtacacgtaggactgagtgtttggcgaagggacggcgaggccaccggcgggcgttgtcggataagacttgaaaaacaaaattaaattacctaatattatttggttaaattatgctaataaaataaatttaccagaaaagaaattacttaaaactttaaatttatatatttaattcggaaattgtaaaggtaaattgattcttccatttaaaaatgccaaaaccaaagttataccaaattgccaaaaaaatggtaacggaattaaatagacagggtttaaacatggaattcgttgaaaaattatgcctaaaagaatacagtatgcccaccataaacatgggaaattcagtgccgcttggcaccatggcactgtccccgtgatgggcgcctgtcgccatgttgctcatcgccggtgccgaacgtgtccgatctcgacgatccctggcacagagaaaagagaaacgtcattttattttaattaaattaacttttctaataataattgttttttagttaatatattttttaattcattttagcattactaaaaagtattattttcaaaattgcaatttgttcattaatgtataaattcgaaaatgaaaattatggcaattaggcggacccgataagagtcattatttctcagttttaaaaatagagaaaatcaatgaatttaattattttgaaataaacccaaaaagtcggggggaaatttaatccatgccatggcatatgacattaattaattttatttattttgcattattaaatgactgattt

SEQ ID NO: 6372 - DNA, 2552 bp, Heterodera glycines
ttattttattttgcattattaaatgactgatttttgtttttatgtttattaattaaccaatgtttttccaaaaaattgaatttattttgccttcgcctgctttgcctcttattccaatagctgacaattgcgaattccacccaaagcggcctaaacaaattaaaaataaatttttaatttaattaaatttcccccaaaattagactcaccaaagaccgtgatgaaagcaaaagttgaggaacacgtccaaccctttgatgtagctgacctttggccattgtgttgttggtggtggtgatcggtgttgtcattgtgagcacctgccaaattccgaaaaggcgtgtttaaccagattttcgagaatttctcgagttgagacccgaggacggagtaaaagcttaacgaataaaattaattttgcgtaaatgccaacatttcgaacaaacaaataatttaatggacagctaataacccactccccgttcacggcttaacttttccatgggcagaaagttcgttgttttgtctagaaagggttgttacaattttttgggggattttgggacaaatatctcacaaaaggtcatttttcgtgtaaaaacttggcccaacatttaaaaaaatagtcacgggtttgtgccgttaataaatcgctttcggccttgctcaatttgcaaacgcaccgttgtgacgcctaaaccgacacgggcgggcgacgcctcgcggctcagccaaaaggacacccacgaaatggcaacaattagcatggactttgaaagggattaaagactaattaatcaattaatattattaaaattcaaacaaattccctaccggaatgacaatgttcatcagatagaagccgagattacgtgacaaaatcacttcaaaatagaggcgagcatatttacctgacaaaaacaataatgattatttttatagggaaattaatcttaatcggacaaactgttgattagggtgtcattgcagttcgtaaagtttttttaaattaaattttcaattaaaacatgaactttttctcaaaaaatctgaaataaagttgccttgaaaaaattagcagaaaattagcaaaattttttataactttttctatagaaaaaaatccttttttttgagaaatgaaaaaaatttgtgtcaggcactgatctgtcctgatcactgatgaattcccggattccgcgaataccaaatgtatttgccctgatcaatcccagtctcagttcccagcaggcaccagaacattttcaaattttaaaaagcatttaaaaacacgaaatttcggacccgatgctgtggtgatatgtgtgccggtcacgcggtaacccgtgcgtcgaaactgtggcaaaaagaatacgtcgaatgccactgcgtcttcgggccgtcgcccgtccgaacgccgttcgccccaataataatctgaaggcttttgatcattttaaatattcaaaaataaatcatttataactataaaaaatttattcaattaaaatattttgaaatttaaattattttagctataattaattcattttttattattaaaatgtaagtttctcctaccaatgtcctccacgtcgtagccatagctttctaggccaagtttgctaaattaattaatctatgaattttggtgtaaaaatggctttaccaagtctgcgaatccattgggaacagctaaaattaaaattgaaaccaatttaaaaaaattattaattgccaaaatattaattaaaaaatgtttgcattttatgagaatgtgacgaaaaatcacctgcagctccatttggcacatcgctttcactgtcagccgttgggacgtgtaaatctgtgaaaaataaaaaatttaaaattattataaaaaattaaattttatttactcggccatccggctcaattcggagaaatgaattgtgagtggtggccaagtgaaagacggcggttttctcattgggaaactgaaaaatgtgaggacaaattaaatgatgctgtttaatttcaatttggaaggttggggctgggctaattaaaatggagtaattagcgattaaatccctaggggaatgatggataattatatttaatcataaattgattaagattagcggtcattcaactgtaaattacagttatggtcagttcaaatagggttttactcccctctcctcgacatttttgggaaattaaaaaaattactttataaattaatttattaatgtgttaattgggtaatggatttccaatgattacaaaagtgtccggtttccacagcctttccaaataatcgacgccaactgtcagttttttgatacgccgtgccaactccgggtccaactgctggaatgccagcctcgggtcgtacctaaaaaaaaatttaggaaaatttttcggggtttttttatagggcctggaccaagtctggcgcaaataaaaatccaatgtgatgtccatgtccacttcagaaacggcactgatcgaagtcacgtgaatggtaatgccaacgtcaaccgctaaaagggtaccaaagttttaaa

SEQ ID NO: 6373 - DNA, 1766 bp, Heterodera glycines
aaatttacaaataaaaacagagtgccaaaaattcgaatttttcaaccttacctccttcgccataccgaggccttaaccgcttgtcatactttttagaatcggtcagccgattgagaatctgagaaaatggagaaataatattatatttttaaacaatcatatttcaagtaattactgttactaacaataaaataaattaaatgaaaaataatttcataataatttaattattaaaattataacgcctcgtcgagcgggcgagttatctttttatatataaattttttatttccagttaatttcaaataattattattttcaaaattaaaaaaaataattatattcagcattcaaatttcaaataattcctattattaccaataaaacaaatttaaatgatcaaataatttaataaattcctaattatttaaaattataatatgccaaataaaattaaaattctcaaatttaattattttattcccaattaatttcaaataatattattttaagaattaaaaattatacataataccaaaaaataaaaaataaaaatccatcgtttcgtttcccaaattcattcatttattttggtcctccacctgtgaaatgtaagtggtgttgaacccgttgttgtcgtactgctgctggttgtgttgcggttggttctgatacgcgtccgaccattggaccatcggctgttgttgttgctgctgctgcgattcgccaacgccatttgtctgctcattttcggtactcaaaagtgtgcccgtcacaccttaaaaaattaattttcaaaaatataaatatttttaaggaaaaatattaaataaattattattaaaaattttaaaaatattttaaataaattaaaatatttattattaaaaataaattaatttgaaaataaatttttatttttgaattcttttatataataattttaaaactaaattatataatattttcaatttaattaaaaattgaaaatttcattcatttataaaaaaaattattttttctaaatattttttaataaaattatttaaaaacttaaaataatatataattaatagtattttaaaacacctccaaattcgcttctgacgaggatgaacaaaagcacaatggaaaatgatgaagaagaattgttgtatttgtggcgcaacattccgccaatttttgtcctaaaaaaacatgtatgccgttgacagggcccgaaccaaagttgcgtaacttgccagatcggacgccgattcgcgacgcgcattagccgcaacaacggaaactgcagctaaagcggaaacagcagaagaagtttcagcagtttgggaacattgctggtcgccatatggacaaatttgcattaattaaaataaataatccctttaataaaatggaaaataaaatattaattttttaaaatttgcgtccctcgcgggggattgaaccgcagcgttgcaaaacttgccatatcggacggattctctcttttttaattttctaccttttttctgtttttttccaattggtcggcctgaaattcgcctgggaaatcatttaacggacaaatggccaaacacaaaaattgataggccgccaaataattcactcttttggccgcttaacgcaaaaggcccccggggaattgttttttatttgtgggagagagtgcgacagtatgccaaacaaataataaatattctttttatttactgtctgtccaacaaaaaattaatgggaggggaaaattttagttaaaaaaa

SEQ ID NO: 6374 - DNA, 2906 bp, Heterodera glycines
tttttattattataaacaactattctttttgtatattattaacatttttatagtccattcgttatctgaattcggttttaaaataagtaattctcttagatctgctgctgcgtcgaggatgacaaggtttctacggactggctcgaggaacagatcacaggtaaacaatccaacttcattccctgtaaaaccatcttttaagacttcgaagacctggtccagtcagtcgatgtggtggcgtttaacaaggtttaaaggaacgattgatcttttaccatttgttactttttgttgttgtttcattttgttaacagtaaatgccgaactatcagtcacgcttattgctcaacttatgtatgcttttagattctattaatggttttagcaccccccccccccaaaaaaaaatttttaaaaattagaagcatgttttttagggttttcggtgtcgttgatcatgaatacgacaccaatttcgaacgaactcgagcaaaatgttgaaaattcaaattttcgaatttcgcattattggttcactttgttaaaaacacggaaacaaactgatgtcatcaatgtattagcttttttattttgaaatctaaaaaataaaccatattagagctatgcttttatattgttcattaaagaaaatgtcctgacagcctttcttgcaataggttttcgattgctgtttccaagacttttttgaggcttaaaactccgatttatcattgtacaatacttggaaaagtagtaatatacttaaacaaaagaacctataatgaaatgaggagtttaataaaaggaatgatgattcatacaacaataatggccaattgccaaattctttgaaaacacggcagtatttggtagtgcttaaaggattaaaacgacaaaaatgaaaggttttagtagttcgaggtgaagaaaaagacgaaataagtaagcgactgtattcatgagtttagtttaggaatggtttctatgcgggacagagaaacagcactggaggtatacaggataagagggaagaacgggtacaaaagaaaatcaaatacaactaaagggtccaaaaaagagggatctgccagccacattaagaaaaatgaatcatctataagcttcgaaatgaatataataactctgaatatctctgtccttttgctatggcagtgttgaaggtgatgccgagaataagccagtcctacagttgctcccacttgttgacggcactttcggttcgaccttgacaaccacgttggtcggtggagtcaccagagcggcagaggtggtaggtggaagattcagcgaaatgaagggaggagaacggctctctttgggatgcagaaacattggcaagacgttgttcggttcagttgtcgccgcctgaggtgcgcatttcgaactgttgactgtagtgaatggagtcccgacgaggccggtgttttgtatggccaacgaaatggaggaaggtgtgaaagaaaagtgcgtttggatgggaatagaaacggaaggggaagacagaggactttgagtttcggttgtctgttgttgctggtctaatgaagggccggtaattgaattcatccgaaattcgctcccgcttccggagccaaccgaatccgattgttgttgaatgtgtttctgctgcgcagcaacagcagcagtaagaaagttttgcatgacgggagggaaagctctgtcgaggatggcactcgtcgtcgttggcaacgtcaaagaggaagaggttgaagggatggaagacacaatgccaaaaactgcggaacctccacttttgtctttgttccttttttcaccgcctctcgccttccgctccttctctgcatattttgctgcagaatcaacttccaacgctttggcaacaatgtccttgaaaattggcaattaaaattttaaattttatatccaatttacaaagtaacctgaatttgccgctcgattccttcctgtttctttgggtcctctgctgtttgttgcttgtgagtgttttgtcctcctcgtttgcctccagctccagtcgttcgtgccggtctcggcctaaacggtttgcgaggtacggtcgtcggcagagcagcaacctccgcaacaaccttaatgataagtaattgctgaaagcactggttaattgactcacttccgcaacggttgattctcgcgtgagttgagacgaagaaatgccgttggaagatgaggacggagttggaacagtggtggaagtgactccggaagaggacgggcaggcgaagttctgactgacttgccgcagggaaagcgaagcaggctgaccaaccgggcgacgatgaccactgctggtggggctggttgtcgtgttattcttaacggactaagcagtttaaaaccaaataagagccaaaagaccccgagattgctcgtcgtatggccaacttccaccgcaacagcggacaaattggcactaatggtggttggcgtactaatcctagtggtagcagaacaagcgcttgggccattgttaaacgactccaaattgttgagaaaattctgcacaccaatgggaccgctgcaattgctgacagtcgtccccccccccccgcccttcagagcgcgacaaatatttcaacaaaaatttttaaaaattgcctagagcaattgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcacatgattccactgttccaagcaccccaccaaaagcaaaagaaaggtaaccaaaatataaggaaaaattttttaa

SEQ ID NO: 6375 - DNA, 2300 bp, Heterodera glycines
cgactaaaagaattatttcaattagtaaagtgcaaaataaaatttaacaaaatgcccaccccgccatcgttggctgtttgtttcgaagaatacacattgtcgaaccaattttcaaacactcctctcattccatctgtaattctgtctgtaaaaaggactttaacaaagaaacacctaaaaatttcgataggcccgggtatctctcggtgtaatgatggctttgaatgtctcctccggattgagtttggtcggtgaacggtttgctcaaattgggaaagggcagagccatgttgatagtgtccattggtactgaacggcgttttgcctccgccatgtcagccaaaattgaagcagggtcaatgggctttccctgaaccggacatcatgacgctcacattgtcaaggattattaccgcttgtactgagagagtcatttggtgcatcacttccatgccatcctttgcgtcgtccgacaaccgtggcatcttcggactcgcatgcgtcccaagcattttgtccgctttgctgggccttccacgttttccgccaaccgtcggctgaactttttccttgcgttcattgctccgtttcgccacgtttttcttgccatcgccctcgtcgttttttcgatttgcgactggcgttattggctctaaattcgaggtagaattcccattgtttcaaattcaaaaatattcaccaaattttgaaacttcatttattaaatggttttgctgctgatggatgggattcacaactaatgcattcgctggtccgactgaaatgtccaccaccggtgaactctccacgagcggttcctcctttacagaatttatcaattccgggatcgaagaaggtcttcttaagttgttaacgcagatggtcttttgaggaagcggcgtgttagcattggcattgtttggaagtgccgtggacacaaaaggaggggcagaagaggcgctgacgggcgtaggggtgccggaagaagagttggtgacactccgctcgtcaggcgtcgtcgaactcccagcgccgcccttccgcttcttttgctgttcgagatcacttacgtattcatgccattttctccgagtcgttggaccaaaactacaaaaataaatcatattaaagatggagcacttttgtataacttaccaaatatcttctccgttcgtccttccgttctctgatttgtctctgagatccaaactcgattcccgagaatttgaagccttcgaattgggagtggacgaacggcggctgccaaagtcggacgatttgcagcgcgaagagttcttttgggtgaaatacatttccaacttcttccggttgattgtgtgcagatagtagggaacataagctgaagtccacgagcaagggttagggcatgctttcatttcaacgacatcggtgatcacagaaatatctaaaaacacttcgaaatgatgccaaaaagtattgctcaccatttagttgtctatcagtgattgcgccctgtttgttcagcggaacgtacggtttggtggaaataattcttgttccttgtttgaggtcactgagcaattcgcgtttaatacgcatctccaaatcggattggaatgcaaaattgttgatgaaaatgatggttgcttcttcagtgatcaggcttctgtgttgttcatttaaaaaatcgccatgtttcaactcaaaagggcgaaattgacgtccaaaccaattcatcaatctgaattatataaaagaattcaaatttatattaaatggaaaaaataaaataccttttgaactcggactccaattttctcgcaaaatcagctgggagtttggcaatttctattccgactgctttctgcacttgcgatccgcccgccacttggacgaccaattgaccaacgccactgcccaaatcaacgaaaacgtccctctgtggtgagataagcaatcaaatttaaagccttggcccacctccgttggcctcaactcgtcgatgatcatcctcatccgctcaaagctcgtctcgccatacgtttgtgatgagaatgcctcgtaatgcttattcagtgccttttcattgtcaaccgcgcggttgtaacagcgagtgacaatttggtgcagaatttcccttgatttggttttcaacggcccatcgcttctctaaaaaacaaatgcataaatattgctgaaacccaataatttattacaaattggcttgtctgcgtcaaaactttgttaaattttttagccaatgagcgcatttgatcataactaaaaaagcaattttaaataattatcccggtacttgt

SEQ ID NO: 6376 - DNA, 2377 bp, Heterodera glycines
gggttcagatcagcggtgccgatcattgcatgatctgtacagggacaaagaatttataggcttcctgtaccaataatgccctcattggcaagatgccatgagtataccattatgcttcctgtaccaaggttaccctcattggcaagatgccaataaggatatcatccatacaaattttataattttatttttgttcgagtccgtgtcaggggttcgaaattggcaaaaatgggtgctgtattcgtgatcagcgacctcaaaaaccccttaaaacttattttcattaatttcaaaagcacatttatatgcatttgaaaatgtatgtgaaatctgtaaggtaaaccacacaagtaccttatccctttaaaataagctcgtaattattatttttttaaattcaatataaacggcatggaattaggattttgccagaaaaattcagatttttaaaatgtaaagaaaaaatttttctctttttcctcgggagaccaattacgaagaattacatttttattaaaaattgatatttttcgagttttattaaaaatagtttgaaaaaaataaaccctcaaaatacagcaaatttagaattggccaccccaaaaagtaaatttacgagctaaaattattaaggaaaatgaagagtttaaagcgaccattaaaaatgaaataatacttggaaacatcgacgttttcaagacgtcctttcagtggctcatcgaattctggataatgacagatggctaaccttcattataatgggaaaatatttataggtaccaatactcgggaggaaataatatttcctttgaataaatttagaaaagaacgaaaagtatccatttgttttcagggtcagtaattaatactataagatttattcgttcaaatccgaaaacaattcgctaaatttgaattcggttctttatacaaatttaattgagttcaatccaattaaaatgggtgtgaattcgtccaaaaaactcttgggtaaacgtcttcaatttttgggactaaatttcttgtcaaaaattagatctgtattccccgctctttaccctccgtaaatcaccttataatgtcaagaacctcaacgcctaatgaagaccccgccgcctctgcactccaattccacgtgatgggctgcgcaccgacggggctttgcagtcggatgggttttttccgctcagctccgtctttgcattggtaagactttccattcatttcattagaatggccatgcccatttttgttctttgcacaactgacgacatttttgttgattaggtcacaagaagcaagcgaagaagggttgggttcattagcagccgcgttattattcatgccatccatttgccgttattagcatatgtcgacctgaaaaggaacttttctttcttctgcttcatttaaataaaaagcaaacaaacaaaaacaattttaatgtggcaatttccacaatttatgcattttaattttaaatatttagcaggtcactcgtgagaatcgaagaacgaatcagttttggatagaaacgagcacccgatcgattgccgaatggtcgcaaagggaaagagggagatattgtttgtgtgtgcagagagttgacagacccctccactcccccgggcgagttgagtagggagacggaaagtccttccccaaacgcaccccccccccccttccacccaaaccccagcagcatttcgtcgcggggagctctttccccggacgagcggaaaacgatcgataatacagagaagataaataaatggaggctggaagcaaaaatgcgaaagaagagagagagggaggacgcattaaagttgaatttagaaaaaccgacactcacatacggtcgaaaatttgcaaaaaaaaaaaaaatcgcttataaaaatgttaacagtagggtttttaccgcatttgtgtgaatacgtgagtttgtaatccgtttcattggtttcttagagaaataagcaaattttataaggagaaaagtatgtagatgggatagagaaaaacacgctggataaatattggtttgctagtggctgaatgagtggcggactgactaacggctttggcagtggaagcgagcgaaagcggtcgattttaacccttctgcagcaaaaaagacgaataaaaatcgatgatttccaatgttgtcgcctttgctgtcgcccggccggaacccacaagtattctttccaccagagaagccgctcgcttgtcaaatgacgcatcgaaggcgtgcgatgaaactttttaattttcgaggattggtgccccttcgcttatccaaggcaaaactatcggtccttctctcgactaaaacagggctttcatcaaaataattcccaaaataaaggatatcact

SEQ ID NO: 6377 - DNA, 4849 bp, Heterodera glycines
acacgtctccgacacccgcccctcgttgaataccgtagccccgctgaaaggggctagtgccccggaagaagtcaaaatcgtccttttctaatccaccaccgtattgtacatactcgtcatactgcgcaatgcttgggtcaaacacaatatgaaccattttattgttattaaatgaaaaatgaatgaatgaaatcagaaatttatcactttcttaaatatcaacacaaccatcgtcgtcccataggcgaacggcactaatcgacctttgtccattgtgcgcagttcaatctcaatttcgtttatttcccgtggtaacactcgcgcaaatatcggtgagtcgtaaatcttctcagtgtagtccccaggggtggcaccgctgatagacacaacccggagcaaagagctcaatgtgttcccgatgatcatattctcggtcagtccttttgagtagacagcaaagcttgagatgccacctcgcaaatcatgtccgtatttggcaacttcatttgacaccacatgctgggggttttcgaacccaaggacatagcccaattgcggtgagaaggacaaatgactgatgatttcctcgttgaacacaaccttgaatcgttccacatcattgttaaagagaactatcaccgaattcggcacatagttcaaagggttttggttagctggaggagtcttaaaatatattcttggtgggtcgagcgtgtgaatcaaacgcgatgggtcaatttgagctgctgatgtcggcggtggtggtggctttgcaaatgatttgacgtttttattttcctctccttcaaaacgaggtggagagtctaatggcggagtcggtgcactagggatcaatttagcggaaagagaaaccgggggtgggggtttaggtggcgcgtcggtttttggcactattggtttggtggatggtgtcgggctttttggttgttgagccggtggtgctgaaattgtcggtttaacagatgggcttgggactggtggttttgttgttgtagtgagaggagcaggcgttgacggcttgggtggttgaggtgcaggcgatgccggctttatcggtttaggagctgccgttggtgtcgttggctttgttaccggaggggttggtgtcgttggctttgttaccgaaggggttgatgtcgtaggttttgctaccggaggggttggtgtagtaggttttgttaccggaggggtaggtattgtttttgtagttgttgtaattgatgggttaactattggagccgacttagtaggcggcggtggcggtggtgcctttgttattgttgtttgtggtggaggggtggatactgtaggttttggtggttggacagccggtgtctttattgaaataggagtcgaatttgtagacggtggtggtggaggagggggagccggcttagcagtgcttggggtaggcggcggctgaggagaggtcgcttttgatgtttttacagtttcgttttgcgtttctacataacgaggcggtgaatccgcaatcacaccttcataatcttcattgtatgatgagggaaagtcaattgttacagtctcgtttccttcataatgaggcggtgactcagaaattatcccttcctcctcctcatcctctttatctccattgtaagacgggggagagccaagctcgttcccgttctcatcaaaaactggtggtgactcatctcttttgtttctcttcgccggtggtggtgagttgagaggctttgtccgatttcgattctcttccaactcacgagggagtggcaacatttttgcaccactatgattccgcaatgtagcagtcaaaaagtctcgcagctgttcaaccctactatgcgatgccttgggcaccggcaccctgataattctttgtcggtcctcatcaatagcgctgcggtcggtgaagtgaatgtcaatccattgctcatccaatgtgccaatggttgaccacgagtaggggtaactgatactgtgcaacccgcacacccacgttccattaaaatgcaaaggttttgggagtcggacacgaaatttgttgggctgattgtccgggtaatcactcacattactgggtaaaaacacaaagaaactgtttgacatggttgttgtttatccgcataaataatgaaaatggaaatgcttttatacaagctgagactcattaatccactcccgattgggatatcctataaatttaacaagcatctcggttgatccatcatctcttttcctctttctgaacaccttctcgatacggtagcttgtctctgcatcctttcttacgcgtgccagctcctgctcatagaagcttcccttgaatttctcgccatgctcatcccgtagtttgtaccgaattgggcgcaccgctttcagcacctcatcaatctcgagtatttcatccccgtaatttggtaaatatcccttctcgaattgccctttatctctgctcatgcgcacaaattcatctttatggaagcggggagtttttctgtcaactgattgcggtcggtacattcgcttccacaccttctgagcatttgaaaagtcaacatcaattgggcgcatcccgtgaacacgtgagggcgagctgttaattccgtccacaattttctgtactgtatccacccaattcagtgtctccttttccgcaaagtacctatacaatcgctgcttcacattccggatggctctctccgcaattgatgcttttactgtcgaatggacgggttcgtgcttctcaatctcccgctcctcaaagaattccttgagcaatctgttcttgaactcggtgcccttgtcggagaaaactcggtggggcgccatgggcatttgatcgatgagttgcttgaatgcctccagcatttcctcggctctcttgtttctcagcggtacaacaaacagacgtttggataggacatcaaccgcaacgagcatataccgatgaccccgattgtggcgcaaaagatctagataaactgacaatttcacttgaacatcgttcatgaatcccgctgcaatagttataataccttgtaatacgaacatcgatttttaacattgcacagtaaacaattttaaataatgaacaatgatgtgaatagaaccgcattaccccgcttaagcttgctcctccctttgccgtgccattgtgagtgactcctccctcaccacggctgagattggctccacctcaccccgccacggacagcaaacaataatgtgaatgattgatgggggaaatttgaatatgtttttgtctttctgtgccatccctcccccatcatcgccactgttgggagtgggcaaaagaaatttttttctcaatttcgttggatgattgatagggaaatttgaatatgcctttgcatttcggtgcgcttctcccctgcgaggcaccactccgttattgcccactgcgatgggagggcaaaaatggactgaaagaaaatgaaatttcttcgcaagtttagttttgattgacagttcagtgtcataaaaaaagaaaatttgaaggaccaaacggaattgtcataaaaaattcaaatgcgaaggacgaaagaattgcgattgcaaaaaaaccaaaaatagtaacgatggacaaaaaatttttgtgcgtttgtgcacaatttactttgggcaaaaaacgaatgagaggaaaaaacttgtgcgtttgtgctcaaattatgttgggcaaaaaatgataatggaacaaaaaactttgtgcgattgtgagcaattatgattgggcaaaaacatagcaaaaaacttgtgggtgcgtattttgtgggagaaatatgatgaaaaaccagaataaatagagatgatggtcgactatcagtcaaaatgggcagattattaaccaaatgagcattagtttttgtgtaaaaaaacatgttttttgtgagcattttggtttcggtttgccgtttgtggggctatttaagacggtagaaagttattgtgatcgtcattcgagcaaatggacgtaactcttcccgtcagcaactcagttggtgaatggatcggtgaggaacggggggatggcagtgttgtgctctatgcgccgtggacggacgtgtggcatgtgcagcaacaacaacaacaacatcaacaacaccaacaacaacaacaacagcaaaacgaggtgcagcagcagcaacaacagcttgtccggtgaacaggcacggggtggacgcagtttccagcatggaacgaaccgctcgttgccaacgattggcgagagaaggaggaaaatctgatccaaaggaagcgactacagcgtgaaaacccggtgtattgggcgcgaatattggaggaggaaaagcgagccggtgaggagcgccgcttaagggatttgcggttggagcacacatgggatggctacaaggaaggccacttcgagcgtcggcacaatgacggctcgtttttcaaggcaatgaaaattttttcttgtgtttttatgatttgaatttttcatttaagtctactgcttcaatgggaaatgctatgaatggaattcatggtgaaggtggaggactgtggtgaataacatggtggcagaggaatggagaattcaaattaaataaaattgatttgcgtatttaatattgcaattctacatttgatgtaatgggggtgaggggataaaatgattcacagaaatttacggaaacgcttggaaaaataaaaattggtagtttgagttggtccgtgtacgggcgaccgcctcacacacagtgatattgcccctcattagatttcgacaacttaagcctcacacccgagcttaatcgttatgtggttggtgttgtttcatgccgccaccaaactttct

SEQ ID NO: 6378 - DNA, 2734 bp, Heterodera glycines
aattgggttcccggtctatccgtcagtggtcaatccgtcagtggacaatccgtcagtaagtggacaatccgtcagtggacaatccgtcaatagctaatttattttggctttgatcaattattggatcgaaatgattcatttttggcgcattggatttttttcaattcgttacatcatcatatcaccttcattcttcgccagtttaatgccataaaatgaacatcgtcactaaatataaattaaaatgattattaacaaaataaattaaaaattcttaggctggtgccgaaacgacccctactcttttttttaactttatggcgccgggccaagcttctcggctttgctggtgctgtaactgttactgttcgacttcaagtcgtcagcaggctgatcaagtttgatcaactgatcaaagctgttgcacactttgccgtcgaccaactcatcacaatgacgacatttccacaaatccccagtagctaaccaacaataatcgtggaaaattgccgggcactttttgtcactttttgggaagcatccattcacgcggaaaatgtctttgccaaacactcaagatttaaagaaaacttttaataacatatgaacagaaactaatttgctgactatctttgcaggtatatgtcaggcaaccccaaaatccgccccaaattgtgccaaattcgccatatggcacgcaatccgttgtaaatgtgttgcggaaaatgtccgcctttttggctgcttcccgcagttcaggtgtacgcaaagtgccatacacgtactcataaagctgcaatgtaaaaatttgccaagtgtttcaacaaaatagttatggccagggcccggatttatatttgctagaaaagcctcgaaattttcgctaaaaaccccaaaaagtccaaactaaaaacatgtaaaaatatatataaatccgtgccctgtggttttggcacaatgtattcgaagaatttttggtttttagcacgtattggaattttgccaagcgaaagaaccgaagaaataattacgggaacaaatatttccaaaacagaggccctaaaatggcacaaaactatacagactgacaccatctggaatctcagaccgattacgaacggccacaacacaatcatccgctgaaaaataataaaaattaattaatgaccattaaggatttaatttctaaataaacgaacaagcgggattaaagagactgttgttgacattgttgttgaagcatggacaaatcagcagcatgatcagcagcacggtgagaaggaaaatgggtgatttggatgaagccattaattagttagggcgagagacgaattagagagcagcactgggatgaggaaattcaatttaaaactgaaaaactcgaaaaaacaaaattaaattaggaacataaaaaccaaatttaaaaatagattgagttaatttaggtgattggtcttctttcttgtaaattcttttggcattgccatttaacggcaaattgccataattttgctgaaatgcaacaaaaattaatttgacattggaaattttttgttttttcatttatgaagcgatctgttgatgatgctttgattatattaatcaattttgtccatcctcaagactttcatgaaataaatggtgaaaaaaaattccagagctgatcggggggattgtgacaatcattaatattcccaacaaacaaacattgaagatgtcaaaacaacgtttttttatggatgtaaaaatgagaatttattacgaattaattaagaaaaataatcagtaattttaattaatattgtaaaaaatctattaacaaaattttattgctgctcgagagttcggtcttcaaattcagagaattttcattttttttttttgtggggctcgattctctctgctcttctcgaatttggcttccgaggcttggaaatttttcaactctcaagcagattaagaaaatttcacccaacttgcttgtaatcgacttaagatacaggcataataaatggttaattgctgtgtattagtgctgtttgagagatgtaccgacacttgcgccgtccagtaaaaatggacataatttttgtttttttgtaaatgcgtgtgcatcagcagcaaaggcaaatttggtgccaaggaaaacaaaataatgaagaattttacgtgctgagacaaatgcgaaaacaaaaaacttagtgatgattaaataattaaatttaattattctatttattaaattcataaaattattatggcgctatgtaaattcgacactgagtattttcgacactaagtaatgtcgacactattgagaatttttaaaaattaatatgaaattttgaaggtgttagtatttagttctgataaattttcctatttcattttctaattcttaatttttaaaagggtaaaaccatgagtaaaacgtcaaacccagtgtcagtgttagacaaaatgactcataattagggctgccaattttatgtaaatacatattttttcctggattctccatgctctaaatagtaggaaaaacactttcttttttgtgtttgcgaacaaaaatcgagacttttatttacatatttttacatatttcgggattttatacatatttggtacatattttggactttttcttacataatttcatttttttacatattttgaggattttttacggaaatatttgggaatattcaaaaaaaattcaaaatttcggcaaatt

SEQ ID NO: 6379 - DNA, 4873 bp, Heterodera glycines
  misc_feature (1253)..(1253): n is a, c, g, or t
ttgaaacacttggcaaatttttacattacagctttatgagtacgtgtatggcactttgcgtacacctgaactgcgggaagcagccaaaaaggcggacattttccgcaacacatttacaacggattgcgtgccgtatggtgaaattggcacaatttggggcggcttttggggttgcctgacgtttacctgcaaagatggtcagcaattcgggaataaatacctgattttaaaaaactggggattataattcaacaaaaacggtaaatataggatcaattttgggaggcgcgtcaaacagattttagtgattaaatatcgtggttttaccaaaaattctttttcatttattttccctgctaaaatataattcaattataaaagttaaaaaatgccatattttccaattgcttggactgtgtcggtgctgaaaaacaatgtaaaattaaatttcttaatctttttaagagcatggtaaagacattttccgcatgaatggatgcgccccagaaagtggcaaaaagtgcccgaaatttttcaacacattctgttgggaagccggtgggacttcgtcaaactgtcgccattgtgacgagttggtcgacggcaaagtgtgcaacagttttgatcagttgatcaaacttgatcagcctgctgacgacttgaagtcgaacagtaacagttacagcaccagcaaagccgagaagcttggccctgcgccataaagtaaaaaaaaagagtaggggtcgtttcggcaccagcctaagaaattttaatttattttgttaataatcattttaatttatatttagtgacgatgttcattttatggcattaaactggcgaagaatgaaggtgatatgatgatgtaacgaattgaaaaaaatccaatgcgccaaaaatgaatcatttcgatccaataatcgatcaaagccaaaataattttaaaaattattattattatattaatatatgtatgccaaaaattgaaatgattaaagtatatttgttgttgaatgattctaagtatattaacgaaattttaattacatgtcttttttgcagtcaataagtcatttgtataaagggattttattttgcaagattcaattttatccatgtaaaattcgcttgttaggccttaagcaagccgtataaactgtaatttattcaattctataatttcatggttcaagaatagccctgctgaagtaaataaaaattttattcatttttaataactttaaataatattnataataattcgtggctgggtaatttcgacactgggtaaattcaacactgagtattttcgacactattgagaattttttaaaattaatatgaaattttggaaggtgttagtatttaggtatgataaattttcctatttcattttctaattcgtaattatataaaagggtaggtggtataactatgagtaaaacgtcaaacccagtgtcagtgtttagacaaaatgattatgaagacataatggtggctacaaaatagctggaaatctcacaaatttttttttttgttgattgtcaattttttagcactcacttcttttcaaaaaaattaattaacaattttgttttggttagtttgtgatgccgcgagttatggatgatcagaacaaccaatgcaaaaaaggcagtgatcactgcactgactgatcagtatttttttttttgaattagcgcatcaaaatatcgctatttggcattatgagtagggctgtcaaaaatatgtacaaaaagtggtccaaatatgtacataaatatgtatgaaaaatcccaaaatatgtacaaaaaaacacaaatatgtaaataaaattttttttaatggttattttttgaaaaaaaaatcctcgtaaagtatgaaatatgcacaagtagtataagacgtcaaaagcgcacggttgcgcacgggtgtttaccgcacaaacccgtgcctatgggaggggcgcagccctttgatgttaccgcccggggacattttcccgcacaatcccaagcctataggaggggtgcgtgccaaccgaaccctatgtgaggggttgtttctttgaagtctgccgccttgtagatttaatttcctcaaatccgcactggtgatttttttttttcactccccctctccgcgccgcgcagcgccgcggaaggtcatcaatcatccacctgtcaccaaagtggcaggtgaaggaaattcaatttttctttgaaaatttaaaattttgaccccaaactacttagacattacattattcgcaatcctgagatttttttttgtgatgctttttctgatcctgaaattaaactcattttgaaaatttgccaaaacagtgcgggttttttttgcatttcctccccgctcgccccgcgccgcgatgccgccgccgcgaaaaaaaaatcgataacggaatttggaagaagtgcaaattaattgaaatgactgcaaacaatatcaattataaattggacaataaaattaattatttaaattgtgtttaaaaataaaaatcgaaaatgaataaataaatcgggatgaaaaaccttttcaaaatatgtcacctgccaaccaaaattgattgatgtgtttttatttctcttccattatttcgcaatctgcacgtgactttttgttccaattatttcgcagtgtggcccattaattaggtcaactgtcaataaaatgggattgattggtttcttattgaaatttctccaccacctccccagagcccctaaacctcgcgggtttctcgctggtgtttcccgcataatcccaagcctatgggaggggcacacaaacttttgaagatgccgccctaaaattccatttccccgaatccgagcgggcgtttaccgcacaaaccggtgtctatgtgaggcgtcaaacttttgaagatgccaccaagatgcaaaacctattggggcaaaccgaaaacatattagattctctttgaagttgccggccacataaatccgatttccccaaatccgtgcggttgctttttttttgcacattcctccccgcgccgccgcgcagcgacgcggaaggtaatcaatcatccacctgtcaccagagtgacaggggaggaaatttgaattcgttaaaaaggtgctatttttaaagtacccaaaaccgtgcgggtttttgcattttctccccgccccgacgatgaggcacaatgcaggcgtcgcgcaaattaaatcgataatgaaattgtagaagtgcaaatttaattggtaatgcagcaaataatgccgataaataaattaatgaactggacactaaaattaattatccaaatccaatttaaaaacaaaatcgaaaatgaataaataaatatgatgaaaaaaaacttttcccaaaagtaggtcatctgtcaataaaatatgattaatgatttttagcaatatgggccaaaaattttttaaaaatctttgattgataggctttccgtttttgaaacgatttcgcaatatggacccatttttgaaatgattaatgagttttatccttttccagcacaatatgcaagtgacagacccaaaaccgagcgggtaccggaatggcccctccaaaatccaaaacctattgaaggggtattttcctttgaagttaccgcccgcttgtcgctgttttttgaatgctgttcattaaaatttaataatacgtgtttaaaattcccaaatcctagaaaaagagcgaaagtgttctttaactgaacataaagataaagaaattatggtccgacgaaaaattttaaaataaaaataataaaataagacgaaaaaattaaacgtaaagataaatttaaaaattgaaattttcaatttttggtgctgtgtaccatatttctttccaaaatcgaaaactatttcgcaaatttgaccaacaatttctgaaaaactgccaagcaaaattgatgatggatttattatttcgaatttctcatttattacacaatatgcgcgcgatttacattaaaaaacgagttcaaaatataggctgcccaaaattttgaaaattaagcaaaattaattaattatcatcagtcagctcaatgacccaaagataattcaaatcccatttaaaaaaataataaaattgaaaattctgaatgtatgttgtttaaactcattcgtagcaatttaaaaaataatttttcttgataattttttgctcccttcaccccttccccataaattgtttttttctgttattcatcattatttttagattttggatttagggaagttaaaaataattactcttatgtctttgccacgtaattctcgttgttattctttctatttcaaatttaattgaattcccaaactcaatggtaggggattttcatctaaagttttcccgctgagctaatttatatacaaataatgctctggtaaaagattcccttttaactctttaacgtaatttattattgtttttgcatttaaaaatttgaaatatttcaataaataatttaatatgaaaaggcaatccttttgagttcccgaaccttttcttttgaatatatattttaaccgttttacatttttgaatgtttaaattataatattaattttcttcccttaaaaatgcttttttttgtgacataagatggtatacagcttttgaatatgtatagataattgaaaacacttcccaacttagaccttttaaaaatctccaagcttaaggcattgaaaaagatcgggacgatattaagatattgattactcatgtaaaaaccctaaaaacaaaaagctttaaaatcgcaaattttgtccaaaaattcattttaatgtaatgattttatatagattacacctaataagattatacattttcatggattaaa

SEQ ID NO: 6380 - DNA, 980 bp, Heterodera glycines
agaggtacaatagtgattagaagaggtacaacagtgactataagaggtacaacagtgattaaaagaggtacaaaagtgattagaagaggtaaaacagtgattaaaagaggtacaaaagtgattagaaaaggtacaacagtgattaaaagaggtacaacagtgattagtaaattcattaaattaaaataaaatattttttaacaaatttaatttaaaaaatacatgaaattctatcaattaaaaaaaattaatttaaacttataaaatttattcatcaaaaaaaaattaatttaaatataattttttatttattaactcaacaaaatattttaaattaattaaaatcattataaataacgtaaaaatgcacagaaaaataatgttacaccgtccggattcgaacctgccgccccccccccccagaagatgactcagaatccccaatcacacagggattctgagggcttaacgatgtaacaattgaaatctgatgtcagattagtgatcagcaccctcaaatagccctaatgacatgtttttggaagatttttgtgaaaaaaaattttccactcaaaaatcctggtcacccccctttggtcccgaatccaaaatcacttttatttttgtatctttttttaaaaatgtgataaaaatgccaaataaaatttatttggtagagcaaaaaattgcggatttttgtagtatgttatttttccaaaatgacttttcagaagggagttaagaatttttttctgaaaattcggatttttccagaaattctggaataactttttttcatttgaagatagaaattccaaataaatcccataaaattctcccgattttttgctatttttaaagctttaattcacttaaattgaccagtcctccattgagttatgaattttcgaatatttcgacaaattttcaaggaccaaaaaaattaaaaatatttttcgaatttttaaaaaatttcaaaa

SEQ ID NO: 6381 - DNA, 4909 bp, Heterodera glycines
aaaaaaattttcgaaaatttctagggggcctagctccaaaattttgaaaatttccgaacatgttgcacatcatccgatagagcttaaaaagctctacaattttgctctttggccatttttggctaaaaccaacccctaacgagttatgagcccgggactcaaatgtcccgctcaggccaaaatttttttctatttccgggaaaaaatcgaaatttttccgaaaaaaataccagtcgatagagctcgaaaaactatgttttggaagtggtctccgtttttctgggaaaaatcgttaaaaaatcctaaaattcaaaaacccgaaaacctacttttaggcctaactcgaaaaattttgaaaattttcgaaattttaaaatttggaaaaatcgagctcattaaactctacaataagttcgctggcaccccctccctcagaccaaaccctgacgtggtattcacctggtactgaagtgggaaaaaaaaattaactgagtctccgtgtctgtacgggtccgggatttggtctgatcaaaaaataaaaaatactggattatagaggacacttctgcggagtgccctcacagcgggaattttttgatccgagtttcagaaaaaaagttacgggcccgaaactgcaagaaaaagtgagaaatcggtccccgggactcagttgggcgtcgagaatttttttctatagttttcccggattctcctcaaaaagttgtaagacccttccactactttcagggcgctcccggccttcggccgggagattttgttttttgaaacgaaactccttgtcaatataacgtatatattaataacaaccaggtaaatcattggaatcaaattcatatttcccttgttctatttgttcataatatttttcaattttatttttcaaacttttaaccaaaataggaattcgggttctaatagttccggacattttcgtaagtttttaaattatatactctttgtggactaatgaattaatagggtgtaatactatacttctttcagatcttctccacttttttaataaattttttctttctcttgataaaacttttagaatgaatttgacaaatttcagtcgtttttcagggttagagttgagtgtttctcttacttttaagtaagcttctaaaattacttcctgtgatattctttccaaagaatcggctttatctaggttatttaaaatgcagtatggaaaaatagttattgtaaaagtgaatttatatacggttttgttttggtatgggaagggttcagtttttaaaatttggttcgttactttggaaattcctgggtaaatatgcactattggaaaggaaaagtttgcccttctttcaagctcggtaacaatttcttcgggtgttaaaaccggaatttctacaataggtacaaattcttcaacttcttcaataatttcttccaattgatcaaaattttcaaaattttcttcttccttttccagttcagaaattagtttctttggccgacacagtttgacgtttatttggaattttttttttattaacaatacgatcacagtatcaacaatagtgatcaaaaatcttggtatctgatcgcctcaaataatgttaaaaaaaaaatcttttttctccaaattgttcgcactagtggacggttcgtcttctagcgggattttgaatgtctttcggaggaattcagctgttttttgttgtccaatcaaaaaacggtggtgatgtgtaaggttgtcctgcagtttattcacaatgattaatgctttgtcctttccagcgcgactgttgtatgaaggactgttgatggcttttgccaactcggtgagtagtcccttgttgaaattttcagctttgatagcctttcccacggcttcaaaaatattttgcgtttgtttggtaacagagtttatacgcttttgttctgctctctcacaatcggccacggcacgattgtagatatcgtcgtgtgttgattcaagagagttaagttcttccaaaaatttgttgttaatttctggagagaaattcgaatggaagttcaaattgtcggtggcttcgtcctgctcaggaatttggcttgctttctgtaaagctcgtgaataactaataaggtcagtgttcctgttgaaattgattgttgcttgaacttctcttattacttttgacaattcttttgcctgtgcgattgcttcttgttgtctgagtttttgtaagacaaattgagtctcctttgacaaggatgatgtgtctacaaaattaaaatttattcagaatcagaagtgtctgaacgtttgaacaattcagaatgctcaaaaattttggtaaagtaaactctggcctcttttctttcagatacagaaatgctactgggatgttttgcttttttcaacaaaaattctggttttttaccagttttcggtttttgaccttcttctgattttccttccttctgttgtgctggttgttgctcaggtttggactgtttcgtgtccgtgtcgggttttggctcttcagttgattttcttttcactaaaatattcgtattttagtgttttttttttttttttgtggtttttgttttggttgtctgatttaaaactcagcgcttaaatctgacttttggttgaagcaccgcagctgtcagaagaaggtttttcagatgattttgcaatgagtttttgtagaacagatgaccggctttttgaacttttgatcgctgatcagtcttttgttattgttggtggtgttgtcgtttgccttcccgggtcgtggcaccaaaattgatgggatgcactggtcgatccaatcaattaatttaatattttatttgggatggggcgacaaaagacacaacgtggaaaatttggtggatttctgatcacaattgatcaatatccgcgatgcttcgaatgcccgagttgtgatgtattcagagcgagttgttgtccggcttgttgagtgaagagaacaataggctagtagtgtgaattggttgaagcatgcctaaactgaaaacccttcccctttttataccaaaattttttggttatttaatagcattcaaaatttccacattatcattttatggttttttcatttttaaattattttttatcgttttagttttttcttcctttttatttaagaaaggaaaacttttcataaacaattttaattgcttttacgttcaaccgttttattgtggaataaatttatttattatttggggcgttttattagattatttttagtttttattgcgagaagcatttgcttcgtttttatgaattcattttattttatttatttattttattttacttttattttatattcatttatttatttaatttaattttaaaaataaaaattttatgaaatgtttattttattttggatttatttttattaatattttgtattttcatgtaaaattcttattattttaatttagttttgtttttattaatagttttatattttttcggatttaatccgacaataattgcaaatataaactttcataaagcaaaagaaatggcctttattatgagcaacttttttgaaatacaaaccttaaaaatagggcaaagaacgaaaattctggaacaaaattaaatctccgttttattagtttttgtacgacttttgcgttagtgaatttcataaaagtcaaaaattggcctactttatgcggttttcttgaaatttagagctctaaaattatataatcgttataaaattatggagcaaaagtgcatgtataattgcaaatataaactttcataaagcaaaagaaatggcctttattatgagcaacttttttgaaatacaaaccttaaaaatagggcaaagaacgaaaattctggaacaaaattaaatctccgttttattagtttttgtacgacttttgcgttagtgaatttcataaaagtcaaaaattggcctactttatgcggttttcttgaaatttagagctctaaattatataatcgttataaaattatggagcaaaagtgcatgtataattgcaaatataaactttcataaagcaaaagaaatggcctttattatgagcaacttttttgaaatacaaaccttaaaaatagggcaaagaacgaaaattctggaacaaaattaaatctccgttttattagtttttgtacgacttttgcgttagtgaatttcataaaagtcaaaaaaaaatttgcctactttatgcggttttcttgaaatttagagctctaaattatataatcgttataaaattatggagcaaaagtgcatgtataattgcaaatataaactttcataaagcaaaagaaatggcctttattatgagcaacttttttgaaatacaaaccttaaaaatagggcaaagaacgaaaattctggaacaaaattaaatctccgttttattagtttttgtacgacttttgcgtttgtgaatttcataaaagtcaaaaattggcctactttatgcggttttcttgaaatttagagctctaaattatataatcgttataaaattatggagcaaaagtgcatgtataattgcaaatataaactttcataaagcaaaagaaatggcctttattatgagcaacttttttgaaatacaaaccttaaaaatagggcaagaacgaaaattctggaacaaaattaaatctccgttttattagtttttgtacgacttttgcgttagtgaatttcataaaagtcaaaaattggcctactttatgcggttttcttgaaatttagagctctaaattatataatcgttataaaaatatggagcaaaagtgcatgtatcgattgccgaataacatttataatcagtaaaagagaagatgctttaatataaggctattttttcaattgcaatcattatgtat

SEQ ID NO: 6382 - DNA, 5232 bp, Heterodera glycines
cgaactgccgtttggccttgcgccttcacaacggtcctttctaagagcaaggcgaatggggaattgaaatctttcaaaacttacaccgtcaggacgtttatctttaaatgtatgccggtttcggggaatcccaataattataccatttccagacgatccgctaccaatggtttcacattcaattaaattgtcagttaattttttaataagaagtcgggtgccattacaaagaccttttgaagtgtttaaatttacgagtaagacgacaattgatccaattttaagccgcagcaaatgggtgggcattcccatcggattcagctgatttagttgtgctacatcaaagtcagccgcatttacggcaaacgggttttcatctgttgccttgtcaactgaaaaatattcaataaagttaccaagcattgattgcgaaatttgagaattgttcaaatcaacaattctgtttgttgtagccaaaagaagccgcttaagcatttcgctacttggcatattaagcccttgatcaaacacccatgcaataagatcttcacgtgaatcgacgagcatgccttttgggattgcgaccgtgtctccatttaatcctcttccaatatcatcaagccatttaaggaactctatttcgtttggattaactcgcatgctttgcgtcaatttgtattttgaaaatattgggtaaagcggtgaggactggatgcatgctgcaacttgagctgcactaccataagaatttattacgactggaagtgattgcttccaatcaccggagattataacacattttccaccgaaaggtaagtgccgtttttgcatgcacaactggcgacagagtaaatcaatattttcaaaaactgtcctctccagcatagtcatttcatcaattattataatgtcactttctattatacgcctgccaaagaaactatcaaaaggaattgcaggtaattttccaggctcaacattaattccaaatttaaacgccgaatggaccgtggtgccacctacataaaagcgggtggaagccattccggtcgatgcagtgggaatgatttttgcgccgatttttcgcagttgaaataaaatataattaagcaaaaaggtctttccagttccgccatcaccacataaataaaatagacgagaattcgacgttttcaaaaaagcattttttaccatatcaaaaaatttttgttgttcagcattcaactttccacgttcaaatgctgttgtgtcaactgggtcatcatcatcatcatcatttaactgctgggggaagaaaaactcgttaagcccacgttgtggatcattcataattgaaatcactggggttggcagtccataatctttacattgtttgttttgcgcaactaataatttttctaaaagagcaagagcatggtcaatacgagcagtacgctcagcatctgtgcagcgtgtgtcatacatttgtgatttaaatttttcccagagcagggctccatcaatgagacatttttcagtggctccaaaaattagtatattagcaaacaattgacgcatttgtgctggggtgagcgaggcagcaccctcttccattgtccgaacccacacatcattgtcatcaataagccccttgagtcgggctgtctccagaaatgtttgacagatatgcgtggggtttaccatttttaattgttgcgggtttccggggaaatgttttgtcagtaaatataatgcaaataactcaggatttcgtggtgaaaccgggtaaattcggccaataattggttttctgttttttatattatctggacgtgctgaaaaagtacgttttttccaaaatttaccagatttgttgaatgaatactgttcgggcatacgctcaaaaacaatttttctaacatcaggatccgtttcacacattttccaatatgctgttaaaggtgtttcgggcaaaatgcctgcctgaacctgctgagcgacggacgctttttcacttggtttgtagtaaatcttttgctgaccgggcaaatggagtgacaacgcaataacggtatgagataatttagcatatttgagcgacatgatccggcaataggcctcaggggatgaacgatataacattctagcataataagcaggctcatcaatacctgtttttccattttcttcattagtctttacgtacgaaaaactgggacctttgaatggatatttgtataaatatttcaaatttgtgctttgcccatatgcatattccaaattatggtgagtttcaaagtgaaccaaaatataaggattgtacgcggacactcgtgaattatcataagttatttgtgtttttcctcttttaacagtcaatgtttgcccaccatcttcggtactcggacggaaataaatagctggtcgatcatcatgtaaaattgtgaatttactaaacggctttggaaaaccttttttacatttccctttatggtttaagcaatggcgcccgcagtcatggaactgatattttggcaataattcacgcactttacaaataaaaatagcccaatcagatttgtcattcttatttggctcgggaggaatatgtgcccatatcaatccgtcaacattttctggtattgcgagcagatcggtatgataaactcgatgggcatgcggaccgccgtattttttctgaaactctctgcattcctggccaatcatttttcccaaaatatttttcttatccaataaataatgaaggtgtcgtagtttgtcctcataaatgcgacaaattaaatcgggtctatcaacagtcctctgaccttggtgaagaaaatttcgagaaatttctggccatctgggatttgtcgtaaatgttaaaaagaatgatgcaaatcctggcctcttaaaccttgacataatagtagtcgcatcgtaaaatttatgttgaaagtatgcccgtgtcccaggctcagatctgcgaaacataacaacgctacctaattcttcggttgagttaagccccgcattacgggaaagccagcgaagcgcattttctggtaaagtactccgtaaatttaattctggttttcgcaaataatttgcaacgtttgtatcaatgcgagctgaataatctaaaataaatttctgactgaggcctccacccgcgctccaaatatggtgaaaattgttgtcttttcgcagcgccatacggtagcgaatataagttctaacagataaaaactgtcgtgttccacttttatcaactgaatcaagtgaacttgtgaccgataaatcgtcatcgggtccattttcatccgaatcaaaagcattttcatcagattcgacattaacttccattgcttcgtcatcgcgctttttatttttgtagttgtaaggaattttggtatgaaaaccgtcatcgccatgtggaaataatgtggggtaacaaagagaatcggtttgtgggtgatgtggttgaaatttttgaagctttccttcatcggtagtgatccaaatgccttttaataatggtggctgatcgctttcagcccagatagcaaataaagaattgccctcgtcgggtaagttggcttgtcttggatggagagaagggtcccttatatttaatggtgcttcacgagattcgaccaatgtcaaacgaaaattgagaacagcttctgggcctagctcgtccaaagttttttggtactgtgtatggaagttcattagctcttttgcaagtggatgatattttcgaataataaaatcaagttttcgaattgttttttcgtttactctgtcaccaccatattctgtgttttttgtcctttgcataaatgcagccatagggtcaagaatatacaattgtgcaaaagacggagcgaattttccaggtaataacccaatttttcgtgtgaattctccattcaataaatagcatttgtcaccaccaagggatgattcatgatatccaacagaaactgatgcaaacgccagcaaggagttatatacattttggtgggataaaaattcattagattccggatcttgccctgccaaaaatcttttaagtgttggtgggtgctcttcataagagggcaaaacaaccgaaccgtgattacaacaaaaactcgaagaaattttcccgtgttttttatctgcttcactatttaataaaagagaatgacagtgttcacatattttatcaccaatatttccagaatcataatactcagtagtgtgctttgcacgcacatccgcacaaggaattccctggtgctttatatgacaacgacgagtaagatcattaagaggagtttttgaagtaatattaagattatcaacagacgacagctcagtatttatgctttttagtcggagcgatcggcgggttgcagtactcataatactcgctgaatgtggtctcaaacgaacgtcaggagttctgtcaatatcgggttcaatgcaaataaaggtcccagctccatctctcgggcatgtttgttcagtaatagactccacattataaaaaggcaaggaatgaagacttgaagtgttctgacggacatattccacattatcactatttatcagcagtgccaagtgccataaaattctgtgcctttcaaaattaatgtttaggtttggaaatttcagtgaacaattatttaagtaggcctcagagtaaagcaaaacaaatacgccacagttaattccgtcatgttggggtgtaaattctgatggacttaaagtcctaattagcacatcatcgtgagtcagaccaggtgtcaattcacaaattccgtttttaattatttcaatccttctcacatcatagccagggtatttaggatcaaaaagccgatcaaaatgcggcaaagaatcaatgaaaagacattttaagtttttccggtcagatcgatcaaaaatgattaaagcgaaatgaccatgaaagaatatagtcatcaacaatacatcatagttctcagaatagttaaaacaattatccagcacattatattggaatgcatttggtccaatgtgaaaattttgtaaatcagtatattgtgggttaacactgcaacaattttgtcaattatttttgatgcaagataaacgttgaaacaatagactaaaatcatcactgaacatatcagtaggagaagaccacgtctcctttgatgagttctttatttattgactgaatacaaacacgtcctggggctacttgttgcgagccaggga

SEQ ID NO: 6383 - DNA, 953 bp, Heterodera glycines
  misc_feature (30)..(30): n is a, c, g, or t
  misc_feature (39)..(39): n is a, c, g, or t
tgaagatacactaacagaatcagagcagcntgaataatntaattcggtgaaatgaaaagattcgtgcgaaaaaacaggcattaatatttggttattttctgtcttttttggccgtcctgacccagaacgattcttagctggtcgtcctcttcttttgactggagtttgatttatgtttgaatcaatggacatagatgaatcgcgcgaatgatgtaaagaacccaaattgtcattttcgccggcaacaaacaatgagcacgggtgatatactacgttatcacgattataaagactgtttatatgccaaagaattctccttttttccaaatttatatcaatgtttggtaaaataagcgattgattgttcatcagccatgcctcagcatataagcaaacaaaatatccacaactgcatccgtcatgttgaagagtcagtttggaaggaggaagtttttgtattattatatcttcagaattgatttgacacaattcaccaattatatctttgacacgcaatacacgagcaaaatttaactcacttatttgcaacgaatccatgaaaaaagtgccataatttatgtcataaataagcaaagtccaatgccctgggaaattgagtggcataagtattatctctgggggcgactgctgattagaattaaagacattttttttcagattagataaaagtatttttggcatttgctggatatcagtatacaaggagtcaacaacaacaacattttttgtcgaaaccgtgctaatatagcagagaaatgaataaataaacgaatcattgagccattccgataaatcattccaatttttttcaatttgcctaaagccagagttgtcaaagtcattttggtaaagattaaggctagctttacgccatatttggcaattcaggttaatgtccgtcgcaaaaactatatttttaaaatcatgaccag

SEQ ID NO: 6384 - DNA, 1133 bp, Heterodera glycines
  misc_feature (65)..(65): n is a, c, g, or t
  misc_feature (1088)..(1089): n is a, c, g, or t
aattttacaaaaaattaaaaaaatggataaaataaatttttgaatgttctttataaatatcttanaatgaattattaaatattaaaaaccatgaatacaaaatataaataaaaataagtaaagtaaaagagaaaaaattaatttatcttacagagcggcacattatattaaatgaatttttcaaaaaataaatcccgggatatttaaaacgaattaatgaactaattagttattgtaattaataaacatttcgaaaagtgtgccatttttaatgggatgtccctttgcgatgagatagatgttgactgacgccctctaataaatgtcggcgacaacattcacactttgcccgcttttttccctgaggattatgtgccaaagtgtgtgccctcggggcatcggtgtggcttaattatcgcctgaggcaaccgagcgcggaatgaacacagaaatcacgggtgtccgtcccctcgcgcttaattaattatttatgatgaaaagcttatttgtcagcgttttattactggcaaaaaaaaaagtaaaagtaagaaaaaatttttttaatttaaatgaaaaaaatttaaatttcaatttaatgtacaaaaattaaaaatttgtaattaatttaaaattttctgttgagtgccaacaaaagagaaatgtgctgctcatttttttctgatataaacagataaaaatgttttatcgtggtgagaagggaggtttgaatgaatgaaatggcgtgagagaatatgcaaattgaaaatttatttttgttttattttaaaatggtcacgaatatttaattatttagtggaattacattttaatacaatttaaataattgaaggaaataatggtataatttgttgaaccaattctcggaaacatttctcattaaattccaatttattttgaaatcatgtccatggtttaggtcccaacttggctctttcatctcgggtttcgttcccgggattcggcttttttaaaataaaaacccgtttttttttgaaattctccgtcccaagtctcggcacccattttaggtaccgattttgctctaagcaggtcattatttcccatgnntgccgtgtctaaaacgggtcagtcaattcagtgtaatccttggc

SEQ ID NO: 6385 - DNA, 3422 bp, Heterodera glycines
ttttttttatttatttaaaaggcattttttggcgttgagttcatttttcagagagtgccgtctcctcttcagtggcttcttctgatggattcatttgttgccaccgcttcaaatttcaattcggctaacgcccagcaaaagtcaaaaagtgaaattttcattccgagaaaacatttatgtatattttaaaattacattaatttgtaaggaacaatgaattttagttcaacaaatttataatttcctttttcttaaaaagaaaatattaaataataaatttatttttaaatttttaaacttgaaaaataaataaataaaaaaaaactcaatttcaaatattctatttaaaattattaaatttaataaaacgaaatatttagttcatttttttgaattttacggaaaaatgagcaaaaattcaggtttaaactgaaaatttgattttgcgtgctgtgaggcgtgaattgtgaattaatttcgccttaagcgagcacatttttctccattgttattttcaaaattcatgaaatttgcgtgttaaatttgcaatttttatattattttctctttttttacccccctcccccggtgccattcaaaaaaaatttatattgcccgacggcataaaaaattggaattacattgcccccggggagcactaaatttgatggggtccatcgggcaaattgcccgaggcaattctcgtaaagaataaaacaaaacaacaaaaaaatgtttcgcaaaagctaacaacacaattttatttgctgctgcaacgttaaacaataagcaaataaaaaaaatgctaaaaataaataattttcgatttttaattaatttttttttcgtgaaatttacgccttacgcggacaaaagcctccattaaaaaaagttcaattaagttttgcctcgggcgtccgtcctttcattttaattaaaagtatgttggcgttatgttggtgcataatatatattgcctaaggcattctctaaaattaatttcaaaatttttttgattgacaatttcctaataaaaattttctggcaattttttttgtatttatttttcgatgtcatcgccaaaaacggaaaatttgccaaaaaactgtgaacacattgtccaaggcgttgtcaaactctcggccttccgtcttccaccaaaaaagtttttttatttataaatttttatatttaaaattattatttttttagttttcgtggatcagatggcaatgtgaggccattgtattccgatcaacttcacatatcggctaatcagccgtcaaaaagggcatttgcaaacggtgccagcaaaggaaaatgtacaaaattaataaatatttgggaaatatataattaaagtaaattaaaattgaaatttttgaaatatgtaaacaaaaataaaaataatttacaaaagcacaaatatttttggtaaatatacatacttatatacaaaaattaaattaaaataaaaatatttttaagaattttttaataatatgtacagaaaacactatgtagttagtaccttacattaaagaaaatgagattttttggtgaaaaaaatcaaatttatataaaaaaaattaaaaaatgttgaataaaaataagcatatttgtaaaaaaaaaaaaaaaaaaaactaaaagtaaacaataatttgaatttaaaatattcgcaattcattttctttatttgatttgactaaattttaatttcctctgaatttttggtgcaatttttctccccccggcccagtgctttcttcggccatcgccgaacgtcccctgtcctgctcgtccaacagtttgttgcgcgtggcatcgcctggcaccggcaccggcaccggcacggcagttgttggcccaggcggaaagcggcttctgtccctggattcgtccgtccatttggccgccgcggtgcacaacgaggatgaatggttgcgcacccagcgcaaattgggcaagttttggccaaacttttatatacactggtcagggccaagaacgaatctggcatccattacgaccaaatgccgaatccatagcccgaatttgaacaaaaaggtttcgaagtcttttaaacttttcgttcaaaactcgggttaaggactcgccattgagaccaaatttaagtcagataggtattcacgattagctctcatttataatatttattccctaccccaatttttattgaaataattttgaaacttttttttttgaacgatggatttttgctagtccctttttgttgaatttgccattttcccagttgccgaagctgctgcacttcggcgccaacgtgagcaggtggtgtgctgtgcgtcggtgggcgcttcctacgcatttttggcactttctgttgcactcagtttatccgtggtcagtaaaaaagcaaacaactttttttttaaactttaatttagattttttcctaaaaatttctcaaatatttaggctaaatggaaggaaaacttttggtatttttttattttctaaagacagggcaccgattaggacacactcaatcagttcacgctattgttcaatgggtcttgaccctacaagagtctcgagtttcttggaattggtcgtctcggctttgaattctccggaaattcacattcgagcaggaacggaatttctgaaaatttataagctaaaagtcaattaaatgttttttgacaacgaccctaaattgattgatcactctgatcagaggaaggaaattattttgctgatatttttaaggtgatcgccgtttgtttgtttctgcattcatttgtgccaaaagaatattaccagcatttgcgcaatgcttcatcatctcaaaatgctaacagtttcgtggataaacaattgccatcacaacagcattcggtgcttacaaatacggcacggaatacggtaaaatgaatttaaaattgttttatattttaatttaaatatttttaaaacaattttcgagtttctgccctgaattcatgatatacggctttttaaattaaattatcatttcatatttttcaggaagcctcagtcctggcaaaaaattctaattgacaggcagcaaaaaattttcaaaatttttttcaaagaagccatttttttatacaagacatattccaatgagcaaatctttataataattaaataattaatcaattaatcattgttgaccaaacaaattattacaaaatatgaataatgtgaacaacaaataaaacgcatttttgcaaaattccgataaaattaaaaatgcattaaattttcttaaaatcgtatgcctttttcgcttcggccccttttccatgcgtttgttgtccatttttggcactttgttgtggtggtgcccaaatggcactgacaattgactcggcactcatcggaatggtccaacgccgttggccgtcgaccac

SEQ ID NO: 6386 - DNA, 3837 bp, Heterodera glycines
  misc_feature (3815)..(3815): n is a, c, g, or t
taaaattcatcggcactcgcattcacaataatctaaaatttataagaaatttctttaatttcaaatattcgttttccgattttaacaatttcattttaatttaggacttttttttagccaaaaagccaaaattgggcaaaacaacacatagaatcatttgtttgtattatttttctgaatttttagaaataattagagaccgatattttggaaaaaactcgaatatttgaaacatgacgcaaaattcaaatcgccaggtgaatttcaggaaaataattcaaaaatgaaaaaaattcgcgcgttttaaacatattttaccggggcatccacaaaatttccaacccaatttggacctcctttcatgtcgaggcctgaaattcaaaaatttaaaataaatttacgaatgttttccctcacataaattccaatccgtccatccgaccacccaattgcgcaattggttcagaatgtcatgcccataggaccaaccgcgaatccaatcgcccaacaacggcgtgtgctcccaatcgaaaaagcctgcacaagcctagaaaaattttttgaattttttaaaattttcaatttttggcacttcgctggccaacaaaaatttgtcggggtataatttgtgcatgaggctcaacggatcgtacgtcgaatgggcatacctttgaaaaacaaattcgaacaaaatcatttaaaatttttttgtttaccaatggacagccagcccatcaattgcagttttttgcgggtcgtaaaaaagctaaaaaatcgaaaaatttcaaaaaaaaaattcagttttttggttacatctttagactccgcttcgatggtatgccgttggtcatcatgggccataattaccaaattttttgatgcttccgagcttttaagggctggcagaagcaattgagaagcaaaatcgctaaaaatttaaaattattaaaaatttaaaataaaatttcaattttgcctaattttttcaattttaccattgcgatttgctgtcaaaccaatgcgcttgccagctgagattaccgttataaacaataactaaaaaatatatatatttattaaaatttaaaaacgacaattaattaattcactgacatggctcattttggagagttaggccccaaaaagtcacattttgtttggcatattcttcaaaaaacctaaaataataaaataattattcgatttttttataattcgaacataaataaatgaattttctcaattttagccgacctcttgaaatactgtgcgtaggtatggaagtagggcccatccaaagtgcccttcattttggcggaccctcgcattcgtccgctcgttttcatccaaccgggcggagacctttgaaaagcataaaattgaaattaaaaatgccatgccaagggaaagatttaaataaacatcaaataaaaatattatttgtactttttatgaaaattttttaccatggcgacgcatacaaacggaggtcccctccggtcagctgaatggccttcaaaatgtgtgggatctgaaaatgttggcagttaattcagaaatttctcctttttgtaaattttaaatccaaaattaggaattcttcaagactcgagaccatttgcccgaaattctcaagaatttcttgggaattgactctccgactatttgtgccaatgccaatgccttactttctcttcaaagtcctccctggccaatgcaaatgtggtcagattgaaatcgtccggcgtgtccaaatacgaatattcacgggtggaaaagtcagagctggcaattggaacacggccaactgagtaaccgatgcctaaaacaggaaaaacggaaaattgaagtgatttggcatatggtaagagaggtaccgtaacccaaacagggtcattagtgccatttttgaatttggcaatgttagaagagtataatttaatttttttaaattgtcaggactgtgattctgtcaatattccatttgtaccaatttccttgtcaaaatacgtcttcagcagtgcctcgcggctccgttcgctcaatgcgtttaaatttacgcctgccgcgtcggtgaacgctccgccaaagcccaaaatgcgctgccgtttctttgacgcgtccacgcgcacttcgaattcagtgtcatcacttgcaccttctccaaaatttatttataatttttgttggcatttttaaattattttaccatttttattttcggcatttttaaatttggccaatcgatgggccaatttgtcgctcacataatacaccattttgttcccactgacatcgcccaatggttcgggcgagtcgcaataatcggacgaacaaacgcacacaaatgagtcatggccaaagctaattagttaaattaatcaattaatcattaatgaattgactaattaaaagccacacagtcaattaactaaattggtttacctctttttcttgcacggcttcacttcttcttcagctatgatcaaattttgaccaacaaaaaaaaataataaaaagaaattaaaaatttccattttgctctaaatatatttcttcaaatattagaatttgtgttaaaatttttatttatttatttttcatgggttcaaatcattcaatcaattatcattcactgatcagacggactcatggccagacaaattctttattgatcagaacgaggacgacatacagctgattacacaataaacgagtaaacagccccccccccacccgataaacgggcagtgaattaagtgcactaattgtgccaaaagtgtaacgccgccaattaatttgcctccattaattaaatgccttgcaaatgagaggataatggatggttcacaggaagggccattgtgtgaaaagcagcaaattaagcagctgctaaattaaccaattcgatttcctcaaaattattttgaaagcgcatttttcacggattttgaaaggtgtaaacttttaaaaattcaactattgttaatttattaagaattgaaatgaaaaaacacgaaaaaactataaaaaaaatttgttttttgacaatttaaatatttcttaaaagcatttttgaactttttaataaatatttaagttttctgaaaaaaagaatcacattacagctctgccaaatagaaagttatattttttcgctgaatgtatgtaatcatcaaatttgttatttttaatgcccgtttataagaatcattaatttcatggccacataacccgattaaatatggccctagggtttaatcgcaagcaaattaacttatagatcagactctgatcactcgtgactttactgattagacccaactttactccacttcgtataaaaattaaagtgattaaaaaatgattgatcagcccaggcaaataaatctggtcccagccgggtttttattctctcgggggggggggggtctggctgaaacaaaataaaatttttagggcacggtttgatcagacaacaataatttctgatcacagattcttttactttcctccatcaattaaaattaaattatgaaaaaacgattaatcaacccaatttttcattctttttgttctctcgggtttgtctggggctaaacaaaaaaaaatttttggcccgattggaatggttttgatctgatgaaatgattgatagggagggcacacacacacattgatcaatcattaatttactgaccagctccgatttggtcttaaggtgataggtcgaacttaaaaaagaatcaaagatgaataatatttaaaatttgttattagtttatttgtagataataaatcataattttcctcanaattaaatcggattaaacaatt

SEQ ID NO: 6387 - DNA, 3667 bp, Heterodera glycines
tgtgccaaactgggtgcgttacactgcaaatgtagtctccggcgtggatttgctgtgcactctgaacaatgatctgattgccgcgttgttgccatccgtgcggcagcggtcccccgaggcgttgaaaatgccattggacttcgcagtcggcgtagcccggggtcagacaagtgaacactgcttgttggccttttaacaatgaaatgaagttagtatgtgtcattgccatgcgttagcgttaccttcgtccaccagttgatgaggcggtgttacggatggctttggcatgtgggcaggtgccgcgggcaatgccgggggcaaagtggcggggtaatggacaaaggcgggcgcagcttgtggcgaggcttaatgtacgagaatggcaccccatttgaacacattctcccgcccgtgctgctgctgtatcctaccgattgtcagcgtggcatcgtccgtagaaatgtcccctttcaatcggccggtgcatcggtagtgtcccgtgtcctgctgttgcacttggtcgatcaccaactgatgtccaaactgttgtgcccgttcgggcaattcgggttctccgattttgctccattggatttccaccaagtcgggctgaaccgggaaaattggacaaattctataaaattttaatccaaatttattctttactttatctgcagaaacaattttgcatgtccatttggcacgagaaccttcctgaatggtcagctgttttggctgaagaatttccacacgaaaaggcactaaatgataaaagactaaattagggtaattagcattaattaaaattaattgataattaaaaatgtgacgtaaagaaagggaaagaaaggaggacactttaattgatttaaagaagagagaccgaccgtaggaaaataaattcgggaggtacagaaacccgaccgaaagtacagtaacccttaccgattgcaaaggcgagcaattaaaaaggccccgagcaacggagaagaaaatttgcagcatttggcccatcaccggcgaagcatcggaaagcgagcgaagcaaagaaaaaacaaagaaaagttggaattttgccaaaaaagtgcaaaaaaagagagaaaaaagtgccaaaatttattcaaatgtcattaaagcaagagaaatttttgaaattctgaaggggcagcgattttagcaatttaaattggagaataaaattctaaatgaaatcagagacaaaaggagggcgagagagaagggcgaatagagagggtgaaagagagagagagagtgggtgcagagaaggagagaaaagaggaaatagagagataggcgagagatgatgagaaatgccggacaaaaacaccgtaacagagacaaaaatcggtttgatttgaaacccttcagagagtggtaaagtgttcctcccccttcagcagcacaattggggagaccttcgaagctgacggaagtgggtttggaactcttcttcctctgaagtgttttgcttaggaggcactcaaaaaacagctgagaaatggccaaaaacacgcgaaaggcacaaaaaacgaacgaagcgaaaacaaattaaaaaataaaataaaaatgaaaaagcaaaacggcacaaaaaaacaatgcctaaaaatgcaagcgaagcgaaataaacggaagtgagtgaatgcgttattatgtaaagcggcgaatgttctgcgcatcggcggtggtcagtttgtgaaaaagcggtggcctcgcacgcggtagcgtttcggcccggtgcgttcgacttttatgccgccgcccccgcgccggtgctgcgcgccattcggaggccgcacaacgccaatgtcacgccggccatcaccaacaccaacaccaaaagcacctctctcaccgtcgggtcccggcacgaactccacttcagacggcttgtgcttgccgatgggctcgcacttgcgcccatcggcggtctgaccaggcgtataaccgggggcacatctgtggaaaaaagtggcggaaatggaaagaaattgaaatggcatttagagaatcgggggaagaaaaagggcaaacaaattacgaaagggcaatgtaattacgctgatgctaatttgcttaattggacgcttaaatttgccaagtgtatgcaaaacgcactcatcacaaagacggccagcaaagcccggcggacagttgcggcattggacctgtccacgcgcatccaaaaagcattcggcggtaccccttcacataaaacgaaatgaatgaatggcactttttgcagccgaaagtgtggcggcactcttcaaaggaacttacgggcacgggcactgcgtgcagtcccacggcgttccctttgttgcgtcgccgtaaaagccctttttgcacaattcgcaatggaacccttcagtgttatgttcgcacagctgaagagcaaaacaaatttatgaagagtctgacgattttgcttatttaatgagattagtaattaaatttacaaaaactcacaatacaacgtccgtatgagtcgcagccgcgcggcgaatggttgtggcaatcgcagcgcgggcgtacaaccgcgatctccggtgccggacgacagtcgtagggagtgccacgacgtgcgtcgccaacaaagccgggcttacaacgctcacaacgatcacccttagacaggtaagttggtgattagaaagtttgtcggggattaaattaaaaagaacccttcaaaaagtgccggaaaattgacattaaatttttatttttaaatatttatgaaaaaataattaattaacttagaaagagagagagagagagtggattaattagcaaaaataaacaaattcatctccaaatttgggatttattaatctcattggcagccttctgcccgtgccaaaaattagcaaattcatttgaatcaaagaataaacttgctaattctaaggctaatcgtcaattcctatcagagtttctccgtgtgttttacctcagtgttgtgttggcagtcaatgcatgcgccgtactcggcatcgcattggcttgcatggttgtggcactcgcacttttcgcacatgcccaagtagggcccaccgccggtgcgcgagtagcccggggcacagtccttggcgacggatttccgattaatttaatgattcctctcgactaatttttaatagtttctatttttggtatttttcataccatcgttatctcccattttcataattaaatcctcttgcccttccgtcccactttcattcatttgtcgtattttaatctgttttgaattttttcccccaccgctctctttcccttttttatgtctgtccccttccctccctccccaatgccaatgccaatgccaatgctttattaatccccatttctttataaaccggaaaaaaaaggtattttctgctaaaaagcggaaaaaatttttgcctatattttataaaccggaaaataaatgtattttctgttattaaacccggaaaacaattatcatttctgttaataaaccggaaaataaatgtattttctgctatttaaaccggaaaaacgaatggtatttccctttatatacccggaaaataccatgtattttctgttaataacacggaaaaccaattgtaatttctttttaaaccggaaaataaatggattttctggtattaaacccggaaaa

SEQ ID NO: 6388 - DNA, 2911 bp, Heterodera glycines
  misc_feature (2825)..(2825): n is a, c, g, or t
  misc_feature (2839)..(2839): n is a, c, g, or t
  misc_feature (2874)..(2874): n is a, c, g, or t
aggattattaagaaaatgtttgtaattgctttagctcagtggcaatgcgtttaatgcgtaaagcttgccattggacattgagcggacgacgcaaaagtcaaatggccaaattaaattatttccatgcaaataattgtttattggcatgatttttaaatcagcattaggaaattaccctccattaatttgttattcgcaaattgtttgggcaaagtaaacttttgaactaatttattaatgatttgttacgtaaatcccttatccgtccccctccccaattaatccgtaggcattttctttttaaacgtttctctccccctccccaaactcgcttctctcacctcgcatgaactgccaatgtatccagctgggcattggcactgttccacgtccaacgcaccttcgcccgtgccgtaagcgtccgccgtgtccaaagaggcggagacaagcgacgcttgcgagcactcgcgcatgtaactcattttgatcagaagcgcgtccaggtcggccagcaccatcatgagctgctcgcgcgaggcggagacgccgttggagtggcgccagccgagctcagtgatcggaacctgaggcggaggagggcattttccaatgtttgccgccccttctctttgtgccgactttacctccaccaaattgggccggtccgcgtgcacttgctgcctgctcacatattccagctgaatgttgttgccgcggatgatcgcgtccgcgtccgggttgagcggcccggcgccggagaagcggaaagtgtagcggagtttgccaccgtaggcggtcactttgtcgcccagaaacttttgcggtaagctccagtatagtgtttgaccgcgtgcctcataaaacccgtggaaactgatggatccatcgtacacctgaggggatggtaccgtatgcacaatgcgttcgttttgcgatttgctttcgctttgctcggcgaacctgcggttgcgtcggcggttgtacggactgtgcgcgtccgacgtggtcgcctccaattggtcgcggtctacgcgcgcataatcgagctcgactcggttgcggcgccaatgcgaactttcgcacacgcgcgtgacgcctgagcagaagcagcgcaagcacccctgggggttttggggcgacaaattgaacgcctcgggcgcacatcggtcgcaagtgacgccttcaaagatattgttggggacaaagcaaaaagcaaaattgaaaagcaaaacgccgaaacataaaatttagcaacaaatttgcgacacaacacttggataaatcagcaaaaagggatttggccgagttggcttaatcccaaggccaaataaacgcatttagcgctttagcatttgtggcgcataaataatccctgcagcgttttccaaggacaatcaaaaggcattttgtctaagctttgcataaagctaagtgaagttctctgtccagactctttccctctccatttttctaatatgtgcatcataatcacaaaatccgctctttctcctaaatccgcttttcctccattagacttttgtccccccggcacttttcctgtcatattttttccgttcttccgctccaattacactttcatttcctagaatttgactttttgtccttctcaccgactacattcggcttgcaatcgcatcgtctgtcgtgttggggatgggcggacaatgcgccggccgagtcacacaatggccgttccggtggctgccgtgccgccacgcaatggcccaggtagggcccttggcccgaccgttcgtagccctcggcacactcttcgcaggaagtgccgacgtagccggggggacactcgcactgctccacctccagcgctcgttcatcttgtgtgtcctttgacacggcaatttcccgagctcgtgtcgccgaggctgaaaatggcatcaaaattagagagggggcggggcaactgccgaagttataatttgacgagattttgctgatgcaaattttacgagagattccttccttttaatggcatggctttgcaaaaggtgccatttgtctcgtacactttgttcttatgaataattagagagagatgcttatacaaaattagtaaattctttgaattttttcctcctcttcagcaattaaaattaaaatgcgctcatttcccagattgattattttatttcatttattctcttctcatctttttctccttttcccaattcataatttattctcccccattttttgccaaatttttccaaattgggtaatacaaataataataactcgcgcgtcgttttccccttattttgtttctatttgtgggcacacaatcacttgcccacttatttatttattagttttttggccagatgctcttcgtcgtggttgttcttctgttcacccccccccccgtttttgttttgtgtcatttcggcatttttcacccctttggaatgctttcgtcataattcccctcctctgtcgacaacattttttgtgtttttgatttatttcgtgccatttgcctcttcggcgccgaaggctaattctgctgcaataattcactaactccctcagcttacgtcagcagtgcttctccccagtgcttctcaccccccccccctttcctcgtccattctccgcttttttgtcgccgcctttccatccccccgcggattttgcgcactgacagttcgaaatacagcagtacaactgtggtactaagaacaaaactacgtgaaagtttaaggaagtaaaagcattttttcattgaggataaataagaggaattcgcattttaatacgggcatttttgattagtgccatggtccggntcgaaatgtgccantcctcccccccccctctctccctcttccacccggngcaatttactcgttgtccgccgcttttacattctaaa

SEQ ID NO: 6389 - DNA, 945 bp, Heterodera glycines
ggtaaccgaagtcccgagaatggaactcattcatgtgccatgtttgtcccggtgccaagcccttccgtatttgccatcatttcttccaaccaatgcttccatttttcgtcatccgaccgttgaatttgccgcgtcccttcccattttcttcgcttttttccggcgttcatttgaaattgaaatttttaatttatttaatttaccattttaagattgattatcccactcgtaattattcattgttctgtcaaaatgtgcggttcgatgtgtcccccggcgctggccaaacttttgggatggcatcgtgccaaagggggccaacgcggccaacggcccgagtcgtttttgacagcctacgaaatggagcaactgccggtgatgctgaacgaattggaaaaggccaaccgacacttttggcaaatggtctgctggcgatggagtcaaaatgagcagaaagcagcggccgaacgaagtgcgaaaaaggcgagacatcagcagcaaatgcaacagcagcagcagcagcaggagacgacgagcggagaaccgagtccaaaggacaaaagaaaaggtttggcattgtgtcttttccgccaaattaagttttaatccaactgttttaggctgtcccgacgattcgtacgtgaacggatgcgctctgcgcgagttggtccgtttgatggcgaagacaatgtgcgagaagggcacttttgacgcgcggacagaaacgatgctgacggagttccgcgcgcgcattttgggccaacggaacgcgtcgatgagagaaacgatgggcaaagagagcaaagcggagaggcggcggaaagagtttatgaagatgaggaccatttcattcaacgggggactgggcgaagggattggacggcacggcaaggagcagcaacaacaggaaaagggcaagagttccgcgtccacatgcgcctcatc

SEQ ID NO: 6390 - DNA, 4047 bp, Heterodera glycines
tttggtagtgaagtgtacattttctctgggaattagttgtcccagtgcttagatggcattggttcgagtttataccttgttttttagacttagctcatcaagagctttcgaatgataccaaatttgtccgaatttgagcgttttaaaaggtcaggagccctctttttcattcaaattttcgagttttaaaccggttcaaaaaccggtttaaatgcttttccgagcccaattttaagcttttctatcgttctcagcacctaagaaaacctataaaagtgtttttgtgcgattttgagccgataccgtattcggcaattttacccaaaattgttgtgcataagaaagcattttaaaaatgtccttgtttcttcttttcctcctcattccattctctcaagcgcccattttttttgcagtcattttgttcctgcaaatttcttcagaaattttgcacgtttattgtttcctttttttctaatgtttgttttttcaaattacctcattataaaaaaaaacattttttccaacgcaataattctgccctttgtgtgacatcattcgaaatacgacatattgtgctaattgccacaaaatgaacggacggtaattaaaaattacaaattgatttgaattattcaaataaactatttccccgcagttcagctgggtttgcagcaatgtttggttggacacttttccgttctttgaccgtcctcaactcggcctcaaattggcacttctttcgccccgttttgatgctttagtggacatgcatttcgatgccaaaagcaaattgacaatttggagaccaatcatgattatcaaggacagtgggcaatcatggagcttactggtcccattttaattttctagtgctattttaaggtgctgagcacgaagccggcctaaaaatgtccgaatccgggttcggtgttcagaattggtcataataaggccggattcatgctcagcaccttgaactaatgctagaacattgtttccaagatttaaaaaaaaaaaaaacgcgaacagtaaactccacgatttccagtacacagcggcgccaaaattatctgtttttatcgatggtatcaattctgtgcaatttccattgcccgaccattcgctgcccaataaaattcgctttaaatcccttcatatttggtaattcaaaagcattatatggaaataaaagcatcattcccttttaaggtacattgaccattccgtgatcgcttttctccgtgccaatcagcaaatttgggacaaaggcaccaatttgatcttgagtattccttttgcaaaagatgatcagccaatttggcgtgtttttgtccgtgaaatttggccaatttttacgcaaaacattcgctacttgagcttttacaatgatggcctccttttggacaatttacgtcgtcgcatttcgccaacaattctcactgatctcaacattaattcaatcagttccggctatttgttgcccgatgcgactgatgattttgacgagccaaatgcaattccaactgctggccaaatgttgtcaaaatggttgcacactccgataaaaaatggacaactgaagcgattgcgttgctttgtgaagccacataatatcgaatgggacaacatcaacactttgaaaaaggtgggccatattttcgttaatcatctgattttgattgcatttaatggccgttttccccattgttagaaatttctcaatgccaccacttccgttagctacaaaattcaatttattattgatccattgtcaacgcaaattgtgccatttgaattagctaacgaacggaccatggagaagctgacactgatcaaaaaaagcggacatcgtcatgaggaaagatggattatgaaacggtgccaaaatggggcgacggcgacgacggatcaatgggaaggcgaaaatttggacgatttgaacactgtcgcctttatgtttttccctgccaaggaatgcgttgggtgagcaacaaaaaaaagcattttattttgtttaaaaattgtgccgaatttttaggcgtttgtctccacgtcgaaaatggtgtcaaattatgtgaaagtgatttatgcatttgagaaaaggtcgatcattttggattataatgatgaataggagtgatttgatcatttttaatgttcgtttttatatcttcgtttaaatatattttattttatctcgtctcgacgcatccctttgatatgtgtactaggttgcgtccccgaccgtcggggttggaaaagtcggggttggaagcgtcggggtcgaccacatcgttcggggtcgtggtttttcaatttttgccttatgccatatagtcaaaaaacttacattatttttgcttaaaatttttttattattcattaatacttttatgtacttttttatttggtaaaaatcagttaaaaaattgcattttaattctttaattttcaaaaatttttcgagccggcgcttactgacaccgccggacccttgttcccgaaaagttttttgtttttcaaattggcgatcactcttgaaatgacacgcagacccggagcgacgtttgatgaattcattgcacaagcagtacgagcggaagcaacgcaatcggttgccagaaactcgtttaggtcaaaccaaacttttcaacggaaaatgcagaatttttcatattcatccaataatgtgctatcaaaaatccataccagtaattggtcccgaccagaaatgaacacgaacaggccaactgtgttgggacgacccacaattcaaataattgtttatcattgggtccgttctttgaccgaccaatattgatttgttcccctctcccatccaattccttccactcatttccccaattcattccttcccaatttgccttcgcattgttttccctcctatttttactccattcctccgaccaaatatttgtattttatttttccattttcttcaataaaaatattttattgtgttgtccaccggcacaacaaactgtagccgcgttggtcacgtatctcgaaattgtacggttccaccaaaatctcgaccctcacaagagcgccaaaaccaatttttcaaacaactcggaacagggggcaaataacgcgcctttaaattggaacaggcaagctccaaccaaaagcggaccacagtttccggcgtcaagaaattttcttcgccaaaattacctcgttgagcaaaacaacgaaccgcaaaaacggaatgatttgctgacaggtgctgtgaatgctgaataccgaccgcaaaattgaaaatttctcaatttttttcttagaattttcataagaaaaaattttctaagatttttttctttaaaaatttataagttagcaattaaaaaaattacccattctacgaaatttcattgtacgaaactccacagtacgaactacccatgtacgaaatgcctattgtacgaactgccatgaccccggacggaggtgcccaaatttctctgatttcagctgagtttttcgcacaaattatggacatggtggacaaaatgagatcatttcttactcggaaaggcgcattgtggacataaataacaaagaagtgaaatgttacggaactgtttgcctcccaagttagaggatcggaaactgctagaattcgaatgttcgttgcccagtctacttttggatacgatcttctttttggaacaaatgctttgaatcaattcattttaccgaaaaattgggtgttgtcccaattttaatgtcacacaatgaggtactaattaggtttgggtccccttttttggtcaaattttttcaacaatttttttttggttaaaaacacctgaaaacaaatatccgggggttttcgggcttgctgatcacgaatacgacatccatttcgatcaattcgggattccgaattcgaacaaaaagtcgaaaagtcacatttttcgattttaggctaaagatggtttaacaatgttttattgaagcactgatgactttaaagttcatttgaatgtatttagaccttgttcgatcaaaaaaaaaatt

SEQ ID NO: 6391 - DNA, 3582 bp, Heterodera glycines
  misc_feature (3477)..(3477): n is a, c, g, or t
  misc_feature (3493)..(3493): n is a, c, g, or t
  misc_feature (3530)..(3531): n is a, c, g, or t
  misc_feature (3556)..(3556): n is a, c, g, or t
  misc_feature (3573)..(3573): n is a, c, g, or t
atcaaaaatcgcgaaaaaggcactataataggcaccaaaaaattgaaaaaaaggcatgaaaaggcacgaaaatcccgaaaaaggcatgaaaaaaggcattaaaaaattttttctaatgttttttaaggtgccaaacacgtaaacttaaccaaaaacttaattctggtcatttaaatgattattaaacatttaataattttttttgaataaggaaaatttttaaaccgaaaatttattatcaagaaaaaaaaatgaattttggcgatcaatttttgagaaaatttttcaattcttcggggtatattttcagaaattttttcaattcttagggatgtattttctgaaaatttttcaagtcatttcttaggggtgtattttcccgattttattccatttttaatggaattttccggaaaaaaaggccaaaaaaggcaccaaaatctgaaaaaagcgccaaaaaaggcaccaaaacagcaaaatgccaaaaaaggcatttaaggcacgaaaatccgaaaaaggcaaaaaaaggcaaaataaaagtcaacgtagaaagctcaaatcaagtggaaaatgtgttatttatgcttaatatatcgaaactagtgcgcagaaaaaaggcatatgcctcaaaatgcggtctctaatcatgttcttctccaaagtcttcatcgcggtcattgttgttgtcgttatgctcacattgttcagaagttgtcgcgttttcgccgtcgttgttgttcagaaacttgcgtttacgacatttttgaagaatttcaattttttcgattaattttgtttataaggcaattatgatatatttatatatatgtataatatacatgtaaatagatgtaccaaaataaataaatttatattttttaatttgtcgggattatgactcattttggcttagtcgggatttcgacgcgtcgggattttgacagcgcgcccccacattgattattctaatttgtacttacttttggttaattttataactttttttttgcagtttttcgtgacttgaattcccatctcctttcatcaattccactttttcatgactataaaaatggttgtttttttgatttgcctctcatatctaataaaaaaatatttctaaacacaaattattctgtcctttgtgaaattgtgctaattgcctcaaaaatgaacccgtaaggaataatttaacccatttaccctcagttatttttccctaatttagctggatatgcaacgacgttttgatggatattctcccattctttgaacgtgttgaactcggcctcaaaatggcacttctttcgccacgttttgatgggctggtggacaaacatttcgatggcaaatcagaattgacaatttggagaccaatcttaattcacaagtataatgtagcggtattatctgtgtctatcgacaataccaattctatgccatttccgttgcccaaccattcgctacacaacaaaatccgctttaacaaccttctgattaagtaaatgcgtaattatctgtgcgtaatatgttgttcccttttaaggtacattgaccattccgtcattgcatttctccgtgccaacaagcaaatttggaacaaaggcaccaatttgtggttgagtgttccttttgcacgagatgatcagccaatttggggtgtttttgtccgtgaaatttggccaatttttgcgccttatattcgccacttgaacatttacaatgatggcctccttttggacaatttgcgtcgtttcatttcgccgacaattctcactgatctcaacattaattcaatcagttccgcttttttgcccgatgcgactgatgattttgacgagccaaatgcaattccaactgctggccaaatgttgtcaaaatggttgcacattccgcgaaaagatggacaaccgaagcgattgtgttgcatgcttgcttctgctggtgatgtcaacaatttcaaagaggtatggcaatgtttttgttaatcaactgattttattgcatttacactccattttttaattgtttaggaatttctcaatgccaccacttccgttagctacaaaattaaatttattgttaatccaccgtcaccgcaaattgtgccatttgaattagctaacgaacggaccatggaaaagctgacactgatcaaaaaaagcggacatcctcaggaggaccgatggattatgaaacggtgccaaaatggggcgacggcgacgacggatcaatgggaagacggagatttggacgatttgaacactgtctcctttgtgtttttccctgtcaagggatgcattgggtgagcaacaaaaaaaaaatcattttattttgtttaaaaattgtgccgaatttttaggcctttgtctccacgtcgaaaatggtgtcaaattatgtgaaagtgatttatgcatttgagaaaaggtcgatcattttggattataatgataaataggagtgatttgatcattttaatgttcatttttattatcttcgtttaaatatattttattttatctcgtctcgacgcatcacttggaacacggacaactgagtaccaaggtcccggttttgaccgggacctggatattcccggcttttttcccggttttcccagccaaaaattcccggtttttcaacccaaaaagtcccggtcgtgcccaaatttcccggccccgctgcactctagtttttataaaatcatatatgtaggtggttttcgaggtcgctgcagattattcttaggggtgtatttttcgtttttattgcatttttcataacaaatttttattcacaagcaaaaatggttgaagtttttttcaattatataaaagactagaaaatagttgctaataactcgataagtagcttaacgaaaaataatatgttcttagtacgttttaagccatagaagagagctcaggaaaaaatagtgaaaaaaaaattggagccctaatgacaattgaaaatcaaaaaaactttaaatattttagtcggaaagaattacatatcaacaataatgagcaaagaacagcaacaaaattatgtatcagaccaatttgtccattcaataatatccaaatccgccgatcatttctcaattatttttcacttccgaacatttcgacggttgagagaatggcctaaattaagtgcaaatttgaatttttcggaacatgttaaactttcgaatgataccaagtttattattggatttggatgctaaagaaaaaagttatagccaaaaacataaactttattgaaaatctgagacagataacccacaagtacctaaatgtgcttgaatttacgaaatgctaaggcgtttaaagcgaatgttcatgcgcaacggatggtcgggcaacggaaatggcacacatttgccatcaatacccacagatacatttggtttgagtccaacgcccttgtgaatatagacacaacgccaaattgttaatttgtttttgccatcanaatgttggtccactanaagattgaaacgcggcgtaagaagtgccaatttgagnngcgagtgagggacgtccaaaaaggngaaaacgtccatccaancgtcaaagc

SEQ ID NO: 6392 - DNA, 6592 bp, Heterodera glycines
aacaaaaacaaaaaacatgatgtctatcgttgtgataattttttttgcatttcttttaattgcatttttgtttttgcacattagtttgagtgaaatttgctgaaaattggtaaaaatattttaaaatatgtttttgaatgggcggcgcaaatgtctattttttcttggcggcgcaagtgtcgaggcgcaaattgaagcactttttgacaaaaaatttacataatttgtttgattttcttttagttattacagaattatctttaatcacaaatcaataactaattgagatcagtcataaaaacgcaagcattctcgaatacaatgcattaatatacgtcaccccaatattgacattataatattgacagttttattcagaagaataataaaatcttcaattgtaaaataaatattattattaatagggatggcattttttaaataaatgccaatttttctgtgaagccaaactatgctctaaaaacatattttccactttgtttgggagcttccagactcaagtttataatatagatagttttacttctttcgatatttttcaaaatattaccattgtatctattttggtacctttttcggcacttttcttacctattttaggatttcgtaaatcctaatcacaaaaagaatacgaagaaaattgtttgtaagtttttctgaatcactcactgataagattatatcgcaaaaaatttaccaatatcatatccgggttcaagacactcgccctttattggaacttcaaccaaaattgtccacttgttgattataaaaaaaacccaatttttagattattatttttttctgctaaaaatgctaatgaacttcatgctatacatttttgtaataattttatgtaagtattttaatatgaaaattttcatattagattaaatatactggatagaaaatattaatttaaaaaacaatcaaaaataattaaaatatatatgttttatgggcatgttccttgaagaaaggggcttataaacagtaattttttttttaattttctttttgattaaaatttttagtgcatttaaatgcatatttggccaattatgaaataattaaaataaaacagaaattattccctaaggattgatattttaaattttcaaaaaagctagcccaaaaatattaattttttttacaatttggcgacaattaaaaaacttttgctattaatgaattaagctaaaaaagtttgttcaattttcctctttccccgcttccgaccccccccccccccacctattttggggcattttgcgggcgaaggtgaggggggtcgacttctgcccattttccatctatgctttacaataaaaatgtggcgcataatgttgccggaaagccttcaatttaaattaattaattgacgcagttgggggagggtctgcgccgtttgttccgatttagccgtcgccaattgcccaatttgccgcccaaaaattcgcaccaaaaatactccgcaaatttatctcaaactcaaacttgggtaattaaaccctacacttacaataaatgtgcgagaaatataaagaggaggccgtcgctccgccgatggtccgatcggcgtttttgcgctgcctcgggcgaccttcacgcgggtaaggcgccacatccgctttttatcgctttctttcccctaattcacgtgcccgccgtcagccgacccctcccttcacccctttctttccttcatcgtttcccgtttgccctaattttctcatcatttcatccatcaatcactcctcgttcgctacttcgttcattcctccccgtcctccccatttgtccgctcgacggacattcgcggctgacgttcagtcgcgacattcccacgactttgaaaacgtcgttttgagcggaacgcgaccatttgtcgtttcagatccatcaccagcggggacggctcggggtcctcttgttgcgaacttgccgtttcattcgctctcatttcctggggcattggaggcggtaccagctcaattgcttcaatccttgaaattgccggtgctcgccgtgtgcctcgagtagctctgttccgctgcgtccactgatttcccgtcaccaaattgcggatggtaacgatgacgggccccattaagtagacccataccaagggtatcaggacatcgcgcccaaaaatgaatgtgacgtaaatgcagcatgccgttgtccagtaggagacgagcagccgaagtttttccataaaccattcttcggtgaggccaatcactccgttcgggagagctcccagtgtgagcgcacgcgccgttttgtgctccttctccttcgacttccattgatccaaacgcagccattcatccaagtgcgcaaatagcccttcgcctgtttcgttgtcgatcgtccatcgatgaaaaactagcggcgtgatttccaacaacgatttgtctccagaggcttcgtggatctcagagatgctgctggagtcgattttctggatcgtagcggtgcgtgtgtcgattttgatccaattgctctggctcagttgcagataatggtagcggaaatttccacaatctgcgaatggtgatgacgctgtgaggatgtgaagctccggatccaggaatgcgttgagcgtcttcttgtcaatgcggatttggaccggaatgtagcggtaacagttgttgactgcctgatagtccacattttgcattgaaaactcagcgcacgagaagatttgcatcgtgtcttcgtttagccacctggccataacatccttgcgtcgtaaaagtcgtctggcctgaatggtcggatttcctcctctggaacttctgcggcattccttggaaaaaagctgcgcgattgatcggcttgtggcgagttgtcctgcagttaattgtactgcgagttgctcctcctggatggctctttttcccaatccacgatcgttgacgatcttcaggtactcatcctccaggattccaaacgattggtccgacaagcgaattggttttccgttgcatgctgtttccattttcgcctctttgctaaacgttagcgcctgttccttgcttttggatatccatgttccgcctgcccaatccgttgatcccgtgtgctctccgtccatactttcgacgaaatggtagtcgcatggcttacagctctcgttgcactccgcgatgaatcggagtcctggattttttttgatatgcccaaaatccaagtcaactccataaattcgtcgatattcatcgatgtactcctgtttttgttccaatgtttcgatcccctccggaaagccgcttgattccacctatgaaaaaaagttggataaaaacttttttttaattatactaccttgagcctgataaattgccgcacatatcctttgaaaatctgatcactccattctgcgtaatgccaggccctccaaaatcggtcgacaatataacccatctctaacgctttttcgagttcaatgtgagtgaagttgccagtgaaggccctctgctgatctgtgtggttgcacttgtgcgaacaccgtgtcacacttttacggaacaaagctgcacatcgatggcagcagctgaatagtaatctttcgtcaatcttcatcggaagtactggtatttgtagtccacgaggagggatgacgcgaacacggtaaagacctcggtagcttaaatgctcaggttttgtccaattgacaatcatctcctccgcgctaggatgaacaacggtaggaacgccaacgggataatcggtgtcatagttgacccatggatatagtgagacaatgtcgaagacggagatcttctcgtcctctgctgtttcagcaaaaagtcgcaatgggccagttcgtctgccgcaatatgcaagtctagggtccagaggtccacgttcattccccaagtcatcaaaaaactctttcatctcgtcgtttttctttagctggtcatttatttcacactcccagacttcttcaacttgtaaacagatcccattatcgtcaggctcgcgaagttggcgaagacggtcatgtgttgtttcattcagctcacgacacgtctttccatcgacgagctcctcattaggtttgaaacatttctcacatccatgccaataacatcctaacacttcgatgcaccgttgttgtctctcaatccatccatcaagtttgaattgtttccatcgtttttcgcgtccattgcccgcatgctggatttcaatgccttcactttttgcccgccagtccaaatatttgattgcgatgacgctggctctgtcgtttcgttcatagcccagctcggagaccattgcaatctgatcttcttgcataaattgaaccttgaagatgttcatgcaagcgctgtaaaatgaaaatgataaaagagcaatttatgttttaaacctcgctatggtacagctaattggcagcacgtcaaatccgtccgtaatttcatccatcaaaatctggcggaatttaaccaaagctttgagcagaatttcggtgtcattcagacagtatgcccttagctcatcgggcaagaagaatggcgtctctttgttgtcgttgtaccattttttaaacttttcgtacttgtcagccttcatcgtgccgggctcatactcgctttcgtccggaagattttccagtcttatggcgtcgttctcccttctgttaaatgcataagggaagaacggtttgtcctcgcagtcaagattaaaagttttttttaattcggcgagcgctatcggcataatcagacaggagtcacgccatatgagcattgaatgctttcggctatattggacgcaaattcgaaaatttttagtccgttcatcacgcattgccataggcttcactcctattatctgaatttaagtttattttctcaatcacatcccaccattctttttctcgctccagcactctattgttttgacagcaaatttcacagtcattttttgactctgacgattcacagcaatcggtgcacgtaatacgtgccgaaagaaaattgacctgatgtatacgctgacagtcgtcctcaagttgttcaagtcgtgtttcagtatcccagacgatgatacgatagcgctgtttttcttttggtatctggatccttttgatgaaacaactcgtcttttccgcgtgataaacctgaaatgatgcgcgtgtttctattttttcaaatagaatattctaccttgcatcgtttgcaatagcttgtatagcatttgtgtatctcgccggtatctgaccaatgagtacgattacagagagaacaacgtttaatcactctgcatgttgacccacggtggttttcataacatgtttgtgaaaaaaagtatcggttacattccgggcacaaaatttggatgccttgctgttttgagcatggttgttctggtccaactgaaaaatttcagtatagcaaaattttaacaaattttaaaatctttagcacattgcggacatctgctcttacaatgaaatgtatgtttagcgtcaagagtgtacgtacactcgcagtctacgcaatatttccgaccaagtttgaagaagcaatgaatttttttgatcgcatcataatgattgtcggaccgaaaaagcgtgacgttaaaacgatgtcctcccgctcctttccatataggccgaggtagctcttctggccggtcttcaaacaacacaatgcgatacgtcccaggaaaaacattatcctgaaacatattttcagcaatttatgactaaaatcgtataacacttacccagtattgttgaacatgctgtagatgttcaattccaaaagaagtttgaccaatctggatgccagatgcattcatcaactcttcagctgcagttcgcattcgttcattgtttgataccaggcgattgaacgcttcgtagtttttgcaaaaatcccttcttttctttatgtttgaaaaaaatggagaatttgtcgaattgggattggaacaaaaaatatcatggtcgtgatatgcccggcctgcatcaagtgcatgaaataagcagtagttgtccacgttgtgtatacgtattctttgcgcttcgtcgtatccccaattttggtatttgtgcaagcgtggggcggaccctgccggaggagtcaagcatgtgacgacgatctcccaagctcggccatcacaacgtcgacattgttttgcagaggagaccgtataggaagaactaccggatcgtttaagacttttccggttaccattatgcacaattttgaaacagtgcgcccacttactttttccgcattttgtacagctctggcgatgagttcatcgaaggcttgacgtagtgcttcatcaggttgctcatgctgggcgttgagcacaaattcggtgacatggcgctgcacagagaaccgctcgatgctatgtgaatgattggtgatttctttgtacaacggcagctgttgctgtccaccatcggaatccgatgatcgatcgcccattccagtttgatttgtcgcttctgatgatgattgttgttgctgggtagtctcctcttccaattgtggttcagttgggtactgttcgaagtacaccattgagcggaaat

SEQ ID NO: 6393 - DNA, 4733 bp, Heterodera glycines
  misc_feature (20)..(20): n is a, c, g, or t
aaatggcagcggacaaaggnccgcacctttacgaggcgcacttcaacaacgcactgctgctgcacgaggcactgacaaatgagccattaattaatgcccgagtgataaattagtggcttaaattgtgggattcaccagtcaatctcttgcgggtttgaaaagacgggataatgaatgactgataagattatgatcaataatggtctgaaagatccttggcacattttccgctcaccactaaatgattgaaaggagaaggaggaggaataattgacaatcaaatcacaaaaatgattttcccaaaattttgttcgtcccctgtttaagatgggtaattacgcggagtgtcaccgttcgctaaaacggtcgttggagcttttcccggatcatttctactccaaaaaattgctgcaacgtgtggagacaattctgaagagctgatttgatggggtcacatgaattaaaaattccatgcttaatctttataaaataaattattgtttaaattttatttggaaataattggataaaaaatggctaaactacaaataaatatgtaaggctgtaatttttatacaaatacatatttttcgcgcatttttttgcacaaaaatcctggttagaccttaaacggtgacttttataatgtgtattttgtcaattttcataaaattcaataaaaatgtaaaaaaataaataaattcatttattttgatttttattaattgtctaatttaaattattatttttttttgtcaattggaatcgataaaaatatttaaaaaaataatttataaaaaaaataaaatttaatttttaatgtggagaatacaacagcatgtgttgtttttttaagaatttttaaaaagttttcatgatgaaaaatcgttggaattccaatccatgtgaacagtgccattgatagcagcaaacaatttctccaaattgccaaacaatgagcctgacttttgtgccgtcaaagcactgttatcattgtgccggaattcgaacagttttgcctcagggaacatttccagccggtcaatccatgcattttctgcttcttcgacgcagtctaatgccgcttcattggtggcttaatccaataaatattaaaaaaataaaataaatattaaaataaatttaaaattgtatattttcttcacctttcgtctgtttgtcttctttttgtgttctttttgaaaatgcgtgctttaatttgtccaatttcactttaaaaatgtccgtccgatcaaagggactttgtccaaacataagtcgaacctgtaaatatttttaaaataaattttctaaattcattttttattattacccctaaatttcttatgtcatcctcaatttcgtgactgtccccattgagtggcaatggaaaattgtccgggtccaactgataagactgtttcaagaaaacaccgaccaatcgggcgcgactctgaaattataaaaaagtaaatgttaaaactaaaaattattttagagaaatttaaaaaaaataatttttcaaaaattcttgccaaaatgaaaaaagggaggaaaatggcaaaaatggacgagaacagtgaggaaaaactgacaaaaaaggagaaaaaaaggcgaaaatagacatgtaaaattttaaaaaagcgtttatattttttgcaaataaagaaaattcctgtaagtgttaaatttaaattattcaatggtccgaccgtttcatcgatgcctttcgtgccaataagccattccaaaaactcaaaattcttagagtccaaataagctttgagcagatgcgtttcctggtatgaatttatattggtaagcattttgtctcttagaccaccgagtgtaccaaatgtccgctgaattgtaacagaacaggcacttcaaattcgaccaaagttggcatatgctaattagaaaaacaggcattaattagcattggtctttgttttttttctctaatcagtgcctttttcgtttctcaccttcttcggtttttgttcttcttccacgggacggattggcatcagtcgccgctgctgatcagttgacaactgattgatcagtcgccccaattcgcgcattttctcgtcaaaaccaatgcgcttactgtaataaatttggtggacgcgtctttgctgtgccggcgacaatttgcgaaatgcggcggggacgggaaaccgcgagagcaaatcgtccggcaaagccatgaacatctcgtcgagcagttcaagtcgtttctaagcacttattatatttatgtgtttttcgtttttgaaataaaaattcatttaaattgatttgcaaatcaatgaaatccttacaaaaatttctaaaattttattgaagttttaaaagcactaattactgattaatttacagtttttgccaatgttttgtccatgtaaattgctttgaatcggttgaatatttctggtggcatcgcttttcgatattcactgagtgtcgtgtgaagtgaacgtttacttgtgacaacaataatttgcaaaaataataatagtaatattttaaataattgcatttttatgaatgggtgggaaattgacactaattggcccattttctttataaatggtcaaaaatcggaataaatattcattgacaaaattcaatgtttgcacaaatgaccacaaaaatggttaatggtcgaaatacagccaaccaagctgcataaaattgctgctatataaaaaaaagtggacaaaaatgcgaaagtaaaaacattttatgataaaatgtttttaattcatataacaaattttgttatcactttaggggacgtactaacaatgtaaaaatgaagtgcagtgaacagaaaatcccgtctttttaagtattcggcaaatttggccaaatggacaatattttatcggctttcgctgatcagcaccgaaacggaaggtggccgagcacaatgggtggggaaaggttgtggagaagcggcaattattggaccaaaggcagataattcataccatttataccatatgggaaggaagcagacactgctacggtattccccttacagtaacgctgtcaacgcaaagagaacccagcgattgttggcaacaaaggttggttggcactttgcaatccattttccatcaactgagtttgtgccatttccagtttaaagcctttcaccgccaaggagctcctgaagatgaacggaggtcagttttccgagctgttgagcgagtctcggcacatgggctgggctcagctgcacaacaccgacttggccgcattttcggcactcacttttctcatcgttctccgatattttgccaaatttacattggctttaatattttgtccaaaaaaggcttttgaaaaattacaaaagtaaaaaggaaaagccgtgttgcgacttttgcgccgcggacatttgcgcctcaacacttgcgccgaccaacaaaaatggacatttgcgcctcaacacttgcgccgaccaacaaaaatggacatttgcgccgctcagtcaaatatatatttaaatatttttactaattttcaacgaattttattccaattaccatgccaacaacaagaagcatttaaaagaaatacaaaaaaataatcacaacgatagacacccaatttttgttttgttttttgtacatcagcagcaaaggcaaatttgttgccaaggaaacaaaaaatgaagatttaataagtcaaattaatgtatgtaggttttagtttaaataaaaatcttttggatattttaaaattttaagaacggtgcaaatggattttatagggcggcgcaaatgtcggtacaccgaataagcagggttgccaactgaaatctttcaaaatcaacttttcctgacaaaaaagcaacatttaaggggtcaaaaatcattcgttttaggaaaattttattccaagtgaaattttgtaaatttgaatgcaatttatttagagattttcaccaaaaatgacaactttttgagatttgaagtcattttttatgaaaaaataagttttggagcccggcggtgccgatagacaccgccgagggaaaaaaatggaaattttgaccaatcttatataataaagttgagtgtctgtatgtgtgtgtccagtgtttgaatttgtgtggcgttttgtttgagttttgcgttaaaaatgaatttgaaaaatgaaatgtttagttttgcttttttcatttttgttttgtcagttttgcaaaaagcagtttttaaaaaatgttttttttctgtttttcttttttaatgaaaaaaagtttttgtatgttttatcaatgataatgaaatcgcaatgaatgctttctattgcatttgttgagaaaagtattttgtttttgttatattagcaaagtgcatatggaaatgaatgctcttaatttttgtaaaaaaaagaaagaaaaattgtttttgtatatgcaaagtcaatggaaatgatcttacaagtagttttggtattgtattgaaaaagttttggttcgagaaattgttttgactttgaaatagagtttttttgtttttgtaattaaagcggatgtcaattatgcctcttttaatggatatggttttaattgatggatttatcgcacttattgtttgttttgacaaaaaaaaagttacttttaacgatataaggtcagtttgttctttttttgtatgtagatgtttatgtaaaagaaattataaaaatgtaagagaacaagtatttataatgaa

SEQ ID NO: 6394 - DNA, 1060 bp, Heterodera glycines
tttttcattaatataatttattacttttcattatttgagccttcttttttctttctctttttttgtattctcatttaattttcccactctcctaaaattgatttctgtccgattttccgcccatttgctgcctaaaaggaaaggaaagggaggggcaattaaagtgagatgaaagttgggcgtaacattaggcattttatttaatgaattacaaaaactaaaagattagttaggaaattcaatttatttattttttgctttcttaaaatgaaatttggtcccatttggctaatacgattttatatgtattaacatctgttaatttggcattttagctgacaatttgctaattactcctttcccaaatggagtcttcctcctcttcctcctcctcctctttctcctcgtcgctttttctgcccaatgcccaatcccattgtgataatgaggcgagccaaatactcattagtgattttgaccacgcaaaaggtcaattcccggctccaatttcttcaaatgtttccgcctccattccgtgccctgtctgtgctgaaccgtccaacggcactttcttcggtgttccaacatgccgcgcttgcggctcattcttccgccgatcggtgcttaacaaacaaaaatatttgtgccgtaaggcgaatgattgtgccatcaataacggaggtcggatagggaggaaaaattggcatttcgaacaaatttttgttttcagaaggaatgcgaaattcgtgccgcgcgtgtcggctcaaacggtgttttgaagttggcatggacatttcgcaaaaactatccaaaagtcataccaaacgttaagtaattcggtgatgcgacatttgcggcgcagaattaaatgacccaaacctaagttttttttcagaaatgggcaaaatgttaagccttgggtggaaatccaatcctttggcatctcggccatttcgttccgaggcaaatccgcctcttatcaaccgtctctttacgtgttttaacgcccagctatgccttctttacaatatcctgtcgctgacctgctttaaaaatttat

SEQ ID NO: 6395 - DNA, 4959 bp, Heterodera glycines
tgagtcagaatttcccaaattcattcacctttatgcgatattttcgaaatattgacaatgcgacaacgagcgttggtcaatgttttgagagggacgcgcaaaatcattttggatgcccagcaggtaaataagcaatgggctcccggacaatcggacagtaaaatactcaaaaagaaaagaaaatgccgtcgctgaaggggaccgattgtgccatatcaagaagaaaccacttttctgtgaattttattttttatgattttttaaataattattttcccccttaaaaatttgactgtcgataaataaatatatcaaaaatttttattgtcctttgagattttttcaaaatttttgatttccgacgttttcggggtcgtaattccgatttccgaaaaatttttgaccctcggaattccgatttttgaaaatttttgggacttcggaatgccgtctttgttaggcattgttcaaccattaattaattctcttctcagttgtacttgatccgacatgacgaacacatccaaattaagcgcggtttcattgtgcttttgcttgaacacgtcagagaacagttccctcaactcaatgaacaaccgacacaaataaaggcaacaattaatgaattattattatttatttttcttaaaaattattgaaaaatgtatacaattagcattttggaaaattcagattggcattgtccaaagctactcatttcaggctgaaattttacgaatttgtttctcaacagtaagaggaataattgatgatgatgattctatgctttctcattttgaagggctttttaaaatattttagcttaaattctttccccggcaaaatgtcccaattaaacatttggtgctcaatggctgctgttttttatcgacagataaattggattacttcttttcttcttacggatcgatcagtgaaaggaaaaagtgcgtataaatacgaattaaaaataaatttaaaaaatggagggttaggaacagaaaaagtttttaaaataaatataaaacataattctcattttatgttcgaacattaaaaggtatgggctcgaatgccttgccagtttcggagtgatcgtgtcacatttaaagccgctaaatttgtccgaacttgagctgagcgcattgaatggaattcagctatggaattgcagtaagtccgcaaaaattggcattttgccaactttaatttaatattgttttttactttgtatttttgcgacaatattatccttcttctattagttgagcgttttgtgccattgtctgatcagcaaaaagcgcatcggaatgcattttttgttgaattaaacgcaatggccgcacaaaacaacggcaaaatagccgagattggcatcagattcggcttattgatgaaccttttgttcgacactttggtgacaaattaattagtttaatttaaacataattaaataataatgaaaatcaaatttaatttattccaatctgcgttttcgcattcagaatgctgcttctcaactgcttgaagcattcgcaatggctgatatttttttcccagctcaccattctttttgcttccccgatgctattgtcggcgctttgttggtacaataaccaaaattagggaaacaattattgtttaataaacaattaaaatttaggatcaacagtgaaattataaatggccgaaaaagagagtgatcaaaagagagagacagacgcaaaaagacagcagagagtgtgtgagaaggagagagagagaaagaggagagagagagagagagttcaatcggattttaatgtcatctaacaattttttttctcattttttaattttttttctgccgtccccaaatgccatcatctgacaacaaattatacaattttatgacaatatctgttaaaattgattcaaaagtttaaaattccagctgcgtttgacggcaccgccgagcttatgtcgtcccatgaagttttttggccaaaatagttaataatcagaagatttcaaaatgaaattccgatattcctttgtcgcaaaattacaaaaaaaaaataaaaatttatgttactgtaaattaatttaaaaattgcctaaaaacctttgtttaattagggttataaattgtatgttttatgctacgaggaaagtggctcaaaatagcatttctacgttaaatttttttttgattaaggtttttgtcaatccatatttcgccatttttgcctttttagcatatttcgttcatttttggcaaattttcattaaaaatgcaataacacctctacggatcgacttttcgggaatttaaaaaaaacatcaaagagaattttttcgaaattttggcaaattttatgtttaattatgattttcttttaaccagtttttctattggattcttttaaatataaaatttaaaatgatcacggattacgggaaattacggcgtttttcgacccccgtaattacggattacggatttccgtaattgagaaaatcgccacagggatttcttttatatcataattttttcgactttttttaatttggacttcatctgaattttctgcattttcaagttgggttgagccccgaccccgagctcctcgatccccgatgatccccgtactccgttgtcattcctttttttggaaattaatttgttaatttaaatataaagcttttatccttattttttcttttaaattgtcgctttctatcggcacctgtagcgtgtgaaaacaaaaaacaaatgcacaattgagtcaaacttatttttttatactttttgggatttttatgacttcttgcattttttttttgactttttcatgacttttcactttttaaggcagttaattttagcaaagaaaattccgaaaaataagtcaattttagacagcaaaaaaatgaaatacttttgatgtgttagcgaaatgaataaagaatgagatttttgatgagaatcacgtaattattaagcagttttgtttcaatttttggctttacctttttggagtttttaacatatatttttgggattttttggctttagcacatataaatcccagcagtcctgacaataacaatatgtacaaaaaaagcgaaacttagttcaattgccttagtgtctctaattacatatgctcaaaaaattgtgtttaattattagggatgggaattttatgtaaatgcatattttttcctgggttctccatgctctgaatatttgtgtttgcgtacaaaaattgtgacttttatttatagattttactcatactatttcggggggtttatttttttattttttacatattttacaaattttcttacataaaaattcccatctctattaaatataaaaaccaaaagtttataagcaaaaaatgccaaaggtgtgacggattttttttgaaatatttttagtaaaaaaattatccttcattattaatttggtttatccaacataataatttacgatataattttctgacgtaagcaaacgctgtgcatattctttccttttttcaattgattttattaattttttttatatataaaattttttataaatctgagttaataaatagggcttgcattttgaggcatacgcctttttttctgcgcactggtttcgatatattaagcataaaaaacgcattttccacttggtttgaggctttacgttgacttttattatgcctttttcgggatttttgtgtcttaaatgccttttttggcagcgttttttaccgaaaaatcccattaaaatgcaataaaattggaaaaatacacccctaagaatttaaaaattttctcaaaaaataatttaatttttttttaaagaaattttaggcttaaaatttccttattcgaaaaacattacaaaatatttaataatcatttaaaagacaaaaattaagttttttggttaatttttacgtgtttttctccctaaaaagcagttaattaaaaaaattttaaatgccttttttcatgcctttttcgggattttcgtgccttttcatgcctttttttcaatttttttggtgcctattatagtgcctttttcgcgatttttggtgcctttttttgcgagctctattaataaagaaactttattcgtataaatatttctataattgtatattttatattaaataataatattctaggtcactaactttactcagaactgattactttttaataaattgtttataaaatttaaaatttaaaaataaaaatattcgtataagcaaaaaatagagacgaagaaatctcgcaaaatttgaggtattctatattaaatttaatttctaagttataaaaagtttctggtgtttcttttggcggatttatgaaagccagggcattggtgcaggcagaattaataacaaaaaccacttttagatatatacaaaaaatgttttcattatttttgttgcaatttttttgctcactttggcatattctcactgcaatggataataatcacattcaaacatttaataatggccaagatggtcatttttgtctcaaactgatcagattaatgttccatctaattatcatactgtttatgatgtgccaactaattaccatttggctaatgaatatgatcacaatggcatggcattgtattcaaattcgatgccactgattagctcaaataatgttaataatataaatgattcttcggttcattcatttgggcatggtctttatcaccatagttacccgaatttttcaagctatcacccagtggaacataatcatgtacacagcactgataatgtgatagtgccaatggataatcagtcaaacggaactcaatccaataattaatcaaaaaattggcaatgtggcgaagccgatcaatttgatgccaaataatgtgcatcatccattgcccgatgctaatcattattgtcatatcaaagcaccaaattctat

SEQ ID NO: 6396 - DNA, 899 bp, Heterodera glycines
aactgagtaccgaggtcccggttttgaccgggaccgggaccagtcccgggttttttcccggttttcccagccaaaaattcccgggttttcaacccgaaaaggtcccggtcccggttaagcccaaaattcccggtcccgctctactctattcaaaatataatgtgaatttcatgagcaatttgaaaataagtacgtattcagttttgaatctaaggaaggatggcatatgtagatgttaaaatgatttattatttctttcctttattacttgtaatatttgtattttgatatttttatgcatataatttagggctggagccaaaaattcccggtcccgaccagccctaatataattagatttttggaggagtggacatttttatcaattaaatgtgttccatcatatttttcagcaattcaattccttcttcctttttctttgcattttcattttcccccaacaaatgctccgttgaatagcacttcctttttgcttctgataaggaaaaaggcgaacggatggtcggcacggaaaacgggcggagggggcggattataagcgaagccggttggcatcgatacgattgttgcggcaccagcctcacaacccttttcgtcaaccttaaaaatttaaatttttttcatttattgtgaaagaatcaagatctaaacatgaatgtcctctctaattggcatttccgatccaatcattgtttttttctataattttttcactcaccgaaatcattgctttttgaagaaccttgtcaatatataatgggatagacttatttatgcccgagaaatcagcactgtccgagttgaacgcacttttaagcccaagcgacggcaacagttcttccaatttgtgggtcgactcaattttgaattttggcaaa

SEQ ID NO: 6397 - DNA, 6412 bp, Heterodera glycines
agtaatttgaactgaattttgtataattaaagacagcccttttatttatttaaatgtaaaataaacaaattaacaaggaaataaggggataaagcaaatatttatttatacgttattctcttcctggtaaacgaaaaaatttgtttgttgcatcatatccaactaaaaagaatatttcaaattaacaattttaaatatctattttgacaataatttgctatcgaaaattggacttcctaattacatgccttgcgaagacatactttgatttctttgccatttgcgagaaaaaatatttctttttgtgtgtcgcgttcattgaaaggatatgaccaatttccattgaaataaatcgcattgatcagaagaagtctaatgaattgataatgtaaaaaattaaattttatgtgtattacactggtcgaccatcaagaaattcgggattaatcatttttggaatttttccattcgtcgcattctcaacaaatgcattaatttcctataaaaagcattaatttcgaattcgttttttgtttttgtttatacgtttgctgcttcttcccttttgccaaaatcaatctgttcaaaatttccctggtaatatttgctcaatgtctgattaaactcttccaaaatggtaaaactttcgtttagaaatattttgttggcaatgctcaaattgaacgttttctccaattccatttcatcgataaatttggcattgttttgatgcagcgaagaaccatctaattaattggtaaaagacattaaaatgggtatggcactttaaaatggaaaaatttgccaccatcggccaacaaattgacaaattcggccgccgtttgtccccgcgcgcccgcataagccatggccaacgcaatggccgccgaaatgggcgaaagtaccgtattctgtgtagacgatgcatcagcacagcagttacggtagattgcgtttagcaaattcatggaaaattctgaaaaaaactaacttcattaattatgagtaatatacttataaattagctaattacccaattaattttactcacgtggtcccgttgtttgtggatattgaaatgcgatgttcaccttcccattggcactgatggacttcaattcggtcggttgccacgtcagttggtgctgctctgtgtacaaatgggcgcccctcgggtcacgccattgcactgcttggccagccatgttcaactgcaggccgcgcatctcatgcacacggccctggaaatgcattttaaaattaattataatttttgtaaaataagtaaaatattgtttatgaacatcatagcaaaataagacgaaatatttatgtattaatcgaactctcagcgaatgaaaacgttcaaatattcaacaaatatatgttgatcaaccgattcctctcgggttttaaatgacgaaatcagaatgaaatttttggaaaaaatatgatgagttatggtcaacatcttatttaaagagcttaaaacacaaaaattttaattttcttaggtgttaaaaacgttagaaaaattttaaaaaaattagctaaagctttaaaccgtatatgatcaacatttaccaaaaatagtgatttattgatgtgtgaatttctcagaaaagtgaatttttaaaaattgaaataaaaaattaaaatactttttcaaattcaatggctggcagtttgaagatgtttgtgccacaactgattaaataacgaaataaattgtcaaaatgaaatccatgtgatttaaattatttatttcttaagtttacaataaattggcatcatttgtcctcattaattcttttgtgccggttgtttacccaaattattttcccatttaaatctttcattgttgttactgattccgtttattttaaagtgtatttattgcgaattttattattattttttttttgtccaattaaatttgtctccaaacactcgcaaacccgcgcaaattctcctacgaaataaaatattattatttgcatttttttctctttacgcactctccgcttatggttactgtaatgccattgaacgcattttccatttgcgcactgccaaataaactgctgcaaattcggtgttggaataccacgggaaaggtaaaaggagaaaaggaagaatccgtaatttcaaaactgaaaacaattaaataaattaataaaataataatataattaaatttatttaattttataattaatggtaattagttattaattaattgccccatttctgataatttgtccctttcttccacctgttctcaaacattgttttcatttgtgcgtcacaatttccgtagaaaaacgaacttttcggctcctcaaattcaattttcacttttgccgtgcaattttgggctgttcctcccgcgacgcatccgtccaaaaatgcgagagtgcctaaagaaaaagtcaaatttaaaatgattaatttttggcacggtaatgtttaaaattgtttttacgtttatattcgtttccatttggctccttttcgggttcattttcgtaaaaatggaccttaaattttaagaaataaattcttcactttttttaacctgaccatgacacagtgtttgatttggtcataatagggattaccacactttggcatctgaaaaagtaccgtataaaataagaatatttattcctttaccaatgccattttgtataaatcctgcaaacaattgagtccgacgaatgttccaatgattttcgaaaatccttcattcggcatttgctttttgtacttaaatgacacacagcagtaccctattcgttcctcttcgaataccgtaccacacaagcacagtaatcctcgtcctgattggtcccattgctcgcctttgtcccactgtaacacgcgtaacatccattggccgacattttctcctccgcttttaatttgttgtcctcaaaaagagatgagtccaaccacgggggccgcaaatgcttggggatgaagcctttctgttggaccaccgacgagcgaaggcaaagcgagtgaaattgggcggagcgatcaatggcacggcacacatccgcggcattaaattctgaaaaaatattaattaaaatttatttttaaaaatatttgggacctggacttgcatcgatgaatttgatacttaacagaagaataatcgttttaaaaacagtcaaaaccaacagatgtttaagctgctggtttataatcatttttgatctaatttcattcatttaggagaatataattctttaaaatatttttatattttttcaagcaaataaaaaattattttttattacatattttatgaaaatattactcaaataatgtcatcattttttggtggaaaagagtgataatatttttgagcgaatttctttcattaaataatttgcatatttattttagtaaacaaaaaataaatgattatcataacggtatattagaaatgaaaaacggagatgagtcatcccagtcagtttggtttattttgtaatatattattcgctcgttgtgtattctggtaaaaagtgtaaagtgatgaagtaatgctgaaaattttaagagttaagtgaaaatgaatattctgattttatttttgtgacctttcccgcacttttatttttcaaattaaatttttaatttaggttttaatagagtagagcggtaatgggtagttgtaaaaaaccggtaccggtatttttaggattgaaacggtactatttggctggaaaaaccggtaaaaaacggtacttacctgttccggttaaaaccagtactaagcactcatttgtacgtttatttcagtaccactaccggtgccgctctactctagttttaataaataaaaaggttttagttcggcaccacttaattttttcaccaaaattagcaccaaaactgctggtgagatcgcttgacattcgtacatttttgcagttgtgcataatttcttagagacttcacacggacaaattgctcaactgccggagagaacgaccatttgggaatatcaaaaacagcccaaaataaacagacactttaatacattcattcaatgccatttctcaccatttttgacaaaataatgacttttttattcttgagatgactgaaagttaattagaatttgtttagtttagaaagctttataaatagactaacatttctcagtttttctcattattctataaaaatgacaaataaaattattttgtgcacaatcattgcattggcattcttaaccaaaattgatcaggttcatcgctttatttatttatctaaatttaaaaatgtttttaaaacagatttcatcatgcttttctgtcacatacggaaatagatgttgcaaaaccattccgaattttcccgttattccaagtattttaaattttgaatttaacatatgcgattttatgatttgcttgtttctaaaaaaccagtgcttaattatgtatcaaatcctaggtattgtcactttgtgtagtgtcggcagtccgtggtgcaacgcttttggagggaattgcgtcgtttgcgaatttgttttcattccgactgcacgttgtgagctgatcaccaagtgcagttgctactattgttgtgaggagcagtacaaagactattgccctcaggggtgcgaaaattgcgtgacggacggcgagggcggctgtgaggagaacgcaaaaagcagagaaaaattcgaaggctgcgcgtaattaattaatctattaattatgaaaaggaatgcccatcacaaacccaaaacccttagaaaaaatataaaattagcaaaatatcatttaaattaaaaatgctcatacaatatcacacttatcataaccataatcattgccaaaatggaatttttgctgatttttttaatattctttttcgattttcacattataacgtaggtgggtaattctgcacccatgttatgataacataataaaactttcatcaaacccattaagaagcacagggtcaacaagcaatatcagaggaggaggcgaaacggcattttcaaagttgaaaaggaaaacggaggcgcagatggcatttgaaatggcaagtgaaaaatcaaaaaataagcaaatagaatgtgataacagatagacacggatttggacggatttatctcaaaggaggagggcatttattatcttcgcacatcgcaacaccaaagctctacgcccgcggaccttgacaagaattcgtcctggtttgacacgatggaccgaaatgggaataaaaaaattgatcctgaagaatttgatcgcttactcggcacaaaatgagcaaacctacattttataaatgtcttaaagtttgaactgcttcacaaaaacaaagggtaaaaaaaataatgaaaattttaatgcacaacatttatttatttttgagtatacggtaaatacaaagctaataattaattatgtgttaatttctcacaaaataaaaatacttatgaatcagcagagattggataaatcgaattcgaaattgagcccaaagttcgcttcgatttggtcatcaaagctgaacaaagaaacgaatggaaccaattcagatggaagaggaacgaacatttgagaagcatcttaaaaagaaaatggaaaagcattaaaaatggttatttaatcgtaaatattggacaaaaaatgcaaaattcattttaatggccaaggaattaagaaataaaggctcataaaggaaccaaaaagtcaaaaacactttcacaaaaggtgaaaataagcaacatttaatggactttgtatataaatcttaaaactaaaattgtatccctggaaccattaattacctatatttggaaatggaaatatttttaattgctcaccaacccaaaagatgtccatttttctgtgccggccaaaaccaatcgcgtcgtttgctgtccgcgccgcgtgcggcgacaagcgcaactgaaaaacgaatttctctgattcaaaaatgctttttctgttgactgtaatgcgctgcgagcatatccctcgtgtagaaaaacgtaattaaactaaaggaaaatgtgaagaatgatacggtagcaacgagttacagtatggaaaagaaaagttacggtaggaaaagtgacgaaaagtaaagcattgaaaagcgccattaacaagttaaaatttctgatctgaatttggtcataatgagtatcttaccatcgatgcctgtgattatatttgatttaagttttgctgcgtttccaaactgtgccaagtcgcgcttgtcgcgtggtggccgcggagattggccgtgaagtgatcgaagtacgcgacgtgcacaacatgctgttttgggtgcccgtcttcaaacggctttcgggccgttgcatcccttggaagggttaacgaatgaatggcattggcatccattt

SEQ ID NO: 6398 - DNA, 1098 bp, Heterodera glycines
  misc_feature (943)..(943): n is a, c, g, or t
  misc_feature (1024)..(1024): n is a, c, g, or t
caaatatttacaaagagaatttgaatttactcaaattctcttggctttcattgcatttacaggaacttaagcattttgatgtacaaaatggcaaattaattggcaatgacagcgacgagtcattggaatcagtaaatgaaaagaaaattaattgcttgattaattaattaattaattacatatatagttgattgattaattatttagttggtttcatttatttctaaaaatggctttggtctcataaacgacgaacggagaacaaaaattgatcaggcaattcaagaaatagaacaaattgtaaagaaatgggtaagtccttccttaagaattccatagaaaaacaaatttaataaaataaataaaaattaaataatgccaatgaaaaaataaaatacccgaatttgtcattttcaatttggtgtaaaacatacttaaattattaattggacaaaatgcgcaatttgcgccaaaatttgaccggtttcaacgtatcttttggaaaaaatttcacaacttttgttcgaattcggctccggggtccggaattgggcaaatccgagttcaaatttgcaatcagcacccttaaaaatccccggaaactgattttgagcctaaaataaaagaatttaaattagggagggatccccattctttaggactattgcccaaattcgttatttttttcgaaatttagaatcgcaaagcgaaaattattgtcatgggttcctaccaattgggcgcactcaccaaacaatcagacatcgatgccatttgtgttgtgcccgaattacgcacttggagagcggcaaaattttttgggaaggcaaagtgccaaattcaatggaacgggttcagaaggtgcgcggatgattcactgttttgccacttttgtttggtgagtgaaaccgtggggaaacttccagaaaattgctcggattanatgaataattaaaaaataataaatttttaaattggaagtcagatgaaaatgaacattgatcgattttataatttagcttanatttaatcaaatttaatgaacttcgtattgaacctctgctatctttatggatttttaaaaaattagtaaaaatt

SEQ ID NO: 6399 - DNA, 3297 bp, Heterodera glycines
gctcaatcggatccaagacgcgtgggtgccgctgattaaattcaaattcgaaatcgacccgaacacttccgtcgattttgacattggactagaaacatttgcaatccatgacgaaatttttaaatccgaagagccaataaaatacgaacaatgcgacgcattgtcagcgaaaatggccaacgaaattggacaattagcgaatcggaggagggcatttattacgaggggtggagactatgaggaactgatggaaatgaacagcgagcgggagaagctgagaaggaagctcagatcattggcaggtgattggcccggcgggggagggcttaaatttgacaatccatcggaggacggaagatgccgttgattactgtgtaatgtcacttctaaagttcggcccaaatttccccgtacaataatagtagacatggaataatgtcctttattccgaaggcggatatccacgaaatacagtatgctaatataatgaggaaaaggggaaagggaccccgacccgtgcaggacggaaggggaggggatctggagtaaatgtgatcccggttataagaatgaatagaggtgatcgctaaggaatgggccacattacgagaaagggcggagctaaagttgatcagagtgatcagaggcactaacaaaatcagacagtcaaaaaataagaaataatgtacaattagtttctcgcccaaaaaccatacaattttaggcttcgaagtgggcgtaattattttgaagaaactttttgcgacagaaaagagagaaaaagaagacaaccaaatcattttaagaaattatcgcactttattattggctgtaaaaatgtgggccaaaggtattttaaaatgaaaaaataaaataaattattattttaaattggtatttattctctaattttctctcatcagagcatcacatttatgacaacaaattgggcttcttcaatggcattagcctttcccttttggtggccaaagtgatgcttctttacccaatggcatcacttccttttctcattgaaaagttcttcttcaccttctccacatggtcattttgttttaatattttcttttaaaaaaagttttaataaaattaattgtcaattattttttgaattttaaatgtcctaattattctatgcaagttttaggccttggccaaccccggtaaagctgtccaatttgccggatgggtcggcactccgctggaaccccagcgaagaaaaacaaaaacggagcgaaattggctatggaattgcggccgaattggcaatgccaattgtcacgccgggacacattgaacaaaatgccactttcaatgtgaaccgatccaccgcaacaatcattcggcgggaaatgcaaaacggtgtcaattaaaggaaaataaaataattagggaattaaaaagggatgtcatcattaatttgaatgtttagcaattaaaattgtacgaaattggccaaatctgagcatttcattgaatggaaaatggaaaagcttaataaaggctacaaaattcaaggaaaaggtgacccaataatattatttaaattgaaacgcgtcaggaccagtcagctggggacagctcagctttaagataatttacaaaatttataaaattgaaaaatattaaaagttttaaacaatgacttaggttagggctaggctttaggctaggcctaggcttgcttgtgcctaggcttaattttataaaaatttaattgtatggctgaatcgtccatcagtcgaattgtcccatcagctgattgtcctcagctgactagttcagaagccaaattaaaaattaaaaaatttcaaatatttttcgcagttttcccatttcattcgcattaattgcaaagccttcgctttggccgacttttacgacttttgtggctacgtggagacgcgaattcgtctccaattgctgatcgatgtcgaacgatttgatcgcattcgattggcccatgcgaagcaaattgttgaaaaggaacaaattttgggagagaatttggatggaagcaccgctaataaaaagaatcacaaaaagtgaaacggagggtctcttctatttttaggattttatcaattttttcctgggctacctttggtcagaaacgtactaaaaactatatttttggatgctattgttaaactacttttcgaatttttagatcctaaaatccttaaaaagagataatttgtcctgttttggcattttgcctaaaattgcctaacaacaacaaaaaaaacgaagataaactccctaagaatcgacttaaaatttgaaaaacaaagccctaatattgtcttttcaatacatacaaaattaagaaatgttttcttcaaaatttggttggttggcctcgaattggacgagcaaatcgcttcagaaaatgagtcggaaagtacgaacaattggaataattggaaagaagcactgaattcgatgctttccgaacaatttaacgccgtcattttgaaggcgtatcggacaaagaatggttttagtggcccattggttcacattcaattgacggcacaatatgagcaaaagcattaaaaggggcataatataatcgaagatgaaaagtaaagttgttttttttggtagagatctcattagtgtaacatcgaaaatttggaaaaataataaaaaaggaaattgatgcaaggttttatggtcatatgctaatcgacaaaaaaatccttaaaaatagccgtttttatgttaaaaaatgctacaaaaaactcccaattttcaatttttttttctcggcggcgcatatcagcatcgccggcccccaaaagattatttcttcttaaaaaatttgctcaaaatcgaaaaaattggtcatttttggttaaaatctggtgtcaaaatgaactcaaattttcaaaaaatttccaggcgtcgcctagcgtcgcaaaaacccttttttcattttgactaaattttcaaaatgctgatttttgaacccaaatgatgatttttgtcggtcacagcccagtttttaattgttttattcaaaaatcaaacaatatgccataaaaggatttttgttaagcgaggttaattttcaaaaatgccaccgatttgggtaatactgacttttactggtcccataaaaaaaaggaataaaaagcccgttttttgcgattctacgttgtactcgggggttatcggggccgctgatcacgaatatgacatcagatttgtcatatgacagagtctaatctatgattttttcaagtctatgatttttcatcaagtaattttttt

SEQ ID NO: 6400 - DNA, 4464 bp, Heterodera glycines
tatgtacataaaacaattatttacgcatttatatgacgagatgagttacaatttacatatgggtatgtataacacaatagaaatagtggtagaaaacaacaacaacacacatacatattatatacatgattatttgtcctaataaatgtatcacggaatacaatcagatacatagatggatcaccacaacacaacagcacattattcaattctactgcttcggcgcctgctgcttctttccttgggccagtcgagcgtttactttcgctaggtccgtcattgtgttgttgggcaatgagtccggcacgaaccatccttcgtcgggctcagatgctgattgtgaagcactggaactgtcggcgttgtccccattcatcgttaatttggtcacagcccctccgctctcgccattgacggtttcgcgcgcatctttttggcttcctcctcgcatgcagcacacaatgcacaccagcaggaccaagaagagcacaattgctacaatgacgctaaaaatggtaggagaaaaatgaatggctgtgaaaagcgttgaacaaaatgatacggacccaatcaaaatccaaaacagcaatgattgttcgtcattagtatcatcagttgtcgccgcctcagtgccagcttctgtagtcgaaggagtggcaaccgtcgtttcttttttggtggttgtgaatgttgtggtgttcaaaggaaattgcggtgatgacgacgcatttctggcgcgaagagtttccgtcgtttggctgaaagcgaaaaagaacacaattaaatgttgaacgtgtacagcagcagcagaaagagttattcacacacctctcattttgctgacagcagccaaagttgagcagaaatgcggcggcgatgaagagaagagtgggcagaattttggaaatttgggaggccatttcagcggcactgttaatgaaagagaagtgaatggagggaaagagtggagttggcggtgcttttataataaaatggcacagggaaaatgcaacgaaacaaagacagaaaatgaaacacgaaaagtaaaagatataaaaaggaaagaaaatgaaacatgaaaaaccgatgtcagcttcaaatgcaaaattttcaaaaataaaaaccatgttgttcgtcttgtcattctttcccgattaaattttactaccaagaaaattagtacccaaaaggcacaggaaaaatgcaaaagtgaaggaaacacgaaaaacggatggtggaggcaaagtcacggcgaaatgaacagcgaaaggatgggcaaacttcgttcgctgtctttccgctctgattgccctgggcttcgacttgcttcaccacgtccatgccctcaacgactcgcccaaacaccacgtgtttgccgtcaagccactgcaatgaaaacatcatcaaaaaccctaaaccgaaaataacaaaagcaatttccgggaataggagagcggaaaatttgcagtgcttaattgtgtgttattcaaaaaccgcaagtaccgaatttcttgaccacggcaccttttcctattgttaaaacacttgcgctactgcgcacataaattgcaatttgtaagaattttccaagtataggcattttcccagtatttcttgaattcgctagattaatttgtgttaaaaatgaatctcgaaaatggctaaatacgcctttcgtccaacctccgttttcactgtgttgatgaaaaactgcgagccgttagtgttggggccggcattggccatcgactgaatttaaaaataagttgaaaaatgacgctttttctggcccatgggctacgagtgttccattccttaaacgttaccaatagtcccgggacggtatgcttctctttgaaattctcgtcggggaatttctcgcctaaaggaccgattcattcgcatttcgtcctaacacttgccatagatcgactcgccgcctttcgcttaattcccctaaataaaaatgtgcttctcatcagagtttgaagacacacgctctaagtgcagatttatcttcgagcaaccttgtcgatgccctaccaaccaactcgaggccatcaaattcagcaaggttggaaaattttcaaaaattttttaaatccaagcaaatccctttccattctacgtttgttaaggtgataagcgcggaagacaacagtctgtgctgtttttgtgcaggtccagtaaatacgcagtataaatattatatatattgttttacataatttttgtcatactttgaaatgaaagcgcaacgattttcatggtccgtcactgatcaaaaaaaagtgttacacccattccgactaaaacccgccaaatccgaaccatttgaactcgaatatgcatgtataaagattcgaaacttctttatagcccaaaattcagttaaaagcaatactgatttgttgcttatgcatgtatataaatttaatgtgacttgatccacaactgttttaacaaaggaccccattttttggaacaagcaaattaaacgatttttgatgctttttagtttgataaaaaaattttttgtaaaataaggaaccattttctgtcgtaattgtttatttatacatctttaccatatccatttttgttacagaggaatacggtcacaggtcgttggaagtgctgtacaaatgttcgacgtgtggcaaagaaacgcacagaatttatgagtgcttcagtacgtcaatttttacaccacatcccctcaattacaataattgtgcccggttttagttgacgtcgattattggtcgggcaatgattgcgacactcgctaccgtactcgagcgtacagtgcgtggggactgtacacggaaaaagtcacaaaaatggcactgctggggcggatgaccatgaacaactttgaggcggtggagcgcaaattcgatgtgatgtgcattgttcaggacaatcattacaagacaaccgatgattggaccgacactttgataagacgtcttgaataaataggcaggccaaatggcaacaatttattgtataactgtatatattatatttgtatgtatctctcgtataattatattatatttgtttaggataaatgttatacgatctttttcgtacaaaatgagtacatttcattcaccatgtctttcgcccttccaatccgaaaaaacgtcactatttctgaatttttgtcactgttttggcatttccctcttcccgtcccgttcaactctaattagaaccgatgaggaaaatttgaaaatttcgacatgatctgttatataggaaattttaattctgggttcgaccgtgccaacatttcaaacagaaccatcgaatttgatttgggtctcagaactactaacattttattaattaattttacgaaatatgtatttaataaaaaagagtcatgctacatcatatcacagagaaacaagcaagcttcagcacaagtgatcaaagttcagtttgtgttctccttccatcactgaggcagcggccaattgctaaaatggcaaagtattaataatttgatttgcattttgtgtttgtccacttccaattcaccttggccttctgtgcctctgcaacgaattgctctttgtgtccggcaatttcactgatcgcttccacaaagaatttctgcatcagttgcgcattttttcgcattgtttcgcccactaaagcaatgctcacctgacaaatgaaacaataggaaacaaattatatataggaatatagtggcacgggaacgggaattttgagatgccgtgacaaaaaggccatgaacagttttgaattggtcggacggttgtctcctaacgtaccccttcagcggtatcgcgccaacaatcgtagtcagtcacaacggcaaccgaagcgtacggaatgcccaattctttggcaaggacagccttaaatttagcatttagtaatgcttttcaatttataaatcacttccgggcacagtgtcatgccaaccaaatcggcgccccaaacgcggaacagctcgctctccgcccgcgtggagaagcgtggtccctccacgcacaccaacacgccgcggtcgctgtgtgcagcgcccaaacgcgtcgccgtggcgagcagcgcccgtcgcaggcgttcgttgagcgcgggatgcattggcatatggcaaatgcccggcggatgacccggcagtccatcgtaaaaggtctgctcgcgtttcgtcgtcctgtgcggtgccaaagggggaaaatgagtcattttagaaatggcagcggaaaattaggaaaaattgagtaattatggaaggagtatttgcaattttaatgaagtattattgttttgccgtcccaccggtcgatgaacgagtcgatcagcaccaatttgccgggctccaattcctcccgcagagagccgcaagcgcacgcggcgacgatgacattgacgccggcctttttcagcgccccaaatgtttgcccggataatttatgttgg

SEQ ID NO: 6401 - DNA, 4722 bp, Heterodera glycines
  misc_feature (44)..(44): n is a, c, g, or t
ggaaaaaaaatatggatttccatataattaccatccctacttgnatgaggaagcaattagcgcacttagagaagaatttggcggaatgatgaaagaaaagggaggaaaagtggcgaaataatttactcggaggaaaaaggaattggaaaaatgaaaaaagagttggaatggctggtgaagtgatcgcttttattccaaatgtcaactaactttttcacgaaaacatttttggggagtcaagacaacacaaaaccttcataagtatctcatccaagaggcaactcatccacacacagctaacatcatttacagaaaaaaatgtttccgtgtttttcggagtcactgaactgataatgatgattcattacgacatcatccatttttggccaattaagttccttgtatccccattgaacaaaaatggaaatcccagaattcataattagataggcagcatcttttgtatgcttcttagaaaagaattaaaacaagaatttttcgacagttcacctatttccaatggaccagaataatctaaaattttaccaaattttttcccaatattatataattcaaaaaattcaaatttgagttaataattttttacaaagcatatcatagagaaaaagtcaataaaatggccaaatagtaaaagcaaaaaaatgactaagaaaaaatactagttcagagaaaaaaattttggaattatgtatttttggaaaatttgacatgtaattaacgtttaaattaaaatcttttaattaaaaaagtgtctattgttgatgagttgcctttgatgatttgcccgtgggtgagatttttgggtgacctctttctgtactttgtcgaatgatctgaaatttgtgattcatattctaattcggatttgtcaccattccaaaattcaaacgacctgccgaaaacaggtgcactttatgctatgacctatttctttaataaaataaatatccggaataattggaatgttttggccaaatccgctaataaatccaataaaaatttttaaattttacagtcggcactaaccgctttgcttttctcaaaaaatatttttttagcaaattgtttcttaaaaaattggatcaaaatcgtaaaaattggttttaggtaaaaatctgttaagaaatagtgtaattgcctaaaataccttaaagaacagtcaaaattttacaattttttgaaatttttgctaaaaaatcacaaaatttagtcattttttggataaaatctggtaacaaatcgcattaaaaattacaaattttttcccggcggctcctattggcaccgccgaacccctttgttccccaaaagttctggaaaaaactcgccgcgaaaaaaagcggtcttgaaaacaaaaaaaaggtcatcgatttacatggccgaacccattcgcaaaatcggaaaattggccgctgacccgcttgttttgcacaaattctgaattttggggtctaattttagtgttctttatcatgaatttgaaaaaaaacttcgtcacactgaatatacatatacttctgaacaattctaatgctaaaacaggcactcgcgcgaaaacggaataaaaattttgtatttgaaaaattttgtccaaaaatttttagcgttgaaaaattacattaccggtttttaccggtaccggtacctgtggaaaaagttggtaccggtaccggtttttgcagtgccggtcagtaccggtaccggttttttataattacctattaccgctctcctctaagtatacctaatcattttgtaaaagaaattttttcgagactggcggcatacgtcaaaagggggtaatgggctaaccaagattttttaaaggtgtgttagtatttgatatttggcgtttaaatttcagtttttgctagaaaagtagattttagcaatattttaaataaaaaattttccttttttttaattataattttttaaaaattttttagactttttttcaaatttttaaatttgatttattttttcttttaaacaatatagcaaataatatttatacattggttctatgggcacttttccattatgctgccgcacaccaaaatgtaaaaaaagggaaaaaatgcgccagttttggcgcgcaacgattatttagaatgaggcataaaagccgcaatttgaactaaatgtcatcgaatgtatcagcaccgcgccgtttgcagtcttcgcgccaaaggaattcgcataagcatgagtcaagcattttggggtgagcagcagggatgggctttcgctttcgcattttattttccgatttggcctaaaaatatcaaaaatatttgaagctttttttacattttgcttgatatctgctaacagattatgccatcaaatggatattttcgaggacttttcatacatttattgtagagtggtacgggaccaggaattttggccaaaaccgggaccgggacctcggtttttgtccgggaccggggaccgggaccaaccgggaaattttaaaaattcaaaaaaattaaaaaattcaaatttttagtttatttcaaatgaaaaaattaaataattaattttttgtttggttttttatttataaaacccaaaagttaacgcaaaattaaattataatatatttaatcaatgtttcaaacaaaatttatttaaattattaaatcatttttggactaatgatcgaatattattagaaattcatatttgcttttcacatcactttttttcggcgagctttttccaaaaacttttggggaaagaaagggggttcggcggtgccgataggcgccgccgtgggagattttgaaaatttgagtgtagttagttaacagattttcaacaaaaaagggtagtttttgggattattagtttgtatggacttactttaaaaaatgataaaatatgtgtcaattaaaaaatatatatatgaggaatatttttttgtcgataggaaacccatgagtatacaaaaaaaaattcaaaatcttttaatttctgtagagggattgaaccatgggaaagaagtagaaaaccaagaggattagccactaggacatcagcacaattggtagttaaaaatttcccttctccaattttcatcactaatttttcacccagacccctattcttcttaccagtgcttattagtcccgccgggaccgggactggcaaaccgggaccgggattttttttcaaaatccgggaccgggacctcggaggaccgggaattcccgccccggtcccggtccaccctaatttattgtaaattgactaagttttatttaaaaaactttgatcaattttatggaaaatcttttaataaagacttttttgttaataaattttgtaacttagtaaagacaaacaaacttacaactagtaggccgtagaaacaacagtaaggaaagctttaaaggcataaattaaattaaaaatttcacttctcaaatttaaaattttcacgtctcaaattttaaatgacaatttccaacaatattattggggtgttgtataagttctgtcacccttcttatgctatgctaatcggaattttttgcaccgttaaccacaagtgacagccgatcaatttctgtcctataggaaagagcagacatttttgcttcggttaaaagccatttttcgttcttccccattcaaattgatttttaaaaaaattttccaatggatgtccccaaattacaaattcgatcacttttattgtacgggtcaaaactttgctttgatcagttggaaatttattaaaagcagtttttgtggccaaatcaagtccggagaatccaaatctggcctcagatttgatctctgaattttctctggcattgtactgctccatgtcgttgacaagaagttgaagcagtacagggtcatagaacagcaactgactaaagccaagaaatcagtggttgaatttgtccacttttttaagtagacccatcagtttatttgagtctaactatcttgaatttaatcgatagatcatttttaaaatctcaaaaatggcagaatatgatcgggaatgatggtgcatattttgattaattttgagttattatttgattttttataaatttttgaatgaaatttttggtcggggtgacagaacttatacaacaccccaatatatagtttatacaaaagttaattttgtggggttaatcctacggtatccccccgcaaaaatatgagttccattcccgcagcggtatccgcaaatttgattgttcgttctcccatttgcgcagatatgtcaatcatgcaattttctttttccaaggatgactcatcgtcgaccatcggcggtcgcgaaacgcccgccgcctccaaaagcatttctggcaccgcatctgcctctgccccatcaaagaaagcgccgtcctctttgagtgtttcgaatggcggtggtgccaaagcggcgtccgtcgtcgcctccggcactgtgccaaagagcaaaagtgtcgttgggaaaaacgcgaagagttcccccgctgcggaccctttggatttggtgcgcgcgagtggacaacggacgaacacgcgactgctcgaacgcgacgcattggaagcatttgtgaaaacggtggacccaaacgaattgttggaggacgaagtggcggacgcgattggcctggtggtggaggaatttgtggacgaactgatccgacactccgtcgatgtaattgagggggggggggg

SEQ ID NO: 6402 - DNA, 4297 bp, Heterodera glycines
cagagaaataccttagtataaatactttctgcctgcaaaatttaagaatttttcgatcatgtacaaattttttacaaaaatcaacatgtttttaaaacttaaaaatttcacggaaaaatatttccgtgaaattttcaagtttattaaacacgggaatgtttataaaaaaattttgaatatataaaatctttttaaattttgcaggcagaaagtatttatactaaggtatttctctgcaaaaattcatatttttctgaaaagtacgaaacgaacaggaaaatcagcatttttaaattccgtgaatcttatttacctaaaaatcgcatccctagtgatcactcccaaatcgacagaattttgcacgaattgggaaaaaaatggcgctgcagtaagtggttgcctcacgatttgaccccccctcagcgacaacggcgggtggacatcgctactcaactgctccaacaacaacagcaacatcccatttctcgggagggtcctgacttcagatgaaaaatggatccccctcgacaatttgcgaccggaaaagcagtggctttccccaggacaacaggcggtaccggggccgaaagtggatcaattatccattagcatatttacttaagcataaaactaattaatctggataataattgcaaaaatcttgaaatgttcgtctttttttatcacattttgcaaagtcttcgtgttctccaattcacaaacatttcacctcaccgtcagtgttcttctcaatccaatcacagtaacgcgatactcgcgtgtacagtactgtatattaagatggatatggtaattagtacatttggacatttgaaaaaaccatgggactgggctggatttcttgtaaaaaaaatcagataatccaggtctaagaaaatttccaaagcccgttctcgggaggcctttaaaaagcgtgaccttaactatcgggcctttggtcggttatctgctttgtgatggcataaggaaataaagtgtgggagaaagtatgataaaaggacatgggagaaccccttaaggaacgcccgtagctcagtcggttagaacattcctcgacatgggaaggccgtgggttcgagtcccaccagcgagttatcttttatgttgttctactacgtacataacttgtctttttttgttttattgtccaccacttacttgcaaaacgattatcctttttgagcgttgaaatgcttgacactccaatctgatcagagaaattttgttggatccttttcattttggcattccattactttaattttcaaaaatgtgagtttaattttatattttggtttaggtaactaggattttcaaattattaggagtaaaaagaatgtataactcaatttgttgccagttttagacagtatgtactagttgggtctgatttctcacctgtgtccaaatgttaccattttgtgtctgttgcataagcggtccaccgctgtccccctaaaatcaccaaaaattcgtgtaataaccttaaaatgatacatttttattgaattattaatttggcactcaattaattccattgtattgagcaaggcatcttctttcttacagaatttttgtctaatatttgaaaatgccaaagaaaattaacctaaaaaccttgcacggggacccaaacacgtcaaattccgagaaataggactttttcgagcttgtctaatgatcttcgatctttttgaacgactaacaaaacatcaccacgttcataagatctgttttcaggatgcaaacgggaagcagaaagaaatccacaaaggccaagaaaaccttccccttatcttgctatattgtttagccaatggaaaacgtttagacttgtatttgtgtaactgattctacacagaataatgcaaatgttgaagccttgcaaactcaaaataaatttaaaaaatgctactaacaaattatgttgattaattatattcaaatataattagttaaaagattaaattaaaaaccaatataaaatatttagtttgcttaataaaatttatttgctttgcttgattgctgtggctttgtgtgtatacggtttagggccgaaacacaaataataattaatttaaataaattaacccaaagagacaccgtactgatgaggcccggtctctttcggttaaatttgcacgtttcgcgaagtgcccatttttgcactgtcgcgaaagagtcgggggcgtttgggccccagtttttgggcccccgcgtttgggcccccgtttttgggccctcgttttttgggccccagggtcgtttgggccccaagtacagaaaaatgaaaaatcacagtaaaaacaactttttaaatttcagcataaaaatgtaaaataaacagtttaaaaataaattcaacaataattttaacaataaaaaatgtaaaaattaacagaaattcacgggttcattcgatagttgcgagaaattccccggagaaactccaaaataatgtgaaattgattgcgattgtggtaattgtgatcatggttgatgttgcctgcattcatcgggacgtaaaggcgcaccaaattaagaattcgttcatctgtcgccaaaaactttcgcttttttggtggtggctcctctccggcaatgaatgacgcgtatttgacgtctgttgtcttctgctcacgacttagcacgtcaatgaagtgaaaaatcgacgggtgtcggcaattgaaggcgccctgtagacgatgatgctccgcctcggagtggttgttggtccgtgaatcggcattaagcgtgcgtgtgtagacgttccattgttcagggcgaaaagttggttgagaccatgtgccattgggcctgggctgtccaacgtaattgattaatagcctgtaatttcagtggggtttaaatttaaaaaaagttcacacaccagtcaatcagcggttggaaaaccgccaaatttccgaactccgtatcaagtgccgctaccgccattctaatgtcacacaagggcacgaacgcaacagacgtgatcattcgagcgttctcggcaaacacagaatcggtgcagtagcgctgaaacgggtcggggtcacttcggcgccgcaataatttttaaaaaaattattaaaacctgccacaaattttgttccttcaatttcttttgcaaatttcgcacaaaatggaagaaacaaaaattgatttgacaccctccaaatacagttgtgaccgcattgctcacggccaattcgaaatcaattgtgaatgatgtaggtgcaaatgttggccatgcctgatgtaggagctcaaacatacgaatgtatgacgcctgcgacttcgatgtgagcagaaaatggcacactggtatgatccatttgcctcgtctaaacattgcaaaataaaaaaatttctaaaaactaactaacctagccaaaattgtataaatttgataaaaaaagtggcggcgccaatgaaaaagtcccgtcaccgaagcaagcttccagcgaaggtgtaaaggtggccttcgtaagacaattttactttttgttttttggttgcaattgggttagccattcgaatgttaattaaacctaacttatgccaagtggcgagggatccctcaggcttagtttttagaatcttaatttttaaaaaagcacatttttcgatttttgggttggggcccaaacgaccccggggcccaaaaacgggggcccaaacgaccccggggcccaaaaacgggggcccaaacgcgggggcccaaaaacgggggcccaaacgctctggtcccgactttaacacgtttggttatggttacatattttattttatatttgaattggcattttgttttttcgccaacgttttttccaacttttttctttttttaccgtccatgcatagtgttgctgatcgtgagatgcaaaatggccaacaaagatgtctctctgtttcggcatcctttcgtgcccattttttgcctaattattgtcgcagtaaaatgtttgttaattcggtgctaccattccactgattttgaggtggcatttaacatttgaaaaaaggttcgaaatgctgaggtttgaaggtccaccgcaattggatggctttggcttaccatttgccaatgtccgattggcatcgctccgatttgtcccaatggacgttggactatccgcctatttttgcttatttggaatggatttttgcacaatttgaaaataaattcaagagggccaaacaatttttgtccgctaattaccccccccccccccttccctaattggcattcattcgtttttctattcaatta

SEQ ID NO: 6403 - DNA, 1728 bp, Heterodera glycines
  misc_feature (10)..(11): n is a, c, g, or t
atatttatannttgaatttgacttacaaattccaaactgaccattattcgatggtacacaacactgcaaaacaattttttttaactttttctcaaaattagtgtttttgtagttcacagcaggaaattttttgcttttgatatggttttctaaagattttaaaaattttttgaaaatttttttcggcgccgaaaaagccattttatatagggcgccgaaattgccgcgccgaagtggccgcgccgaaatggccgcgccgaaaaaacccgcgccgaagtggccgcgccgaaaaaacctcgcgccgaaatacccgcgccgaagtggccgcgccgaagtgggcggttcccaacttaatgagtaccttgttgggtatttagtaatttacttgtcaatttgttcgtccgtcagtgttttcttccgatcagttcaattaccagcttaagtattttatgaagtcttaatttttaaatgtagttcttactcgtttcaacctcctctcattgttcgtcaaaacttgggtcgccgtgtttgttgcttgttggattaaatttgcgatcagctcgtctgttggttccatttcacgtaattccaaaacctaaaacaaaagatttaaatgtctaatgtaaatgaacaatttcaatatgtacgttacttgaattgccacagctcgtgcatcttccacatcctgttcgtctccttgcgcgttgtgaaacatcaacagttccaccgcgcgtccacccataaattgcacaatttgcgcaaagcgttcttcatctgtgtagagtccttcaacatcgtgccaagaagtttcgcccaaattgcctccttgggcttgaatcgtgacctattaaataattgatgaaaattaataggaaagtaagcattcattttttgtaccagattgctgaaaactacttactttgtctaaaatgtcgatgttgttttgcccatattttatcgcgtgtgccgcttcgtggtacgctgtgaccaacaaattctgtactccttccaatgccggcccgagcaatatattgtatttgcgcttgtacagtccaaatctccaacgcccgtcaacttttccatatttagcgaatcttggttttcgtttttttcttgccattgctaaattaaaacttaaaaaagaaattcactgcaattaaaaaaaagtagccgatgaaaacggtaaaaagaaacagccaaaatattcatgttgagtttaattagaaccgcattatatgagcccttgctcattttttcggccatttgggctccgggccatatgaccgatattttccaaaaaacattatttgtatacctacatgtattaatataaaattcaaaacaattctatttaatgcacataatccaaggttaccctttgtcgttacagacccgggactgaaatggccaaatggctttgggactgaaccgtccaaagccaaaaacgcatggaattgcgaccaaatagataccaatcgatcccttacggtctgctaatcatgaattcgaaggaatttttggataaaaaagaaatttacaaaagttatggctcctcaaaatcgttaaaactgttataaaccgattcagtcagaaaaaaggaaaaaatcaaatataaaagattgaatttagcttattgcgctaaaaaaccaccgccgcatactcgactacggcggccagtaggtggggcgagactacgggctccggaagaagtccgcgcgtgatccgcag

SEQ ID NO: 6404 - DNA, 1619 bp, Heterodera glycines
atgcataatttttttctctatcgatatgcaaaatttggtgcagattgtatgagtagaaaaaaagttatatgtggcgaaataaatgttataataaaaatattagatagtacgccaaaaggagacaaaaaattagagaaaaaaagataatgtttttctctggcattctctatttattggtacacatctcgttttttcggacggtgtgtgcacggatcatgagaggaaatattaaaaaataaattatttaaaaaagaaaaattaacaaatcaaaaagatttatcaatttttgacatgaataaaaaagaaaaataaaataaattacgaagagccaccaaaaaatctggcaatttgcgatcgattgcaatgttgtgcaataatacagctgctgccgtgatcaatgttggcacattctgcaacttaattcgtacttcggaatgtaaaatatggaatcgcctcttccatctggcaaatgcattctcgacaataacacgcgtttttgcatgtgcataattatattgttgctgagctgcagttgtagggtttgcaaaaggtgtcattagccagcgacgtgttgggtaagcactatctaccagaataattccttggatttggcccccttcaaatgcttcccatacgcttgactgtcgaagaagaacaaaggcatcgtgactgcaaccaggccattggcgagaaaatttgaccgttttaaagggtcaggggccccctttttcactcaatttttcgagttttaaaccggttcaaaaaccgttttttggcacttccgcaactggagacctacttcttcgtgcatagctcgtcaagacgaatcgattggtatatcatttgtgtcatttttttccggggggttgactatagtatatccaaaaatttatttacacaatttttctgtctatctataattttaaattatctaacgagttccagatgtgctgttattgccatttttttgaacccctccgcgtctgtcggctggttgatttgtttaattagctctttcatagccgctggcactttctcatgagggattgcgatataatcccccacctgtacaagtcttgtacggtacacacccgcgccaatcgcgctattcatggcgagtgcgttaagtttttggatatcctggaaagaaaaaaaacaaatatttttcttttgtttttttaaattttttggaattttttattttaattaattttttagattttccttttttttttggtttttggggaaaatttcaaaatagtaacgaatacaatcccattaagcttcatgcagcttacttcttcagttaaagaatttttattttcaaaaagtgccgtcgtgttttgcattcttttcagaaggtcacgatcatgtaaaaacatagttaggccactgtaataatcatccatccacttttggagctctttttttttctcctcactcagacccatttgtactggatccattttaaaataaaattattgtactgactaaatgaaaaagtaagttaaaaataaatgtgtttataatgaaagcataatgggaagaatgaaacgattagtaaaatgagcggaaaaggacaaaggcaggccaaaggaaatgcaaagaaaaattagctt

SEQ ID NO: 6405 - DNA, 1678 bp, Heterodera glycines
gccatgaaagtggaaggcgcagtcccccgccttctgacgacggacggctcatctgaagaggaaatatgcaataaaattgaataattatagtaggaatagcgcattttgaattataattagaacaagccattcgccggaattcggagcccacaaaatcgacgattttttgcggacgtctcaaaaaatttccagcattatttttcaatgcgccgtagcattttgagttggtttttattaacggagatttgtaatataggtaattcaatgccccctcccgttttagcaaaacattttttttttaaagtcgtgaaaacatttttcttgaggcttggaggctgatcatgaatatggcatactttttggcctattccggacccgaatttgaacaaaatggggcatttgacccaaaatattttaactatttctcaaacaaaaaaaaaacttaccggcaatgttttccttcgatgttccgggcgttgattgagccgtccttttagagcgctttacaaaagcgttgaaactgctcgtctctttgtccaacttttggatgaatgagtccaccatttcataagtgctctcggcgagttgaatcttttcattgcacaaatcattggcccttaaattgttttttgcacattttatcattttgccagtttcccccacaaaatccgcacttagcgaattgttcttcgatttcctcatatttccgctttcgttcgtctttgcccgtctttttccatgtgtttgccatttgagtcattttttgtctgagctcattttctgccagtttcgccttcacgtccaaaactcggatgtcgtacaaattctcctccattttccgatggatcggacgcgaattctttagacatttttcgtaaaggtcttccatctttttaagctttcgtaaaagtgaattaatacaataaaatcctttaagagggataaaaatggaaatttaagttcgtaaatgcgcccttcgagccagcagataagtcatttgatttaaaaaaagatttacataatttggctcatgcatttttttaaataagaaattgcatgagagaaagaaacaaaatggtcatacacataattgagaaagagacgcagaaaattgcgaaattgcgaagcaaaacgaaacaaaacgaaatgaaacattttcatttcttttttcagtgtttttgaagagaaaaaaattggcatagagtcagaagagagatgaatttaaaaagcaaatgatgagcaatggacaagcgtattaagcaattcatttgtcatttgtttgtttccctttgaattcgcccgccaattttcatcactttttaaaaacgaattaaaacttgaaattgtttatttttgtattgttacaacaactcctacatacagctcagcttcatctcgattatgatcaaggcaaattaatgcttattagatttcattacattatttagcatatttttaccagtttcttgatcaaatacataattaatggtttttcttggtttgctcttaaactaattagtaattactaattaacaaataattaatgttttctaattttacctcttgttcggctattatgtatgtccattaactatttcattatgcaattttttttcattccattaataaatatgtcctctttttcagctgttattgtcattttatgcagcacaaaaat

SEQ ID NO: 6406 - DNA, 2824 bp, Heterodera glycines
tgtattgtcatttatgcagcacaaaaattttgtcggcaatgaacggggaatgttttcgcgcaaaaaattcttgccaatgaacccggtttattccattggcactcccgttgaccagcagcaacagcagcagggcaaaaacaatgaagcggcggacaacagtgaaaatgtgccggccaatcaaatgccacccgaccttgacgaggtgtgtttaggctacatgactcaatgctcgagcacacaaaattcgtaccaaattttcatttcgcaattttttctcggcatttgtgtcttgagtccttgaaaaccgattagtttagtgtgtctgtttaaagttaatttccattttatcttgttttgaaatatttttcaattttccacaggctgataccgcgcatcgcgtccaaacggacacttttgtcaattatgcgcccctccgactgcgttccggctttccccaccctgacgaagttgtggaaacgctctcgctcagcagtgtttcgtcgccggaaattcgctataccatggccatccccgacgaagtggtcgacggaggtacagacacaaatgggaaacatgagttttcgaaggtccacaatctcttccatttaggcattccttttccggggattgaggagaggattttaaccccttttctggtccgacaaaccaaaccccgcccccttttttcagatttcttaattaggattcgctttttaccaaattgaaaagttgcctgatttgggtgtcacttggtctattgtataattggtcaattcaaatttaactctcgttcttaggtcggatatccaatcttcagttggaagccgcactgtacgcctgccaagctcaccagcgttttttgccttccggggaaaggattggctatctgattggtcagttttgccactttttggtattttttttaaactcattcataaatttttttaaaaattcctgacccattggctccgcaagaatagatttttttccaaaaatggccgttttgaatttttttggccataaatttcgaatatttcccatttccgcttcttgccccctggtattttcatcaccctttccatccttcggcaaatgccataacctttttatcaactttgtgtttaggtgacggtgccggcgtgggcaaagggcgcacaattgcggcgattattttcgagaatttcttgcgcggccgtcgcaaagcgatttggctgagtgtgtcgtccgatctgaagtatgacgcggagcgagacctgcgcgacattggggcggacaaaattgcggtgtgtgcgctgaacaaattgcgctacggacgcattgggtcctccgagagtggcggtggcatcggtcggggcgtcatttttgccacttactcctcactaattggcgagagtcggcgcggtagcacggcaaaaggtggcaaaagtgccgacgcgatggaaatgatgaaatcgccaacgacacaaaggcagcaacgacagccgcttgtaacacgcggcttcgccagttggtccaatggtgcggccgcgagtttgacggcgtcattgtgttcgacgagtgtcaccgggccaagaatttatgcccaaccgctggctcaaagccgaccaagacgggcaaggtggtgctggagttgcagcaagcgttgcctggcgcgcgaattgtgtacgcctccgcgacgggagccaccggtaaagcgctgggtgaaaacgggagacggtcaggggaggaatattgttagctatacttttttcgatattgtcgctgagatacggcattttatgaactattttgcaactaaattttccatttttcagagcctcgcaacatggcctacatgtcccggcttggcctctggggccttgggctgaccttcaaaacattcggcgagttcatccatgcggtggagaaccgtggggttggtgccatggaaatggttgcgatggacatgaaggtatatgtgtaacggcagtaatatttataatgggtcgtttaaaggggttccccggcccttgattctggacatttctaatcccgaaattactaatttgaaatgcccctggttcagctgcgtgggctgtacctctcgcgacaactctccttcaaaggcgcgagtttctccgttgaggagaccccattgacgctcgacttcatcaacatttacgacgagtcggtgaagctgtggatggaatgtcggcgtcaatttgcggtgggtttcatcttcgcaattaccattttgtatcattaggttttttctggattatttgttaatttttgcttgcgccgcctattggcacagtcggacttcgtcgtacaattactttttgagagtttgaccccaaaatggtaaaatttgtcatcttttggcgcaaaatccctacaaatttttgccttttcactcaggcgctggaaatttggacaaataagaccggaaaaaactttcactgaagagcctaaaaaacaaaatgaaaaagttttgggttcgtccatctgggttttttctggatttgggtttgaccgatggcaccgttacctctgccgtggaagaaataaggattttaaaaatacatttgtcttttggttgacaattagtgcgctttgcttttcagcgcgcacttcgtcacatcccggacagccgggccagcaagcagaacgtgtgggcccgcttctggggcgcccaccagcgcttcttcaagtacatgtgcatcagtgccaaggtggactcgtgcgtgcgcattgcgctggaggcaatccgatgccaaaaatgcgtggtcatcggcctgcagtcgaccggcgagtcacaaacgttggactttttggacgaaat

SEQ ID NO: 6407 - DNA, 874 bp, Heterodera glycines
ccccccccctggggaccgtccctgatatgcgggctgaatattaccgtctccaaattcaggcacttcttccgcatggcgccatgacattgacacggccggtgacggagacagccaatcggcagcactgaagcgttcaaaattgcatttgttgtgcggcggcggtgacggactgacaaccgagcgtgaaagcgggggcaactctgagtttgacgaggaggagggggagggcagcgacgactacgactcgtacgggttggccagtgacgatgacatgtcgccttcatccaacaatttgtccgacgatgatgaggacgacgagctgagtgcggagtcggacgatggcggtgacaacagtgacgaggaggagttggaacgtctgttgggcggaggcgcggcggcgattgacggcgacgctgtaccgctcgccaacgacggcgacaacgcatcctttgaacagccggaagaggaggtggaggtgaaccctttctgcatggacttggccgtcgaggacccgtgggcgagcgtacagaagaagcaaagcgttgaaagcggcggtggcaaatcgcagcaacagtcgctggacaaacagcgagcggcgactgtggcggcggaggcggaaaagcagcggcgactgcagcgacgcaagcgcaaaagggaggcggcagccaagcggaagcgacaacagcggcagatgcaggaggcactgatcaaagccaccgtgtccaacattacggtactactacttttttgtatattttgtctaaaaatccaaaaatgaaattttagtgcggcaccagcgccgagcaatttatcgccgagacgaacataatcgacggcagccaggaagacgatgcggacggaagtgtgaatttga

SEQ ID NO: 6408 - DNA, 1780 bp, Heterodera glycines
tgtctccgttttgtagtacaaattgtccagcaaatgttttccttcccctccctccgtctcttcctccgatgagtcactttcttcctcgcgaatttgttcaattgtcattccctccgcttcttcctcctcctcctcccattggtgccgtttttgttgcaccgccgccggcttttcaactccgtccatataatcggcgatcagttccaaatcggacaggaacaggtggacgtcctgttgagatattgggccttaatttgtgggcatttaatttgggactaatcaatggaaagcaatgtttttgccaaaaatgggatttatttgtttatatttttcattttattattcatttatttttccaattttaccaaagatttcgccttttgaagcgaaaattgacaatgtaaagaaaggaaaaagttttttcagcaaaaaattaaaactcatttcgcagaaaaaatttaaaaaaaagaattttgttttatatatttatataattaaaattgtttattattattggcaatttttattttaatgattaaaatgttcgcctcagtttccatcatttaatacgtggaattggcgcgcgttgaaatgagtggcggcgaatgcgcttaaaaacgccttcacataaattatttttacaaaacaaataataaccatcacattttacaaatgaaaaagttttaaaaatatagtttaaaattataggaatttgttagtaattttaaaaaagcactcataaattaaaaaaatacaaaaaaggaattgcaacggccgggaatcgaacccgggccgcccgcgtggcaggcgagcattctaccactgaaccaccgttgcttagtatatggacaaagtgaaattattagaaaagggatcttttggtactaggtcgttatttaaaaaactatcattatgattttatgtaaaattatttataacttagcttaaaagcaaccaaaaaggttttttgagttcatctagccctaacatttttgaaacttgacgaaattttctgaaattttgtaaacttgtagagcatacttagggctatcgaatgatatgaataaataaaagttttattgcttttaagctaagttataaataatttttcataagatcataatgatggttttttaaataacggctccgccccgatcttttgctgtggaaacgcaacataaaaaaggtacggatgtttctgtttacacacttctcattttattttgctgaagaaattataaatatttaattattagggtcgcgatttttagtgatttaactattttttgttcaattgttttgaagaaagtagctcaaaaaaagcatttctgcgttgaaatttttcgattttaatgtcacaatcggtcactagaaaactctattttggcactttgtcattaaaatagttaaaattcactatttgggttttgtcactattttttccattattgcgacattttttggaaaatttctcaacaaaacaataaaatcaaaaatatacatatccctaaaaacctaaattttcaaaaatatatccctaacggactcgctcagttcggccctcacggttcggccccaacgtgtttttccactatagcttttttatttgtaatccaaatccaataatcttggtatcattcgaaagctcttaacatgctctattagccttacaaaaagcgaaagtttttcaagcctggaaaaaattttattaagaaaaaacttcaaaaatttcgagtttttcgaaattttcatgaataactttttgtataattatctaatc

SEQ ID NO: 6409 - DNA, 1312 bp, Heterodera glycines
  misc_feature (1238)..(1238): n is a, c, g, or t
  misc_feature (1264)..(1264): n is a, c, g, or t
ttttttttttttcccccccccccccccccccccccccgccgggcgagtatcatccctcacaatctgcgaaagaatgagttgatgagagggggagagaagcgaatgatgcgagtgatgtccacccccaacgcaacccacccccagccaaattacatataaaaagggtccccaaagacaaaaccattcactccgttccacaatcaatgaatggtcccttaaatcttaaatggtcattctttcttttttgtttcctctattttgtaatttaatttttctttccatttattcttcacttttttaaattaattcccaactttgaggagtacctaaatacatttgtatgttgtatgtaagtcaaggagtccccgaagctgttctacccgtaccggtttacgaaattttccatgttttatagtaaattgtcgtaaacggaacgggaagacgcactccgaggaataggttcattcaacttattgtcagcctgcaaccgtgcaaaagctgtgatttgccttgctgagcattgttcttagtcatgttgtcgtgcagttgatttatgactagaacgaatgttcagcacggcgagaacagtgacggcaaaaaacaaatgcaaaagtctgccgatcggattggcatattggccgttgtgaatgtcatctgatcggcgctttcattcacatgggcgtaatgtgctgattcgttttgctgttgccattctttcgcctgcccactcattccgcactcaaatcttctaattctcgctaaagtcagccgcggcggttcgtgtatgtgctcttcggtggactggccataagcattttgctgctttcccattgttcaccgggagaacatatacgagctgaaggggttgaagggcatggccaacgaatgtcctaatgtgttttgtcgcaataagcaaattcgatcccaaattcaaatcaatattcactttaaaactcaaatttactattaaaatgcataatttgtgatcgcttttcgcttcttttgtgtctctttcggtgagccttctccgtaattttttgctcaccgggagctcacaaatggagtgcgaaatttgcgtccatactaaacaaataccaaatgtctaaaaccaaagccagacgatggtgcttcttcatgcacaaatccagaacagattttggggagatttggcatggtagaagtccatcctctgcttttggtattgccattcattaattattttcatttttacgcatganatgcagtgagtaaagtacccaactanaaacggcatggattcttggattgacgaggattttgcgaaactggcatt

SEQ ID NO: 6410 - DNA, 4659 bp, Heterodera glycines
gctttttttcggtacgctttttccaaaactttgaaaatttgagggtaatttgttaacaggattttaccccccccccccccccccccctcttcccctcctttttgcccccttgggcttgatgagtgacatcaattggtgatatacgcattgaataagatggaatgggtcggccggggccgaacaacaactgaaatgggaagaataattaaatttcgccgaatgctttttctgttggatctcccgacgaaaagcccctgcccattcccattagctttttattatccgacgccaaactaaaccgccgccgtcccacccgtggcactggcatttattcatcagcagcggtgctttctttagtcagccgccgctgttgtgtgccttttgagaatggcacgaatcgatgccattgcttttggggacacgcaaatttgggaggccaaattttattaattcttttttatttatgtagaagaaataaatcagtagtttttttaataaataagtcgtcatacataaatgtcttccgtcaaagtcgccgtcagagttcggccattcaacacgagggaaatcggtgggaaattggccgaatttgaaatcgaaaaaaaaacaaaattcaaagaattgagctcaaaatgtgtcattgagatgggcgagaaaacgacaagtaagcaaacaaaaaatggagaagaaatgaaaaaaagtaaaataaaaatgaatgttttgttaagcgataacaaaccttttcaacaatcagtcgaacaaattcgaattcgacttttcctatttttcattcgaccgaacgaacagaaaatatgccagccaagaacgggtctatcttgaaattggtgcttgaaaagcgaaataaaactcaaaagttggaaaattgaggtgccgaaatgcttgatcacgccttcaatgggtacaatgtgtgcatttttgcctatgggcaaacgggtaagtcatttttgaaaagagacaatttttggcgtaattggcattcctttcattttccacaggttccggaaaggtcagtcagttacagtacgggggagaaatgttaccgtattcattcgaatggacaaatgttttttccttttgatttttgcccatttcagtcctatacgatgatgggcaaagcgaacgactcggaagagatgggactgatcccgcggctgtgccgcaatttattctcgcaaatatccgtgagcaaaaacgaacatttgaagcacactgttgaggcatggcaaatggaaaatgcaaatagaaaattcaattttataaaatgaatttgaggtctcttacatggaaatttattgtgagaaagtgaaggacttgctgagcccgaggaatgagaatttgaaagtgcgcgaacatccccaaattgggccttacgtggacaatctgcagaaaatggcagtctgttcatacgacgagtaaaacgggcgggggtggcgggtggcactaattgggtctaatttgcatgtttaaagcattttcgaattaatggacgcagggaataaggcgaggtaattaatacattaattaatggggaggggggtaattaaagaaattccaatgaaaaaaaacacaaatttaaaaaacacagaactgtggccgccaccaatatgaactcgacctcgtcacgttcacatgcaattttcacaattattctcacacaaagagagcacgacacaatcacggatttggacactgaaaaagtgagggaaaataaataaataattataatttaataaataaataattttttgattccataggaattattttaatttaaaaattattattttctgtctaaaatattttcattaaattaaaataattattttcttttgaacaatttaaattaaaggttagcaaaattttcgctggttgacctgctggtaagaaagacaaattatttaaaaaattaactaaactcagcaaaaccattgtttaggaagtgaaagagccgattcgacaggggcggaaggccaaagactaaaagtcgaaaaataaacaatttaatttaattttggcatttaaaaagttttaggagggcgcaaatatcaacaaaagtctgacaacacttggaatggtcattaaaaaggtaaaatttgtgaaataatatttaaaacaaaatatttaattttaattgtttagctcgcggaacaatcgaccaaaaagggacggcactcgcgcaccgcagtgattccttaccgggtcagaaacgggcaaaagcatcgttggcattccgcttgttcaggactccgtgctgacttggctcctccgcgagaatttgggcggcaattcgaagacggcaatgatcgccgctttgagtccggtaaattttggaagaaaattagcagaaaaacttccaaaaatacaggccgacgttaatttcgacgaaacattgagcaccctaaggcaagaaactcattcatatggaaattatgtgatggttaattgctccgtcaaagatatgcggacagtgccaaacaaattgtgtgccgtgccaaagtcaacgaggacccaaacgcgaagctgatccgggaactgaaaggtggggccagcggcagaagggcatcggtaaaagcaagcagtacatccggatttgatttaagaggaagtgtacaaactgcggaacatgttgcaaaactatggagtggaggttggcaaaataaggacgaaaatggcacagtgccaagccattcccctgaaatttgccaggttgacgaaaacggggacatttcgtcgagcacgcgagtcttttcggggagagaagaggagacgctggaacagatcaaaacatcggagaaactgatcgcggaactgaacgaaagttgggaggacaaactgaaaaagacggaagccatgaagtaaacgaaagagaaatacggggggggggagcaattaagtggtaattaatgggccaaacggacgacaaacccggcacagaaaggtgcgtgaagaagaactgcgcgaactcggcttggccacctccgcggacggatcggcactgggcgtgttccagcccaagaagctgcctcaccttgtgaatctgaacgaagacccgctgatgagtgaatgtttgctgtactatctgaaggagggggtcaccaggtcggtaatttgtgcagttaaaccatttgtctaattaattaatttaatttaaaattaattttttgctttagggtcggaaggtccgaggcggatcaacggccggacattttgctgagcggagaacatattcgaaacgcgcactgtcagtttatcaacgcggacgccgtggtgaacattgtgccaattgagggcgaatgttttttgaacggacagccaatcgaaggtgttttttggagggcacaagataaaaccaaacccacaaaaaacagctggaaactccaccaaactgagctcgggaagtcgcataattctcggccgaaaccacgtatttcgcttcaatggtaatttgtgaggaaataattggccagaaaactgacaatttgcagaccctcaagaagttcggacgagtcggcacaatttggcggcaattgcaagtgagggagggaggaactgatcattgcatagattaatttcttcaacgaatgatactgttttttttgaataggagaaccaatcgattggcgttttgcccaacatgaactgtttgagaagcagggcatcgacctgaagcaggagatgcacaaaaaagtgttggagatggagcaacagtttcgcaaggaaatggaacagatggaaagggaacaccgaagacggaacaatgtaaaagcaagggaatcactcggaatgattgttgtaattgccccaaattgatttgatattggccgataactctcgccctcccccattcattaatttatttaattaattggccaggagtacgaaagtcgcattcaaagtctgcaacggcaagtggacctcgcgcacagtcagttgatctcctcctcgggttgttcaagttggaacaacggcgagttcattctcagcaaaagtctgctggccgaaggtgccgttttctgacggcatttttaaaataatttttaattaagtgaacgaagacccgtggactgcgcaattggcgatgaaaatgcaaaaagcagcgctgaaatggcgctattaccaattcacctcagtcagagacgacctttggggaaatgccatctttttgagtactataattaattaaattgattaaatgaataatatattaattaaatgaatttgttaaaaattcagaggaggcaaatgcaatttcattggaactgagaaaacgagttgaattccaatttgtgctgctcaccgacacaatgtacagcccgttgtcaccggaactgttaccgccgggcgaaaatttgagcctgagaccgtacccaaagacgggtacggtgggaaaaagggaaaacggaggggagggggaattttacactccgttcttcggattttgcttttcactttaagtggtggcggtccaagtgcgcgacttgaaaaacggagcccttcactattggagtttggaaaaattgaagtgagtcatttgattgttggcacaaaaatggaagagaaaagggacaaaagacacggggaaaggacaaaggaaactcaaaaagggacaaggtgtcaaaaaattaagcaaccaattaa

SEQ ID NO: 6411 - DNA, 2277 bp, Heterodera glycines
taaaattgtaaaatttcagatttgatttgggcaggtatcgaagtgtgttggaggtgcaggaactgttgggcaattgcatttcattggtaaattattacatatttttaattgatcaatttgggttaattaattttcaaaaaatttatttaaatattttattcaattgaccaatttttctttatttatttcaaaaagattaatttattgactattcttaacacttttttgaattattttacttaattatttaaatttttttttgaaatatttgaaatatttttataccttttttttttgaagatttttataaataatttttacttatctaattaatttaatatatttttttaatatttttaattattttaactttttttcaattatttataattaaacattttttcttcttttttaggttacgcctacacgtgaacttctgacaaaagctcgtctttggaagtgtactggtcagttttggaggacttttttttgttttaaacacaaaaaattaagccattttttagggcccagtttttagggtcatttttcaaaatgtaaaaaatttcaaaaatttgccaaatttcagccgcttccgcaagcggttccaccaaaacggaggagcgttggctgttcgtcttcaacgatttgctgctgttggccagtgatcggagcgctttcattcgcggcaccaccggtgccggaaagtgcaaattacgcgcaatttttgccgcaaagtttaaaaaaaattttagctaaaaaatttttgggaattttttttttccagacacacccaaatttgtgaaggtgacagcttggagcgtgagcattcattttatttgcggggctccgattcgccgcagggtgatcaattaataatttaccaatattactttaattaattgaaatttttaaatttaaattttcaataattttttttattgggcaactttgagtctagattttcgacttttttatacttcgatttcgattttccgaggccaatttgtgtggtttcgtgaaaacactgaccaactttgggtatcatatcatccaatcaattaaattgatctgcagatttcctaattattcaaattttctctacatttaaccctacctaaaaatttataaaatttcgaaaattctcttcttttttttccaggccctcagcgatgtgtggagttgtgttgtgcttctcaggcagaaaaggacgcactgtttgacattgtttggaaagtcattcaccatgaagtgagttggagttataaaatggaaaattaaatatattttaatgtttaaaaatttttgaaaatttttttagacaaattcaaaaaattcggcggaaacattggccaaaaacacgaacaacaatagcagcaatacagaacagcaacaacagaataaaagttgtgcacattgtgacactgactttggatggtaaagcgattttgggaaaaatgaaaaattattaaatttattttaaattacaaaattaaaattgaatgaaataatttaacaaactattttgtatatttaaaaaaatatatttcattaattatgtaaatgtatttattatttttagacagaaattaaaattaattaattgttacataaaatttattcttttattattaaaaatttatgctaagtatttattttatgaaggtgattaaacaaacatttaaaaaatatatttttttaaaattaattattatttttttaaattttaatttattttccaattttattttcaaaaataattttactccatgcttttcggttcccaagaaatttgaagcttagcaatcatgaaaaaaaaacaaatttttaagccccagaattccgactttggcatttccatcattttccccaggtacacacgtccgttggtgtgccaacgatgtcaacaacggttttgcaagcgctgctttggccaacggcgcaaggagcagaaaatgtgcttggactgtttaaggacagcggtcggtacaaatgccatatggggaagggctggacgcaattacggattaagccttaattacggcgtttttattttttatacctctcataatgattaatacgaatcccttaattacggcatttttatttttatgcctctcgtaattattaattacggatttcttaattacagtgtttttatgccatccataatacagcgtttgtagaccctccttcgcgtgattacggattactggtttccgtaattacaacaattaggacgttttaacccctcttaacacgcccccccccccccccccc

SEQ ID NO: 6412 - DNA, 3826 bp, Heterodera glycines
aattccattaaaatttccaaaaattttcctcggctgcgcctgtcgacatcgtcagaatccatattttgtcatattttcggaaatttgactacaaaataagcaaaaatggtcattttttcagtgaaaaatgaatgaatgagtcatttctgacgattttttaatcttctaaatcacatttcattttttcgaaattttggatttaattgccccaaaaaagccgagggatttcagcccaactacatatataaatattcagcaaaaattccatccttcagcccttaattacagtacataaaccatttgaatggggtggggaagggctacgaaacatacggtaggtgtttacgggaaagtatagtaatctatggttttgtgaaaaattaaaattcaaaaattaaaaatgctcttcaaggccagctatgtgtccttctgcgggccctccggcaaacagatgcaacgcttttttgtgctgcgccgaaatttctgtctctattcctatcagacggacaaagtgccaaaatttgcggaattttcccgctaaaaattttgtttaaatttctcaaggacaaatgcgctttggccatgttgcccgtgtccggctgtgacattggtgatttatcatttatttacaatattattttgtgaattacctgaaaaaaagtttaattttttaatttatttttaatcatttttacttaaaatactaaatgaaatatatttaattcggtaatttaatacatattttttgtaccttcaaattatctatcttttaacggacaaagaagtaaaaaatctctaatatttaaatataaaatactttttaatacataaaaatggcaaaatttatttttaaaaaattaaatgtttattaattttaaatcaaaagaattttgttttttaatctggacaattacatttcagcaatcaatcagaatgaaaagttcggcttcacagttcggcacgcgcatcgaacctattgggtgacatggtaagactacagttcataagtctccttttccaaaaaaatctctctctattccccgcccccccctcccttaattagttttaatgagtcggatcatgtcgaatggatggcggcacttttgctgtcggcaaatgccaaattgccgggcgaaagcgacgcggacgaaagcggcggcggtggaggagaagggcataatcacggaatgcagcagcggaacaacgccaccaacaattacgggggcagaagcacccgcagcagcacaatttgtggtgcaatttatgtttttttgattaatttttaaattataaatttatttttatttcttctacaaaaatataatttttgattttttaattgagaaaaagcaataaaaatacgaatttataaaatttaatttaaaagttttattttaaatgtttcattcaatttaagtaattaaggctcataaattaaatagactaaaataccaaataggggacataaaatacgtactaaaaatgcccgaaatataaattttaaaaccatagaaatccaaaaaatataatttgaagcgataaaaaatttctattttaaattaaatttaaatttttttctcaattaaaaaagttgtatttctcaaagtaataaaacaaaaatgttgacaactaattgcaaatgattccccttttttcagataatctgaggggggctgcagtgatcaattcgccgcgtccaaaaccgtcattttgcgcctcaaacccattcagcggactcattgttcgacgctccgcttccatgggagacgcgcggtaattttcaaaaggaaattattaacaaaaaaaaacaattaaaatttaattaggtaattcatcattaatttttcagaattcgccaaatgactgctcacaatcggaccaccgaaaatggacaaaatgaaaaagacgaaatggcggaaaaaaattgaaaataaaaataaataaatttgtatctcccacccataattattatgctgtaatatcttttttttaaaatagtaaataattgaaaacttgactttttacatacattcaatagctcattcgaacgctcttaggctctacaacatctgtatatgagtttttacgcctgactaattttcttaaaatttgaaaaaatcaagtagtttataaaaaatcagataaaaataaatgattttcaaaatctgagttcagattcatgatcagcgcatttttttactctagaaaaaatgctttttgaaattttactatttttttacgtcgggaccgcaattccacaccattgccatgttttcaggaaaattttctttctttatccaaccatcgaaaaaatcggaaaacaaaattaaaaagccattcatttccgcaattcgcttcgtcgtccattctctgcccaaaaatcaacgacgatcgtggtagaaatggtcatcgcctcggtcgtcgcgtctgcgacggtcgcgcccaccaccaccgccgcctcctcctcgatcgccgcgatccctacgaagaaaaacaaaaatattcacaaaaatttagcagggcgataccgccgccggaccttaccccctaaaaaaattttttacgtaagcgcagcgaaaaagcgaggccgaagagcacccccccccccatcaagagtctggctctaagtttttgcccaacataaccaccacccgccgatctccctcggcggtcctttttcgtccgtcgtccacccacctgttgcccccttctcgacgatcgtagccatcatcagcgtaaaagcggtcgtggcgacgtgtgctgcggtaacgtgcaccacgattggcgtaacaacgttcgtagctgaaaaattaaaaaaaaatttaattcgaaaaatctttgcttccctagggttttttgtaaatcgccagacttacacttcatccgacacatctttgaggtgcatgaaattgcaaaagccgccctttgaacaggtggaaatttcgtgctggcgacaacgcgcctcgcgaaagtcggacacgggggacagctcggcgtagatgggctggccgttgaacctgcggagagaagggccatttgttgttgtgacaaaaaatgatagtaattcctctaatatacacaccccccccccctctatcagtgctggccccttagggttgaaaacggagaaaaatgggcccaaggaaactagtatcaaatggcatagtaaaggaaaatcacgccgtaaaaaacggcgtaaaaaaaggtcgttgcgtgggatgcaacctccaagccaaactcaaggactgtcgctgtctcaaaaaggcagaaacttctttgaaaatcgaaaatgggttggtaaattcttcacagcgagtacctccacgtggacacaaaaaaccatctccaagtaaaacagggtatgaggcgctcatttaataccaattttttttaaccccaaaagtagtaaacgaaaaactccgaaaatgtgtaatcagtcgaggaaatgaatggcatttgctctattttgtgaccaaattccaattcattcccccaaaaatgctaaccatcgattctccaggccttgcacggctttttctgcgtcctcctcataaacaaacttcacgtacacattgccaatctgtgaaaaacaatggcaaatgatttgttgagcatgtcaatttgtaccatgtgctcgccaatgttttcacaaacctaaaattgaaatgttttgtaaaattaagggaaaaaaccatctccaacttacgttcaattcctcaacaggacctgaaaatttagaaaatcaaaaattgtaatctcatcaaaaaaaaaattagaattgccgaccataagtgcgttggagttcggtgaacacttcctcgtaaaa

SEQ ID NO: 6413 - DNA, 8052 bp, Heterodera glycines
ttctatacgtcatattgtacctaattattaaatttattccccccttattttcctggaaatagagtaattaaataataaaacttttttatttatgcaaattgtataaattttactacatgaaaaaaacttttgtgtcttttcttgtcggaaaaattgtctctggtcttttctattctaggcagtctaattctcttgcctttgcgtgtaaattcgtccgatcttttagttaaattaattaattgctctcaaatatcaatttaatgacatctgtataatattgaataggtcaattaaatttatcctctctcaagttacctttaagcttggcaggtttaaaattttttagttcttatttttttcatattgaatcggcatttgatctatcattaaaaatcacgtctttaaaactattttctttaaacattttacacatttgtctgattttactttttatatattcttatttgaaattataaaataatattttcttgttggaacctgtccttagtgttgagtgttgaacgttgacatcattttgattttaattttatcgaaactgtaaaattataaagatcaaataattctaatggcacaaaaataaaaattaaactttttatctttatcttatttttaactatattcttgcttttcttttagttaattgcctttaaatttatcggcaaagataaaaacaatctcaatgacatttaaaatcatttattgtaatattttaaaaattatacttaaatttttttaaataaattatttaatgcctatcagtaagtatatcatttcattgtacaaatgtctttttttaattgtatattaaatattggaaatctttattgtattatcattatttattttcatgtccaatcgttctttctgttcattcgtgcattatgcgtgtatatttttcattatttgtatttttctgttttgagttactatggttaaattaccttttaaataattttatgttattaaaatgtgagatcaactgaattaaaatgcaccttataaaacaattttaattttttatctataattattttaataatttaaatattttatacataagatagaattttttagccattataaattaagaattgtaaaatattcatttttccattcattaaatttatgattattttctaaacattgaaaatgctagagttccatatatatttatttttttaaataagttcttttgaaatttagatttaaaaaatgcgcagacgattgatttacataagcaaatcatacccgctggcaaaatgaaatattttaagtgagagaaaaaagatggtacaagcagaagcgataagcgaacgagaaggtggggttgcacttgctgctgcgacaaaaaatgcattatcggaacgcgggagtgaggttgaacaacaacatcagcaagtcgtagtgatggcccgtggaggaacaataagcaatggggatggtgcccgtgcaaaagcagaggccactggtggcgctaaaagtgttgttgaaacgaggattacggaacatcacggtgaagagaggctagctgcagctacagccgtcatacatagagaggaaaggagagaagaaagaagaagaaaaatacgcgtaagaaacagagaccgacaacaaggaggagaagagaggcagcgcggagaaggacataggcagtctcgcccaaacgaaagacacaacgacaactttcacagttcgctacaattgaatttaccgcccaacagaatggaccgaaaggaacaggaggaacacatgcatcattcacgagatggtttgatgggacagtcgaacaatcaacaaggagaagagaggcagcaaggaggaggagggcataggcagtatcgcccaaccgaaagtcacaacgacaactttcacagttcgctgcaattgaatttgccgcctagcagattggaaggaagggaacaggaggaacgcatacatcattctcgagatggtttgatgggacagtcgaacaatcagcaaatgagaaaacgaattcaacgagaatgtttttgcacgtgctaatttttttggtgtttggtattgtatgacttatattaattttctaaataaaataacaaaaaaaaaagaatattattttttttcaccaatgagagcaaccaggcaaattggaaagacggtcttggtctaaatcatcattatcatcatcatcatcattagtttcttcttcgtcatcttgttctgttctgtgtcgtgtttgctgttgcgcatttcggaaaccaaaaggcagggtctccattccgggccttattcgtcctttaacatagtgggggcggtaatccttgtgtgcttgataggtgtataaatcagcagaagtgttgcggcctatttgaggaaaagcaacacggatcgatcgcgatgagccagaaaaaacgaaagtgtcatcataatcagcaaaatatagtgcgtcatcactaaaaataatcagcagcagattaatattgcaagaaggtctaattaacacactcacatttgtccatcatgatcgtagtgctcaagaacaatgtctttcattgattcaaaatttagcagctggctagtggaatatgagaggcgaaaacttctgacttttagctctgctttttcttccgctcgtgtatggcgatcacaatgtcgaaaaccgtaattttttggaccaccgcttataaattcaaatattcgacgttcaggaagctctcgcttcatttgacccagagcttctccttcaggcaccaatcgctccccattttttgcaacataataaatagaatcggtatctaatcactagaatgtaaaaaaaaagataaaaagctgaccacaatagagaagtttatgaccaagttgtacaactttctcaatgtaggaataaaggtgaagtcttgcgtatgaagtaacataaattgcaatcggcaaacagttggtcgctggtgcttttgaaaaatcagcttttgtcttcacaacaacacggtcaagatgaggtgaaacatgatgaaagtcgagtacttctatcgaagggtcgtcgagcaaacagtggaactcagatggcgatgaagcgtaacgaacttcggttcttcccacgcgttgggcaaacttgccccaaagggaatttgccagcaatttctaaagtagaattagcatagaggatcattactcaaggcatgttaccgcaaccattcgaagaccaggattatttgcaatttttccacggtcgagtcgtattccttcggcacgctcaaactcgtcaatatagtcatcgcgacgttcttcgctttcacaaccagtaggccatccacttgcttgaactttcatgcccacaaatgtgttcatataaccacgaaacatttcagcatcccattcatcataatgccaaacctatattttattttttttttacaactttttttcaaatttatcgagttacctcaaacagatcggttacggtatatccgagttcaagcgctttgtttagttcaacatgtgtgtacctaagtgtataaaccaatcgatgagcggggggggggggggggtcatacgcagcgttccaagaacgtaaatgatctgtatgtgcacatgcgcgctgttggcgattatcagcacaacgagcacagagaggaaaagtcaggcgcccatcatttgtccgatatggtagcagcgggatacgaagagggcttagaaccggatctggcggcaaaacacaaacaaacagcagccctcgaaatgtattgcagtttgcgtttctccatggtaatggagatgccggaggttgtaaaagcacttcacgtgtaagcacacgaggatttccaacaggaaaatcaaatgccttcatcacgtaagggtagagactcaccttgaattaaaatgctattatgtttgcttcactgttgtgtatgacaaacaatatcgatgagaacaatttcctcatcgttagtgcaaatgtgttggagagtaaatggctctgtgcgccctccacgcagggcatcctcacgtggatccaacgggcgaggaacgaaggcgtcattgtacatttgccgaagcactggattggcccgcaaacttttcttcaactcacatccccaaacaacgtgaagctcgaacccgtgcgtgtgttctagctcccaaaggcggcgttgtgtacgttcatacaactcttcagcagatctaccgccagccaaagtttgttgacgatcgtttggaaaacatttgggacaccctgagaattattattctttttcatacgcatttaactcaattaatactaccatgataaaaacagcccatgtattcaatcgctatatttcgcagaggaggtagacgaacatgtaatccatccaatcgataaccagaatcctcaacatgcgcttcccccacagtccattgcgccgattgaacgtgcacacccgggttcatcagttcatacatgcgaatgtatcgtgcggattctgccgatgcgcgtcttcctcgtaaataaccgccctcaggtgtgttgatcagtttattgcgagacagaaaacaacgtcgaaaggttgccaacgcaagtgctgcacccgtagatgcaataacaaatggatccaagcccatggtattctccatgatcaattggcgaaatttcagcacactttcacgcaggatagctacatcattcgcacaataaattataagttgttctctgagctgaaatttggcgactgctccttcataagcataccaactcaaaaattgttcgcgtttggccgttttcatgtggtctggttgatagaatacagcatttggcagcccttggaggcgaacattcaaattttggtggcgaataaataaatatggaaaaaacggcttggcagttgcaatttcatttggcaaattgaacgttcttggcagggcgtcaagttcacagaagaaaaaattgagtgtgtctttaaaggttatttggcgctgaagatttcctttaagcgacattgagtaaatttttagccccgttgtgcagattcgttttgggggtaaatttcgatgatgtagtgcctccaaaaccagatgcatgtcgtattttccaccattgtgagacaaacaaatagtatgcgattttcgagggcctgttgagatgaggaagtcaagaaactggtccactgggtttttggttgcgtcttcaaagcagtggaagaaaagacgtctaggattatatgtgatgtttgttggcatctcagtgtcgtcatttggtgcgttacgaaagggcgggctacaccaaagacggccccgtggccctgatggcatgccacaaacacaaccattcgccttctgtccaataccgccgtaaatggtaattctatcggcaatgcagcgctcgcaaatcacttgagcaataatcaaaagcggaacatgtttttgcggaatttgtgttcgaagttgtaatggcctgtcctgagatgtttcagcatcgaagaaacaatatctaattgttttttgagaagcttggcgacggtggccaccacccccagccccatgctgggactcgccttctgcatcattgtcatcatcggtatcatcttctttatcggcagcatcatcgttgccattcaaacagttttcaactgaagattgttgctgttgttgttgttgtttttgttgacgccgtgtttgcccaaaaacacgacgtccatccattggctgaataaaacatggaccatcttccgcatgaggtcccccacactggtggcacaatgatgcaaattgctgttgctgctgctgctgctgctgttcttgctgttgttgttgttgtcggaccgagggtggacaaacatgttggaaattggtatagacgatccccccacatgctcgacaaacacgcctccattcgcagattgaacggaacgcgcgcccgcttcgcccatccaaggtggccggtgcgcgattggacaaatgatagttgtagcagtccaaatctgggaaaacgaattggcactgtgtacaaaaatgtttgctgttccttccgttggcaaattgttgttgttggcaagggtagtttgcaccatagcgtagacaaaggcggcaaacaactttgcattcttgcggatgataccaacgagtcacccgcctttcacaatcaacgcaataggacgtgcaacggaacagttgttcaatacgcccaacatagtgaaaatgggcgttctccaacaataggcacaggttgaagcaagcagcacggccagacgcccctttgaaaacaattcgatactgtcgcactttctcaaaaacagttagacgaatctgtgcctcttcgtagcgttcatcaacccattgctgaagctgtctgacgtcatccagcgtgtacatatttttattcgtcttaattcccgctctccgtaacagatggcgagcatcaggcccatgaaatcgttgttggccaacataattcttaaacatttgttgtccagctcgggtgttttggtactggcgcgaacgatggtctttcaacccaattaaaacggctcttgctaggcacaatctgtcgttcggattccgaatccggactaatgagttgacggtgtgaacaacggagtgttcatgatcccatgaacacgcccctatagaaatgattcaattaacatccattgtggtctcttttaccttcacgtccatttcccgttcgatcatcatgcattggccaaacagccaaaactttggtaagcgttgtcccggctgttaagtctattcctgccgctgattgatcgttcaaacgttgaatatagtcagcaattgcggccggatttttttgttctggaggccgaagagcaattgtgaatggattctcaaacgtgggcgggtgcaattgtaagccaatcaaggagggcggtggccgatctccaagcactcgcgcaaacaattgttcaacaagcatttccaacacgcggtccggtcgttggacttgttcaagcgggacaaaacgcacttgtgccacttctccccgagtgttccttggcctattgcgcatctcatgcacagactcgatagaaaatggatttcggttagccatttaattcttaatgggagaaaagattgaataaaggtaacaataaaaaatttattaaacactcaaaaaaaagcacaacaaatatatatttttttttattggtcaaagggatgcgctagtcgatggctccgaatttattttttgttgtgttgcttcttcggcttcttcttctgttttttctcttcctcaatttcggacatcgctttttccacttggtcatttgcgaatttttttaggcgttcagagtaactggaagcagtttttttggggatggatttttggcgcatttttttattttaaatgttaatgacctcattcgaacgaagaagcggaataacaaataaatttacagcaaaaggggcggagcttataacagaatccatttttcggtcatcatcgattattcaaaaaaatcattcattgtttatttcatcatcatcaatttcattgaaaatttgcgctacatactcggcatgtaaacgcatcaattcttcaaattgcacaaaatcctcttcttcttcttcatcttcttcctcttcttctcctctttcttctccctcatgaacgttgaaaagcaaagcctcctcaacatccaaaatctgaatcaataattcagcttgttgttgttcgggttgttggggctcaggcagcggtcgagcttccaaatcattaaaatctagcgagatatttgaaaaattttcgcttggaggcatttgcgaaagtgaatgatttagaagcgcatgaggaggcaattttatagccaggccttgatatacgaggaaaggggggggggacggggagaagcaaaaagcagcaaaagagggaaaaagcaagtagagagaatgcagagaaaacatacaaaaacgaaaatagggcggcgtgttgcaatttctctctgcacgcttttgcaccccatcataaattgggggtcagaggatggtacgggacaccggggggtggccaacaggccagggggagccggcacgcaccacctccgctacaggctttggaca

SEQ ID NO: 6414 - DNA, 609 bp, Heterodera glycines
ttcacggcatcatatcaatgattttgatcataataactccaccagttttaattatcagctttcaattctcaatctgtgcttaaatttgctaaaaccaaattctccgtttttaactctgatcagtgtttgtccatcgatcactactcatttcctttccaaatttttggcaaaagaaattccggcaaatgatcaaaatccaaatcggctgttactccgatcattttggcaatgaactgatgctagtgctttcgaaactgatcaattcggcttccacccacttgatcggaagctgttggccaacgcaaagggcggcgtccgccgccgtttggtcttgggccaccgcctgccaactgagcactgtggtgaagcccgggtcggtgaccacgcggcactgcagttggaactgctcttcgccgatgtcaaacctttaaaagccaaacatttggaggcaattaattaattaattaccccctctcagcccgacaattaaaaaaaattccataataggcatcatttttgcagaaaatttaattttcacgaggaccaatgggaaaacccctcaattttcaatcccatctcgaaaggagaggggttattagaggggggggg

SEQ ID NO: 6415 - DNA, 1433 bp, Heterodera glycines
  misc_feature (1400)..(1400): n is a, c, g, or t
tctagagtcaaaacaatttgccgaaagaattattttttattttcaaaaatatataaaattaactcaaaaatgaaaaagggaataaaaattatgaataattttattatttttttaaattaacccaatcagcagaaggggtgagaggcaaaaaactgacaattttcttaaaatttgtggagattactataaaaattttcagcaaaaaaaattttgaagaaatatttaaaaaatatatgtaggtattcttttcttacgagaatttgtaaatacggccttacgatggataaacggagaatttcatcagagaaaaaaattcaagaaatttaaaattttcgcaaaattccgtcgcccgtcgcgcacctccgctcagccatccgtcggccgctttcatcggtgtgatgggcgggtggtcgcctttgttcgtgccgccccggggccgcgcaatgccttccctcaacagctgaatggccgtgtccacaaagcgttggcctttggccaactcgcgcagagcgccgacaaagtcgaaactgtccgggtacgcggtggtctccgtccgcgggtaactgagcggcgatagaaaaaataaggatggcacttttgctgggagtcgattagcaggggactaattagtctaatcagcaatcaacagaaagccaattaataaacaccatcatagatcagtggaaatgatcacagcagaatgatgagaggcggcgattttgatcatccaaaaatagctgatcaaaatattaaaagaattgaaagtgatcgaatgattttgatcatcacccaaaaaggccggtcaaaatataaaaattgatagaaaataaaactgatcggaaaacaaatcaattttaaatgttttaaaattcgaagctctccactgtttatagccaaccgactgcactgagtcagtgccagcatcagaaattcgagaacccaaatgagtttcagagggaatatgggaaaggcgtcgagagtctcgagcaaccagacaggcgcggcacaagcggttcaaccaaagtgcccgcccgtccaccttatgtatccgcgggtgtacaagtgttccgcaacagccatggtttgcgcgggagacagtcccaacgcggtggacgccacccgcaacagttcgaccgtgtgcagtgcctccggcttctccttgcggtgctctttggaggacacgtcgcacaccgtggcggccacgcatttctgtggcaaaatgtttatttttttttagaaaaatctcatgtaaaaatttttcgggggaggaggggtgtagtacaccaaattaggcctgtttttcatactcttctctcattgttggtatgtaaaaaacggattttttgatggaaaatgattgttttgggttctctaatttgtaagttagtttaaaagaaaanaaattttgaaaattttaaaagcattttagcatg

SEQ ID NO: 6416 - DNA, 3025 bp, Heterodera glycines
agtggtattgcgagtccctgtccctctccaataaatgctcatcggggaaaaattgaaatttttgagcgaattttcctaaaaaaaatccccaaaaaatctccggcacggcacgacccaccggaacaccgccgcgtccataaaattggcgccgcccgcgccgcgcatcgccggccgcacggcgtcgacgacttcgaagcaaatgttctcgccctccttgtcacagtcgagccacagcacaagcatatcgcaatgtttggcctcagaggcgagaaactgaggaggacgacaattgatttaatttaattaatttaaaaaataataaaaattaattttaaaaatggaaaaattaaattttaaaaataaatggtaaaaatcaaagatttaaaaaaatttaaatggacattttgcgaaaaagaaaatgaaaaattatggaattttttgatgttaaagggggtgaaaacgggaaaattttcaaaaaaatttgaaaagataaatataatgccgtaaaattctccctgatttttcggcatttttgtcaattaaatgcaaattaatggcattttttgcaaaaaaaaacaaataaatacctccggcattttcagcttcggatttgcctctttttgctcaatgttgcacagaaacagctcggccgggtcagtgcgatcccacgaattgtaacgggcggggaaatcgacgccttaaaaattaaaatttcgaaaaattaaatatttaaaaacaggccaaaaaattcaaaaaaaattcattaaataaaggtttctgatttttcttttataaaagaaatgacaaaaagtttcaaacacagaaaatttttgcttttaaaagcaaatttttcaaaaatttagtaaatgccggacaaatttaaaacattaaaaatttgctaagaaaattggtaaattcaaaaaatgaagtttttcaattgtccaaacatcttaaataaggataaataaaggacaaagctttaagttttgtttaaatctcccgatttaatttaaaatcaaatttttaaattttaaacggaaaattaatttttgaaatatttcttaaaaatttccaatttattatcccggcacttacacatcacatgcccacaggtggaagtgacccggaaattggcctgttttccccgaaacgatgctttgtactcggacactgagcaggcgccgttccatcctggcaaaatggggcaaaaattaatttaaaattaattagtttaaatttaattttattatgccgtgccatgcctttccgagtgtggcattttccgttggacaaaattttggcgattgcctccgccaaaataggcttttcggccaccattagcacattcattgcgcaacaacaccttagattaacaataagtcaattaatttaattttttaagggttaggagcgataaaaaaatatatattaaagcaaaaacgaaaaaattcgaaaaaaaataaaagcgttcgtaaaatatttctgactcctccaacaaattgttaaacatttcaaattttcattaataaactcatcgccaaaatatataaaagtaaaaaaagcattttaatcgactcgaacaattaattcagtgctggacaacaattatgtttaatgagctaattaatgaagagtctgattgaggcagaaataaaaaaggacggaaaagagaatgatgagaagctaaaaaggaaacggactgaacaataattattatcggcgggttaaaaaaacagaatttcaatgaatgagaagaaatgatgaatgattagttaccaagctcaattagtggtgcgctgttcgagagtcttggtctcgggtgaaggattaagcaggatctgcgttcctctcattttgtatgaaaaatgcgcagttttgagccaattgggaaataattgccactggcggacccccaaaaaaacaaataaaaggagaaattttaaattaaaaaaacttgaatcaattagcaacaccaagcttaattaatagtgatgctgatcaagagtctcgacccgagaaaaatgttgatgagtcattattttctatggttttttcgtgtctcaacattcgggtgccaaatgtcggtcttgtgaaatttaactcttgaatattttcaaatggattctcgagtttttacccgagaagagactcccctttttggggttcaattgaaagctacagtctctgtcaagagtattgtgaagttagtcctcgaaaaccctatcattcgaagcaactaacgcttaattactcactcattcgtcagagtaaaaaatgacatttttgtgtgattattttctccacgtgatggcatatttaaaaatagcatttccatacttttttaatgcggaaaggtgggaattgctggaaacggaggtgtttggtgagcagtgaaatttacacaattatcggtgaagattggttggtgaagttgccggatcggacggccgacacaaaccatcgaaggcctaataatgtggggaacgggggaggggagggggggggggatatgcgaaagatggaaatcaacgaacgatggatataaaaaagtggccaataaggttgtggatagcacacactttacttttctgtaatttgtttaaaaaatattgttttttgatcggaggcgacagattgtgagatgatcggtgtaaaaagcggtgggatgggaacattgcacgaacggccaagtttttgccggctttaaaatgatttgttgttggaaaatggatttcattttgagcaatttgtggaggagtggagtcgtacagcagttcattctcctctcctagtcgtaccatcccctgcttctattcgcatttctttaaacaattacatattcaatttgattattcattttttttaaattttagttcattgcttcatcctcttcggctatactgttcttgaactttgttgagcaatggcaaacaaagaaaacgaagtaataatgacaaaaaatttaaattattttcacccctcatcctcaaacatccccccgggcataataattaccctaaagaaa

SEQ ID NO: 6417 - DNA, 1868 bp, Heterodera glycines
cattcgtcagagtaaaaaagacatttttgtgtgatattttctccacgtgatggcatattaaaaatagcattttcatactttttaatgcgaaaggtgggaattgctgaaacggaggtgtttgtgagcagtgaaatttacacatttatcggtgaagattggttggtgaagttgcgggcggatcggacgcccgacacaaaccatcgaaggcttaataatgtgggaacggggggaggggaggggggggggggatatgcgaaagatggaaatcaacgaacgatggatataaaaaagtgtccaataaggttgtggatagcacacactttacttttctgtaatttgtttaaaaaatattgttttttgatcggaggcgacagattgtgagatgatcggtgtaaaaagcggtgggatgggaacattgcacgaacggccaagtttttgccggctttaaaatgatttgttgttgcaaaatggatttcattttgaacttttagttcattgcttcatcctcttcggctatactgttcttgaactttgttgagcaatggcaaacaaagaaaacgaagtaataatgacaaaaaatttaaattattttcacccctcatcctcaaacatccccccgggcataataattaccctaaagaaatccaaaattggccatgtgcggagtttcttatatttccacttttttaatgagtcttttttggtatttagtgcctgatttaaatagcacgaaatgtacaaaattgatgggcaaagaagggagtggagcaaattatttgaaaatggccatttttgagtaaattaatttctatttaaggtcgaaacgtgggagctgagctctgtctgccagacaattaccatcaccgggctgtcccaaatggtgaaagtgaattttgtcgaccaattgtttgcgggtaagttgtataagatttaaacatttaattttataatttcataatttatttaggcattgtcggaattgccaattcaatcgaacgctttgggggaccgttcccgagtttggatgtgttcggccttaaccgccacgacccaaattatgtaagtttaacacctgtcatgcagcgatctcaactgatttaaaatttcggcaatttatgccgcaattttgtgtgtgcttataattcaccccccccccccctccctcatccattttgcagggtttttgtattaacgaatttcgttgttaatggtacatattttaggcgaaccgcgtgatgaaagaagccgccgcaattgtcgatgattgctgcgactctcagctgtcaactgcggctgatattaatatgctttctgtctgagtgtgagttcatttttttgtaaaatattaatggttttggtaaataaatgtccgtacttactgaaatatgaccccccccccccgcgggggcagaggtgttccaaaatcaacgaaaatgacaaaatactatgtgcaaaaattaattattatgacagtgattgctcaaggcaatttgcctggtcgtggcgctccctttttgcctggggcaatcggatgcactccaaaaatttgcggccgaaatcgcgccggaatattttttggaacataactttattagttgtttaagcaaattaagcagggtatttattagctgccgttttgttttcgttggttttcgcacccatgcccccgtaggggcccaacttttaccccacacggagggagggctcggcggagggggggttatatcatgaacgactctatttcattaaatacagtataatattgtaataattaaagtgccaaaattgaatattctatatttttgtgtaataaaactttccctcaaaaaggtgatcgggctcaaaatgcagttgaatggtttgagcaa

SEQ ID NO: 6418 - DNA, 2245 bp, Heterodera glycines
  misc_feature (2176)..(2176): n is a, c, g, or t
  misc_feature (2186)..(2186): n is a, c, g, or t
  misc_feature (2234)..(2235): n is a, c, g, or t
aaaacgattttcgggtttttgaattttaggaatttttaacgaattttcccagaaaaacggagaccacttccaaaacatagtttttcgagctctatcgattggtaatttttttggaaaaatttcgattttttcccggaaatagaaaaattttttggcctgagcgggacatttcagtcccgggcctataactcgtcgggggttggttctagccaaaaattgccttagggcaaaattgtagtgttttttaagctctatcgaatggtgtgccttttttggccctcgggattttggcctaatatttgaaaattcatatctagcctaagggttgaccaattttgagtaaataaagctttaaaaatagagaaaaatcaggagaattttatgggatttatttaggttttctaacatcaatatgaaaaaagttattccagaaattctggaaattttagatttttcagaaaaaaattcgtaactgccttctgaaaagctatttgagaaaagtaaaatactacaaaaatccgcaatttttttctctataatataaattttattttacatttttatctcttttttgcgaattgttataaaaataaaagtgattttgtgcttcgggtccaaaggggggtgggtgggtgaccaggatttttgagtggaaaattttgtcaatcatccaaaaatatgtctttaggcgtaatttgggccgttgatcacgaatacgtaatcagattttacttttaacatcgttaaggcctcagaatccccgtgtgattggggattctgaggcatcattttaagggggggggggcaggttcgaatccggacagtgtacattattctatctatttattttttggataattttcactgcatttaataaattaaaatagtttggttgtaaattatttaaattaattttttttaattaaaaattttcattatttattttttgaatttgcaaaaaaattaatttcatctgttaaacctcttctaatcacctctttaacgggcgcgaagcgcccgtaagagttcaacgaatttaaaaaacgggcgcgaagcgcccgactgaggccaacaaaaattgaaaaaccggcgagaagcgcccgactgaggccgcgaagcggcctaacaagctaaaaaacgggcgcgaagcgcccgtatgagttcaacgaatttaaaaaaccggcgcgaacattttgaggtggggggggagttcggattcgggcgtgtacattattttctatgcatttttgtgttattttgactgtttttaattaatttgaagatttcttttaaattatttaaatttattttttttaaattaaagaattacattatttttttttgaatttgtaaaaaaattaatttaatttcacttaaataaatattcaattaataatttccataggtgtatatttacgatcaaatgctttaaaaatgcagaaaaatacggcacattttatgccttttatttggtatttaaacaacagatacgaaaaaagctatgacaaaatttctgaaaatttccgaattttcggaaaaaattcataatcccttcatattaggggtacaggtagaacataatgatccaaaaatccgtaatttttagctctacaaaaaagttacttgcactatttatccatcacttcttcaaaaaaagttttttctgtgctattttggccgcttatcacgaatatgacatttatttttagtttcatatttttcttctggcgaaaaagtggtctgatcactgttgaacctcttctaatcactcttctaatcgctgttgtacctctccctaatcactgttgaacctcttctaatcgctgttgtacctctccctaatcactgttgaacctcttctaatcgctgttgtacctcttctatttacttttgtacctcttctatttactgttgtacttcttttaatcactgtgaacctcttctaatcgctgttgtacctcttcaatttacttttgtacctcttctatttactgttgtacctcttttaatcactgttgaaccttttctaatcgctgttgtacctcttcaatttacttttgtacctcttctatttactgtacctcttttaatcactgttgcacctcttctaatcactttttacctcttctatgggaaaattttttcctccaaaattgcttaaaaatgacttttctgngctattttgngccgcttatcacgaatatgacatttattttcagtttcagatactttgnngtcgtttaaa

SEQ ID NO: 6419 - DNA, 5485 bp, Heterodera glycines
tcgcatcgatttttccataaatgttcctttttcacttagttaaattttaatttcgaacaaatatttttatactttatttcattaaaaattcaataatcatacctatcattgtttataatcattaacgaaaatgccaaatcactttgatcgaacctggagggactgttgcaaattgaccaatcaaattttgtgcgaaattttggaacgcgacgaattgcaaatccgtgaagaaatttcaatgtggaatgcggtaaatttttttaaatttaaaaatgttacaaatttatttttaaaataagtccgaatctttttttaatcactaaattgttttgaataaaaaaaaataaaattttctctttaatttccttactattttctcttctctgacttgtcgctgctaccatttttagcggcgggcagagaagaaaaaatagtaaggaaatttgagagaaaaacttctctcaatttaacttgatatttccaaattgtgtttaaaagcggaaattatcgcatcgattttttccataatgttccttttttcacttatttttattctcaatcgagccaatttttttaatactttatttcctttcaaatttagaattttgcctaccattgtttattttacattgacgaaaatgccgacactttgatcgaatcggagggatttttgcaaattgaccaaaaaatgttgtgcgaaattttggaacgcgacgaattgcaaatccgtgaagaaatttcaatgtggaatgcggtaaatttttttaaatttaaaaatgttacaaatttatttttaaaataagtctgaatctttttttaatcactaaattgttttgaataaaaaaaaataaaattttctctttaatttccttactattttctcttctctgacttcaacaaataatttcattccaatttcaaaaaaaattcaataatcatacacatcaaatcttataatcattattgtacctcttcaaatcacttttgtacctcttttaatcactgttgcacctcttctaatcaaattttgtgcgaaattttggaacgcgacgaattgcaaatccgtgaagaaatttcaatgtggaatgcggtaaatttttttaaatttaaaaatgttacaaatttatttttaaaataagtccgaatctttttcggactattttataaaattattatattcaccagcctttccatatttacagttttcaactcgtcctcaaaatggcactgttttggcccgtttcgaagcgctggtggacaaacattttatgacaggacgaatttttttataatttcggcaagtattttttgtttttttctgttcttcttttttgtttttgtttttgggttatggtcccaaaagccttaacagccccaaattttcaaaattcaaaataaaataaaaatttttggaaattcaagaaaatttatttgtaaaagtaaatagtttttatgtgttttttttgaaggattttatgcgtaaaatatttaatggcctccaagtaggcaagtttttttttgtgtgtaaaaatgagaatgtttcaattttttaaattatttttttaggatttttttccaaaaaaacgaacttcaattttcagaatatcaaagtggtggacattctcccctttttgaccgtccatctcttaagagaacattttttcttaaaattaaaaaatcttttttttttggaaattttacatttttaatttaattttttgaccctttttattcaattaagcctaaaaatgcattttctatgaacaaatttacatatttaactaacattttttcaaagtttcagctgggtttgcatggtgtttggatggacattctccccttttgaccgtcctcaactcggcctcaaattggcattgctttcgccccgtttcaatgctccagtggacaaacatttcaacggctgaaggcgtaagtttcagtttcaaattggccatgaaaatttttctaatctctgttttttttggattcggcatttaaaaaatttaatttgaaaattttttttgagaaattttttcgatttatgacctcagaatccctgtgtgatttgtacctcttctaatcactgttgtacctcttctgatcacttttgtagcttttttccccattttttaaataactagagcgcaaaaaaaacctttttttcagcgacgaatatcgattatattttattattcatttctcagtataaattttgttattgattcccccccccctcccttttgttaaataattaaaaacaccaaactaccaatgcttattaagtttttcctttgtatagaattttaatctatatttcaaacattttagataattctctctttattttttgtttttttcagctgattttttgcaacactttggatgggcatttctgaccatcttcaactcggcccaaattggcattgctttcgccccgtttcaatgctctggtggacaaacatttcaatggcaaagcggattgctggcaagtttcaatttttctcaaagtaaccggtcaaatgtttaataagctctaaaattgtgattgcattcggcagttcataaattgaaaacggaaacaattttctttgttgataaaatcttaaaaattgtaattttcaagcatatgaaaatcaattattgtaactttttgaaaaaccaaaatcgctcaacattgtgggcttataccaattccatcccgtaaataatttgtgaaataaaaaaaatgttctgaagcaattgctatgtttggccggtttaaatcttaaaattcatcgatttgaccatgaaatgaataaaataagaaaaaatttttagatgctcatatatacaaaaattatggcaaggtgtacactaagccaatagttttgctaacccaaatctgaggttagttaggaattaagtttcgtacactttgtcacgcataagctccaaaatagaattaagaagtctttacacttgacagaaaaaaaatgttcttaaatttttaaaaatattattcagtcaattgtaaagatttctgtccttatgacccttttgagactcacatttttatttgttttcaaatcttatcggtctgctttgcgaccatgatgagatttgtgcacgtgccggtctgctttgcgaccatggcaacatatcggtctgcttagcgaccatgatatgtagtgcacacgccggtctgcttcgcgaccatggcgaggctggtctgctttgcgaccatagccattagtgtcggtctgctttgcgaccatgacacagtgccggtctgcttcgcgaccacggcacccatatcggtctgctttgcgaccatgatatggaacccaagcccagacctgctttcgccttttgcgttgcatgtggctcgttcgcgcaatggtagcgacacttatgtggccaaattggcttacccatgattggattgtggtcattttgacctgcccatcatgggactgtggtcaatatgtccagcccatcacgggattgtggtcaacttggcccgccccttcttgggattgtggtacgatgacctgtcctttgaggattgtgttacacaacggtttacaatgatgatttccttattgttaccggccaacatccggtgcgaagctggtcccgcactttgccaagaccagtggactggtgagaagtaacataggatatcggagttaaccaagacttatcaagtcaaaacttgatgttaataaggacctatcctctgggaattgtgaaaggacctaatctttctggagatttgtggttcataatggttatcaatgatttcattgaccaataataataactcagcactcaatgcccttagggcagatgggatatgtgagctctggctgattgattgcagcggcttcactgtggcgatcaggaagatgcacattttatttcacactatttcaatgtttttgataaatatttgatttgagtgtggtttatcggttgtaattcctaaatattttgccacatgtacatatcatttcctcatttttgttttcagatgacaaaaaaacaagaagctaaaagaaagaatgatcaggagcgataccgacggcggacggagcaatctgtcagcccaggtcgctcacccgtcccagacggaagtgcagatgggaatggagaggcatctgcatctctccggggcaccaccaccccaagtttaagtgctttgcaaataagcacacctgcttcttccattggaagtaaaaaaaggggaagacccttgaaagcaggagcgaagccaattttggcaacgcaagaaactgtgtcctcaattgacacacctcgaactgctgtcacccaaagtgaccaaggttcgccgtgcaaaaaaaggggaaaggtcaccgagtgtgacaaacccacgtttgcaaatgaagctattgcttcaacgcctgtttcgactcaaagtcgtggagggcgacctgccaaaaaaattggtggcccaggccgaggcaaactcagtgattccatgagcaaaagctctgaaatggatatcaatcttgaaaatgccccaattccggcaacctcgcacactgtgtctgaaaaaattgacttcagcactgtgcaaattaatttcgccacatcgcgaaattttgcctgtaaaatttggaaatgggcagcaatcggcctttacgaacgtgatggcgaaacaccgattgccccaagatctggcccaagatacattgagacctgttggaatgatatgacccagtttctcaatgacggctttgctgccacatacttggcatacttggcaaccatatcacaacgaaaagtggtcgttgttgacccaatggtatggagcaatggcctggacagagtcatgccttataaaaatatgacatttgggtacgaccctaatgttccggcagaagttatacttttgccagtacatttccctgcacattggactctcattgtccatgatgtgcaatttggcactcattttgccgattctttgcctaccacatatggcaggttggatccgcaactgacggataaaattaaaaatatcatttcggatattttgccgtcagcagtgttggaagggattgttgatgtcgaaaatctgacggtccaacacgatggtaatagttgtgggtactttgtgtgcctgtatgctgagtcatggcttatgaacaatcgcacatttgttctgcctgatttatccatcaattatgaaaagaagcgtattttatggcacattaacgagctgtatggctctgataatgtgccatatcatccaagggaaggggtgccaactccttgcccaattgtctatcgacatgcggatgaagcgcagtcgacatccatgacggtagcgccaatggaagttgatggtaacgatgacatcatgatcatcgaaccacagacgagtggacaggcacttaatgtcattccaacccaaacccaagtggcaggtgaaaaccaagctgactcgcttggtttggtgtcggaatcttgcgtcccgcaa

SEQ ID NO: 6420 - DNA, 6673 bp, Heterodera glycines
cggaaccgctcagttgggcgccggcatgtttttagctataacttatttctttgtcatccaacattgttgatttcattggaaagctctaaagtgtcctctattagcctgcaaaattttaaaaaatttagttaggttcaaaaaagttatggccagaagaattaaaaaaaccaaatttttccaacttttttggccataaatttgttcaaaattaacaaaattttttggaattttgcaggcaattagagcatctgaagagctctcgaatgataccaagattgatggatttggatgacaaagaaaaatgttatagtggaaaaacatgtgctggcgcccaaccgtgtgcgcccaactgaggtagaccgaccggcccataattaaaaaaaaacattttgatctttgtacatttaatttttccaatttataaatctctctcaagtcctttttcatatagtgcagttagccctgaggccatttttttttttgtaattcgctttttgtggaatattttgaattttttctatttttactcggtttttcgcgaagatattccaaaaattttcagacgttttttccttttagcttttataactatttaatttttgttaaagggtctctacgctcggacggtgaccaaacgctggggcttggaaatgtccgcctcaattgtgccatcttcgcgcggtccgcactgggcgcgccaggacttggttgatctggttggcgtcaacaacggaggtaagtcaaatattcaaaaaattaaaaaaaaaacttgttgttggcgttatgtttgatttgtacatgttataatcaatttttgtgtttggtggtggcgtttggtcgtttgttttgttatgcaatgatagcttaacatgtgaaaaattcattttttaattttaatttttttcccatgatttggttttccacttacacttacacaataacatgcctttctataaatatgaatgtacttaacgacaaaaatttattttaaaataaagtttcccacacatttacctgtcattttttttatttacgacaaattacaatttgtaactatttttagaagaataattaaagcagcattatatccggtaatagtttttttaaattgttcaaatcgtcacaatgacaatgccaaatacggttgtttttttgtccctttacaacgaaggcacttaaaaaaaatttttttaccatagcctaaaacccaaattcgcaagtacatttttgccctctaggcaaccttttttttcataaaaaatcgctttttttcttctttttccatcggatacattattacatattctcaaaacttttttttcttcttccattcttctttttctgtttgtttgaaagcggaaattgctttttccatggagaataaattgccaacggattagcgttaaatgtacactaaacattatgtagtcaatgaaaacagttgtcggcattttttttaaattaaatcactattttttaaaaatatttttaatagaaaatctattttaatttttaagaaaatctttttttcactgaaattgtttttaaatcatgccagctatgtatgttgaatcaatttaaaaagctcatttgaacacatttgttcaaacattccccgttaaatataccaacattagtcaatgaaaacagttcggcatttgttaattaaattattatttttttttataattaggatattcttttcattgaaattgttaagtcaaatcatgcactttgtgttgaattttatatgaaaatcaatttaaaaagctccatttgaacacatttgttcaaacatttattttcccataataaattcaataagcatcacgcaattaaagcccattcattatgttctttgtttgggttgatgccgcccttaattgtgttaccaatttaagcattcaatttggcattttcaaatattatcgaccaaattttgccaccgtaattgtcatttttactttgtatatgtacaaattttcgagtttggccccaaaaatggaccctttttggtctaatttttgcgtgtgattgatgtgtccccccccccacactgactgactgcttttgtgctgctaaatgtgaggaattggcataaaaatgggtggaatttgccactgaatgcgatgggaaatggcacggcacacacacactttttagggaaactaaatgcggtcgcttacacaagcaaaataacggcgtatttttggccaaaatttatttttcaatctttttactttttgagtattaaatagaaagcccatggcatgaaaaattggatattattcttttttttacttattaatttaaatgaaaaattctaaaattcaaataaagtataaatttacatatttctttccgatcaaaaagtcagccccatttaacgaaatcttgcatttaaattgctaaaaattttttttctaaattactatctttctttagaaatttcaatttttgatttcttcgtggggcgggggcctcgcaccttcggaaatggggccatagttctgagacattgttttttttttgtactttcgtttcataaacactaataaaaacaataaattaaacctaacaacaatggtggcacattttgagacaacacacaaacacattaaatccttaattgctcgttgtcacacaaatattgtgccaaaaattttgctccatttgcgtcgtctcccgccgtcgtctatccctcccttcacctcctcctcctcttccatccttcccgcgccgttcttcgcttaattggagttttccgtgtccatgtccccgtcctcctaatcccctatctccttctcaaattccatccttctctcatcatcaccgttcttgacaccccacccctttgggctgggcatataacaacaacatttctaatttttttttcagtccatgttatcacttgcaccggtgccattccaccaccggcggtggggggtcaactctgtcccgccaattccgtcctaacaggcccgtagccagaaaattttttttgaagagaatggggaatctgaatttttcttcttttttttttttgctcttcgggccaaaatttttttcttccagtgttatttcaaattttttcgcgccgggtaaaaaagcattgtagtcgtttttgccaaaaaatgactaattttggtgtcaaattctcaaagaaatatagtaaaatgggcgttcggcggtccaaaaattagcccctttttcttgaaaatttttaatttttcatttccggggggggggggggaagatattagaaagctgctctaaatgtttggccaaattttttttcaagataagtgaaaaatcttccgtccttatttcggtgcatcttattttcctgttctgttcgccaatctagttctctccttttaattttaattctcaagaaaaaaaacatgcctacgtcattcgaatgtattccgtgtaagtcactaagttttcgagtctcttagcatttgcataaatttgtttaattgacattaaattattttcattgctttaaccttgggattctttagtaattaacacgcttctcgcttcctctataagtggagaattttctatctttttaatttgcgcttcaagcacttaattcttattccaattagattttagataaataattattcttcccggctcaatttcgacttttttatgtacagtattcttattgcttttttcttgaccgtttgtcgcacttttgttcattgtatacttttctttgaagtgtcatttccggtgcttattttaagcttttcttcctttcttaaatcttttccgccaatttaatttggatcattaattaagtttattaactatttttcacttaaactgtttccatgttcgtctttgtttgtttttagttaattgtggcataatcaaatttttgatagaaaacaattaacacaatgttgctatgacgaacacaaaaagaaattaatactctacagtaattgccaatttgttcaattaattgatgacaaacaaattcgagctaatttaaaattgtagcttataaataaataaacatcaaaaagagcaccgccctcaattagtattaagtaatctcacatccccacgcggggcggcgcggcataataacacacattggctagcggaagaatttcttgtgcctaaaatcaatgccctgcggggatatttccgcatattttaaccgaatttttacacccctttaccccacccccttcccacgcgggacggggggagggagggaggcggaaagaatgaatgaatgaatttatgttagaagtgccaataccaaatttgtgcgttaggcggtgccaatgcccctcgccccttccctttttccccttcacctatggcccctgcgggaatgaatgcgagtgattgtgctaaaattattatttatgccccaatggcattagtttcacttctactgcagtatatctatacataattttataaaaataaactgaaaatttatatttattttgtaaattcttatgttagaggtatttccttgaaaaaaaacaattttaaaaattctttgtttttcttttaaaaaacttttttgtttaaaaaattctttgaaaattgtacaaacaaaataagaagaattttttgaacgaaatttgtttgaagaaaattattttcattttttaattagaaaatctctaagaaatttataaaacaaaaaatttttgcaaaagattttgtctgtcgagggcgggggattaataaatggacaaatttaaatgttcttccgttcattttccacctctatgtaagggtaattattaaaaatgtccgagaccaatttctgtccctgatccgtacacccttttaaaggattaaaaaacattatacccgcgccaaatggcggcgaattttgtcacatgggcatttttgaacgaacactttggcacacaaatttgtctgcctccggcgtgaggattatttcccatggaaatgaaaacgataacggatatcctcggtcttctacatggttaaggaatggagaaaccatactttcataatatgtatacaaaatccttcaaaaatttttttgctatttcttcattttacctatcgagaaatgcatttgttgcattttttacttacgccttatgcttaaatatattatttttttaatttaaatatttttaaaaattggcatttctaattagtgatgtgcgcgaatttttcattaattagctatatttgacgaatttttgaacttttaatttgcaatgttttataagtttacttcaaaaatatttttgggattaatttgacgtttcatactttaagtgttgtgtatagattaagcagttaagctcaaaatccttcttgccaatgacgacatttagacaaatgagacattgacacgacaatttgcagacaaatcgtgcaaaaattcttacaagaaaattaaaaagttattaaatagggatgctttcgaaatctcatctcttagatgctatgacgttagtcaaaaaccaacaaaatgggcgttcgtcaaaaaaccatcaaatgaaagttgttttttttttggtataacttttctcaaagcaacctaattttaaaaatcttgatataattcattaaaaaagcttggtttttgagtttctcaggtcataactttttaaaacttgacgaatttttttgaaattttgcatgataatagaaaacacttagggctaacgaaaaatatcaagttttaaaatttgatttattttaaacgaagttatgaaacctaagtaattcgaaaataagaaaaaaggaagtcgggatttctttccagccgattttggactaatatacctataacaaaatagggaataaatcctttttttctttggttaaacaatgaaaatttcagaactcaaattagagtgccacgggaccgggaccgggccgggaattcccggtcatccgaggtcccggttcccggtcccgtattttgaaaagctcaggtcccggtcccggtagggcaaccgggaaccgggaaaaacaagcactggtaagaatgggggtctaagtgaaaaattagtaatgaaaattggagttaaagggaaaaaattttaaaaatatattaatatattctttaaaagtaacgctgacaattgtgcggatggcctagtggctagtctccttgacttccccttctttcccttgttcaatccctctacagaaactaacatattttgaatttttctttttgtatactcatggctttcctatcgaaaaaatatgcttcctcatagttttattttaattgacacatttttatcattttttaaatgaaaatcctaccaattgagcttaataatcccaaaaccaaccttttttgttgaaaatctgttaacaaattacaatcaaattttcaaaatttcccacggcggcgcctatcggcaccgccggacccctttctttcccaaaaagtttttggaaaaagcgcggcgaaaaaatttatgtgaaacgtaaatctgaatttctaataatattcgatcacttagtccaaaaatgattaattgtttgaactaattaaagaaatttgtttgaaaaattttcattagtttaatttttgctttaacttttggattttattaaataaaacacaaaattaaaagtttattttgaattattttccctagaaataaattaccatttgaattttttt

SEQ ID NO: 6421 - DNA, 2661 bp, Heterodera glycines
  misc_feature (1016)..(1016): n is a, c, g, or t
  misc_feature (1040)..(1040): n is a, c, g, or t
  misc_feature (1058)..(1058): n is a, c, g, or t
  misc_feature (1069)..(1070): n is a, c, g, or t
  misc_feature (1076)..(1076): n is a, c, g, or t
  misc_feature (1129)..(1129): n is a, c, g, or t
  misc_feature (1169)..(1169): n is a, c, g, or t
aaaaaagttatagcccaaaaaccgctggggcccaaaagtgccggggcccaactgacgggttccggatatttaagtttgatttgttgaatttaattcatttaaaaatagtttttttttcgcaatttaaaaaaaatatatatatttgttctagtattaaatgtcaaatttcgtttatacagtttataatttgaatttacctaaattcccatattttcaaaaaaatatattttttaaaatgtctattttgtaattaattaattaattaattttaattttaattatatatactcacccaatgcttggaagcaaaaagtgagcacattttgaaaaggcttttccccaatttgttcatcaattgttttgaacaaaacagcgccaattacgatgaataaaatggcgaataatattgtggtaaacaggggactgtagcggagcaaaaacttaaaaaaaaattttgctttaacaaaatataaaatttaaaacactcataaatattgttttaaaaaatataacaacattttaggataattaaataaaataaaataaaaataaattcaaattatccaattcgagcaccactaaacagttcgaaaatgttcagagaagtgaacgaagttttaaatgaatacatattacggaatgagctattagtatgatcaggcggtgcaaatcattttaaatttgctattaaagacccgagacaaggcttaacctaaattaggcacctcattttctgattttacgagaattatgggagatttaaacatttattaagaataggtccttattatttccattttattattattaaaatttaatttgtatttttttggaaaaaaagtatgcttctaacatattattatcaatttttttttcacttttaaagacttggaataaaagttttcattgaaaatttataaaatttgtaataaaaaagatacaagaaaattaatattaaattataaattttttcgcaattaccggttcctcaaaattaattattttaatttaattantgaaattgtttcgcgcatttaccngttcttctgctttcacangtttaagctgnntcattnttgctgctttctcttctcgctcctcctcagcttttgctttgatggtggaatcngacagaatgaagacgatcttcgccgaatgacggcctctgnttggcacttctaacattgtcgcacactcttgcttataaaaaataaaaatattcatccaaaatattctattgttaatttatttattaaaaaaaaaaaaaaaaaaaaaaggggggggggggtttttttttttccccccccccccccccccttttttttttttattaaaaaaaaaaaaattttttttttttataaaaaaaaaaaaaaaaaaaaaaaaaaccccccccccccccccccccccccccccccgggagggggggggggccgggggggggaaaggttttctttccccacaaaatttcttttttcaaaaaaaattaaaaaatttttttattttttttgaaaaagggggcataaattaaaaatcaaaattttcaactttattacttaaaccaacattcttttttctttgcattttgcactttttactagcgacacaccaatcaaatcgtttgttgttgtgtttgctatgatatgatgtccattatatttgccagtctttcgcaaatatattctcctctgctgggggtgaaaatgtgtgggaagaacaaacagcattgtttatgcccaagggcttacactggggttttgctgtgttgctgggatgggatgtgcaccccaaaattttgaaaaaatcgctaaaaaaattttcaaaatttttttttcttgaattttgtttcgaaaaattctgtctgaaaatgcagaaaaatttttttctaagggggccagtgaccggttggaagaaggaaacgaactgctccccgcctccccccccccccctcaaaaataatttaaacattcttggtgttattcgatagctccatgtttcaaaaaaaattatgaaatagtactcaaaaaacttatttttcaaaaaaaatctttttttcgtacatcaacaattttaatttacaggttcttcacctctttccctttggagttattttaaaatttgaatgtaaatttagggaactgtttgagaggaaatcccgcggatttttgcgcgaattccgctcccgttcccgacttttttggagaggaatttttgcggaatcgcctgggactcccgccccgcaacgttttgaactcccgcatccgtctcccgtaattttttttactgatctctagtagattgtacacattttttaaaattgttttttttggggggctcggaatacagatttccggttgcgaatttttttgggctgtcggattccgtttactgattgccaaaactttttcagtcgtcggaatgccaatttccgattgccagattttttgagggcgtcggcactttatacacaaaatgcattttcatttgcagtttttatgacttcctttccttgtattttacataatggtgggttctctctacgagatttttctcttaattgttaattaaggccttaattaaagtgtttttcaaatttttgcagggttttttttacaccaggtggaggataaccctaaatttaattttttattgtttttatcttgt

SEQ ID NO: 6422 - DNA, 1907 bp, Heterodera glycines
aaatgattggactttccgctcaaactgcttaacgaaagtatatcaaactttaaaaactgttgtgaatttttgtccccagttatataatgagaaaattatatgtacaaatatttgcagtttaaatgaagtaaaacagtgaaagttttgaaaatagttcagtgtcgaaaatactcagtgtcgaaattacccagtgtcgggattaccggacacgtctaaaagcccggatagcgcccaaaaatatcattgtatattttgttttgttttctcttattaatgcatttcgaaatccaactcgtactgtttttcgcattcgatagcccttaaagtttctatatctgcaggaaaaaaagtcaagaaaattttattgcttttcaaaaaagttatgaacaaaaatcatcgcaaaacgaacccattttcggagggcattcaaaaattgtgccggattataccaagaatatttaaataagtccattagggcaaaactatggcattttttttgtcgaaagacagtacgagttatgtttttccattttggtcaattttcaaaatttgaaaaatgcgaatttaacctttacaaatgaagttggataaaaaattatcagtcgaattgattatttatttggggtaaagtaaaactccccgaaatctcatcatttgcaaaatattctcctatttggtggtcctcttatgtgcgttccctttttcttccgatccgtcgtcattttatgtcaaaatgtttccgcgccttccgtttttggcaatgatttttcgcctcctattggcacttgtccaacccctcgagcccattggcaacagttgaagctgaactggttcaaaattgttttaataaaatgcgattctcgtgtttttctcatcaagtattatccgtaaaaaataggaaaaccctaaaaatccaggctttatccaacgcaattatttttctgctatttgtgtgacatcattcgaaattcaacagcaaattttgctaattgccaaaaaatgaaccgacggtaagcacaaattcgtcatttatttacctaacaaaacttttttcagttggatttgcaacgacgtttggatggacattttcccatcctttgaccgtcctcaactcggcctcaaattggcacttctttcgccacgtttcgatgcattggtggacaaacatttcgatggcaaaagcgaattgacaatttggagaactatcgaaattcgtcgcaagggcattggaccagaaacgaaactttatgtagagatcgattacgaatttgtgccatttccattgcccgaccgtccgttgcccagcaaaatccgttttaaatggcttcggattgagtaattcggaatcagagctatgacaataaaagcatcggattccggacaatccgtcagtggataatctttcggaagacaattctattagtgacggacaattcatcagtgaagaacaattcgtcagtagactgacgttccgtcaaaggacatttcgtcagagaattaaaaaaaaaatttgttgacggattgtccactgacagattgtccataaccgacggattgttttactgatggattcccactggcgcacatccagtagcaactttttccaaaaggcccaccgcttactgtatgccaactagctacagtatattattgttacaaaaacccatcccaattctacagtacccttcccctgctaccgccgccgtcctcctgttggtgttgttgtgctgtcctttttgtgccgcatgaagtcgatcagtctgtcctgcacaatgtccggctcggaagcagcttcatcttcctcatttcgtgactctgtcgaaatggagcgaccaccgccgccgccagcaagcgatcaaatctttttaaaaaaaatttttctaagtagaaaattaacaagtttttta

SEQ ID NO: 6423 - DNA, 3316 bp, Heterodera glycines
attttcatttgctttggccaatgtcagcttttcctttgtccattcgttcaccaattcgaatggcaccatttgtattgacggcacatgaacataaaaatgaatttcgtaactgacggaagaaatggcattggcacgaagaaaatgctaaacaatttgaaaacaaaaaacagtgatttgtcgagattatggccacacctccttgaaattgttgatccaatcaaagtccgtttgttcgttgtaattaccgcaacgcaatcgcttgggttgtccatcttttctcggagagtgcaaccatttggacaatgcttggccagcagaaattgttgaatttggcccatcaaaaccatcatcaatcgcagcgggaaacaaatcaaatgaatggattgaagtcaattggttgagatcgatgagaattgtcggcgaaatttgacgaagcaaatggtccaaatgatcaccatcgtaaaagcgcaagtggcgaatgtttgccgaaaaaattggccaaacaactgtaaatcggtgcctcttttgtcgaaaatttgatgatttgaacgaagaaaagcgatgacggagtgatcaatgtacctaaaaatggaaggaaagcttttattgccataactctgattttaaattactcaatccgaaggtctttaaaacggattttgctgggcaacggacggtcgggcaatggaaatggcacaaatttgtcatcgattcgtacagatagcttcggttctggtcctttgtccttgcgatgaattttgatctttctccaaattgtcaattcgcttttgccattgaaatgtttgtccaccagcgaattaaaacgtggcgaaagaagtgccaatttgaggccgagttgaggacggtcaaaggatgggaaaatgtccatccaaacgtcgttgcaaatccaactgaaatgggaaaacagtttagtcaaataaacgacgaatttgtgacttttaatttaattaccgtcggttcatttttggcagcaattagcacaatttggacgagttccgaatgatgtcacacaaatagcagaagaattaattgcgttggaaactttatttttatataatgagaaaagcgtaaaaccaaaaattctaacgaaaatcacattttatccaaacaacttttgaattttgtttgccttaaattgttgcaaatgggcccgaggggttggacaatatgccaatgggagacgaaaaatcattgacaaaaagcgagcagaaaaagggaatggcagtgcattggaatggaaggaacgcaacagaggagaatatattttgcaaaatgatgacatttgccgggcgttttagcccctacccccaaatcaatcaataaaaaatcaatttgacggattatttttatccaactttcatttgcaaatgttagacgcgcatttgttttttgaaatttgaaaactgaccaacgtaataataaatagggcttacatttttagatttttacctatttacgagaatttttgattttaaaaattatttttctcaatttgtcttaattagggaacggatttttaagcgcgaaaaagtccaaaataagtgcttaaataagggcgaaaaaagcgcgaaataagtgcgaaaataagcatgaaaaaattccaaatgtagaggtgaaatttgttaaaattgctgttttctctatgtaaattagttaaaattaagtcaaacaattttatttactgattgcagttaaaatgaagtacatttagaaattttcaggatttaagggtcgattctcaggggcgtatttttccgaaattttttgggtcgattcttaggagtgtattttttgaaaatttttaggtcaattctcaggggtgtatttttccgaaatttttttggccgattcttaggggtgtatttttgaaaatttttaggtcaattctcaggggtgtatttttccgaaatttttttggccgattcttaggggtgtatttatcatttttattgcatttttgctaataaatttccgaaaaatcgcgaaataagaacgaaaataagcataaaacgctaaaataagtacaaaaacttattttaagggcgaacctctaaaataagcatttttaagcacgaaacgccaaaataagcatttctaagttcgaataagtgcgttaaaacacaaatttttcgaacaaaaaatgtgtttttcgtgcatttctcgtcgagttaaagccgcagaaaaaataagcaaaaacttagaaatccgttccctagtcttaatatttgttgactttttaataaaatttttgtcattttacacccctaagttcggaactttttggcacctattttcccatttttagcacctatttttggggttttttagaacctaaaacctacctattttggcagtttttagcacctaaaaatgtaagccctaataataaagagtcaaactaccgtatttctctaattatatgcaagtcaccaataatctacccctttcgaagtaggttgaaaaataatctccccttctctatttatctgcccgggggataaatagaatttatatttttttcgaaaaaataacttcttttctatttttattagagtagagcgggaccgggaattttgggcaaaaccgggacttgccgggacctgagaagccgggaccgggacctcggtttttgtccgggaccgggaccgcaagaaaaaccgggaaccgggaccaaccgggaaattttaaaaattcaaaaaaattttaaaaatttaaaaaaaaattcaaattttaatttatatcaagtgaaaataatacaaaattatttggttttttataataaattaaattaatgaaaattttcaaacaaattttcttcaattatttcaaacaattaatcatttttggactaaatcatcgaatattaatagaaattcagatttgattttcacatcacttttttttggagcgctttttcaaaaaacttttgggaaagaaggggtccggcggtgccgataggcgccgccgggggaaattttgaaaatttgggtgcaatttgttaacagattttcaacaaaaaaaggttggtttttgcgattattaagctcaattggtaggattttcatttaaaaaaggataaaatatgtatcaatttaaaaaaactatgagtaatcatattttctttataggaaacccacgagtatacaaaaaaaaattgaaaataatctaatttttgtgactttttcatgactttttacactttttaaggcaaaatttgactttttgtgatgaaaattccgaaaaataagccaatcttagagacggaactgaaatttcttagtcattaggactcaaa

SEQ ID NO: 6424 - DNA, 6862 bp, Heterodera glycines
gtaaagctcatagcactgtgaatgtgttcagcatttgatatagaaatcatttttaattatatttggcataatgtttttcttaaatttttccataaaatttattttacattttaatttttaattttggaatttgcctttgcaatctttttaatttcatttttattcatttttttaaaatcttttttcaatttctttttcactcattcgtcccccattttttcattttcatgcgatttgcgttgtaataatatttttttttgatcattttctaccgaattttttcccatattttttattttttatgctctcttttccctctttaaaatatgcacaaactttaggtaattttacgcgtctttccaatgtttcattccggactgactttgacccgagtgccgaacagcaaaaagtcgcggatgaatccgaatttgctgatcccggccgcttgtcagtgtccgacttgtcactttttccaggcctcggcttccacgccgccctcaaacaaaggacaagcggagagaaggcaccaatacggaaaggtgaacaaaaatggggaattatgagcaaaattactaatttattaatgacgattcttatcttagagaatttaaaaggctgagattttagctttgcaacagttttcgcgacgaagagacacgatttatgcgcgatttgaacttgttggtcaatgttttcaagcggcgactgtcctccggcattggcaccgacgcgaagggaaaggtccgactgaattcggtcccttccttaagaaaaaacttcgtaggggaaattgcttatcagggccatgcaatttgctccagcatcatcgtttaaaaatttcagcacggagcgaaaaaaaagaatttataccgattttgcgccaaaaaatgacaattttgccattttcgggtcaaaatttgaaaaagggtgaaatgggggtggtatcgttaggcgtcgccgggaaaaaatttggaaattttaatgaaatatggtaaaaaaattaagttaagtttttcaaaaaatttgtccattttttcttgaaaactttggctacggcctgaatcttccctcaaaattttacccaattttaaggatattatctccaatctgttcggaaatgtgcacgaaatcctcgagttgaccatcaaaatccaccggaccattgacgatgccattgacatgtccgacccaccgatgctcggaatgggcctttgggagttggcggagggctgcgaattcgacgcatacgtccaatttatggtgggggggggggggacaaatggggaaaaaccgaaaaatcttaattttatttttggaataatttcaggaagtctttcgcgaaccccttaacagaaagttggccaaactgctgaaggagacaaaacacatggaatattttgatgtaaggcaacaaattttgaataatcattttctttttttgaaaaataatttacatattataatatttaaaaacggtttcaccttcgaacttggaacaaactctgctcaatttcccttcttaagttttttttttaaaaaaaaaaaacgttttttattcaaaaatgaaaatttctcaaactaaagacaaaccataaaaagaaggaggacacttggaagtccctgctttacattaattttaaaattttgacggctgcctttttttctccgaaaattggcattttcagcttgaagaccgaatgtacagcggcacacccggggggcacacttttcgcatgaccgtcaaatatgttttgcctgcactgctccattcggtggtcgcccatttcaaatgttactccgaatttgtaaaggttggcaattcgttgccaatttaaaatattcgaaaaattcatttatttttcaattagctgataatggaggccagtgaccacgaggcggacagaaaagacttgtacaacacggacatgtacctgaacatggtgacgaaacgaatgaacgatttgagggggctaatgtccgcccaagtgtaagccaaaacaaaaaaagggaggaagacggcaatcttcggaaattacccttaattttgccaattaatttccatttcccgcgcctcagaaatgagagaatagcgaggggaatgcgccgggacaattcgcgctccttccaattgagtgccatccaacgcattcagcgcagcatcgacgggtgggagggcaaagagatcggatacatgtgcaacactttcatacgcgagggcaaactgttccaactgcgcgggtcgacgacaatcgccggttggtgggggaaaccgagaaaaagtcatttttattgaaatggacgaacgaattcagcggaaattgttggaagagtcaatctgtagtcagttgaacgacttccaaaagtctttggatggaaagccgggccaggaaaagctgggaattttacccaaaatgagttttttgaattggccaattcactcttaaaattggttagcatttatgggttttccatttcatcagataacattctgcgcaatcgaagcggagggactgaacggcacgtgttccttttcgaccatttgctggtcatttgcaagccgaacaaaccgatgaaaatgagcagcagcgcccatcaaacgacggccggcaatttcaaattcaaagaaaaactgtacatacgacgctgtgacatcatcgacttggacgacgaccacggtgaataatgccaataatgagttggggaggtccgaaagctgagattgtgccgatttcactggtggggtgatgaccaattgacaatggcaattaattccctcacccctccccctttggtgtgccaatggatgcctttaacaaaactcatgggttatatttttcccaaggttaaattgaatcttgctagttgcaataaatcatgttagacaattggcagaaatgaaaaacgccttcaaaatttgcacgtcggcaaaggctggcggcaacgacgagtacatgtccatgctgactttgttctgccaaagtccggaagagaaggagcaatggatggcaggaatggtggaaatgcaaacggcagggtaaaggggcgggggacattggcacatcctcggaacagacaatcggtccatcctccgaatgtgacatttcatttttacccgatttcgtacacaattgaaaaatgaatttgccaattttttgcaggcaattgtttccggaaatgcgtttgatattatttatagcctcacaatcagcattattttaaaagggcaggaacttacaattagctccgaaaaaggttgataaaattttaaaaaatccaaaaaacctaaatattctgtaaataggtactgtaagttttttcatatcaattcgctgtaaaaatttcaaaccatcacactaccgtatctcgttttcatgaaattctgactcatggacgcattttcgataactgtgcaagaaaaccaaccaatttccattaatagttatacaatttaaaaaaaacatcgttaattcgatttttaaatttctccctttgttttgtcagtgcggtaaaaagaagaataaaccgtataattcgatcacttttttcgcgtctttcattctcttttttcctcgaaattgatctcaatgggccaacaaatcacttcaaatgtttgtgtaaagaaagaaaggtaaggcgaaaaagaacaaattgaaaaggaattaattcttttacatttgtcccattggctggcattgcgcaattttcccttactttttgggcacttttggaaatttttacacatttttggcactttgaacagaacactgcagcgaatgttggacgcccatcagaaagaggaggagaagcgcattccgctgatcattcccacggtttccgagtaccgttacgcggagccggacaccgacgagaacatcattttcgaggattacacccacaacagcggcatccccgtggttcgtgccggcacagtgctgaagctggtcgaacggctgacgtatccgcagtaagtaaatgtttcatgaaattaattctgaattttgcatcgttttccctttgggtacaccgacaacgaatttgtcaaaacgttcatgaccactttccgctcgttctgttcaccggccgaattgttggcacttttaattgaacgctttgtcattccgacgccgcacattttcatggcattggacccgcagcatttgctgtcatccgtgatggcgaactcatcctggttgtttgtttgtttttttcatttttgtaattattttggcatgtttcgttagcaatgattcggcatccctctcaaatggttctctccaacattcgcaactccattcgttcgcccacaatttgtcgcagtcccaacttgagcaggcattccacaaattcaggcaggaataccaaaagcccattcagctgaagtgagtctttattgtgccgtcataaattggcagtgccattgccaaccattcgctgtttctcagagtgttgagcatcatcaaccactgggtgagcaaccacttctacgacttcgagtcggacgcccttttgctcgtccgtctgatcgattttctgagcggaaacgaccgatccatcaaattgatcaccagccacaagaaatggtgcaccaagattcaggtagaaaatgccaaagatttgctggattatcctgccaatgttttctttccttcttaaaacagtggcaaaaacaaaggcatttttaggaagtgataaagcgaaagcacaggcatcaacagcaacaacaacagcagcaaaatcagttggactcggctggtcactcggccgacggcgaagtggcggacagcagcaacagatttaacaacagcaccagcacagccatgtcgtcgtcgtcggcaccgcccgcctccgacagcggcaccgccggtgtcccagccgcagcgaatgctgcagcgactgcgttcagtgtacagtgtccggaagtgagttgggacggggggatgggatactgtagcatacagtaaaataaatgatgaaagtgaatcagaagacagacttacagtttaaactccatccatccattcatttttttgtttagcccgtttggcattatgccaaggagggcgaagtcgacgcctacgaccttctcacgctgcacccattggaaatcggtcgtcaggtgacccttctccaatttttcctctaccgcgccatcaaacccttcggtgattttatatattttttttgtgttttcaaatccgttttaagaactcgtcgacgcggcgtggacaaagcgcgacaaataccagcggagtccgcaattgctgaaacttatcgaccacagcaacaatgtgaggctttctttctaagaatttgcctaatgcttcccttggctttttagctcacttattgggtcgctcgttccatcgtcgagaccgaatcgttggaggaacgcgtggaaatgttttcgagagtgttggagataatgaccgtgtttgaggagctgaacaacttcaacggcattgtggccttttttgctgcgctgaactgtcaaccggtgtatcgattggacgaaagcaaatcggtgggtgaaatgggggcggatgagtacatatatctaaaaaacttgccaatttttgtatttgtttcagcgattggacaaagagaagaagggatggtatgaccattatgtgcagttatgtggcaatggccatttgactgaactgctccaaaaactgcgctccatcaatccgccatgtgttccatttgcaggtgaagaaaaaggcgaatgccaacaaatcaatgttcattaattgtttgtaggtacatatttaacgcaaattgtgcttcgtttggagagtctaaagcaaatggagggacggatgaaccaacaaacgacgaaagcggccgaattggcaatggcaaacattgaacagcaacaggtgggcaatgaagaggaaaaggacgtggccaatggcacggcgcccaaacgggcacaataattgcttttgtcgactccgaattccccgatttgccatttttagacttgtgaacagaatgccgactccgcttccgtcgccgcctccgccatgtcaacggaacggtcgccgctgcagacgcccaaagggaaggcggacgcggaaggggccgcgcggaaaatgatttcctttatgaaatgccgcaaaattgcggcgatcattcgcgaaattcaaatgtaccaaaatcagccctattctctgcgagtggagccgaccattcgggtgggtcttctcttttaacatttaatcctcaattttttgattgatggcccttaatttgttgatattttttaaattccatctcagcaatggacggggcaccaaacattcatttgccaattgcttttgtttactctcccatttcatttcatttttcgtttttccacggcttttcctcctttttatgatgaatgccctttccctgctgttcacctttgcccctttctatttttgcatttaaatttaaacaaatgaattaaatgccattaaattagccctcaattgggcggcggtgtcattcgttcggcgatccttcgctttgtttgttctcttccgccgccttttcgttcgtttgtcggtgtttctcttcggtgtgtgtgacgtttccaattgtgacctctccccaaagcattggagaacccctccggcgctctttaccttcccatcccttcctcgtctcgttttcctcatttccggtccctccctcccccccccccccctttcccccttttgctcccctctcccccattttatgcgattcttccgaaatcgtccgtcagttgttgctgtttctgctgcatgtaattgtggtgaattggccgaccacatcagtggccaatggtggcacatttgaccaagaaatcgctttggtggacgcccacccccca

SEQ ID NO: 6425 - DNA, 5450 bp, Heterodera glycines
ccttaattctaagcacaactgattatactgtataattctaaaagcaatggttatgtcaagtgaaataccacagcaaatgtttgcaatagttccgcttactgattgtccacacattgcccaggtgcttttgttcgttctagtacagttttatacgtccagtaagacaacttcagtttcttaggcattacttttttatttcttggtcaatgtaactgaaaagttataaccacctcacctaattgcatttgccgtaaatgtttattagttttccattaggttgccagtgtccccctgggcgatgtggacgttaaggccaaatgtaacaaatgtgcaaatatcggtgagatactccttcagttatttttttacaaaacgtttttaggtgaaaattgggtttgtctcacgtgttatgaggtgattagctgaactattaagtggtcttattcactgaaaatcgcatttcgtcaggtgaattgttctcgcttcgtcgatggccatgcggtggatcattccgaaaagagtgaccatccgatcgcactgagtttctccgatttgtccgtgtggtgttactcatgcaatgcctatttggacaatgaagcattcgctgctgttatcgaagccggacgcaagtcaaaatttggacagaacgatggcccatcgacgtcggaaaaatagtgaaaataacaatgtttgattctcctaagattattattttattttgactattgcgatgcaaaaaaattcactgcgattagcctttgctctgatattgtaggatatcttttttcattcatcaggcaaaatttgaaggttttataatgatttccttaatgatcccgaattttcaaaaaaaaacaaacaaattttttgtgaattgataacaaatcataaaagcgttaaggtggcgtcttagggattctctcttctgtcgctttggtcattgcccccccccccctccctcacttcggacctccgaattctccctgcgagttgggaatggcgggttcgtcgtccgttcgctgttcgtctctctttgtttgtttttgttttgctccctccttcccatctttccctctctctctcctcccatccgttttcccctccatttttttctccatcgatccattggccttcgtccatttgtccccttttttcaaatttcaacacctccagcagctaatggatttcttctcgtttctgttcttcattgcccaactgattttcactgattgccaatttcccgaaccgacgcgaagtgtcgatttgtgggactcttttgggtgaatccgccgaatgtccctttgctttttgtcatgccttttcctttttcagcacttctactgcgaatagtttcggctcggttcgactgtttttccgtgtttttcttttcatttgtgcctttaggatgaatctcgggggaatgtgctggtgcgtctttcggttggcgaagtggtcggcctccgtgtgaccattccaaatttgccatggacgccttggcaagacccaaacgagcaaatcccagccgatcggacccattctgaactgaatcccctcccgggcaataataatgtgtccgttttcgcctttttgggaatgccttacgcggagccgccaattggcgaacgccgttttcgggtggaaaagggcaaaagaacgcggcactcatttcattggcatttgtttaggcgccccagcagctgatccgtgcgtcacttggccatttgtcctcttttagtgcccctccccccccccccaattggacgacagatctccccggcccttcgcccttcttggccaacactcttcccagtgcttgtgcccaagatatcgaggcccacccgtcccttttcgtcaacgacccctttccctattcggtcagcgaggtcagcacaacgccaaacgctttgagcagcgactgatcatttttgaattccatttcccattaaggactgtctccacctgaacattttcaccccttctgtggtctctccttttcgccttttcccgtccattctctcctccatttagaagtctttttcctcttccgtgtcaaattctctccccgttttggtcagtggcaattcaattcctttttgccatccaaattcaatgtaaaggtgttcttccacggcggcaacttccaaacgggcaccgccaacgattggcctggccacgtgttggcttctcggggcatcgtcgtcgtcgcggctaattaccgtctcggctcattcggtcgtttcccttagattagcttcccgtttccttaattttaatttttgtccttttcatttgaccatttgtcatgcgtttagggtttatgagtttgggagatgagttgaccggcaattatgggatcaaagaccagcgaatggctcttctttgggttcagcaacacatcacttccttcggaggcgacccgcgggctgtgaccatcggtcattccgtttgaaaatgccatgctcacttggcattttgtttttagttggccacgatgctggcgctgtcagtgctggcattcacatgctcagccctttctcaaaaagtacagcagcacataatgaattccgctttcacctcttttagacctcttccgcggtgtcgtggccatgtcgggtgccgaagtttcgtaccattcgatcattggaaaaccggcattgggtgccataaaaattcccaatggagttgaaaatctttttacacagcctttaacaacacaatgaaacttggccgttttctgggctgtgttcatccggtggcttcggaagtgttagtggggggagggggcaaagggaggaaaatgggggagggtaaaggcgcaagtgaagggggggggggagaggctgtgcccccatattagaattggttgggtctttcagctggagttgcatcctcacccgttccaccgatgacattgtccaggccgtttcctccaccgccgtcccttccattccggtcctttcatccttttatttccattatttgctttaagctttcagatcgaattcaaccgttacttgtttttgccatcggtgacaattatatatttttcttataaaacccattaacacacttcaattgggtttatgggtttcggttggcccttcgtttcgccgtcaggtccctttgatttttctccgcttttgaggtggatggccatgaactcacagcccacccgctttggctgcttaacaatgtgcgcaacggaattgtcaatgtcttttcggtgcccttcctcgtcggaatgaatgcacaggacgggaccgaggccattttggaagaccgcactttgggtgggacggcactctcccaatttggcactttgttcatttgcacaggcgaattcaccgactttctgcaaatcacccgccaatacatgcgttccttcatcatcgaatacgcgttcaagcacaactatacgatgaacagagaagtgccagcgaaagaccagagcagaataacgatctgatcagcgtcccttcaggcggttatcgatgccatcgaatccttctacacttattggcccgatgcttccgatgtttggcaaatccgacggtggttcatcgacttgatcactgatgcctattatactcagccgatcactcagtcggctcatctccactccgataccggctcccgtacctttctctatgtgaacaattacaatttctccatgcagcgtgaaaacactgtggcacataacggcgaagtgcccaattttccggcatgggccggtgaatccggccttttatgataggcatgacttccattatcaggcagctgtcacgactgcgatttgttccttctctttggctttcccttcatgccgcctgagttgctgccaaaggcaattcgatcggtcaattggacggacactgatcgaaatgccagtcaactgttctcctcatttgttcgccagttcaccaaatattcgtttgtcctgccgttcttccatttaattccaaaattcagtgaccccaatttgccaaatgatggcacttggttggcccatcagccacgagcccattggtacattaactttaattactctcgcgggcaaagtctgacagtgccgggcactctctcccgggactttcgctttgaacaggtcgctttttgggagaattatatccccgcagtgagtttctcaagtttttattttaattggaaaatacccattaagttggtcaattatatgaccaccactttctccccggaggagggaagtgttcgaaatgagatggtgttgttcaaagtgagtggttggacttttcaaatggcttgttgtggttatggcctaagaaactgaggaaggcattgattggatgtctaaagtgaattagagccgcgaaatatgcgtacacctccgtgctattcaatcctttcagggattgttcggtgtgtctctgttggttctcatcgctcttttggtgctgaccctttcattgggttacaatgtgtgcactcggcctttgagagagcgttgtggaagatattcggaatgggaggaagtccaagccgaagagagaggagcaaatgtggaaatggcaaggaaaagcacgagggaaagaggaggaggagaaggagctggacgggtgtcaagcttatgaaggacgactgacgaacaaaaaaaaacaatacgggcaataacttaatgaaattcagggaaaaccaaacaattaaaattgaaaatattccataaaatttttcgtaaattataaaaataacttaattgataaaatcgaaagacacaaattatatgatgaaaattttgaaattaagaggcaaaaagcaaaaggagagagaaattgagagggaaatcgattgaaggaatatttttagggaaacattggaggaaagggggggggggggggaatgaatgcaattgtgtacattttcctgcacatattttgtttaagtgtttgttatgtgagggaaacagagaaaaaagatcaaatcgatcaccaaaatttttttatgattaatccgagcacaagcgaagcgcattcattttaatgttcgaattcatgctttttagactacatacaatctcctgttgtccaacaatattaaatgataacagtcaaaagagaaaattcttaccgttttatttcgtttaatttctcgttcaatgtggcccttaaagtttgttgccgaatgtgaactaacagtagagaccggacgggaccgggataacgccggaaattgccgggactcccggtcccggttattttggacaaaccaccgggaccgggagtccctcccggtagaacgggagtcccggtcgatttcccaagtcccggccatttgggccgggactaaatttcaccagtgaaactgccccaaatttgaaaaatttaataattattttggcgaaatgtttttatttcaaagttcgaacatacaacttaaggatttttttaaatttgtacaatttcaattgtaaaaagatc

SEQ ID NO: 6426 - DNA, 1419 bp, Heterodera glycines
gtcccggtcgattttccaagtcccggtcccggccatttcaaaattccaatctctaactaacagtaattaaatgaatttaattttgctaattaatttgtttggcgttgtttagctttgtccgcttttcttacttttcattcattttccgtttgcttccttccattaattaattaggcacaccattttcttttcaatttctctttctttgtccttttcccattttttctacatgaattttattcattctctatagaaacgctttgagtatgttatgtgttgtcaagaagccttttttgcgtttccttctgcgcgtatctctcccccacccaatcatttccatcgtccctttcattttcatttattaaggctttttccccatacaaatgtcattttctttgcttcgctttgcttgttttgcccacttttccctctctttctctcactcgtttttaggccatctcaacaacaatgtttttcaacaataatttccactaaaactggaaaaataacagtcgaaatcggaccactgataaatagggatgatatttttaggttttaactaaattttttgctcaattgttttgaagaaaggagctcaaaaaacgtatttctgcgtttaaaattttcgattatgttgtcactttcggtcactagaaatcactattttggcgtttcgtcactaaaaatagtgaaaattagagcctggagcaggatcgaatcctgcgcagaattttgcaggatcccagtccgcaatcctgcattttttggaaaatgcaggattaatccggccggatccggtccggcaaaaaattttgaattccaatcctgcaacaggatccgcaaatttgatttttgtgcgggatccggcaggatccgcatacattctttgaaaattttaaaagacggaatgccaaaatttttgaataaatttataataaaatcaatcaaaataaattcaattttcatctcaaatttccgggccaggctgttttcgcatggccgttttcgcgtgggggtcgtttttgcgtgagtgcatctttaggactgaaattggtcgcatatctgccgaatccatttttcgaatcccgaacccgaattcgaacaatttttataactttttctctttttatttcttgcggctgatttcttctataataatttgtcagtttggtcagatgtgcgtcaaacgcaaattttttttattaaaatacatatgtagtataacaaaaaataacaaatttcagaacaaactaaggcaaactaaggtcgcatttcatagtttcgggaaataccagagcgaaaattgttcatgttttcgggattcatattgacatttgcataattggattcccggtcccggacgaaaatcgaggtcccggtaagtcccggtcccgatttttgtcaaaattcccggtcccg

SEQ ID NO: 6427 - DNA, 1088 bp, Heterodera glycines
acatttgggtttaaatttagtttcaaaaagagtaaatctctgtttttggatgtaaatgtaattaaaaggttaaattttcccccaacccatcaaaaaaagtccaatttttaatcaaaaattactacgacaactataatgacgccctccccccccccaaaaaaaataatccatttttttttgctgccgcccggcaagcgcgtcgtcgcgtcgtacgcgcggcgccatagcactcacttggacaagcgtgtcaatggagcgtccaattgtttgtacagccagctgagcgtggcgcgcctcgccgccaccgcccgggtccaccaggcacagcacgcgcatccacgcgcgcagccacagcgcggcattgccagtggactaaaatgggggaaaatttatgttgatgatgcttttgtatggtgggggattttggtggatgcttatggggataatggacgaatgaggtaattaatgcccgtttaaagggcataattaaaataattttttcgctttgctatgatcaattcgaagcgcgcactgctcaactcaattgccctctttttcttttcctcttccgcttgtgttggcactttcccactctctctttctctatctctctctcccatttccctcttccctctctctctggacaccatgaactgcttgacgaagcgtttggcaatgttctaggaacaacgctttttgaattggaccaatgccaaaacgtatggaaatgcagggaaatgacaatatattcaatttgtgggacccatccattggtgctggaaaacgcaaaattctagaaaatggaaaatgtttctcggtggcgggggcttagaaactcaggggcggcaaaattttataatttataattgcttaaatcaccccctttttcgcttccatttttttttgcttgcctgaattacgccttggacaacgtcgccgccgctgccccctccgttcgacgcaccgccgacaatggcacagtggtgcgagtcttcttccgtcgccagaatactgccacttccgctaccacctgtgtaagattggttaccaaaaaaatctgagaagagaacccaccccctccctataag

SEQ ID NO: 6428 - DNA, 3867 bp, Heterodera glycines
gagtgctcacatcgatggcaaaactggaaaaatgccaactggttggtgtcaaattgaaaatgagaggaagggggtcaaatgatattacaaatttggcaattattaactataaaaaatgcacttaaatgcgtttttattccctatggcatccatcagtcaaattccttttattttccattcaaaaaagttgaaaatttttagattatcaattaacaaatttccaatgcctttaggaaccaccaaaatacatcaaaaatttaatgaaaacaaaattttttaacggttatcttttcaaaatttaggcgaacaaaattgataggatttcgatgggttttagcgggtccaaaaatgagtttacccttccccattcattttcacggcacacaaaaataaacaaaagaaatcattaagccaattatttttcaaaaaaagtgcatggctctggaaagtcaaagatgcattgatacgaaaacccacaggttcaggacgagtgcccgcgtcatgctgtccaccacgtgggcccattgctccaccatttggccccaaatgcacgcgcggaacaccgccaacgcgtcgtcccacatccgttgctcgtccactaggcgtacctcgcggatgacgctgacaaaaatgtacacggagagcagcgtgcgggcgagtccgccggcggtcgcttggccaaacgcgtccgacttggcggtggtcagctcgacggcggcacccaactctttgatcagttcctggagagacaaacggttggaattgttacgagcttgtcccatttcattcattcacttgcgtcgtataattgacggccaaaaaactttgggcctaattaaaaatggtggtttttaaaattttattaaaacaaacggaaaagactttttaagatgatttttaatctgaaaaattgttcccggtgattttctgggttgctgaccacgaatctgacgccaatttaaccaatccggtcactattggcggttttcatgggtttcagacgtcgaatctgacatctaatttgtcaattccggcccctaatctaactgatcatttcgagttcttggaattcgagttagtgatggaacttgtgaaaatgggtgcactctacgcgtgtcccgacatttgcggccccgacttttgcggcccgacatttgcgcctttgtccaaaatctggttcaaaactaagttttttcaatcactgatcgcataaatagctttaaataagcgattaaaagtgattgtacatgatcatttgatcttcaaaaaaatgttgaaaaattaataaaattttcaaacaaaaaattattgatcataatgaaccataaaaccgtgttttcttaattttaatgcttattaggctatcaggggttgaaaaaattcaactttgagtccgattttggacataggcgcaaatgtcggggctccgcactacgcccccccccccccccgaaaatgctgatttgtgagagaaaatttcgaaaacttttacgaaaatggccatgtccttacctgccacacagttttggagagcggacgggctaaaatggtgctggaagggttggccaaatcgcgcgcaatttgcagaatggaatgggcaattgtgatggcggtctgcaattggtgtgaattattaaacaggcaaatggaagaaaaagtgttggaccattcaaaagctgctgtatctatgatgctaacaatgatgagaagtcttaaaatttaatgcccgctttttcataaatatttcaaaaaaaaaacaaccaccaaaaagaaaatgttggaccaccgacctgcagacgatcgccaggtgaactcaaatagggcgagcggaagaaggagaagagcatgtgaatgagcagcacggaccagtgctcaatgctgaccacgcccgactcgacgaagggcggaaactcgcgctgcaacagccaatggcggaccaagtccagcaccttttttgggcaaatagaaagtatttagattcctgatttgtgagggagaattggaggaggatgagaagtaaaaccaatgcaacgaaccgcattcaaggaccaagacaatgaatgcattgagataaactgaagacaaaaagcattgcttttccaatttttaatgccaaaaaccatagccagcgaaaataaatggccaaaaaggttcaacttacggggtttaaaaaattttgggcatttcgcaaaagcagcatgtaacctatttaaacaaacacaaataaccgataaaaatgccgaataaacagagggaccgacgaaataaaaaaatgcaatgaacaaattgctttgcaaaccttttgaatgacaatgcaacaggccaacggcagacggaacgcctcgcgcatcagagtcaacagcacattggacgcccgttgggaggagaacaaagccttgaaattttttttaatttttgaagacttaaagaccatgaagattgaaattttgcatatggaacgattggcattaaaacccccaaaaatgattgcctgtttgaacaacgcgaggctgggcggcggagcggcacgtccattcgcgccggcgttgaacttggactcggaagcgatgttgatgatccagcggatgagccaatatctgtgcgtgaactataaaaactgatcggtaaaaagtggaaatttttagtagagaaacagaaaaatggaagcggtacgaatccgtcgaaaaaacatacaaaataaaaattttaaaaattgttccttaaaaattttcagaattttctagccttcgaaaagcaaaacatttttaatattttattggaatttgcattaattaatcgggggagtcaagctgatcagtgcagtaacaaccaatcacctggcgatgatgatcgggtcaacagtgtccagcattggctgcacaatggcgccgtccgcgtcagtgccggtgccgccgccctcctcctccgcctcatcagctgaggtgccctcccagccgccgaacacgtccaccccgttggcctccgcgtcggggaacacctcgaaaatgtaggcgacaatcacgcggtccaacatgaagctgacggtgtccgcacgccgtgccgggtcggcccagtcaattttggtcgtctcccgagtggtgtactcgagaaatttgtccaaataaatctgaaaacacaaataaaattgggtgcacttcatttccctctggacgccccgaaaattcattaaaaaaaaattgcccgtagaatttttcaaaaaaaacttattggtagcgaaaaatttacgagcggtttttcattccaaagttttccaaaattcgctgaagtttcttaattttttttcgaaattcttatttgttgttcattcacctgcaggttctgtgcccgttcccgaaatcgcaactttgcggacgacgaatttgtgggcgacgaagacaccgacgaggcggaggaggacgaatggtgctgatgatagctaagctgagacgatggttgttgatgatgatggtggtgatgatgactatggtggtggtgttgcagcaacagttgctgttgattgtttgcgccgttgttggcattgccggcggcggcggttgacggctccacaagttcgggctgtacaattggcagtgcgcgcgcgggacggacatcggcgccggaaccgccagcggaacaaattggcacggaggatgatgcagatgatgaaccagcatggagatgacgagcattggcggatgatgctgttgatgatgatgaggatgggacgtcgtccacaaaaatggaggcgccctcgcaataggactgaaaattggaaaaattgagggaaaatcggaggagaggggattttttgttgggaaaaaacgatgaaataaaaggcaacaaataatggaaatatacaaatgacaa

SEQ ID NO: 6429 - DNA, 2348 bp, Heterodera glycines
  misc_feature (96)..(96): n is a, c, g, or t
  misc_feature (150)..(150): n is a, c, g, or t
aaaaatgcccgtagaattttcaaaaaaactaattggtagcgaaaatttacgagcggttttcattccaaagttttccaaaattcgctgaagtttctntaatttttttcgaaaattcttatttgttgttcattcacctgcaggttctgtgcncgctcccgaaatcgcaactttgcggacgacgaatttgtgggcgacgaagacaccgacgaggcggaggaggacgaatggtgctgatgatagctaagctgagacgatggttgttgatgatgatggtggtgatgatgactatggtggtggtgttgcagcaacatttgctgttgattgtttgcgccgttgttggcattgccggcggcggcggttgacggctccacaagttcgggctgtacaattggcagtgcgcgcgcgggacggacatcggcgccggcaccgccagcggaacaaataggcacggacgatgatgatgctgatgatgaaccagcatggagatgacgagcattggcggaggatgatgttgatgatgatgggacgtcgtcaacaaaaatggaggcgccctcgcaataagactgaaaattggaaaaattgagggaaaatcggtggagaggggattttttgttgggaaaaaacgatgaaataaaggccaacaaataattggaaatatacaaatgacaaaggtcgaaatgaataaatcaaaataggtccaaattcattttaaaaatcggaagagtaaaagaaaggctattttgcggttaaatttttttttgtacaatttagtttgtaaaaaattttctgcgccatgggaaaaatagaattagccatcaaaaaatttgtgaccaaaagtttcaaaaaatatggaaaaattgggatccggcattgccgttaggtgcagcctgtgaaaataaaggaccaaatagttaaggaaatttagaaaaattttaaaaaaagttgaccattttttttatttttaaaatgttttattagggtttcagcagtgttaattttaaaataggactcaaaaaaacgaaaaatgaagcccgaaaaagatttcgtaccagtaaaagttggtcagattgggcccggttgcgcaagggaaagtgcggcaaacagcacttgaacacggtgtccaaacagcgcgttgtgtggccaaacatggccaattcctggtaccagatcaggaacagacggatggccaacttgcgcaccgccaacacattgtccggatggagtgccattttcagcacaaattcgatgccattcttttgccagcctaaaaagcgaaagtaaatggagggagtgagacaggaaatggagaaataaacgcaaaaacgaacaaatattcgccattttacgggatggttttctataattggacccaaaaactgtcacaagccaaattcgcaatgtaagaaaacaaatggatgtgtttccggctggttttgttgggcagcgtcaatgaaatttcaaaatttatagttgaattgtaaaaaatttcctaaaatcgaaaccacaacccaagaaaaccaatttgtatgaattaagcgtttccaacccaaatcaagggcctcgaatttgcggaaataattattgttcaccctttccgacaagttcgggtgcacaacacatggcctgctccaggatccaaagtgcggactcgacgtcggcgatggtttgcgggtcgacgatggccgcgtcgtaatgggcgagaaaaagcgcatcgatcaggtggaaaatttcgaaactgaacccctcgaagagttggcgcctttcctggaaattggacagcataaatcagtggcataaacactttcaatcgactcaaaatttttaagatttttgttaaacaaaaggaactaccaggaattaaatgttgtgttaaaccaagaattctcaaagaaactgaaatacccagtccattttcagtctacgaattgccatgaaatccaacttttcgtatgcgttcgattattgcattaaaaatgcaataatgccccacctggacactcaggcattcgtaggcattgcggaaatgttttgctctggacaccgggtcccggccccactccgcgaagcggttcaacgaattctgcaagtcttggtgcggctttttccgcaacatttttgctgtttttgtcaccccaaaaatgaatgatgatgatggtgatggattattcagcacgcatttttctcatcagctgaaaaagcgacggtgtttagtcatccgctgacaatagacaaaaaatgaacgggacgacaaaaaatttaaaaaaatgcataaggtaaacgaggaaatgggagcaaaaatcaaaattcctgtaaagaacaaagtgaaagaacggatttttaatagagac

SEQ ID NO: 6430 - DNA, 1640 bp, Heterodera glycines
attttggcggatgcaacatacaacgacgatgccgaaattcacgatgttatgacggctcttggtctgcaggtcgaaggatatgcaggaaaattgaaggactacgaaaacacggaagattcaatcatgaatttcgcttagacttgttcgatcccaatttttacccttttttattcattcattttttgaactattcctttttcctgcaaaatttattatttttgttatttgtttatgctattctgataaatcgttaatgaattatgtgttacgaagccttaaaaatgtaattttccgactttttcactaattttttagcttgggcgacatttcgacgcggcgacattatgacgcggtgacattttgacgcggcgacattatgatgcgacgacattttgacgcggcgacattatgacgcggcgacattttgacgggcagcgaaaaaaagaaagaaaaaaattgccaaaaaataaatggcgtaaaaaaacaaaatgccagtaaattcaaataaaaaacaaagagtctttatgcttgatcaaatgcctaatcaacgtcaaagcttccaacccacttcaaataagtcaatagatgttttttagagataatattttaaatttagttagtatttactattttcagtgccttatttgcgttgtttagttttgatcacacttgatcagccataactcgcttcattccctataaaatcgaataattttggtatcattcgaaagatactgaaaagaaatagcataggtaatgatgaaacaagaacggtacggttcacaacaagtcacccaatcttattttggtactaatggagtttgtatcccctacttttctatatttttttttgtacgaattgtttttagattaatggaatgagtgatcgcaacgcgtggccacagcaaaattcaacccgacaaacccgtggcaaaatcgcttaatatgtgcattcatcagaagcagaagaacggatgtgcctttgtgtgaacaatgagcagagagacgagattgaaacgatgctggtgccataaaatatagatgaaccgacgatatgattgatgatatatgagataaattggattcatatttgttggtaaattgttatttatgccattgcatatatgttgtatccgtatgcataaaattaggattggatgaactgctgtgaatcgaatcgtaccgctcagtttctcatcctttcctatgttatttccttttcagtttggcaaggatggtccttggaatttggccctcttacttgaaaatatcattgaattcaaaatgtccttgaaaataagcactcgaaaaattcaaaatgcgtatataaagggaacgcattgaacaaaatgctctcattttttgcgtccgtcaatagtttcttcataaaattaaacattaatataattcaatcatttattataaaaattataaagacaatgcgcttcataaatctcgagccacctttaatcacttccttaaaatattatagaaattcgaaagacaatgcgcttcataaatttcgagcttccttttaatcgcttccctaaaaaggaagacaagtgatttcaggatatgcgcagataaggtgaaaaattctatatttttctgcaaacattataaaaagtgtctgtttcttg

SEQ ID NO: 6431 - DNA, 3980 bp, Heterodera glycines
  misc_feature (3952)..(3952): n is a, c, g, or t
aattgggccctctttcttgaaaatttgaaagtatccttgaattcaagaagtccttgaaaatgagcatttggaaaagtttttaaaaaaatcaaagaaatttgataaatttttgtaattttcaacaatattttgagtaaattatggcattatgtcaataaaaatgtaattttttttctcatggttgagaatttttgaaattttgtggcataaagtcactatttttcttaaaaaattagcccaaaatcgcaaattttggtcatttttggacaaaattatgtaaaaaaaaaatgaaaatatatatgaaaaaagttcaaatatgtaactggtgacggatttatttcttgcgtctgattgagcagtaaatatgcaataaaaattattattttattcatttttcaaaataataaatatttttttgctattaaataaaaaattataattcatattaaagcataattttattttgcattgattatattgatggatggcaaacgtcatttgcatatttacaacaaaattgtttttttcatacaattaataatatgccgaattacgtcagtaataaatattctcattgaattattacgtcaattaaatggcaaattcaaataaataaaaaatccataattagggctgtcgacagtcaacaattttgatgactttataactaatttaaatattcgaaggtaattgctgttttttagttgctcaaaatcatcggacctggtcagtttagtatggccgttttagtcagggggtcgttttagtctggttagctgttttcacccacaaattaattactttttataaaatatcattttttgtcgagcatatacatttaaaatttctgttcacctacaaagaagtgtttgcgttgcgagtttttcggacctaataacaaatgcaaaggtgtattcaaaaataaaacaaagaatatttttttaaattcagcctacacattgacattaatgctaatgtcctcaaaattattggaagccacacatgcgacatgattgccgaacagtggagtgtcagcgacgtgtgacccagctaaaacggcgtgcagttgagacgtggaaagcgccggctacaattcgtgcgcaagtcttgcagaacacaacaacatcaatgttagctgcttttccgaacaaagctgcgacaaaaaggtcaacttttcctaatttttatgccaaaatttgatttgttcatttattttaggttataaaacgtgttcgccgtgacgaatatgtgccacctgctgtacaactcagtttggacgctgtccacaaaggtgaaaaaatgaaaatcctaaaattccactaaattctgtattaaggcttttggtgtttgctcgatcttcgtcttcacaatggatctgtattatgaaaaatgtgttcgcagacggcactttcagtcggcgccacctttttcaggtaaatttatgtcctcgcaaagtaaaagcctaattttcatatttattttgggttttaaggcgaattaattggattttgattacgtactgccttctcacttcaagtgtgaagcgttgaacacgtatgcctcaactgattgtcaaagatggccgaatttttcgcctgaaacttttcgttggacttcgaggtggtgatatcgccgatgcgagaattcttcgactcttacggacatgccaatgtcaatgttaatcccgatatcatcagcgattttctcgttggtacattatctcgaatttatgaaatgtgcccgtaatgatttttcaatgttttgtttttttattgtaaatacattgataaatatgttttagtattaaattaaacatttttcgaaaaaaaatcagattagaatccatatggcacaaaatcagcttgccagactaaaacgaccccctgactaaaacgtcccctcagactaaaccggccagactaaaacggccagactaaaacggccagactaaaccggccagactaaaccgacccctcccgacccatttatgcctgggttattcaattctaacaacgaaatacgcaatgatgtataaaaattaaacattaatataattcaataatttattataaaaattataaagacaatacgcttcataaatctcgagctaccttttaatcacttccttaaaaaggaagacaagtgatttcaggatatgcgcagataaggtgaaaaattctatatttttctgcaaacattataaaaaatgtctgtttcttggcttctaaggtccaaatcaatccttttattactggattattcaatgcaatcgatgcaatttgcaatgatatataaaatttacccattaatatagaattcaataattttttatacaaaaacgacggacaatacgcttcataaatccaaatcaatccttttatgccaggagtattcaacttgaggaacgaaatgtgccatgctctgcaaaaaatgatttgtggccattcagctgagtaaagcctctccaattggtccgcatgaatcagaacttttctgattgagtttcccgtcatgtccttttttcctgaacacttcccctcctggcccctgatgctccggaaaaattcgttcgcaatttccgcgttttccgtcacttcgagctctttgataagagcatttccaatgccctggaagacgtgaaaaggcgccagaattattcgttcaaactcaattgattgtaaaagtggctcatcgacagttcccctggtgagcgctcgagcagcagcagtcggtttttctccattttccacaagtcgtccaaactgctaggcttacttcaaagtttcctccgatgtcctcatttggcacttttcgcgtccaataattggtcctggcgacaatcgcaaacgggatggaaatgtcgtaacggcagagccacagtgtcaatcagtgcccacaagaagctcagatcaccgccgagaaacctgaaaaattgagttgactccagaaaaaatatgttaatttacaatttgattttttttgcccgcaatttcattcaatttgccgatctgttgccaaatgttgccgcagaatttgatcaaattttcccttttgtccttcgcgggaaatgctgccacgatgaaattgttggccggagaatttgcatgtgaagtatgggccaaggaaatggttatttttgtgaagccttggccgttgtcagctggtcattctgcgcctgttgttccaattgacggctcagatcagcgatcattgcgtctctgttgcggacctgcagtcgtagaaagctgatcgtttgttcctgctccttcagctgtttgtccaactgctcggtttgtgtcgcggcgtcctcataagccaaatccacgtccgttgccttgtccatcattgtcaaatccatgtttgttgcattgtcggtagtttttggacggaaacccacatggcgcctgatcggagtcgctgacaatggccttgggcttgaacgtggtccttaatttattttttgcttcaaaatagtgattttttgacttacgaaggtccggagttgacgttgacggcccattttcggcggcttgggtcgatgtcccctctccatctgctgttggtacggcttcggtctgctttaaccctgaaaaatgcagtgtttttaaaataaaattaatttgatcaattttcgtcactttttggggttgatccagtttttttgcatgctcttggcgccattccttccgttttcgctttgcttcattccccgaattgcttagtttcattaatttatcagtttttttacgtgtaataacatttaaagcctaaaaaaagttgtgaatttagttgaatttttgcctggaaaaaatttttcccaattggtaactttttttgaaattttgcataggccaatattttgaccccctctatcgaatccctgtttattttttcgaagttatgtttttaactcgagatcggctcttctatttttactaaagggaatccccanaaaaattttaagttttgcaaagttttgg

SEQ ID NO: 6432 - DNA, 2391 bp, Heterodera glycines
ggaatcggcagaattgtcctcccccgtcatttttctgctcgaatgaaattcagcagcaactgccgcgttcattgtggacaacatcctttggaaggcatggaatgctgcggtaacactgacaattagcataaaacaataaaattgccaatcgagagggggagggaggggcaaagagttcaaaagtggcactttgtgtatgtgcgtgttttgaattaaaaacatagaaaaggctctaatgcactttatgagtccaattaaggacaatcccaggtttttatacaataattttattcatgttcgaacaaactatcattttggcatcattcgaagcacaaagctaaagtatataaagtcacagcatttagttaattatcaaaaaagatttgatttattaagtaattgctgattattttggtttgtaactttctttaaatgttagaattctcttgttttctcctattattaaatgatcggacacataaaatacctgtggactcatgactcataaagtgcattagagccgaaaatatgccatttaattggtaactgtgaaatgtttttggctctattataatgtacgcgtccaatcattgatcatccttagttcctttgaccaaaaaaaaacttatgtacacttcaaggtttctttcgtttaataacaaatagtatacatataggcattatgatggcattgattggatgtagaggctggaattttgaaagtattgggaccgggcttattgttagacatttgaccgggtaccgggccgcccgttcaaaaaaaaacccgttttatcagccgtcggaacacgggtttttcccaaaaaaacgggaccgggatcgcccggtaaaagcccgtccgggcctctaattggatgcgttaaatggaatttagccattgtctttggtttttgtttgttgttacgtcgcttgcaacttcgataggcgattaattttaagtaattctcttaaatttatctcttttttggatatttcagttgggtgtgcaacgatgtttggatggacattttccacttttttgaccatgcccaactcggcctcaaattggcactgatttcgccccgtttcgatcttttagtggacacgcatttcaatggcaaatcagaattgagaatttggagaccaatcttaatccacaaaaaggagaaaataattaaaagatatggggacgaaatcaaagttgaggaatttccgttgcccgaccattcgctgcacaacaaaatacgctttttcgaccttagtatcaagtaattcaaaaagcattattaaaagggaatccaaaaaatatgcacataaatttctctaaattgaggactaaattttccaaaattcttcaaaaggctcccggacaatccgacagtggacaatccgacagtggacaatccgacagttggacaatccgacagtgaggacaatccgacagaagtggacaatccgacagtggacaatccgacagtaaatttctattttaaaaaatattttcaagtcattagaacggattatttcctaaaaatatctcaatcaaatcaatttggttccggcattcgataagcgattgcacgtagataggccaaaaaaggtctgttatgacgatccaagaaaatggcgcgaattgcttggtcctgctgtacgtaaatgtttttccttgccattcccctgccacgcattccattttgtgggttattgttgtaatcttgcacaatcaaattccagtgtctgtcttcttctttcatttttttgacaaaataacttaatggcggatgaaggaagcggaattggctattgaaagagcgatgccacccctcgatgctgttatttgtcctcattaaattttgcttaactctaaatttttgtttcttaaaattctatttccactttcacctttcactcatattccacatttcctgtcggaaacttgcagacctcccctaattttgtatgggcgtccagtgttgtcgtgatgtacagcagcacgtacatgtattcgaccaggacaataaggcggacggtgtatgcagcgataaatttcaatgcctatgatcaaaacgcggcgctactgcattttactggccaaatgcattttgaggtgtccaatcaaaagtaaacttagttatgccataagtatggatgcgatttacagtaactaaaaccgccaaaatcgttagtttttaggttctaaaaaactataaattgcatccctagtcatagaaatagagggtgatcatggacgccaaaatgctctattggagcgtaaaatgcaatgtaatatgccaataaaatacatcagactaaccatctgcaattcggctcaaagcttaaaagctatactcgaacccgtcggccaataaaatttctctgcgctgagttgtt

SEQ ID NO: 6433 - DNA, 7153 bp, Heterodera glycines
  misc_feature (4682)..(4682): n is a, c, g, or t
tctccgaatccaactcgacaaatgcaaatttttgcagcccgatacttttgttccttgggcatattgtgtcagcaaacggcattcgtcctgacccgtcgcgttcagacgcaattcggaaaatgcccgcaccgatcgacaaaagcagcctccgatcatttttaggcgctttgaattattatggcagatttgtcaaatgcatgcgtgagttgcgtgcaccgctcgaccgactcctccaaaaggacgtagcttggaattggacttctgaacagcaaaatgcttttgaaaaagcaaaggaaatgatgacatccgacctattgctgacccactacgacccggcacgcccaatcgtcgtatcagcagacgcctccaaggatggaatcggcgccacattaagccacacattccccgacaaaaaggaaaaagtggtagaacacgcagcatgcacattgacagcagcgcaacaaaattacagccaaattgaaaaagaggcattggccattgtgttcgccgttcagaaatttcaccgcatggtgtacggcagaaaatttattttgcaaacggaccacaagcctttattggcaatttttggctccaaaaagggcattccgatctatgccgcgagccgcctccagcgttggtccatgatcttagcgaattatgattttgaaattcgctacgtcaacacaacgtcatttggccaagccgacgttttgtctcggctgatcgcaaattattcgcgtccagaggaggacatcctgatagcaaacatctgtgccgatacggattgctacattaattctgttttcgaaaacagaatggatcagctccccgtgacaacagtcgaaattacagcagaaatggccaatgatcaaccacttcaaacggttcttcaatttttgagaaatggatggccagcaaaagtcaccgaatctgaaattagtccatattttccaaaacgggacaaaatttttgaagtggacaattgcctactgtatgaggaccgtgtgatcgtcccaacttcgcttcgcagtcgcatccttaaggcattgcacatcgctcacccaggcattgtgcgcatgaaagcacttgctcgacgtcacgtgtattggccgggaatggactcagcgatcgaaaaagttgtgagcacttgcgaagagtgtcaattgggccagaaaaaccccaccaaagcacctctttcaccatggccaacgacggacaaagtctttcagcgtgtccacatcgattttgcaggcccctgctcagatggtcaccaatatttaattctgatcgactcattttcaaagtggccagaagtttaccgaatgaacacaatttctgcctatgccacagtatttgtgctccgatcaatcatttttcggctcggaatcccagaagaaattctttccgacaatgggactcaatttcgatccgccgaattcgccacattttgtaaagaatttggtattaagcacatcttcacaccgccatttcacccacaatcgaatggccaagtcgagcgcttcgttgacaccttcaagcgatcgatgaagaaaatgtccaaaagtggaaaggattggatcgaaaagatgctgttctcctacagaaccactccacacgtcgccttaaatggcttttcgcccgatcaattattttttggcagaaaattgcgcacaaaattgtcgctagtccatccgaaaggagaaaaagacgaaaattttgatcgaaactcattcaaaaagggtcaaaacaattacaccgacaaaatggctctaaattttgatcggaagcatgggacaaaaatgatcaatttctttccaaatgatcatgtcctactgatcaattatcggaacaacaagacggagtggctgcaaggaaaagttgttgagaggcttcacaaatcgcccacatatcgtgtttatgtgcctgttctgcgtcgactcgttcatcggcacgcgaatcagctaaggcgacgccatcttttggaagaagaagccgaaaaggaggcacctcaaatcgaagagccaccgccggttgtcgaaccgcctcatccgccccaacaaaatcagccggccaattcaccattggttatccgccgatcaacccgagttaaaaagccgcgccaattttattctccaggatgaaaaatttaggcttaaaccttcgggtttcgaatttaagaggggaggtgttagagaaggaagtaattattgattaggtgtatgaccccacgccacttcgccatcttccccctccgattcccctcattcaattattattgtgcccaccaatttgacctcccaatttattctctgcatttatttattattttattttcttcggcaaataaacttatttaatttgttatcttcggacataacaaattttggcgcagtcagcaatcaactgcacatcaccggcaacaacaattccgagctttatctcgtgttgatattgctcgagagggaaaattagaaagctcgtgttgatttctaattttcgcagatcatcaaaaacttttctctccgtgtgagattaaagtctgccgtgtgcagttctcttcaattggccatggacgcgcaacagctacaacaattgcttaatgcactccaacaaatggtcactaatgccgcaccagcaaatttgagcaatgccagtttggcaagctctatcgatgctcgcctttcggcctttcattacaatccggaggtcggcaccacatttgaaagttggttcaaacggtttgggaaattgatcgaggacgacggaagcacactgccggaggcctcaaaagtgcggcttctcctcggcaaactcggagaggaggagtacagcaaatatcgggacacgatcagcccaacccagccggaccaagtgaattggaatgacaccatttcgcacctcaaacagctttttgccgagacacgttcgctgtttgtccgccgctacgaatgcttcaaaattcgacagcaaccaggacaggacgtgtcgtcacttattgcgcagatcaacgcatcatgtgaaaatgccgacctgagtctgacaaaggagcagctcaagtgcattattttggtcatcgcactcaacgatgaacaccatgatttgcgacaaaaggcattgaaaatgttggaggacgcgcagaaaaacggcaccaacatttcgctcaagaaaattgaggaggaacttcgggcaattcagcttgtcaaggagagcgccctttcgctggtcaacccaccaattgccacaaacgccattcgcacaaggccacggcaatggaccgacccagcgcaaagacaaagcggcggctccaatcaaaggcaaactccaaatgccaattcaagcggaaagccaacgcgtggtcaaccaacgcttccgtgtggatcatgtggcaaatccgaccactggcgctccgactgcacattcaaggacgccacttgctttaagtgcaacaaaaaagggcacatttcaacaatttgccggtcaaagaaggcaaaggcaccaccgaacagccaccggtcattccacactgtcaaaatcgacgcaaattgcttacatgtcggcacgactcaaggacgatggtggaaattgtgcattttgattaatggaaggcaaacttctatgaatggcgacaccggcgctcaggccacaattatttcattgcaaacatggcgagagttgggagaaccggaactgactccatccgacatcgatgccaaaaactgcaatgaccagccattcgccttgcttggcaaattcatctgcaccgtccaattttccgacaaaccaccgcaaactctgatcgcctatgtgagcggagaagtcggacacaatttattgggattgccgtggatcgaagctttggagatcatcccccgccaaattttatttccgtccagcaaatcggctgatcaggcgacaaaaatgattgacaatttttcggcagtgaagccgccaaacaaatcgatcaatgatgtgtcaacgcttaaagcggcactccaaaacgatttcccggaagtctttgaagaaggactgggacactgctcaaaggcaaaggcgcatctcattttacggtctgatgcaaagcctgtattttgccgagctcgccccattccacacggcgccatggaagctgtgaatgccgaattggatcgtcttcttcaaattggcgcaattaagccgattgatttcagtcattgggccgcaccgatcttggccgtaaaaaagaaaaacggcaagacgagagtctgcatcgacttctcgactggcctcaacaatgcattggaattgaaccggcacccactgccaaggccggacgacatctacgcttcactgaatggcgcgaaatttttctcaaatttggatttgcgcgatgcatatttgcaaatggaaatggatgacaaatccaagcaattgtgcgccatcaacacgcatcgcggactcttccaatgccaacgcctgccattcggagtcaaatcggcaccggcaatatttcaacatctgatggaccaaatttgtgccggtatcccaggtgtattcgcgtatcttgacgatggattaatcgccacaaaaacgcttgatcaacacatcacggcactgtacactctttttggacgcataaaagaatacggtcttcgcatccaactggacaaatgcaaatttttgcagcccgaacttttgttccttgngcatattgtgtcagcaaatggcattcgtcctgacccatcgcgttcggacgcaattcggaaaatgcccgcaccgatcgacaaaagcacgctccgatcattcttgggagctttgaattattatggcagatttgtcaaatgcatgcgtgagatgcgtgcaccgctcgacaaactcctccaaaaggacgtagtttggaattggacgtccgaacagcaaaatgcttttgaaaaagcaaaggaaacgatgacgtccgaccttctgctgacccattacgacccggcacgcccaatcgtcgtatcagcagacgcctccaaggatggaatcggcgccacattaagccacacattccccgacaaaaaggaaaaagtggtggaacatgccgcatgcacactgacagcagcgcagcaaaattacagccaaattgaaaaagaggcattggccattgtgttcgccgttcagaaatttcaccgcatggtatacggcagaaaatttattttgcaaacagaccacaagcctttattggcaatttttggctccaaaaagggcattccgatctatgccgcgagccgcctccagcgttggtccatgatcttagcgaattatgattttgaaattcgctacgtcaacacaacgtcatttggccaagccgacgttttgtctcggctgatcgcaaattattcgcgtccagaggaggacatcctgatagcaaacatctgtgccgatacggattgctacattaattctgttttcgaaaacagaatggatcagctccccgtgacaacagtcgaaattacagcagaaatggccaatgatcaaccacttcaaacggttcttcaatttttgagaaatggatggccagcaaaagtcgctgattctgaaattagtccatattttccaaaaagggacaaaatttttgaagtggacaattgcctactgtatgaggaccgtgtgatcgtcccaacttcgcttcgcagtcgcatccttaaggcattgcacatcgctcacccaggcattgtgcgcatgaaagcacttgctcgacgtcacgtgtattggccaggaatggactcggcgattgaaaaagttgtgagcacgtgcgaagagtgccaactgggccagaaaaacccgaccaaagcgcctctttcgccatggccaacgacggacaaagtgtttcagcgagtccacatcgattttgctggcccctgctcagacggtcaccaatatttgattttgatcgactcattttcaaagtggccagaagtctatcgtatgaatacaatttctgcttatgccaccgtatttgttctccgatcaatcatttatcggctcggaatcccagaggaaattgtttccgacaacgggacccaatttcgatccgccgaattcgccacattctgtaaagaatttggaatcaagcacattttcacaccgccatttcatcctcaatcgaatggccaggtggaacgcttcgttgacaccttcaagcgatcaatgaagaaaatgtcaaaaggtggaaaggattggatcgaaaagatgctgttctcctacagaaccactccccacgttgccttaaatggcttttcacccgatcaattatttttcggcagaaaattgcgcacgaaattgtcgctcgttcatccgaatggagaaaaagccgaaaattttgatcaaaactcattcaaaaagggacagtcaaaatacaccgacaaaatggctcaaaattttgatcggaagcatggatcaaaactgatcaatttctttccaaatgatcatgttcttctgatcaattatcgaaacaacaagacggagtggctgcaaggaaaagttgttgagaggcttcacaaatcgcccacatatcgtgtttatgtgcctgttctgcgtcgactcgttcatcggcacgcgaatcagctaaggcgacgccatcttttggaagaagaagccgaaaaggaggcacctcaaatcgaagagccaccgccggttgtaaaaccacctcttccacctcaacaaaatctgcctcagccagccaattccccgttggtagtccgccgatcaacccgagtcaaaaagccccgccaattttattcgccatcaaaataaattttttttttggcttaaaccttcgggtttcgaatttaagaggggaggtgttagagaaggaagtaattattgattaggtgtatgaccccacgccacttcgccatcttccccctccgattcccctcattcaattgttttatttgtgcccaccaattttgacctcccaatttattttctctgcatttttattattttattttcttcggcaaataaacttatttaatttgttatcttcggacataacagaaggcaaaggcaaagtgttggattttctcatcggacatcacaaggtagacgtcaatgggcattttttgtatgcagagtaaaaaaataaccaggtcaaaattttcaaaaattttcggtttctaatcatgagaaa

SEQ ID NO: 6434 - DNA, 2300 bp, Heterodera glycines
ggctctactgcattttacgcgtccaatcacagtttacgcgtccaatcgacttttacgcgtccaatcacagtttacgcgtccaatcaaaagtttacgcgtccaatcgacttttacgcgtccaatcaaaagtttacgcgtccaatcgacttttacgcgtccaatcaaaaatttatgtgtccaatcaaaattttcctaattcgaacatccttttgacataaggtaccaaccattgcaaaaagaaataataatttaaatatgacaaaacgtaacaaccattgcaaaaagaaataataatttaaatattaaaaacgtaaatccgtcattgatcacttattatcaaagtatcgataggtatatacgcattcaatcaattgttataaaatttaataatagagagactaatttgtgcgtgcttattttggtttcgataacctctgatatcaaaattttttgtgattttttattaacaatttggccaacaaatgacttcaatatgtttcggagatctaacaataacgaaaaaatttttcagcaaattctcgaagaaatacgtattcaataccctgtctaatcatcttttcgttgtattaatcaaagtcttcattttgacatttaacatttaagcatttaatgccaatattttaaataattaaataatttataataattgattggacacataaatttttgattggacgcgtaaacttttgattggacgcgtaaacttttgattggacgcgcaaactgtgattggacgcgtaaaatgcagtagagccaacaattctaatgctaaaaaacaggtactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtaccggtttttttgcaattaccgattaccgctcaactctacttacaatcaaaatttttagcatttgtaaatttatatttttcatgtgttagagacatgaaaatagcggtaggggtcaactccgtctggccaactccgtctcagcaatgttcaaaaagctataacttttttctttgttggccaaacttcacaatcatggtatcattcgaaagccctagatgtttagaagatatttataagctgtttctcagtgattaatcagctctcaaaaaagttgtcagtttaaacccacaaaaaaggcagaattttcagttttttctttctatcttttttttatagttcgaaattttctgtaatttttagtaggctaatagagcctgtgaaaagctttcgaatgatatcaagattgtttgattcggtcaataacttcaagagttatattgactcaaagttggctcagacggagttggccagacggagttggcccgttccgtgaaaatagtacgccaaaaagagagaaaaagaaattcacaaaaattttcaccaataaactttttgaagtgcccgaattaggtggaaatgtaacctgaaaaaaatcggaacggggcgggcagggtccgcagttctttttatattttttgtttcgaggtcctagcaaatttacggtgtaaacacttttaacaaaatcaaaaatttttcactaataaatcagtcgaaaaataaccccacccctttctgaggaggttgaaaaataatccccctggtggataattagagataatacggtatgttttctgaggaaaaatttaaagcaaaacatttcataaaacagtcgggagaagaggggatacggtagcatattatttaaaatacgatagcattgggacacattttcaattaaaaattgttttttgctgaaaacaaaattatcaaaaaataaaaatgatgtgccaaaaggatcaattcaaaaaatcactgcgaaatgccaaattcggccaacaattctttgctcgcgaagacattggaggacagttttttacgattggacttgaaacatgcgcgcaatttgtcaacggaattcaaatgcaaaaaataattctaaaaatatataaaaataaaatttaatttcggaaatatttaaaaatcactttcaaattgatgagtccaaatttttcgatcagaaggaaacggtcgatcagcggaatttccacgcaatttgccaattgcgtctcacagcgcctcttcaaccagtccacctggaagaagtcggccaatttgagcaacaccagcacattctcagctgaaattgcaaaaaatggtgaaattttacaaaaaaatgtattttaaaa

SEQ ID NO: 6435 - DNA, 2218 bp, Heterodera glycines
gccaaaagctgaagcgtcgacgaaacagtgcaattggtgcttccgatctgtatcgggcagatgcaatgtaaaacggggaattgaaatatcgtccgaggacgaccaatttttgaacaaattaatccaggaagagttggaatcagtgggcaatgattggtcccactccaatttttctttacagagagattggaagaacaatttgtgtggtatcaaaactggtgagataaggccaagggggtcgtaacaagaagcaatgaatgatagaacagtacgtttcgtaaaattgtgggcactagggggtggttgtgtgaaaattaaacaatcgatttctgtattccaattaattccgagaaatttttggagagggtcaattagtcgtttggcctctgggagctgggaaatggcttcgacggaattagaacaaaattctctaagtggcatggaagccttttcaaaaagcttaattgattttaaacatttctcgtttgcctctgatgggttgtttgacgaaaggaacacattatcaacataaatgttatttttgatttcatttgaaaggggggatggatttagagacagatggtgctgacaaagggaggtggccaagtgtccgtgggatttcggaatgagattttttgggtagatagagcacccatgggttcttaagaaaaatgttttcaatttctgccaaatggacccctgtgccaagataaaaaaggccaaagtttttaatgatcaaataaaagaaatacctatttgtacctaagcacggtgtccagttgtgtagcgatagtgcgctagttagcatcatttaacccagggtggatcccctacatgtaaattaatttttttaatttttttctattatgccaagtcaattatcaaaatatttttttataaaaaaaactttatttttaatttttttgaaattatttagtgcagcaaatactcaataaaaatattagacaaaaatatattttttaattcgacaggatatttattacatctttatgtttaatggaattttttgatttttaaaggaataaaattaaaataaatattttgataaagaaataattttttttgataattgaattgcacataaaaagcaaaaacaaaattacaaaatggatttacacataggggattcgaacttgtgaccgaaaagtttttgactaacacattaccgctacaccaacaattgcttgttaacacgaaataaatgttccttttctttaattataaaaaagctaaaaactggcatgtcataactcggcactcgtactcatttggcagaaaataaaaccatttttcttaagaacctatgggtgctctatccacctaaccaagtttcatttggaaatcccacggacacttccctttgttaggttagcaaaatatgcaattataaaaattaatgaaaattgaaattttttaaacttacgatttggaagaatcggacactgaagagcaacgagcgaaattgcctccataaagtccttgaactgctccatgtccaggcccaactcgttcaaagtgatcagtcgatgctgcttctcccgcatttccacgctgagcatacgctggaccaccggcgaaacggacataagccaatgtgcggatacagtaagctgagacagtaaaaaagggtgggggagtacggtaaataagccgaaacaataaatggggtgggggtacggtaaattaaatgttcgctgtctttttttaaagccctaacgattggtgttttttgtagcaaattcacattcaaaaaaaaaacaaaacattttttggcacttcatagagcaagggtcaaaaacgaaaagcgaccattttaatttgcaaaaaaaaatatatattttacattttccagggattgctgaaaaataaataaaatttaatatttttctcaaaaaatttttcatttccggattgaattcactatttttggcaaatagtgccaaatttttccagctttgattactgaaaccgttgcactttcatttgtcaaatccaaaataaaagtaaataatagagatcggaccggtcggtttttttcggtatttttcgattttcagtttcggtttttaaccgaaaaaaaccgaccgataaatttttgagtttttcggtttttttcggtttcggtttttttcggttttttaaccgaaaccgttcgaccgaaataattaaaaaaccgaaacaatcgaccgactttttt

SEQ ID NO: 6436 - DNA, 681 bp, Heterodera glycines
ggggaggaggggacgaaaatgataagagatgccgaaggaggaggggggaagatgatcagagaagcttgaagggggatggattaatgaaatgccgggggaggaggggacgaaaatgataagagatgccgaaggaggaggggggaagatgatcagagaagcttgaaggggtatggattaatgaaatgccgggggaggaggggacgaaaatgataagagatgccgaaggaggaggggggaagatgatcagagaagcttgaagggggatggattaatgaaatgccgggggaggaggggacgaaaatgataagagatgccgagggaggaggggggaagatgatcagagaagcttgaagggggatggattaatgaaatgccgggggaggaggggacgaaaatgataagagatgccgaaggcactgatgcagtttatttttagagattaagtagtgaaaatgtgagattctctatttacattttattatcacttgaaattcgtgcaattgcagctccgtattctctaaatataaactgtaacagtgctgcggaaatatcgaattggtagcgccaaacaatcttccatttactatttttgcgtccaattttgtgaatttctcataatttcagctccttattcacttaaaataaactgtgtcagtgttacggaaggattgagttgataaa

SEQ ID NO: 6437 - DNA, 1330 bp, Heterodera glycines
ggtttaaaatcaaaaatccgaaaaaatggtattctgaatactttcaagaattttcttagtttttaaccatttttatttaaagaaaaatttcttcactttctcaaaaaaagattaaaaatttttttaattctaggttttggattttatataatctaaggggttggggtggaggcgaaacgacgggggattaaatgtactcgaattcggttcaaattttcattttttgaaataatgccatcatttttgtaggtactacgctaattacggagaggttggttttgaaaaaaagaaatcaatagatgaagatgacttgctttattcttaacataatatatcagttgctcaaattgggttgtttaagcaaaactatcgttcccaatccgtaaatgtgtccatgtcatcgtcgatggtgggccagaacgggttgtggacaaaaccggcacttttcacgaaccgacccaaagaagagcggcagcgtgagcaggacgatgacgcacttaggtagcaattagtccgggcgcaaatgtctggacgctggtctgacaaatgagacacgttgtccgggttttttttttgaatatagctcggccaaaaaaatttgggtagcgaaaaactacaaacaatctccgccgaaaaaaatagattgactgtatgcaaaattggtccattggtccccggatactaccaccgcccatcatttttttaacttccattgtatggccgactatctgtgacacattttgttaaatgaaaattcttatagggttatgcgtgagaaggagcggaggaaagaaatgcgccgaaaatttacgcaagagaaccaagcgcaacagaaacggcagaaggacattgagaaacggcacaatgaatggacgaaacaaatggaagaggaaagggaggcagtgaaagaacgaatccggtgggaatcgcctgatgaaaaagatttagagcaaatacctaattagaactcggagagaaaattacttcaaatttcatgttttaaataatttctgaaaatgtgcatttttcttgaaccggaaattattaaaatattctaatcgcaattatataattttcaggatgaataaacaaaagttggaggagcgcaagaagtcgggcatgaacggggaaggggacgacgatgacgaagaaaattaaatcataattaaaaaataatagcggaatttaccagatttttttttgtttccagtttttattttaaaacaatttctgactacgacattttgtttgcttttttgataaattattttgtcggatttctaattaatcacaattttttctttttaaatttttacctgccaattcccct

SEQ ID NO: 6438 - DNA, 3833 bp, Heterodera glycines
actaaacagctaaaccaatgggccctcgattttgcgtctcctaagcggcgcattttaaaaagtttgacctccttttttcttttttatttccactttgcattattaagcatgtcacgaggcgttcaaaatgaacgcgtcggttcgccttgggcccgagttggaaatcccggggtacaattgcttggaccatttctacgaattggacaccgaacagcactcgtgggaaatactccgcgaaattgtggaagagtcgaaaaaggtggcattaatttagaacccagaaaagggagtccttttctatattcggtcaaatttgattgagttcggataagataattctttaattcaactcaaaatgatgacgctaaaagacattcagctgcacaacatgctgatcatcaccggaatgccaatccgtcacaacctcggcctttacaattgcatggtggccgtggccaacgggcaaattgtgttcatttacccaaagacaattcttgcgaatgacgacgtttatcgggagggaaggtgctaatcaataattagttacataccctctcccctggaatgaataaaaataaaataatgacaataatacatttctcccgtccaaactttctctttattcatttaagtcatcaaaacaatgggacccgaggcgtgtttcaaaaataaacattttttaattgtttttccatctgttgaatttaaggtggtttgttgcatggcaacacaaaaatgagttcatcaactaccacataaaggaggaattcggcttctctcaggtactgtattaccgttttattgccaaggaaaatcttaaaaataacacatttgttgaacaatttaaacctaccgatttaaaatcgggaaaaccagttttagccattttgactcaaaccggtctaagaattttcttggcacttttgaaaattggccacattttaatttcgtcccagcaaaccgttccctttggcacttccgtgctcgagtcggcggacggcgttcggttgggcatggaaatgtgcgaggaaatgtgggcaccgttcgggcccagccaacggctagcgctgcaaggagtggacatcatttgcaactcgagcggctcccaccacgtgttgggcaagtcgcgcatgcgcatcaatcaactcgtgttgggtgcaacagcgaaggcaattaacacatattttagaattataccaataatcagtgtccacttgagaattggtttcagcttggcggcacttatttatacgcaaaccatcgtgggatggacggtgagcgcgtgttcttcgatggaatgtcctcaattgcgcaggtgattttgaaacgtacacttttaccaaatcttacaattaggcaaatattgtgctttttgtccaggatgggaagctgtacgcccagatcgaccagttcgacatagaagaaaccgccgtttgcagttgcactttgaatttggacaattcggtcgcttaccgggcaaaaattgccagcctttgccaacaggtgaccattaccaaagtggaaatattaaaggagtttctttcatattaaattttcaaattcctctttttttgaaaattaattcatgaaattagatccatcaaaaaatgatttattttttgctttttgcataagcgaaaagtgctttttccgtccagtccagcaaagtcgtgccaatgccatgcgttcggtgcgatgcgcaattattggccgacactttggcggtcggcggcggcgctctttcgcgtcagatcagcgtggaacagcggacaaacgttgatgagctttgccatgcgcctgcggcgtggctttggcattatttgcggcgcagcggaatggtccgtgggggaattaataaattatttttaatcaaaacatcctttttctctcttcccgtagagtggcttctttttgcctctatccggtggccaggacagtgtttccgtggctctgatggtccgtttgatgtgtgaaaaagtgtgtgatgccgtaaccaaaaatccaggtttgttggaatatttttattttttaattgttgaaatggatgtaacttttctctcccacttttcggcttgagtcctcctgcagcagaagaggaatccctgttgcaaattttgagtttaacccatacaaaaaaataagactaccatactactgaattaaaaaccctgggctttatttttctaccccctccgtcgaaaggggggctttatttcagggcatacatggaaaagggaggtgggtcaaccgaaatttttgcgaagggatctgggagggggagttctaattgagtaaatacgtttttgtttgtttcattttttgccataattcattcgtccccattcgttgtcagactctgatgacccggcctattttctgtgcggtgagcgcgtgccgaccgacccggcacttctctgcgcccgcattcttttcacctcttttatggcgtcctcaaattcctcagaaatgacaaagactttggcggcgggcattgccaaagacattggcgcaacgcattcaaagtacaaaattaacaaatggagagagataatttatatttcaattaaaattcattttgatttcgcatccattcttttagcattaacatcgacggaattgttcagtcgtaccttcaaacattggatttcactccgtcctatgaggcacatttttcgaatttattttctgatataatttttataaatccacaaattttctctaaattaccaatgccttttgcgcatttttcagtcttcggacctccgtgaagggatggcccttcagaatgtccaggcccgtgctcggatggtcctcgcctatttgcacgcgcaactgacgctgaccaaagagcggcgtaaaatttgcacttattgataaattgtttaaataatccctccttttcagggaaagggtctttgttggttttgggcgcttcaaatgtcgacgaaaggttggaaatgtttatttttttattaattgtagttttaaatgtccctttcagtttggttggctatgtcaccaaatacggttggttggctctcccccccccccctctcttttctctctcttccccttttctctctctctctttctgttgcttttcatttcctcttccacagattgttcctctgccgacattaacccaattggtgctatctcaaaggatgatttacgtgagtttctgtgccatgtgaatgctaatcataaattcccacacttacaaaggttcggcaattttttattttgtttccgaattacattaattcgatcatttgttgtgtttgcccccttttcagtgtcatccattcggtgccaaccgctgaattgcgtccactgaaggacggccaaattgtgcagacggacgaagccgaaatcgggctcacctatcgggaattgtccacttttggcaaattacgtcgtccaggctgttccgggccgtacagaatgttccaagaactcgtccacatttggcatcccgcgcgcagctatgacgaagtacactaaacatgggatggatagagttaacaggttctcccccccccccgactcattttctaccgaaaattttaaatttcgtctggaagtaaaaaaaacacatttttattgaaataaataatttggtttttatttttaagatagcggacaaagtgcgcattttcttccgccgttatgctatgaatcggcacaaggcgacagttgcaacacccggtaagcagaagactattttccaatttaacgaacttttattgcccctttactcttcagcttaccatgccaacacttacagcaacgaggaccaccgaaatgaccatcggccgtttctttaccggaca

SEQ ID NO: 6439 - DNA, 1373 bp, Heterodera glycines
tcactgaaaaacagtgtcacgttctgcatttttcaaatataccccgactaatgtttttccgttaaaatttgcaggaacaaccggttgactacgatggcacagaaattcaagtggtggacgacggggcggaagaagggccgacaatggcggacggtcagcagaatgtccaatacattctgcaggtgcttaccaacatttaaaagcattttttaaatataagtttccccgataatttacgaattcataaatttccacaataattttttgtacagtacgcggacagtggtgagatggaaaattcgatggtccagttggaggacggccgaataatccacgccacccaaattgggcagccaattccgttgtcctccgccaccgaagcgaaccttccgattggacagccgctgattatgagcatccccggcccgaacagtcaccagcagcagatgcagcagcacttccaagtggtgggcaactccgtcgccgtgccctcctcctccgccgcctctcttccgccaatcgcttcggcgccatcgccgcaatttcaacattcgccggcggagggggaagaacaatgaaaacacaaaaaacgaagggatgagatggattgatggaaggaggaggagtaattacaattagacaatttttcgctttaattcggagctttccatattcccataaatttgtcgaatttattattaacattaaactttttgcttttttattttcattgcaatgttttcagcgtcgctatgtcataattaccgtataatattataaaaaagaaagaaaattgaattctttttaggctatgcattcttacagcaattttgaggtgagtagaaggacaagaaagaaaagccgatttctagaattcttgttcttgggagtgttataactctgaatccgtttaatgaccctaattaggcagtgtcttaccacgcccttcagccactctttcgcggttgctccgtgccggcgtcccacgcggcgactgtccagtcgattcccccttttttcgtcgactttctacaccgacttcatcggatggttaacgaatacagtgccgaactgagccactggagcggagggatgcgtttttgtgcgtcacaaagggcactttacggcgcgaaattcgcagcgacgccaccgccggcgacaaaaggacggccaaaacgggcgatgggcgcagctgcacggagggaaaaaagcacactgaacgatagtcccaccgaacgacgactttcggggtggggcgggagtgattcaattaaaaattattaaatttgatttttgtttttggcattgccgggttcgcattttgccattaaaaaaacaatcgcaagccgacgagcgacagcagcagaaaagaa

SEQ ID NO: 6440 - DNA, 3606 bp, Heterodera glycines
tcctacaagcatcaaaccaacctaaaaatattattttcgtggtttttaggccgaaataagtgtgcaaagaaatttggaaatcaatacaaatccgggcccgaaattcgaaattgaggagagaaaaagttttcatccttcattcaacaaaatttgtaattaaaaaaaatagtttaaactattaaaaaaaaactatgctctctgtataataattaataattgtattaattattaatttaattaaatgcaataaaatttctcactgccgttcattgaatttggaggagaaaatgtatgggatttcgttgttcggccacctgttgttttgttttgccttcagcgcaatatgcttggtcatttgtcctgtttttagcagacgactcaatttaatttggcgtggtgacaacactaaatattttttggattaccaaaatgattgtgatgctcaaattatgagtctcgacatgtgttaattttatttgttggattttataaaaatccaaatccaaaaacataaaaattttaattaaaaaaattgatgaaaaattaactaattttttaaaattaaaattattaactttaaaaataacatactattaaataaatattttcttaatgatagataattaaggttatggcaaaaattcaaacaaaggcaaaaaatggacaaaatacaaaaaaaaatacaggcaaaatcccgccaattcttcagataatttttagatttttgtaaacctggcaaaattaggcaaaaacccaaaaatattgtgtaccgatgaaagaaaaattcctttttcttaattaaataacaatttaaatttattgtatttttttttacaaatgtctccgtagaccagccgtttgccaccaattttttcattgtatttgtatggcgaaagtggcgacgcaatggccaaatgggcacagaaaataattggccatcgaagcttttgcagcactagcaaaagaaaatattttgaacccaaatggtatggccacattctttaactataattaaattaaaattgaatttaaattaaaaaaaaaatgaattttaaattgtaaaaaatattagcgttatttttcaattaatgaaaatttaacaaaaagattttgttcctgaaataccgatgaaaacgaaaaataatattttaaaataattttacaaattcattaataaaatgtttttacaatccatggacaaattggctgtgtcccacagaatataaagcttccattaaatggtcaattggcgcaaaaactgggcttccagacggctgctgaaagacggctgaagaatgccaatttgtttgaacaaatgcttcgcttggccaaaatggcggacggacggatggacggacggacccatgggctgggccaacaattggatgtaacattcggccaaatatgtttttgtgtgtgtttcttatagttaaagaaagattattattaaatggttccggatttattgtgctgtttttatattctaacgcagggttacccttgaaaatttccctaaataagaacatcgctggtaaaaaataagattttagggtcaaaaataaggacattttttaaaacacgcttccaaaactttaaatgcatttttattcaacaaaaccaagcattactcaccgccaactatttttctgcgcaattacggcttagaaatgagaaatttatacatttccgaaaatcaattttaattttttaaattttttgggtgtaggtgagggaagagagtccggcggtgtcgataggcgccgcggggaaattttttgaaaatttaatgcaattttttaacaagtcctgtccaaaaaatgaccaaaatttgcgatcttgggctaattttaagaaaaaaatagagttttggggggccggcggtgccgataggcgccgctgggggaaaattttaagaattttaatgaattttgttaggaattagccaaatttttcagaaatttcctcttttaaatgaaaataaggcactaccccaaatcagaacatttcttagaaataataacagatacaacagctctaatagacgctgccggaaaaatttttgtaatttttaatacgaattcttaacgattttgttcaaaaaatgacaaaattaggattttgagccaattttttaaagagaataacaaaccgccgagagaaatttgaatattaactgaatcttgttaagattttgcatattaattcgcttcaaaaaacatttcgttcaaaaattatcattaaaaactaaatttctccctaaatccaaaaaataagacgaaaataaggacaaagagcttaaataaggacaaatcttacaaataaggacatttaaaatttgtaagatttggaccctcaaaataaggacaaatcttacaaataaggacaaagggtaaccctgttctaacgccttccgatactggcgaagtttgatcgaattaaaattttgaaaaaataaaaatcttcgaattggctatatttgtgggtttgtggtaggaataaggtccgatcatttccaaccttctatatttcgggaatcgaaatagaatttcgagaccaaggatagtgaaaatgtaaattccgatttttttacatgtttgaattaaggaaaaacaaaattattattttgaatatattatatatatttttgtttcaattataaaaaagggtcaattaattagaatttacgttaattccattgacaaattttgtccaaaaattttttctaggacttgatttacggaattaaatgatttattatttgaaaattatcgtttatttttatttcatttacaaaataaaaaagggttaattaattcgcatgcctaatcaaaattaatttaaacattaaaagtgaaatttgtttggaacattgtaaaaatgaatggttataaaattgatcacattttcaaataatgcattgttctatcacagtaaaaaattatcacagttttcataaatgctgaagtgtttttgtcgtccaattagcaatccaaaagtctaaattaaattgatttaaaaattgaaacaaataataaattgaacgcgagtacctatttctattttttaaatttacttttcaatttctttaaaaaatattttttttactcggattagtccatatgaattcccgaaatccctctaatcaaaaaaccaggcaaatgcttaggcccttttgataatttggcacattagcttaccttttcacaaggtatggatgcttcaactccgtttccaattgctgtcctactgctccatcggcatggcaaacgatcggacgctgatcagcgccggacaacccggactgatcggatgatgcacaaattggtgacagccggtgatcagcagctgaaacacatgccgagaatggtggtggccgaaatgccgacgggagaatggcatgctcatcaaacatattattttcaattaatttatcctgatcagccatctccatgtcgttgataaaactgatcggaggcggtattgcgctttgatgatggtggggtcgtcggtgaatgagttgcgcggagcggggataaatggagccggttcgacgataacgggtcatgattttggacacgccaagctttaaatgcaatttttaaaacg

SEQ ID NO: 6441 - DNA, 1063 bp, Heterodera glycines
  misc_feature (1025)..(1026): n is a, c, g, or t
  misc_feature (1046)..(1046): n is a, c, g, or t
gataacgggtcatgattttggacacgcaagctttaaatgcaattttttaaaacgtcaaaaattaatacagtatattggaatacggtagcttacgactgcaacttatatatagaaaactacgctttatattcaataaaacaaaaaaagaaaagaaaaaatgtattcaatacagtattgaagtacggtagtgctaattgcattaattaattaataatttttttgaattttaattatgcttacaatgcgtaacgccaattactttggcaatgtgactaatcttcagccccctctggtacaggttcagaattttttgccgatccaacatgccctagaaaaaaatatttgtgaattttaattaaaaaatattagcgcattaccagtggccgaccaggattgtaggaacggcccaacttgtttcgtgctgaaaattacaaaatttattgtaaaaaaaaatttactagtcacttagtctcatctttttttctgtaagtgtataaattttttgtaaatttccggcaatttgttctttgccaatttgcacctaatgggtcacaaagaccaacaaactttcttttgactaatgacaataattttcatagtaatatacagctgaaattgataccgtattctaaactacaatatccattaaattgttgggaatatatgattataaattaatcaataatggatcacaaagattgcccactctcttacaaaaggactccaactgatcagcagcggcggacaataccgtcatccttttgtccatgtttgtgccgtgcatagtgtgatcattattgtccaccaccgtttcttttcgctgtacagtatccgcttgtgcaagtaccggtactgtggaagacatacagtcgttgttcctaatattgtcgttgttgttgttgtccatggccgctgatgcggaagcagtagctgcagcacaattggcaatcaaattgtgctgttggaggaggacttggccattgttcaggtgggccaattgttgttgaagcagttcgttcacttgnnggataatgtggccactgctngtgctgctactgtagct

SEQ ID NO: 6442 - DNA, 2707 bp, Heterodera glycines
acaaaaaaaaaattttcgaaaacacaaaaatatttttatgcagaaaaaaaagaatttttgttatttcaataaaaaaaagctttgtacaaaagtcttcatttttgctgccttttccgaattttttgtgcattttttttgcctttttttacccttttcgtgccaattttatgtgcctatgtggaaaatattttcttgcctaaaaatccggtccctattcatttctcttttaatttgccattaatttttggcattttgaattataatttgctataaattgtttttttttcttgattacatttgtgagaaattgggttatgctgtgcacatttgggtcgactaaatccagtttttcaccacctcctccaacagcagggggcacaccaaagtggaaaagttccacgccaaagccataaaagaaaagtcgcgcagatgaataatgataaaaaaattttgtcccatggctcttaatcaaaaaatgttggaggaacggggacatggaaaagtgggacggagacacggaggaaaagcgaaaaaggcctctgggcaaatggacaggaccaaaaatgatttattatgtgacaaattaaaaatatgaaaatgaataagcataatgatttatgggaaaaaaactttttattatctgagaaaagttgaaaattgaaataaatttattgaaattaaaaataaatatgagaaaatgatttatgttttttttacaattttttagaactaataaaaaaatttatttgttaaacgtaaaaatataatttgatttaatttaatcagtaaaaacacaaatttaattaattattcaaaacaaataatttatttattgtttttaatgttttaaatatttatttaaaataaattagataattaatggagtcctttttttacaatttttgattgtaaaattttaaaattttttgttttacaaaaaataaaaaataaatttcattgaaacagtaaaactataattatattagttaattttcaaaaataaataattaaaatattgttttaaatttataaaattttatttaaaaattaaaattttatttttttacaccaaaaaaccatatttaaaaaaagcttttatacaaatatttttctaaactattaatccagtaacattctaagcattattaaataatccatataattaatgctaattacccgtgctaatagttcccagagcatttgttccatgatcatttggcgttgtaaaagttgctgttgttgctgaaattgcggctgttgtgccgcaacaaatgccgacttctgccaatttgtcgccacaggttcttccacctgcagttttagttgatttacatcttcaactttgatcattgtcttcatcatcatctgcagttgatccatgctcatgttcatgttgcttctcccaacatcacaacatattgttgttgttgctggttgtggtgacgtcattgtgattagtcgaagaagcattggcaagggatgaaagccattgtttggcggtgccaacaacggcaaattatcattattgccactaatggacaacgaatttgcggcacgaagtaacaaatggtgttgttggttctgatagtgctgctgatgttcaagaagcattctgctgatcagtggtgattcattctgttgttcttgttgttgttggttagccaaaagttgtgccaaattgaactgatcggacaactgttcataatgatgattataattattgttgctcgtggcggcagtttcactggcggccaatgacatggcgttgcgctagtcagatcacttctgaactgatcacattattttgtatgaatttagaaaacaggtaaattgtgggatttgtttggaccttgatcagggaagaaatttaaaatttttggcctgatcagatgaagagagcttacatatttattatgatttttagccaagcaaaaatatttcaaaaaattgtcaccaccacaaacaatttggtcattttttgttcatgaattaaacaattaataggctacttagcctgactaaaattaataatgccaatgcatttttcataataaattgttttgagtttatgttccatttttttttctttttcaacaaaaaatgaatgcttaagccaacaaatcctgtaaaaaaggacaaaatccctcctccaactcattttggggttacaaaacacacacacaattggagccaatgtttttgggaataatgggaagggcccatggaatttttgggcggggggtaaagggccaaggatggacccgtcagccgcgccgcagccctgtccccccccccccccaccaatccgcgtcatctaattgggacacgaattaagtggatgatgtgggtcggaaagctggcctcctgccaccaacgaccccctgccccgaggggggtggtgagagcgcgggggtcagggccccgagggtgaagcggattttcctttcgctgtgcataacccagaaaagctgatgggatgtcggcacagaggcagggtggagaggtggatctgtggagtggatcagccaaacgcggactattttttgcacaaattgtcgtcgtcgtcgtaccctggggccctattgggactgactgactattcattccccttccattattcgtcgtcctttccaaatcacctctcccccctaaggagggccgggggggggggggggaggatgtgatggaaaagctccctccccccttt

SEQ ID NO: 6443 - DNA, 1320 bp, Heterodera glycines
  misc_feature (17)..(17): n is a, c, g, or t
  misc_feature (1286)..(1286): n is a, c, g, or t
gggggtgaggagtgggngcggcagggcagggacgagaacaggaaaaaaaggtgggccaaattcgtggggagtgatatgtgggacgtggtggtggggctggggttatgggacaggacaaccggcgaccttcatcagcaagcagtaacaggaaatctgctgctttagctgacgaaatcattgctgctgctttttgggatgcgcatttgtttggtggctgacgccctctcattaggggccccccggggggacaatttgggggatggaaatttttgaagtcacttggggattaaatctcaaaagatggcattggctgtaaaaaaatgtgtgaaattctgattgtgaagcgattaaattacgaatatttggagatgattggggaatgaattggttgagaatgtttggaagggttcagtggcagtttgataagaatttttactatttgttcgaattcgggactggttttcgaattcagaacgaagttcttatagaatttctttatactacaatacttaatggtacagaaatttattttaaagatacttgtatcactgaagcattttataatgacgtattttccggtcatggaataggcttaagcctctagattttctttaattgcccacaaataactttgtgcgtttcaaacataaaatttatacaggatacaaaaatatgtatacaaatatacagcagtgtaaagttttaaatcctgaattccgatatgcgaaattacaatgttttggattttgaatgcaaacgaaaaaaatcggaattcgcaaataatatgacaagcaaaaaaatatacaggtttgatacaaaatatgataaaaacaaatatgtataccaacaaggaatacaatgaaattggaacccagaaactcaaatgaaaaacaaatgttaataaatttcaattttcctgggacttaacagaaaatcaaaaaacttgaaaactaaattaaaaaaaggcattgaaacccttatcctaattttgactcgactcggaaattgacggataaactttgactgatcaggcccccaaattttcattcgttttccgatcactatgaattctaacaaatcacaaaataaacacttaataaccaatcaacagcagccgcctctgtatctctccccaattgatcacactctctcactgaacaatctaaaactgatcacagccccccacatttgatcactactgattgatcagcatttgccaaacaatctaactacagctggcatcattgcaatttgtacaaaagccaatcgtaaattggttaaccccncgggcacattccggtggcaatttgtcatcatacg

SEQ ID NO: 6444 - DNA, 2911 bp, Heterodera glycines
  misc_feature (2773)..(2773): n is a, c, g, or t
tccgtaaaaaattttgaaaactaaaaaaaattaagtttttcaaaaaaaaattctgatcggaaaaggaaacattgttattgaggcctcgtaactctattggtttttgctaatggaaaaaaaaatttcaaatttacaatagaagcttttggactttgctctatccaatagtgccaaatttatgcccacttttcgactggcactgaacagttcgatggatgggatgggtgctaattgtaagaatggttgattcatttaccatcactcttctttgtcacagattgaactgtttgcggtgtgcacggaacgccaaagtgatgccgaattggaccgtattgttcgcctccaacagtccctttatgcgtcacttcagctccgttttcggtgggtgtggcacagaataaaaggccaagaaaaagggtgcactccataatctcgcctctaaaatttttttttttaattttcaaactgaaattttattgaaaaaattttcaaaaaattttttgttaaattttcttataaaaaactaacaacttttttcttgaaaatttcgaaatttgaaattttttttaaattttggcacttagattttgtcccatccaaaaaaaaatagtgacattttgccaatgtttttttgtctctcctctcaagggtaatggacatgcccagtgaagagttgggagcaccggcagcacgcaaatttgacttggaagcatggatgccgggccgaaaaagttggggcgagctgtgcagcgcgtccaactgcaccgatttccaggcacgacgactgcatttgaagtacaggtgaggagaagggggaggaggacaagcaactgatgagggaggcaacaacaaaccacgattactactgtatttatacaatacaattctatacagtatacagttttagccctgacaatgaggcggcacttcattcgtcccccccccaacccaaccccttatcgtttcctctccgaaatttaaatcttagaaatttttcgaaacaataatttttttgtttttttttaatttaagtgaaaatttaaagaaaatttcaggggggatgcctctccgctgacaccaaaatgttaaaaaaacgaaaaattttccaaattaattgaaaaggagttgctgtttaaaaagaactagttattgtcacatattcccccgcacccctcccccccccccttatttttaatgtctgtccttgatgactgtctgtctgtccatcatctctgtccgtcaccccacccccggcacttttcaggccgtctgccgacgctgccgtcaacggtaatgaaagcactcctctccgttttgtgcacacctgcaacggcaccgggctggcctcaacccgggcaatgatcgcactgctggagacccatcagacgggggtcagtcggccccccccacccacccaaccacctgtttaaacagacacagtcattagtgctgctaattaacccaattatgtgaaaatttcatatatatatttaatgtcgaccgaccgcattaaaagcgccgcctgtctagctgtgcaaatattataacataatgcatttagataattattttattcaattcacgatatctcatttaatggttttaaattaaacgggtgtacgactccccccccctcgcacaaaactttaaaaaaattcaaacttttcaacaaaaaaaaaacataatctatttttaagaaaaaaaaattttaaaatcgctagaaaaatttttcggttttttttaattccctggggggggtgatggtggtggtacggtggatgggactgatccgaagcggattttctggcctggctgagcaagtaaaatgtatttccataattaagtttaatccaattcacgatatataatcccatttaatggcactaaattaaaattatcatcatttaagcgtcaaaagggtgtcaaattgccggacgtaatcaatgaacggatgcacactgaacgaagtgttggcatttattgtatacatcagaaaaatgccggccgaatgacttttgattgattttgacacacatcgatgggctttttttggtgaaacaaattggcttcaatttcaattcccatttattttccacatttatccctcaattttgttgaacatttttttaaaaattttattcgttacattgaggcaaataaaatttgttcctcaatttcggactcatttttatgttttaggcttatatttttagtgatatcatttacctattttccctaccaccagggtttcattaaaaaattttttgttggattttcaacaattttttatattattttcccatttttgaaaaaatttcgtcccacataattttttgctaataggcattaactacgcggtacaggactaacttaacctgcaaatatttcaacccttattagttttaaaaaatttttcaaaattctgagttttttttatttatgccaaaaaaattatcaaaaaaatgttttccatttttgactttgacagtgtaattaaaacaattatccgcaatgtaaccctcatttatttgagcatattagcgttagttaattgataagttccggctcattaaactttctcattaaattttaaaatattttaaattgtaactttctcaaacaaccaaacaaaaaaacttgctgccactcattagtatgtaattaccagcgccaaaaagtgcaatggcaatggcaatttccgtttgccaatgtttcgcccttagcctttttaattaatgggaaatgctttttctcccatcccactttttggtgngcttctcgatccccccccccgctttttggtccattttctctctctctctctctctcccctcacctctctcttccgtctctctctcttccctctgtctctttccccctctctttctcgtctccctgtctcactccctct

SEQ ID NO: 6445 - DNA, 1541 bp, Heterodera glycines
  misc_feature (1532)..(1532): n is a, c, g, or t
ttttttctttctcaatcaaattaaatattcttggtattgctcgaaagcatttgaaaaactctattaacctacaaattttcacaattttttatgcttgtacaaaaaaatcgggggcaaaaaaagttcgaaaaactatttgctgttgtttttttgaccataaatttttgagaaaaaatcattcataatttcgcccaaaatgagccaaattttatcatcttaatatcattcgatagccctaagtgttttctattaccttgcaaaatttaaaaaaaaaatcgttaagtttcatcaaagttaaatgacctgagaagttcaaaaaaacaaccaagttttttgaacatttttggtcataactttcttttaaattaacaaaaacttttgaaatttttgcagactaataaaaaacacttagggctatcgaatgatataaaaaattaaaatttcattgcttttagagcaaagttatatgaaaacaatttttgttttttgactaacgtcgtcatagcagcctccaatgttccaaaaaagaggggatccaaattagctgacccattcatttgttgctttagagaatggggatgagaatttaaaaattatgccaccaattcatttaggcgagtgacaatatttaagagacaaaatccaaaatttatttaaaaattaattaagcctagccaagccatcaataaaataaaattatagctaacttttatataaaatgaaatgtcaaataccatcagcagtcattttaggtaattgaatttcgttcccaaaaattctctcctcacaatttttcttccatttctctccctaataaaattttacccactaatttaatttattattttttgctctcctccaaatttttgaatttgtggtgaaactttgtcatttttcacagaatttctcctcccttttttggcctctcttttctgatgcaaatgacagcttttttttgccattgtttcatttttggaattttatttttagtaaaaaaatttttttaatctaatgggcaactaaattagggccaattttgtaaaagtcgtcataaatttgcataatttttcgttttttgttggtctaaaaactttgatttgctttattttattcgtaaattatcgatattatttaaaagaaaattcagatttttattaaaaaaacgaaaattaagtatttttttataaaatgggcactcaaaacagcaaattgcgccaattttatcgtaaaacgctgagaaggagaaaagtgttgaaaaaacactggtgctcaccagcagcagatgaagcggcagcacaactcattgaaatgggaggaaaggaggaaattgtaaaaataaaaataataaatttaaattaaatgaatttaaataaaaaattcatttttaaatataaaattaaaatgcttaaaatagaaaataaaaatttttcttttctatttttaaataaaaatgtttcaattttaaaagaatttaattaaattgcttaaaattcaatttcaattcaaaggcttaaaaaataaattcaaatgcngttaaatta

SEQ ID NO: 6446 - DNA, 2048 bp, Heterodera glycines
  misc_feature (77)..(77): n is a, c, g, or t
  misc_feature (2036)..(2036): n is a, c, g, or t
aataaaaattttatttttttaattaaaaaattaaattactttaaatcaaaattctaattttttaataaaaaattcanctagatagttgaaattaaaatcaaaattaaaatttcttcaattttaattttttttttcaaagactcttcacgagatgctcgagccccgttctgcttcagctgctgctgctgttcactcactaaccaattttgagaattgccacgaattggaggaaatgcagcaattaattgacacattggccggctcattaagaaagcaattagatgcccttgtgtcggtcaaccgggtgaggaaaaaagaagaaaatatttaccgtattccctaaaatacagcccccccccccccctaaattagaacttctctgaaatgaagccctcaccccctctttgaggggattcaaaaataaagcccctgggggatttattttaggaaatacggtaaattttagattttcctgaaaacatttttcggaattttctaccatttcagcagtttacggaaaatatccctttttggctctgatttggtcgcaaatccgtttttctccggaaatttactaaactttttcatttctggaattgaattttttttttcaatttagtccaggccaattttctgaatttattggacaccatttttggtttccgaaatatgtgcttaaatttctagaatttactgacaatgggcccttttttcctaaacaaatttattaatttttcgggagttttcctgaatttaatcgcatttatttaattcatttttaatcacttttttttaactttcagcaaaaagtccagcattgttctgttcggtggaaaaatgttaaaaattcctttttattcgctgatgccatcccgggcaaagagcgccgaaaattggagtcacagacggacgaatgccgacttcgcagttcactgcttaccgacaaaattacggtagggccaataccgtagtgtagtataaatttgttttttttttgtatgattttgaattaaatattatattatttattttggcatagaattgcttggactatttgcaaaattttgacactctgctcaattccctgcaaagtgaacaaaggcggaaaagcggtggtaaataatttgatgttttttaaggctggggggatttatttatatttatgaaaattacaaaatattaaaataaataatatttatgaaaaaatctccaaaattcagtaaaataaatttagaatttcgaaaaaacaatttaaaacaaataagcgtgttgaaatgttttcaggaaatgagatgaaaatgttgaatttaggttgattcacttcaattttagtgtccctgtaaagtttggtgagcttctgagcacttatcgaaaaattaggagggaaaaattttaggaattaattttgtaaaaaaaataaataaaataatgaaaacttagaattttttgaaaaaatttttaaaaccaataagcgttgaaatattttcaggttaagttagtcttatagttttaaaatataaattcctaaaaaattggcttaatttttggtaaaaagttaaaatggaaaaatatttaccaaaatattgcgctgacccacgaaatatccaagtctcgaattttagttttttattattcagatgggcctaaggttaggcaaggagtaatataaagggtatattcgtattcagcgaccccgaaaaccctaaaaatcctaaattagactcattttgttgttataaattttgaaaaattttggacatttcgtgggtttctactcttttggacatttcgtgggtttctactcttttggacatttcgtgggtttctactcttttggacatttcgtggcttggacactttgtgggggcgccaaatattgataaaagtcaaaaatatatttttttttttttttgtatattggcattaaaataacattgcggtaggaaatgtttaaataaatcaaaattccagccctattgatgaaatttcaaaatttcaaaatttatttatttttttgttttttcagacaaagcganttttgacctgca

SEQ ID NO: 6447 - DNA, 5325 bp, Heterodera glycines
  misc_feature (10)..(10): n is a, c, g, or t
  misc_feature (5289)..(5289): n is a, c, g, or t
taaaataatntgtcggatgaagatttttcactccataaattttctattttgaccatctcaataagaacgcggttaagcgagcatttgttttccatctgtaatcatttaatgattttttagatatttagagaaattacctcaattagattgattgcataatttgcatgcgacaagtgaagttaaattgcctccattatcgagaacacagtcataaaatcggttaaacgttcggctttctgaccattctcttcggttatttgggttggaaatatcaattcccgcaattaggtcggattttcggcgttttggagttgtgcagtataattcatctgcagcacccgtctcgtattcaatggcaaacgcagtgtcttgtccagaaaatccacaattttgtagttgcgaagataaatgtgatgaagaagccatttaattccgaggaaaaggacaaatgtttttggttctattggccaacaaatactactagaagatgaatcaatggtggttcgtcggctggtcgctcgggtgaagaaaaggtcgttccacccacccatcccaccccctccctcgttcaacacacatttgcatcaatttacataaaaaaacacctgcatttcatttacatccttttcaattctataattcgtaatttaaaaaaacatcgttaaaacatcgttggcgttatgcacatcgttaaaattaacaaaacgatgttaaatcgtttctttaaaacaaaaaagactcgaacccacaaaatcaaaacgaacaacaaaagtatttctgatcccaaatcacagttaaattttaatctctcggtcatattttcatacaaaaaataatttaattacctatttaaaaattttgaattttaatattttataattcacaaaaatatttattacaaaaaatttaggttttaaaacattattccagcagggcaggtccactatttttttaaatagaattaaaaaagaatgatataagtgatcattttatttatgtaattcaataatttatcgaccagctaagtcaacactcttctctaatacacgtttaaataattaatattctctctatccaaaggcataaaaatttattaattctttttcatatgcataaaattatttaatagagtgaggaacttttttgaaccttaacgaaattttgcaggtttataaaggatattagggctatcgaaagatactaaaattgttggttttggttggcaaaggaaaaaattatagccaatttcaattcaggcaaaattattattattactttttaatggcaccgcccgtcagaaaaaagaaaaatttttcttccaaaaatcgtcgcctcatttcttctaccgcaattggtgaacgtgctgaacagcaacagatgggttcacttgtgacaccatttggaaaaaagcgaagagttcgacgagtggccaggaaaacgaagaaacgaatttctttgaagaaaatgtgagccaaaaatttgttggattcgaaattaatggatttcattttaatttcgctcaatatttttttcgcttttccccatactttctagagctcgacaatttgaaaaaaggcctggacccgtaattggatgtcctggacaaaaatccaggtccaggaaaaatccaggcctggatccccagaaccaggtcgagctctaataatttcagttcggtgtgcaacgatgtttggatggacattttgccttgttttgaccgtcctcaactcggactcaaattggcactgatttcgccacgtttcaattcgttggtggacaaatattttgatggcaaaagcgaattgacaatttggagaccaatcgcaattcggcgcaatgacagtgtcacaacaacgacggcaccacaattatttgtctttgccgacgatgccttttctgatcaattttcaaagctctttggctacgatgccaatcctgggccatttccatcgctccttggcgacaatacaaattgtgtgccatttccattgcccgaccgtccgttgcacagcaaaattcgctttgaatgccttcagattcagtaatttaaaaaaaccaaacttttatatgggaataaaagcacatgactgccagagatatgatgatttatcatcatcattagggcttccaaaaatatggatataaaatggcgaaatatggccataaaacatggaccaaaaatatggacataaccgcgaaatatggatatagagagtagaaacccaccctagaagcttaaaaccaagctaaaaacatgtttttcatacgtttcaggccacccacagtccaggaaaaaatatggattggatttccatataattggaagagctaatcatcatttttgctaattccaaggtgtcgatgaatgattttttctgtttaaaataatgatttccaaagcacaaaattgcaaattttcagtgaaaatctgtttaaaatgaccaaaatttctaatgttttcctccggcggtgcgtagggctctcaaaactttttttatataaaaaaaaaactggctcaaaatctctaaaatattttgctgaaaatctgctaacaaattgcactcaaatttgcaccgtcggaccccaaaaagtgttttttctgaaaaagctttgcaaataaacaattttaatgatttttttaaggttctgctcggttttatgcgtcccctgctggggtaggggtcactttggcgtagacaagaaaaagtttgattacttttttttattcaaccaaataaaataatgttgatattaaacgataggtctaaatgttctttattagcctgcaaaatttcaggaaattatattcggtctaaaaagagatatggcgcgctgcgccaaaatggccagaaaaatgcgatttttgaggttttagccataacgtttttgtatcgcggctaaattttttgaaactttgcaggttaataggcactatcaagtcattaaaatcataccaatattatttaatttggttggtaaataaaaatgctatgactttctgcgccaaaatgtcctgcgccaaagtgaccccgacccggtcccctgagaattttaagccataactttttcttacttggccaaaagctatattcttcgtatcaaacgaaagcttacatgtatagaagcttttgtagaactttatttttatctaaagtacaatagaaaaaaaattatactcgaaaaatttgaatttcgtgtttctcaaattttaatgccagtatttgcccttttctttcatttataaatcccgggacttaaaactttcgtttgataccaagaatatattccactatagcttttttatttgttatccaaatccatcaatctaggtatcatttgaaagctcttaatttcgacttttttgcaatttaatgttataacttttttagtaattaagaatataggcattgaccaagtaagaaaaaaattaggtcctaagaaacagaggatgataattagtggtaattcatgggacgcataaaaccaagcaaaatcattttttcaaaatgataattttttgccggaccggctcagttcggccccagcccaagtttttgatctataacttttttctttgtcaaccaaatccaacattcttaatatcattcgaaagctctttacatactctattagacttacaaaaagcaaaaaaaaaattttcaacaagcaaaaaatttatgatgaaaaaacttgaaagcttcgactttttcgcaaaattttcatatataacttttttggtaattgtctaatcgttaagcaatagcttagaaaaagcttctaaatacattaagctttcgaatgataccgagattgttggactttggtgacaaagaaaaacgttaatagtctaaaaattggctgggccgaactgaggtagaccgtttttggccccactttttgttggcaaaatggtgattttgaaacctttcatctgctggcagacagacctcttgctgaataaaagcattccattttcaggtgcattgatcgctctgtcatcgcttttctccgtgccaacaagcaaatttttgacagaaatggcaccaatttgcagttgagtgtgtcttatgcattcaaacatgatgtgatcagaccaattcggcttgtttttgtccgtcaaatttggcccatttttgcgacaaacattcgctgcctgtacattcagcgcattggtgattttgtcaatttgcgtcgtctcatttcaaagacaattctcaccgatctcgacattcatatggtcgattccaattttatatcgcccgatgcaactttttctactggccaagcgttggtcaaatggttgcacacgccgacaaaagacgggcagccaaagcgattgtgtttcaaaaattttgacgaacaattgatcaacaaattcaaaaaggtgtggcccataacaaattcccgcccaggtcgattttccaagttccggccccggtcccggcaatttcaaaattccggacgtcaccaattaaaatatggttttctctaacaatacaagttgcagtgctgcactttgaacacaccgagtcaattttgggcttccagttcaataaataaattggcttttgtaagatagtaaagggacaaaagacggaggttcgagtccgttgtgctacatgtcatttttttattaatttttgtccaaaaaattaaaaaatttcgattcgaagtggattcagttcttctctattgacagagataaataaatcgtataagagatgtttttttctctgcactctctctttattgacatatgtctcgttttttgactcggtgtgtgaaataagttgattttttgatttatcaagcattaaaagtgggggagcaataccgactagggttggccggtaatcggtaattgtaaaaaaaaccgataccggtacttaccggtgatgcaaaaaccggtaccggtaactttccaatacattaaaatttttggacaaaatctttcaaatacaaaatttttattccgttttcgcgcgaattttccaattttgcgaaagttgtctgcccccattcttaccagtgcaaaattttaccggcggttccggtactaggtaccagggatgtgccgagccagacaaaatccgattccgattaaatcgccgattccgattatggcccaaaatccgattaattgcgattccgattacgattacgattccgattcggcacatccctgctaggtacttttatttttgataaaaccggtaccatttccaaaaaccggtattaccggccggtacagtaccggtaccgaccaccctataccgacagaacgcatgngactttgcttcgtcattagcacatatagtatcgcct

SEQ ID NO: 6448 - DNA, 2107 bp, Heterodera glycines
cgaaactgaaatttgaaagcaattttcaattattttttaaattgtcgttaagttaccaaattattctgaaaatgtcttctaatatttgtatattaccatcttttgtcggagttttcctgtcttcttgctgttcttttccttcttcttcctccagactgaactgatcatcattcattcctcaaaataaaatttatgaaataaaatttaaaataataatttttggctctattttaaataaaaaagttattttctaaatatttttggccattactttttttgaacaaaacaaattttatgaaattttgcagaataaaaggactcttggagctataaatgatacaaagaatgttaatttggctggtgcttctataaaatgctatagtttaaagctttcaaataatttaggccatttcttttattattgtcctgtgaactgcagcaatagggccaaatttttcgctttatttgattaataaatttcaaaataatttctttgattttaaaatttcaaaaccatttcttttattgtataattttcatactgtatccactcaattatacaaaattccctaccgtatccgtcttgtccaaacacttcagaactggcaacagatggctccattgttttggctcgattcagctcagcaattcgggcaatcagaacactcatttcctccgatgtgctcagatttggaaaaattgctgaaaatgaaaaattaatttaaaaaaaattaattttagcaaatttaattattgaaaaatgtttttattattgtattttaattatgaattttaacaaattttttacgttggagaggagaaaattcgtcaattttaaaacctaaatttaaaattttaattttaatttgtttaatgcattcagaaaaaacatgagcaaatgaaggctaaattctgctatagccgctgtaattgtgcacatatttataggccaaaaagtaaataaatttatgggcaaaacgatgacccaaaaaatggagaaaatgcgacgggcaaaagataagaataataaatatttgaataactcatagttttcttccgtttttatcttttatttattcaaattgttgccttttagtttgggcaaacggtgacccaaaaatgggcaaaactgcggggaaagaaatatttgggaaaagggcaaaaaaagttgagatgaaactttattaaaaataaaaatggtttaattagggagaaggcttatatttttggaaatgaatcataacataattggccaaaaacgggaaaatgttaaatttctgctctatttcacttcaggcgtcaataaatgaaatatccaattataaacatcaatttttcaaaaatcttaaaaatttttctataagagaaccagtgccctacgagcactgaattttggaaaattcatttatggagaccaaaaatggaaaaaatagtactttttggtgaaaaatggctaaaaactcgattcccgagtcgagaaatttctcgggttttttggggtttcagttctcgtatcgtttcccggggtcatttctcggttattgtatcgtttctcggggtcatttcccggtctcggttctcggtagaaatcatttctcgcacatccctaataaatcgagagaccgtgggacaaatcgtgctgggtcgtttcttaaaaactgccattatgagcagcgttctcaggagcatattccaataacggtctaacataagttttgtacaaaataatccaaatcctagaagattttgatttaataacccgaaataaagagcgcatacgtaaatatgcattctttattatttgtgtgacatgattggaaaattgcaatttattatcaatatttatgcccaaatccctaattgtatccacgacatttattatatttccaccaattttatatatttctttggggtttttattccccaaatgaagtacaaaagtttttttaattgagattctgatctgccatttatttgcccattctgataaattatgcaatgctttatgcataatttctgtttcggttcttgctttataacaaatatataatttaacatcatcagcatataatttaattcttactcctgatggcaaagcatcaggaag

SEQ ID NO: 6449 - DNA, 5032 bp, Heterodera glycines
ggagaacctttatcagaacatgttatcaccgttgccttaaagctctagctctacccttcagaaagccatctttttgttttcccaaccatttcttaatttcaatttaaaaaatgtcgacaattgatacgaagtcaaaccatgctgatgaaatgaaaccgaacatgcaaaaagggaccaaacgagcggcaaccgatcgctcagacgagcctaaacgaccccgcttccttagtgagaagtgccgccatcctcgtttaattgccttcgaagaaagagaagcggcgtgccagtattttgaaaaaattttcaagcgtgacaaatttttgttcaaaaattctgatacttccgagtctgaatcggaataaattcctttaatttaattaaccaaagctacaaataatcaatcgcccattcatgtgcacccattattttttcttatttatatgctaatattattcgaaagctactaatattctaagctgtgaatatacacaattcgatacttgaaaaagcccttaatttgcaaaaaattaatcagaattagcgcaattcatgtgtaccctttacaacccacgtaaaaatatgatttatatgctcgcgcaaaattttttacgaatttatctttagctttcagcttataatcatagcttctaaccaaatagaactgctcgaaatgccatcacagttgactcctgaaatgatttttgataaaatttgcaacgatggatcgacaaaaatggacaaaaatacattgcaaagtctcctttcgaatggcacagatcgatctttcaatcaggacacctgtaggcttctcatcgacctgtttgactccaatcgcgatggcatgattgatcggaatgaattttggcctctttggaaggtgattattgttgcagtgttcatctttgacttgtcgtttagtttttgataacacattgttttaacggttcattttagtatgtggacgaatggaagatctcttttaagaatattgcagccgaaggtgagctgacaataggtgttgaccgacttgaaactgctttaagagaatatggtgagtgggcattttttgtctacaattccgctgtgagaaattggcagcgggcgctagcacaagctgtcgatttctcccagcgggcgctggcaccagctgccaatttctcccactattctaaatagtttctttataggatacagattttctgtcaacttttactgtacattattacgaaagtatgatcgcacaatgtcgggtaatataactgatttagttgttttcaatctgataattatttaagatcgcttacactttgatgattttatttatctttgtcttgtgctgcagcaattgactactccattccgcgatcgtgactttgatcagaaaggaaggattagagtttgtaagtaccatcttcaaaaattcatcccaaataattctttttaggtttcgaagactacatcgcgatgtttttatccacaatattataagattttcgcatttgctattaaattttgctctctatttggatttttattggtcattttacgttcaatgacgcatataattattaacttttggtttaaatgtcactataatcgtctttttgacttaatttccagcaaatcatctcggtattctctccccatcggtgtgtgaagatgaacaacaacaacaacaacaacctgaaacgattccaaattaagccaaaaggccccgaggaacaaccaactttgcgcacgaaaacgctcagcgaggtccaggagtttgatgcggctggctctttctttctgcgcgcaaagattgctagcgttctgttttccatctacaaggtgatggacaaaaaaaacgcttgctcctttgtcgcattatgcttacaatttaggcctgtccgatgcgtagcaacggtattccatgtcgtaagaaacttgacgaggaagacttctgtgtctcgtgcgcacatcgcgccaaaaagcccagccgcaatttgtaccttcgtgttgtactccgagattgcgatgatgaggaatgcgagcagcagacaaccgctttttcccatgtagccatcaaatttctgggcattgccagcgtagacgccttttacaacctatcagagaacgcgcccgataagttggaatcgatcttgcagtcgaaaatcgaccaaactgtgttcgtcaagctcaacatcaaggtgggtagtgtaaatggtcctcccgctattatctagtccagtgtcttctacgtaaaaattatgtcagataaacatgtatgttttaaggaaaagaatgagaccgcgacgctagactggattatttcctcaatatctgaggaaaaaccggtggcggtggtagtggatgttgaaagcagcgatgatgaggccgaggatgggtcatcatcttcaaatggttcacctaagaagcgcaccaaaaagaattgatgaaggtgctaatgatgatgatgtatggcgccggtaacggacaagatgttgacccgcaagccaaattttaaggctagatattctctgatgatttttagcattcaaccaaaaaaacgctttacaggattttttgcttttcatcttaaacaagtcgcttctatttgcatttgccatattatatatatagtaatgcgttaaaaaacgctccttatttccaccgaggtgctgaagatgtgcgaaaacagaagcattaatctcatgtttagcctttttcttttgcacacaaccacaatacatttgaagagtcaaataatgaaaaagggtgaagacgacactgctactgctgctgctgctgtcccacgaggcaaacggcccaactcaaactctgtatcagctgcccatttttctactgaatcagaggagatgaaaagttgtaagaaggaagagccgatggcgaccggatgtcgcaaaggtgcgaaacgacaatacccttattcgttgatgtcagctcgagcccaagatgtgtggtaagttttcagacccaaagtaaagcgtatgaaaataacccaggtcgctaaaacttgaccagttggaggagaaatattcaagaatggaagaggagctttcggaagacagcgatgatgcaattgatttctacgaagacggtattgatgatattgtggaaaagtgagttagcctcctttataccagctagaatgttatccattcatcctttttttttaaggataaatcgtttcgaagcaaaagtgaaaaaatggtcagtaaatcatggaaatacgccagtcgtcaaaaaaccacggttagttgttttcaagcagacagaacgcaccacatattatgacaacatactgaattttacagttataacacaaatgctgatgagaatagcaatgatgctgatgatgatgcgccaacatcgactgtgtacctgaatttgcacaatgacaagatgatcgagaaaacaaattaaaaaaatccctgatatggtttaaaaatgatgataatgatgaggatcataaaaaaactccgatatataaaccgattattttgtgagtgttttattacccaattaacattatcgcgaaacaaaattttttttttttgaattcctgtaatttgtattcagctaaatgccatccgattctgatagaaaaagaaggacaacatcagaaaaaagctccaagcaaagccaaactcagcctaaacaaccgagatgggatttccgctcgatgtcctattttgagaagtatccgactgagccacaaatggaagaggagatgaggcaactacgactagcgacagcaaatgatcagataggcacaggcgatacccacacatcggcagattcagaacaacaacaacaacaacagaagcaacaaccgttgtataaagagatcaccaaccatgtacataagcttgagcgattctctgtgcagcgccatgtcactgaatttatgcttaacgctcagcatgatgagcccgatgaagcgctacgtcaagcgttcgatgagctcattgccagagctgtacaaaatgcggaaaagaaaagtgggcgcgcagtctcaaaattaggcattatggtgtcagggaaagtgttaaacgatccagtagtgatacctatgcgccctccaatccaaaacaacgtcgacgtggtgatggctgagcttgacaagttgggtcagagcgagggagacgatggaggtgctgacaaaaaaactttgctgctcagcgatcctgtggagatcatcgtcacctgtttgacccctccagtagggtcagccccacgtttacatccataccaaaattggggatacgatgaatcgcaaagaattgtcatacgcaacaaggatagctactgtttatttcatgcgcttgttgcaggccgtgcctatcatgaccgcgatattttctgccttactcataacccaatagatgagcagcagcctcaatttatggcaaacataatgaacagacacgatttttgcaaagactacgaggcattcaatcgtctggtatcaaacattggtcgaatgcaaactgcagttgaagagctgatgaatgcgtcgggcattcaaaaggaccagacttcttatggaattgaacatattcagcaggttcaacaatactgggtatgatgtattacaaaattttaatcattatgtgttagaaatatatttcagaatcgtgtttttcccgggacataccgcttagttctgtttgaagatcgaccagaagagttacctcggccaatatggaaaggcccaggagggcatcgttttaacgtcacactttttctatccagcgatcattatgacgtaatcaaaaaaattcattgtttcttcaaacttggtcggaaatattgcattgagtgtgagtgcacgtacactgttgacgctaaacatacaatgcattgtaagagcagatgtcctcaatgtgctaaaggttagaaaaataatgttaatattttctataaccaaaatgtttagtcggacctcaacatccatgcccgaaacaagacggtgtccaaattttgtgcacagaatgcaaccgttattttttttcgcgattctgttacg

SEQ ID NO: 6450 - DNA, 2312 bp, Heterodera glycines
ggtaatttttggctatgtttctgttaaatcaatttctcagcgtgcttcccattctgaatcgcgttttgctgttcttgcaggtccaaacatggtacactttattatatgaattttttggtttcactttttttttaaattttaggcgggaaaaagcacttatatggtaatgttaattttactttttgttgtttatcgtacatttatttccttttagcgccaagtttgcatgttgcaaatattagcccaaatgggctgtatggtccctgctgaaagtgcatcatttgtgccgatgacaaggattttttcacgagttggtcataacgatgatttggtgcagaatctatcgggatttgcagtcgaagtatgtccaagttgtttaattaaaatatgaattcattttgaatggatttgcgttgtttttcatatgtccgaaatggcggtaattttgcaaaatgcgaatgaaacttcactgataatcattgacgaattggccagaagtgcgttcatgaattataacaaaataatttaattacaatatgatttactttttgcctggcatttattttttataggcacttccaccgaagaaggcattggaatttgttatgcgatttgcgagaaattgctttccactggggtgtctaaatgaaaaatacttacagtattctaaagtgtttgttcaccctttaggcctttgtgttttttgctacgcatttcttggacatggcacaaatggcattgaattacccaaacattgtcaaaaagtaaccaaactgattttaattttataatgcatcaatttcagctatcatttcgcttctgtttcgacgattgaccaagcgacacgattggaaatcctcacgccatcgccacaactccacgaaggaccgtatgaagggcctttatacggtaagatcaacaaaaggcattttataatgctgttaaatccagtgaaattcaggattggaattggctgagttggcgactttacctcaaaaaatcacacaggaggcacgccaattagcagagaaaattaggaaggcgaaggaaaattagtaatttataaacacacggacattacgtattacattttattaagtgtgacttcgtcgttctttgataagtcagtcgcatctgtacagtgatttgaggatttttatattttttcaatgtctcccatgtatttgtctgctcatttgtgcttttgagagatgtccaaattggtgataattgcaaatgcattcattgtttatgttcctcattatgtgatttctaattttccatcaaatttattgtatacaaatatgtatttgtgtaaaaaggcattgttatacaaaatagaatgacaattccatctgtttccatcatgcttttgtcctcctctccctaacttcccatattttgttcctcctcctccgtttctcatccccttttctcttcctctttcaacgcttttgccaccgcttcggcacatcgccacgcgtcttcctcccccacgcacattggtggctttatcctcagcacattcccttcatttcccccctttccgaccaaaacgccctcccgtcgaatgcattcgaatattctctcaactctttccgtgcccaacaccctttgtccatcctcttcgaccagttcaattccgatcattaaaccctttccccgaatgtctcccaaaaggcgggaatcgattcggcacaattcactcagcagaaaattaccaattttgaagcaattttgctggagtccttcctcgtcgattacctgcaatcaattagaatgggtttccgtttcgaaattgcttcacctcgagtactgctttggccacggtgcacgccagcggatttcctccgaaagtattgaagtatcggccaccctccatcagtctggcaccgatttcttttgttgtgattacggcgcccatgggaaatccgttggccattccctttgccatcgccacaatgtcaggcacggcattttgactttgaaatccccaaaaatgagtgccaaggcggccaaagcctgtctgaacttcgtcacatatcctaagtcctcctgaaatgttttcgcttttccaaaaataattcgggcctatttgcctctggcatggatctcgtcgaatgcccgctttaggtatccctcggggaattggactgtgccaccgatgccctggatgggctccgctatcattgccgctggtcccgttgtgctgggaaagtcgtgccgaagacaatcagtgagctcgtcgagatggtagtccaatgcgcagcacttcccttcagcatcggggcgttttcacaaatacgattttg

SEQ ID NO: 6451 - DNA, 4266 bp, Heterodera glycines
  misc_feature (4132)..(4132): n is a, c, g, or t
  misc_feature (4170)..(4170): n is a, c, g, or t
agtccatcgtggtacgctttcgcagactgatcacgtcgaaacgcccgtgtaagtctggccaatccagcgccaattcattggcttccgtcccgattgacgaaaagcacgagctgaggtgccgggcattcgtccgaccaattcctccgcgtattttccatggcatccgtttcgtaaatggtcggactgtgccacaacaaatccgcttgctcctttagtcgggcggtcacttttctaatgcaattcgttggcattggcattaatttggacccacgggtggcaatggccgacagaaacggtgacaattccgccgatcatgtccaaatatttgttgccctcaatgtcccacaaaaattgcatctttcccctggcaattttcagcggctgtttgtaataagcaatggacgaagcgggcaaaagaaaacgacggttcattttaagcaaaaatcaaaaaataattatggacggaaattttttttttgttcttttggaaggaatcttttaatgatattacaaacaattagaaatgatgtgaccgcaaattgagaaaaaatgggagggaaaggtcaacgaatgcggaggagggacatcaaatcgatgaaaggcaattctcagcatgacaatccaagcagtaccttcaatttccctatcttttccattttgaagaacacaaatctatcataattggtttatataattaaaagtgataaataaatttgcagtgaatttatcccaattgttcgttcatgaaagacatcaaaaatatttaaattaatgggtctcaattctggcaactgtaaaataggaggttatactagttttaacttaaaatatttaaacagtcggaacaatcatagcactcccattttataaagtgccgtaattcacacaaaggcatagaatcaacgcaaaaatcaggcaattggcaggtcactgtacaagaacaaaagagctactgcggcacaacttcggcacgcctgccactttttgcagtcatcgcattcggattttcatgccgcgcaatcagacgttcaaccatcacctgaatttgcaaaaaatatggacctaaattgtgattattcaatagttttcatcaagcgaattaccttagtgtatttgagtctctgacacaaatctttaggacatccgtatttctccaaatattggaatttgcaggtaaagacattcttctgctggtctatgtatgtggcggcactcatcagcggacacacaatcaatttggagtgatcctgaaaagacaaatcccataataaatgtgcagaaatcaccaatattagaccattcatgtgtttattcaatgcgcacctggaagaagttgatctgcagagtgccgttgctcagatgcaagacaatcgccgactttgtccggaaccacgtgttcaggcagggcagccgcgccaactcgtcgccgtcccgcatcttaatgttggcgcccgccttcatcagatgctcgttcatgtacgaccggaagaacttgagcagagtgatcttcttctccagcgcctgcgggtatttgttggccccgtaaaagtgttcggtgttgttccgctcggtgtattgcaactgactgaaggccaacggaattggcatttctaattcaacggagccaaactcacttcccagccgcgtccaaaatgactttggtgttgtcgttgaacagcaccccgacactgttatcacacagctggtagcccagtccgtacttgtccgagtagtcgacccaccgagacacccaaaagaagggttgcgccctcggatcttcgatctcgtctgagaaaatcagaatcagtcaggtatttatcacaatcactgatccatcacctttgtccgcttcgctgaaccgctcgggatttgtattcagcagagagcacagctgcgcgtacaaatcggacaagtagaaatcggccggcacatcgttgttctcgcctaaacggaagcaatcgctgcaattaaacattcgcaaatgcggcagacccgcggccatctcagtgatgagcaccgatgccacgtcctgctttaccgccaccgcctgcggaggcactttcgtctcggggacggaggctagcggcgcatgtccagtgaaagcggggcctttggcggcacgaggactggggacatggtccaactaatagtgagaaaatgttagttctagcaaaagggaatgccagttccactcacttcgggtcgccgaatgagtccgcctgacaccgcctgcatgttgaacttgggagccatggtcagacatgaactcggcaacactttgggcaaaaagccgtccgtgaagaattggaagttgagaatttcggtgacccgcggtcgcctcgctgggtccggcgccagcagacgagtgatgagggaagccgcgtctttgcctattttgggcggaatggtgtactggttggccttgatgcgattgtacgtgtcctaaacgaaatgaaacacttgagtgacaagttatgaaccacaaaaaagcaccttcaaagtttccgtctcaaatggcggcttccccaccaaaagtgtgtagagaatgcagccgatcgcccaaatgtccacttcgtacgagtgccctttcttgtccagcatttcgggtgcgatgtaattgggcgtgccgcaaagcgtcttcttgcgctccccgtcgtagtccaccaccgtggccaggccaaagtcgccgatcttcagctgcatttccgaattcagaaaaaggttgccaagcttcaagtcacggtggatgattttcttcccatgcaaatatttgcaggcttcgacgatctgaacaatcagtggctaaagttggcaaaagctaattcgaaactcggctaacttggaaagtgaaatagcgcgcttccggctcggtgactgcctttctgcgcttgtgaagttccatgagagagcgccgcgaacacaactccaacagaatgtaaacattgtcatcatcctcgaagaacccttccatcttgacgacgtgcgggtgggcgagcgcttgatggatttggatttcctgagccatctaaacttttcaaataaaactcactcatccgctcaattcttttacttttttaaaatcatttgtttattttggacatagaaattgtgccagctttcaccttgtctcgctgatgtttcttcaccagcagtgttttggacacgactttgcccgcatagattttcttcgtttggttgtccgtcaactcatagcaccgtgcgaagccgcccttgccgagaaaaatgcctttggtgtaagtccgttttgtgacgttattctgtacgatgaaaggcacttccttcagcacaggctttgtccgcttttgtgttgacatgaaagtaatacaaatttagctatcttaaaattatggaaatatatgcattaatcattttttaaaaattctcgatatatattaaccaaaacggcgctacttgcaaagagcgctcttttgaaattatcaaaaagcaaaaacaaaaggggggacccttttgtttgcaaaattttttaatatttggtcatgaaaatttattccctggggttcttggggtccaagacctcgaattagatgtcagattcgtgatcagcgacctctaaaacccccggataacaaatttttcgtccctctttggtttttttgggaatcccaactgtaagcatcgggggtcttaaatctgtaaatgccggaaattaatttgacttcgatatttttttaattgtttcccttccctaattcagtgacatttacgagaattgcgaaacgattccccaaaaggattgcctctcgataaattctgtcgctgttgccgccaaatccgtcaaaggttttctcgtatttgtcggtcggaaggatggctcaattgcaattttttcgccatcaaacgcattcaaagaaccgctgaaagtgctgcagggacacaaatcgaatggtaattacttttccaatttcctattgactttatttttcagtctgtacacttctttatgacgaaaacacgggccttctcatgagcggttcatgggtatgttatacctttgttatcacattcattgtcagacttttctccaaaaagcgcatttttgttttgttactccattacattgaaccccccattttgaggatcacatgggctntggtttggcccgtcgccgatttgctggtcgaggatggntcccgaagttggcattggacttctgtccgggcatacctgctccgtgtgggccgtttcggttgttcccgccaaacccgtgcctatttttttgaccgc

SEQ ID NO: 6452 - DNA, 5498 bp, Heterodera glycines
aataaacccaaaagttaaagctaataaattaatgaaaattttcaaatcaaattttcttcatttctttcaaacaattaatcatttttggactaagtgatcgaatattattagaaattcagattacgtttcacataaattttttcggcgcgcttttttcaaaaaatttttgaagaagaaaggggtccggcggtgccgataggcgccgccggtggaaattttgaaaatttgagtgagatttgttcagattttcaacaaaaaaggctggtttttgggattactaggctcaatttgtacggattttctttaaaaaatgataaaatacaattaaaaaaaattaagaataatattttgtcgataggaaagccacgagtatataaaaagaaacttcaaaatattttcatttctgtagagggatcgaaccaggggaaagaagaagggaaagtgaaggagactagccactaggccatttgcactgttggtcttgctactttatgaatatatttaattattatttctaaattttttcctttaactccaaatttctcactaatttttgcactcagacccccattcttaccagtgcttgtttttcccggttgccctaccgggaccgggacctgagcttttcaaattccgggaaccgggaccgggacctcgaatgaccgggaattcccggcccggtcccgtggcactctaattacaacttcaaaatcaatttttgtaaattgagcaaattccgcaaaaaaatattcgaaaaaatcacttccatttatttattcgatcggcgcaacacagcaaacatataacatttatgagttatgaatacatatgtatatacatagtattgtacaacagcgaatatacaaaaacagagacaataacatcataagacacatcggtcaatcattcaattctcatcatatacgcacgtcggcaactatttcttcacaaagatgttatggtccaaaccggcaagcgtctgatactttgaatcttttattgaaaaagaggggaccacagacatttatttatttttttatttattaagcaagaaaaataagtcacagaagggcggggaccacttactctgtaactgtcaaaattatagcgaaacagagcaagtgaataaagaaaacaagcaataaatgaaaataaatcataaaaataatcactgtcaaaacaaattaccataaatgagatcaatgtcaattatggataatccctcccaacttttaaatttttgtgcattggtataatatttaaaattttcttaaatgtattaatcgaatttgttgctaatattgttttatcaagagaattccaacttttaactgatcgatttacgaaggacatggatgatttcttagattgaaacttggaatttaatcaaaaaatgatttattcctagtatttaaattagtgcgtttaaacatggaatttggatctaggtgggtgagaccatgaattattttatatgttgtaagaatatcaaaaatttttcttcgtttttcaagagttggtaatttaaaaagttcaagcctttgtccatatgggatatatggcaaattacattttcttaaagctatacgagtaaagtacttttggcatttttcaattttattaatgtgaatttttaactgagggttccatgcctcaggagcatattcaagaagaggacggatatacgacataaaaatgattttccatattgaaattctttttgacttaataatccgaaataaaaatcgcattctaccgtaagcatttctagttacggtatttatatgttcagtaagtttaagtttattgtcaataagaatacccaggtctcgaatggtgtccacttcgcaaattgtgttgttatttattttatattgttctctagggttatttttgcccaagtacaaaacaaaggttttgttaatagagatgtcgatacaccattcattagaccaattggacaattgcctcagagcttcgtgcattatcactctgtcagttttagttctatgtattgaatacaatttgacatcatctgcataaagtttgataaaaattcctttcggaattttcttaggtaaatcattaatataaataagaaacaaaataggtcctagaacagagccctgggggacgccagagcacattttgtattcagaagaaaacgaattttcaacacgaactaaaaaggagcgattggccaaaaaatcaaaaatccaattaaggattttacctctagtcatgttttaaaaggaaactagtaattgccctgacaacaaattttttaaaaattttacacagtgaacatgtgagggcaattggtctatagttggtgggacaacttttatccccttttttaaagagaggaattattatagattttttccaaaaggtcggtaattttccggtatcaaatgagattctgaaaagttcggtaacataaggtgcaaaagaaaggaaacaattttttattaacctgaaatttataccatccggtgaagtattatttttatttggtaaagatttaaggacccggccaacatcaacaacattaaattcaatatcattaattacaggagagtgactagataaatcataaggtaaagacttagaattatgtaaataatgttcagaaaaaacttttgcaaaaatttcagctttttgatcaggagaaaaaataactgaattatcataatttaaagtgggaatcttttcttcacatttgatatattttcttaggtacgagaatagtttgttcttaccaccggatagtattttattttcacgtttaccaacaaagtttctggtttggatactaatatgaagggagatacttttatataggtgttcatatttggctttatctcgtttcattaatctgattaagggtgccaaccccgaccccgccccgaccccgaaccccgacattttaggccatttttcggggttaaccccgaccccgaccccgacgcttccaaccccgacgaaccccgaccccgacccttaaccccgactcggggtcggggttaaatatacacccctaagaatggcattttcgtgggggaaaaggcaaaaaagttataagaaatttgaatgttgtctttgaaatgacaaaaaattttgaaattagaacattttgccaatattaataaaattatctaaaaataaatagaaaatttttctcctttctgcatttttcaggttaatatattgtacctaatttagataacatgtctgaaatatggtctttttataaaaaatcgcaaacatcggaaacggcattatgtaacctttgtcgcaattctttttcgtgtaagaaatcgtcgactaagggattatgggatcatttaaagacgatgcataatgacgaatttgaacaatggcaaaaaaacaaaggaaacacaaataaagaagtactaaatttaaaaggttctgtgatttataaaattttttaggggcaagaaaacaaaattacgaaattttttcaacaatctgatgaccaaaagcaaaaggccgacgaattggttctgaaattaatgttgcggacaaattcatcttttttaatcaccgaatcgcctgaattgagagagctgtacagcaaagcatttcctggatttgaagttattttttctctttattattcctaaaaaaatcattttttgcagctacatagtagggaatatttccgtaaaattgttctaccaaaaatggcaaatgcaatcaaggagaaaatttgttcacaagtttcaaacgattatttcacaataacaacagatggttggagtcaaccgacttcaactccttcattattaaggttataaattctctttatgttatatttaagttaaaattttagcattactattcatcatattgacaatgaattcaaccgaaacgattttgttttggaagcagtacctatcgaatcacattctggcgacaacattgccgactcaatttatgatgcacttgatgaaaacggattaaaaattgagaaattaatttccattgtccgtgatgacgcaaaaaacatgcagcgaatggctagggtcttaggaaaatcaaggtaaaacattttataagaacgaaaattattcgaaaatttaagtcatcaatgtgtggctcattttttacatcttgtggcgcatgatgtactcaaattgggccaaatcaaggaacttacggacaaagtacacgaatgggtgaaattttgccgcacaaggaagggatttgaaattttgagacgccatcaagaaaaacaaaatactgagaaaataaaattagtccaggttaaaataattttctacaaatctatgattttaaattcagtcggttataacaaggtggaattccgtttacaaaatgcttgatgtttttcgtcgtcagaaaaaggcattgctttcaatggaagcagaacgcactgaatttcatttgcttggttcacaggcaaagcgttcacggctcgattttgtctctgatcatttaccgccgctaattcagagtgattttgtatttctgcgccaactttgtcctttgttggagctgtttaacagagaaactgaaagagtaaaaacaatttaatttataaaattttctgattttctcattttaagttttcacgtgaaaagtcaacttgttcttgcattttgccaactctaaaaaggctttttgattttttaaccaaagaagaacaccctcaacaaattatgataattgcgcaaagtcttgctgaatcaattggctctcgaatgcacaattacagagaaaatgaattattgcgaatttcaatgttgttggacccccgttttgcgtatgatctgaatttatttatgagtggtttctggaaatcaattgcagaggatttaattgattttgcaaaggaaagtaatttaaacaattttaaacagaagtttattttattttaagttaatcccgaaaatgaaaccaatgcgcaaaattttaccgaaacacaacaaatgatcaatcagaatctgctcattttacggattttagtgaaagtgatgagagcgctttaaaatgtaaacaagaatgaaaaactttaatttttatttaaaatttagtggacatttgaaacagtatataaaaggataaataaaatatttatttgctaagggaaaatgaataataatttagtggtctggttaaacgtggatttgttcccacggcttttcttcatcggattactgttgccaaatttgaggactttggcattggcaaaaacaatgtaattaatatttattagcaaatctaattatatatttttcttaagtttgatgtgcgtcaatgcgctgcttatgttgaacaaatatttaatttttggagcaaaagcaaagataagatgacagctgatagaattgataatcataatataattactaacgatgatgtcgaaattatttatcccatccaaaatcaacatgtaaaaagtcatttccatctaattaattgaaaattattttagttaaaacaaccaattg

SEQ ID NO: 6453 - DNA, 933 bp, Heterodera glycines
aacgcgacggcaacggcgactgtcgaggaggaggcctcactaagtgccaaaacagcaacaacagcaaacactgctggacctgaagaagggcaagggggaggaccaagaagaggggtggaaggaggtgcgcaccaagcgcaacaaacgcggcagcaacaaccgcaacttcgccaattcgaggcagtggacgaccaatggcggcgaactcgacttccagttcgactcggagatggaatccgttggaaatgccgcggacggtggagccgaggcgaggcgagtcatttatttggtcattaaatgttggccaattaattaatcggctgacaatttctggcaattttcttggatgggtatatggggagcaggatgaaaggtcgccgccgaagcatctccaggacaaaatgttgtcgcagttttttttcaaaaatataaaaaaaatatgtcaaaaatttttttgttacctagcctaattctaaaaatttttattaagaaaattgaacgaaataaaaaatttattttttctggaaattcagcaaattttgttttcggtaacactaggttttcaacaaaaaggttttaacaatttaattaatttattttttgtgatgtttatgccggcgacgttttggggtgttcccgggtctatgacatgacaattatttcttgtttttgcttattttagtgaggacaaaatttgggacgatttggatgacgcgatgtgcaacaaactgatcatcgtcacccaaacgccgccttcgtccggcagaaaagggacggacgtgcggaaaatggaggacaaaatcaacaaggagatggagcacacgctgagaagatatgagcaggagctgtggtcgagcaaagcgcagcaacaggcgctggtgggcaaagcaaaatagcaaaagaaaatgcattggcaaagcctttgtgaggggg

SEQ ID NO: 6454 - DNA, 4988 bp, Heterodera glycines
ttcaccataaaaatttcttgaaaattttctaagttagctcataattttaaaaaatttctcggggtaaacgatgcggggggagtgaaacggcgggagggaaacgagctgctcccgtaaatggaggtatccgcggcggtgggccgcggactgaaattgaatttaaacgcgcgcatttccatagtcccacccttgcagcccaaaaaaaaaaaattcgggatgggcacccgaagagctttaacggccaaatttggacaaattcccttccccctggttacgggcatgcatccttggcattcggttttgaattcatatggccctagacacctttgttcaaaaaccatttcggaactctgcttcttatcctttttcttttttacagaaagatgcacgtggtgggcaatgccaagccaatgaaatggcaaaagggcgctgctcttcggcggacgaaggcaagcaaaatgcgcagagggaggaggggggcgcgtacaatgtgtggaccaaaaaggcgttggaacgagcggctgcgagcgcctccattgttcgtcgtttcgttgctttttgttctaaatgaaattcatttccccgggattatatttagccaaaaagtccggtggccaaacgcgaagagaatgacaagccggtgaaacgcttttaccccctcaacccgtgggagaagcagcaaccgaacaacaacaacaggcaaaacaagggcaaggagaacggcacacgccagccccaggtcatttggcgaaaactacctgacatttgacgatttgcaacttggtgactcgacttttagagactatacacttagggattccgacatttgaggctttcggcaattgtagggattttaatttaaaaaaatatttaacaaaaatttccaaaaaattatttcttaacaaaccaatttgacaatctcgttttcactcgaatgctcttggtgaggataagcttttaataaaaatttgtcgaattttcggctgaatacttagtattttcattaaaatcccccattgtcgtgtcccaaatgtcgggtcaacaaaagtcgctttataccaaatgccgagtcccctatgtcggaatccatgtccctaaaagactggtccaaaagttacaaatacccaaattttgcgcgatgcttggcactggagtggtcgaaatagaaaagaacatttggaaagaaaagtcccaattttcgtgtcttcaggctatgcctgtcggctgggtgctcggcgttcgttccaaaaccacgtccataaatgaagatgccggaccaagccatccgtcgacctccgacgctctctcaacaacggtcaagccaccggcatcgtcgtcgtcgattgccagcgttcttcctcctcatccctctttctcattgattcaagaaaacgggttcgaacagcgggttcgtttttcaggagttattaataaatcgtcggattctatggttgccgaatgatccaatccatgttcaggtgtacactgattggaggagtcagtgcaaaaaacagcgtgaggcacttggctacgacattcccgaggtcaagcattttttaaaaattatctcaaacattcaaataaaacaggccagtagcccgaaaaaaattctggttaggggggggggtggaatccaaaggccttgccattcgggccaaaaatattttacccagtgttatttttcaaaattttcagcgccgggagaaaaacaggaatctgtactggttttgggctaacaaatgacaaattttgcccttttacgggtctattttttcaaaaataatggcaaagtggggtccgacggtgccgatgggcgcgccaggaaattctttgcaaagtttattgaaatgataagaaaataatacaatttttttaaaaattttccaattcagatgcatacgctctatcggttttggtctctggttttgcgggacaatttccacaggtcaatggacaacgagtttccgtaatttgcactggaagacgctgaccatgggtaaacgaattcaaaaaggcgtcttctaaatgctttacctcccattcattcatccatccctttagccttcggtatggcattgaatcgcttttccgtttctacagctatgggcttgagaagaagttgcgcccgaagctgtacaacgatttccaagaagccactttgcaggacgttaagcgcggacacacttttggtctcgagaaattcctcgcctttttgaaatgtctctggcgtttgatttttttatgtatttttaaacgaaaatacgcttttttcagattgtaagtacagcactcaattggaggtgatgccacaaattgccaaggaattggccaggtaccgcagcaccgatttattcgccaccgaagtgagtgaagtggaaggttttactcggaccaggccgttttctacgagcataaattgttggctataactttttttttctttaccaacaaaatccgtcagtcttgttatcattcggcagccctaagtgtgtcctctattagcctgcaaaatttcagattaaaaaaagttatggtccgaagagttaaaaaaactggttgttcgaacgaacattttttgccataacttttttgaaccttaacgaaatttctcaaaatttgcaggtgaatagaggaattttagggctatcgaatgataccaagattgttggatttggttggcaaagaaaaaaatgttatagccaacaacttgcttgtacgaacacgcccctaacccattttaatgtgtgaaaattgaaaatatctatttaagccagcgaaagccgcaaaactcgaattgcagaacgagtcgaagaatcggagtggcggccgtaatgtgatggtcggtgcgggcaaataaaacatttcattttgttgattgatgcttgaccataaatgccttccgttgtttgttttctcctccttcgttttttttttgcttattagcatccctttccgctgttgacttccatttccatgattttatgttttccccatgaaattatcgcccatcaaaaaaagccaaaaagaacattctctcttgttgtttcaccaaccacttgaacatcaaaaatttgagtcacactttcatacctgaacacgggggggggtctcttagtcgatcgtaagggttcgagacagtcgatcgtacgaggtggggtggggaaggaaagttggggggcgggggtgaagggaggaagagggagaagaagaaaaaggagtgagagaaaaaaaaagtcagcgaaaaagtcgatcgttaataaattttttcatagtcaattcgaaaaattgccttatttcttaacaaatttcattaaaaattcaatatttttacgatcgactaatcctgatttgagaaaaattctcgagtaagaggaaagtgggtaaaaaaaccccgaattttgcctctttaaattccaaatttcttcgatcgactaaccctgatttgtgagaaaaattctcgatcgtaagaggagaggggataaaagaattcaaaatttcccttacgtcgcctataaaaagccttatttttcctaaaaaaaaattgacttaacgctaaaatagcactgtttagtgaaaatctgttagcaaatcacactcaaattttcaaaatttccccgccggcgcctatcggcaccgccggacctcttgtggtctccagttgaggccaaagtcgatcgtaagaccccttcactgacccccccccccccccttgttcaggtatgcacactttactcagtctttgcacttttctttgctctgcattgggtggacaaaaccagacagggggtggtgtgaggtgatgacaactcgtacaaaggcagactaggcctaattcgctaaatgtaaagtaaacgttgaaaatggacaaattttttcctaaaaatcaacctgaaaagcgaaattttcgcttttttttaaattttattattgacataaatttatcaatttttaatttaatttattcaatattctcgagaagattttgctacaaaaatattttttgaattttcggtctttggggtcaaaaaggccaatttagctgatgggggccgttcgttatacacagcgagtcaattttgggctccaagtacaaataagtttattatttatttagtaatcagaacgccaaaactttgcaaaacttaaaattttccggagattttcccttgcaaaaaaagaagagccgatctcgagttaaaaactagacagctaaaaaataaactgtgattcgatagagggggtcaaaatatgggcctatgcaaaatttgaagaaaatctgaccctaggaaaaattttttgacccaggacaaagttttttctttttctctcattttgatgcactatttccatgtctctaacatataaaataacacatggttcattttttgtcaataaacaatttttttaaacttttgactaattaagaaatattcttcagaattttcccttcaaaataagtataaaatggttttatttggtctattattgacaaagttataagctaaaaaaatctatatattaattttgccgtgtgtgtcacaaagtaaacaaaaaatttaaataaagttttgacgcgattgtttttatttggatggaagaaatgaagtgaaaaaacagagataatagagataagttgtattgtaagaaagagtgaagaagagagagagatgaagacagttaggaacaaagagcggagagtaaaggagagagaaatgattagagaaacaggaaaaaagagagagaaagtatgggagtgaatgagacagagacaaataagagaaagagagagaggggggagagagaaagaagaggagcgcgagagagagaaaaaaggacagaaagagaaagagaagagggagagagtgagagaatgattaaatcgagagagaataaaaaaggagttgagagaatgaaaaaaaggagagagagataaagagaaaacaggaggtagagagagagggggagagagaagagaagcgagagagaga

SEQ ID NO: 6455 - DNA, 5871 bp, Heterodera glycines
acaattttaagatattttctaatgcttcatctcgtccccccccggcattgtcattttgcgcttgagtaattccgctgccccgttccatttgaccaatgcattgactgggaggcgattgaatgggacttcagaaaacagtggaaccgaataccattaacgccatgagagtgatctggcctaatttctatgcaatttcctgattttgaaagttcaaatttgagaaaataaaaatattcattcgtatttctaagaaatgttcgggtcttgtaattttcagaaaagaataaagttgaaaaatatagttcaatgtaaaattctgtagaattaaaaaattttctgttttctaaaccttttgtttctcatattggaattggaattttattgccacaatgctctcagaaatgttcaaggaatttgttctgacttaatctgctaaaaattataaattaattgtaaaattagcttttagcacttttttggttagacacaaacaatttatatgagaattaaaaaagccgctaatggaacgtgttcgtatttaggagtctgtatcgtttcggcgccgccgtttcggcgcgagggtcgtttcggcgccagggtcgtttcggcgccaagccaaaattaaaaaatcatgaatcagttggaaattttgagcgatttaaattttcaaaaattaaaaattttagcaaaaatgtagaataacaataaactaacaaaagaaaatttaacaaaaattcatttgtttaccgtacttactcgtttagaaccccacccctctaaattagaagccccccccccaaaaaaaatatttgtttgccaaaacgagtttaaatttcctgcctatttgacacttaaatgtggaccaattatgttacaaaaaagctctaaaataaagaaaaatctggagaattttatactttttatttgaattccctattttcaataaaaatgattttgaaattcaggaccaaagggggaggacatgatttttgagtgggaaaaattttcaccaaaatcttccaaaatttttttagaagttatttaagccgctgatcaatgatcacgaaaatataatcagaatgatcttaagattcgttaagacataagaatccatccgtatcagtggattctgaagggatggcggtggtcaggttcggatcctttcgatataattttttgtgcattttgggtcttgtaaactttattgtgaatttttaaccattttcgtctgcttcaaaagttgcagggccttaaaaatcagaaatttttttggcgccgaaacggcggcgccgaaacgacccgttccccaataaaatacctaattcccgtcatttttttttaatttggggataaatgcataattttattgaattgattcttcaaatctctcctaacagcgattgaatcaatgaaacaacagaatagatgttattagtacattcacaatacacagatggcacatatttaggcattggtaacaacatcatgatgatggcattttgggtgaaattatatacatacaaatcggatggatttgacgggggatcaatttcattatacaacacataaaggggagccacactctctaagatgggcacaattatccgtgatttaattagtatcctctgcaaaaattcgcgtccatttcgtttgccatttttctccatgccgttgttgttattgttgttgttgtaccatggctcatccgaccacgcgtcacgtcattcagtcactgtcgctgcttgaggggcttctggtcgcattcccatgggtcgtattgttggtggcattcatcgtcgccggcggtgtcacgtgcaccgtcgtcccgttcattgcaagaccttgtgaaaacaggacaattattatatttgttgcttcaaaaaatgccaaaaaacgtattacgttcaagcgccaccatgacttccctctcggcctcggtcataggggcatgaccatgaccgtgcacatccaacgctcctccgtacatggggatttcatcgtgccgcgtacgcgcagcactccgtccacgcttcggctttctcggacgtccacgcccacgcttcttggccgacttggaccgcttctttggcgtcgctttgcgcgccacaatccggcgacgtcgacgagacgctttcctggcggacgacacacggcgcgacactcggcgagacgcgttcctgacggacggtgaacgacccgttgccctgttgccggttgctcttctgctcgcggaacgacgacccgtatgtgttgaacggctccgactacggccagcagcagcagcagcagttgaagtcgtacgacgagttcgctgaacggtggggaggaggggaaaatgaatgaatggtggcggaaaaagcggatgaaaaatgaatgaaaatggaggggaaagggatcaccgatcttgaagaagtcatctcgtcgatgagggacgaagaagctgtagacgaattggaattgtgttgtgatagcgcaacagagagagagggcaaaaaatgtgtaagcgctaaaattaattgcaaataattcaattaggagggataaagccgacttgaaaagagagtgaatgccaacaggggcaatcctaatttttgaatagaaaagagaattttgaaaatgttgcattttttctggggaaaagcttcgaattcattgaacaacaatttatgtatttttggtgcaaaataatgcttcaattattcctttaataaaaacaaaaatacgcattttccgtattttgaaaaaacatttcaactttttattcgaattcgggtccgagattcggaatttgggcaaatccgagttcagaatcgtaatcagcacccttgaaaacccacggaaaaattgcaattgtcacaaaaaggaacaaaacgtcgaaaaatggacagagcggaagagtgaatttgatgaattcaaacaaaaaaaaagtgcaaaaatcctaaaaatttctgcaatttatacttttttgaaaaatgactgacaaatttatgaaattttctgcgtatttaagcggtgaattccctaccaaaatcatccattcattcattgcattcacccattgtttctttccatcggtcgaatcgtcttcctatacaataaataattcccgtcagtttttttttgtttcattttttaaaatgaactgaattttgtgcccttttttcaggatggtcagagcaacaacggccaggacaagggcatcagcagcgcgagcacggagcatcaaaatcaatcgtcgaaatgccaagaaggcgcgtgccgcaattggacgagccggacatgtgagtgaagcggagggcaattaatacactaattaattcaaggacggcaatttttaaatgtgccaatttttcagacacgcaatgcgatcgcacgagagaagtgcatgatgtgtctgggcaaagtgagctccatgacgcgtgtgaccatgggctgtgtgcacgaatttcatcgcaggtggaggcggggctaattccgatcaatttcgaacccatggatccccgaattcgaacaagtctaaaagtcgagttttcctggccaaaatgccggaagttttgcttttgctgatcaccgaattcgaaatccgttccgatcaatttttaacccatgaccgtcgagttcgaacaagtctaaaagtcgttttctgtccatgattttctagaaattccttggtggaaaatttttggattttttggggcatagaatcccaattttgacatggtgatttcggattaatgcaacgcttatcattatccccccgtcaaggtgcctgtaccgctggctcaaatacaacaccaactgtcccgtgtgccgcttcaatttcatgcgcgcaattccccctgaagaaccggcggaggaacagcaacaacgagaagaaatgactatctgatcagatccatcattgaaatctgtaccatcataatgttgtgtattatgtatatgtctgtgtgttgtgtgtgtactcagtataaagatgatgatactcggaaaacccgaattttttttgtcggtttttgctgtagatattatttagaggtcattagtggagtccggcttttcagattgttgtcaaaattaggttagctttgatcagttcttctctcagtctctctctctagctaatctggacaggaaaagcggatctatgcaattttttttttgaaaataatgagatttaggtgtatatgtatctttttaaaaattgctgatcatgaagtgcccatttcaaaatttttgaatctggccaatttattcctctttttctctctctatatcttgcaaaattttcacgccttttttcatttttggtcacttttacaaaagtttgattagtttaaacgcatatcaccaatacatacaattccagtgatcggacattgattgaattcaagtgatcagatattgattgacacatgatgataggcaacataggtatcaacgaaaccaaatgtacaattcaaatgatcaatcggataaatgtcaatttcttatccttctgttgttgtgccatgatgctaatccaaagccacatccgcggttgtcgctggagtagtcgcagcgggcgcctcagtattggtcgccgcattcgtcgtcggagtagtcgccgctccggttgcgtcagtgttagtcgccaccgcgccatccgcaatcgccgtcgttgtcgtcgtagtcgcaccgggttcgttagcgttggtcaccgtcgctccatccgcgttcgtcgttgtcgctggagtagtcgcagcgggcgcctcagtgttggtcgccgtagtcgcaccgggttcgttggcgttggtcaccgtcgctccgtccgcggtcgtcgttgtcggtggagtagtcgcaccgggttcgttggcgttggtcaccgtcgctccatccgcgttcgtcgttgtcgctggagtagtcgcagcgggcgcctcagtgttggtcgccgtagtcgcaccgggttcgttggcgttggtcaccgtcgctccgtccgcggtcgtcgttgtcggtggagtagtcgcagtggtcgccgcgtccgttgtcacagtcgccgctccggttgcgtcagtgttggtggctgcatccgcagtcgtcgtcgtctgctgctgggcagcgttcttcccccgtcgggcacggccttttttcacggtcctcggacgtccacggccacgcttttgtccagcagtgcgcggcgccgccctcgatttgcgcgatcccctcggccttccacggagcggtttgagcttgagcggacgacgcattgccgagccgcgcttcttcctcgtgctggtcccgtcgccgtcgttgttgttcccctgccgacgtgacgcgcggcgcaccgctgcactcacacgcgctcgggcgctgcttcgaccacgcactggcgctgtccgtctgttgttggttgaggcgccctgctgtcgtcgacgagctctctgaacaacggcggggagggcgtaaaatgagagacggaaatagttgcagcaaaaaagagggactgaagcgggtgccaactgagcttgagaaaactttcagaagccatctttttcggcacttttgctgtttaagggggtcccgaaaaagaacgacagagaatttcattttcacacactatttgcacaattctcaagagatatttcaaaatagcgccttgtaatgagaggtagagacgcatagttttaaaaaaaatgttacttttgctttacttataaaagtatgcctcttctaccgctcataacaagggacagtggaagcagagaaagagaaacacgaaaatagcgcgtgtaagactttttctgtcttttcgggattcacaaacagcaaaagtgccgaaaaatgtgatggcttcagagagttttcttattagacgcagttgaccgaccactagcg

SEQ ID NO: 6456 - DNA, 3200 bp, Heterodera glycines
  misc_feature (3114)..(3115): n is a, c, g, or t
  misc_feature (3160)..(3160): n is a, c, g, or t
aagtataacgtttatagaaatgttaagaatctaaaaaaattatatttattacatttaacaatcattttcgcaagatttttgatcattgctcaaaaaaaaatttgctgacgaattgtccactgacggattgtccattactgacggattgtccttcactgacggattgtccactgacggattgtccttcactgacggattgtccactgacggattgaccactgaaggatgcaccactgacggattgtccggaccaccaatgaacgcacctatggcccgtcccagtgttagcaagaatggatcaggaggcaaatccgccgctagaagcagcaatgccacaaatggcatcaccgacattcacggcaccgctctatcaatcccaaccaggggtgggcgaaacttcgagcttcgtgcttcgaaaacttcgcgtttttggggcttcgaacttcgagcttcggcttcgggtaacttacccgaagtttcgggaaaaacacacccctaaagatcgagtgaaaaatgttttaatgaaaattcaattaaaatttggtgcgtttcagagcactttttcaaaaaatattttatgaattaatgttgcaaaaaaatattggaaactcagaatttcgaacaaatttttacaatcaatatgcgttgaaatattttcaggataagttagttctgtaccggggagtatatctgtaaaatttagtgcgatttttctaattataaaaagagttaagttcgataaaaccgtaccagctgttttcgacagtgattggtttcggcagttctttttaattgattttctacttgatttattgtacatatgaattactattaatatacaatttgcatatacaaaatttagaattgagtaagtggtaataataaagattcgtatgattatttttattaaaaaatgaatcactttcattttttctatactaataactcctgctggactgtagtcaagaatacaacaaatttcttatatacgattctcgaatcgtgtgggaaaatatgctaacaaatgctggcgttgagtgccaagatgcaaatatctacaagctctttcttatagcagaattcgaaatcgcaaaccccgctgcaatgtaaagagcctgccctaatcattttaatttttcaaaatttatcgaaactttaccatatagagcaagtttttaaaaacaaactttactgtcgagatcaccactgtcgaaaactaacagcaccgatggaacgacaagttgtcgaccctacactggacaacactgaactggccgctctcaaccgctaaaattgctcaatttccagaaaaataattaaaattttgtaaaaaaaaagaaaaaaaaatgccaccatcgatagaacacgaaaaacaattttgaaagggtgggcacaaaataagaatcattttttattcgtaaaataattgaaggaaaaatggcgggaaaaaaaaatcttctactgttcttagaacaattcttctccaaattgtttcttccattttgaaatgctctttctatcaatttgtaatgtttttgcaattgcccgttcactcattttcggatttctctttttatttgccaataaattttcattttttccattttttccttctccgttattttactgcgaatgccaaattgtttcttccattttctaagtgtttcacggtttgttccaattttcttacaaatttcgtcataatttttctcccattcttttgttgaatattttcttttttgtttaaattcatttttcattacaatgaatttattgacaatttcaaatttttcttcatccgtttttgatttatagcttttctttatttgtttttgaaataagcaaaaaaaaatattcgccaaaagaatgggagaaaaattatgccgaaatttgtaagaaaatttgagttggctattatgacacaattaggaaatggaagaaacaatttggcattagcatagaaaaaagaactaagaaagaaaaaattgaaaaaatgaaaatttattggcaaataaaaatggaaaatccaaaaattagtgacaaagaaattgctgaaatgatacaatagaagttccaatacgaaacattcaaagatggaaagccaaatttggagaagcaaataatggaaaagaaattaaatccaaaaaatgagataaaaagaaagtgccaaaattcggaaaattgtatttatgagattttttcggtgaaatttggccaccaatcaaaaaaaatattttccatgaaatttagtgggttctaaagaaaaaaaaatatatgattctcaaatcatgaaccattatgcatgcattaagttcattaatattatgacaataaaattctgaaaaaatatttaggaatttaaaataatggaaaactcaaaatttcgaaaaaatttttaaaagcaataagcgttgaaagatttcaggttaagttagtcctgtttcaaactttcgatactttctttatcctcttttttgttttcatttcttctccattatttctctattttttctttatccgttattcttttttttttgctaatgccaaattggttttttcatttgttaattgtttcttgcaaattttggcataattttggtgccattcttttaacgaatattttttttctctttaagttcattggttttttcaatgaatttttgaataatttgacgtttttcttcatcagttgttgatttataacatttattttggttaagccccaattctttgatccatttaaaaattgtggttcgatttgtccccaatttcttcgctatttttgagttaatttttccccattcatcttttgaaaatgttcttcctttttgctttattttctcttttattttataaaattttgcaattatttctctttttttgagttgatttcgcctttcttcttccttttcttcccatttttctccaaatatttcgtcaaatgaattttgcttcaactttttcttttctgttaaaacataattaatatttattgcgacgatgaaaaataaaattaaagacaattttaggcctaatttcattttcttcaaaatatttttaaatgaattttttataaaaattttgttaatttatgcacaattttttatacatgannaaataataatcataatgaaaatattttattattaaaacaaactancaaacataaattaaacaaatattcatattaataaaaaaaa

SEQ ID NO: 6457 - DNA, 3219 bp, Heterodera glycines
gggattagaattctatcgatggaaataaaagaattgttgttgattaaaattttgtctctttgggtgggcaccgcaaatatcggcgccgcaagtgtcactttgaatgggcgccgcaagtgtcggcgccgcaaaaaaaatagccgcaaatgtcgggccgcaagtgtcagcgccgcaaaagtcggcgccgcaagtgtcactttgggtgggcgccgcaaatgtctgccccgcaaatgtcgcatcaccaattgaagcgagtcgtgcgggggagtcgttttgttgccgacattttagcgacagctcgagttgttgaattttttttttttgtttttacaaaaatccgacaatcgtggcatcattcgaaagctttacatttctaattccaacccgaattcgacgtattcgaacaattttttttttatccaaaatcagtttttctaccccaaattcgtgcttttttataactaaaaattgcgtcaacactgttttctgtttaaacattaaatatgctataaattgtctccggcaattttattttgcaaaaaaaaacgcaaaaaaattcctttaagtaaaaatttcaatttttcaaaatttctcctattttttttgttgtcataatcatcgtcttcgtcttctgctgcataggcaaatgtcgtcttcgcatggcggacaacagcacgggccacaacagaagtcacaaaaattgttgttgttgttgccgttgccgttgttgcgcattggcattcggcacggcgcctttttacggcacggcattgcacacatagccaccgggacgagttgcactttatggaaaatttataaaaatgtttccaaaaaatcgaatttaatttttatcataattatccgaaataggttggacgactaaatttacataaagccttattgattaaatcctatccaattcgaacactcggaaatcctggtccaattctaacttttttttttaattttgtggcaaattatgaaaaaaatagacgaaatttttgaaaatttcgaatccaacacctccataaggattctcttaaaatcataacattaatttttttattttgttgaaagcaaaaatttaagatgtcaaaaaaatattttaaatttactcggaggggccatggccggttgtggaggttgcaaaattcgtggtggtggtacctgaaaaagggatttaaaatttatttattatgaattaaatgtatattcctaatttttaaattaaaatattatttttttcatttattttagcctattatttgcatatgaatttgcccaaaaatttggcacaattggggccagtgagggtggcacgggttgcgcaaggttcatcatcggtggagcaaccgcgccagtcggcatcgcggcacctaacgacggcgcacaaagtgccgtcggcggtgagcacattggcattggcattggctgaacttagtgaggaaaattgaaaaaataattacatgaataaagtaatcagtaggaatgggaattttaggcgcaaaaattcgcaaaatagacattaaataggcacaaaaataggcaaataaattatttttcttagcactttttaggtagcaaaacatgtaaaaaaacataatcaaaaaatttaatctttgttatatcgcaattgtaactaaattataaaatattttaaaagattttctgtcgaataaggaaaatttagaaaacaaaaatttttattaagaaaaaaaatattttaagggattagtttttggaaatttttcaatttcttacgggctctatttttcgtttattgcatttttgttaaggatttattcgaaaatcctttaaacaggcacattaagcacaaaaaccccgaaaaggtaaaaatcggcattataaaagtcatcgtaaacccccaaatccaagcggaaaatgcgtttttcgtgcgaaggtcggaaatttgaaatttttgaaaaaattttcgaaattttaaaatattttaatatgctaaatttagataatataacttttgcaaatagataacaatttttcaaattatttattaccggaagtgacggcataactgctgccgggaggccaccaatcggtgtgccaaatgcgcctgcgggtcgaaattttatagaaattttaaataattttttttataatatttcaccctgaaaaccagcaaccggcatgttcagacagggcatgcccgggtaaatgcctcggcttaacaacaaaccgcacggtgcgggtgcaaacagaatgccaaatgcgaaattcaaatgccaaatgagaagcaataaatgggaaagtggcatttcgataattttatattgtttaattatggtctcgatttaattaaaacaccatttatctgcccattatatcatctaaattttgtacgaataataatttcttaattcatgtgttaaatttgtcaattttaattgaaaaaaataaattttattaattaataataatcaatttgtagtttattttgcgaataatttattgcccattatcaaaaaaaccgtagttttgaattaatttattccatttattttcagtgaattttttgatgcatttaattttattaaagattccatataattcaaattggaaggaaaattattattttttaaatttaaatatttttatcattattcttttttgtaaatataatttatatttttaaactcttaagcgagcaaatcatttgctaattttcattaattgatgctgttcaattagcggtgaatcattagacaataatgaagcgacgctaattggcgataatgatgcttcaggattcacatattcaaacaattttcaatgtccattcattttttcatttgaatacaaacaaataaaaaaagattggccatttgttttgtatacctatttttgggaatgcaaataaacatttatttgagcattttcttgaatgaatgaataaatggtcaatgcgatcgcgactgaattgagtgatcagttttggatgaacgtagacaaataattagtcaatttgtgttggggtaaaagaattttataaaaaattattttatttttaaaaaacttgtgaaatgatgcgtcatttatgaaattttgaatttgtaactttttattaaaatatttgcgtcgtattagaaaaaaaaaatcaaattttagtaaatcattttaattgtaatttattcattttcgatttgtagtatttgtacgtagataaaattgttaatttctatt

SEQ ID NO: 6458 - DNA, 1912 bp, Heterodera glycines
  misc_feature (1767)..(1767): n is a, c, g, or t
  misc_feature (1789)..(1789): n is a, c, g, or t
  misc_feature (1803)..(1804): n is a, c, g, or t
  misc_feature (1815)..(1815): n is a, c, g, or t
aaaactcaaaaagggtaattctttttttataaattcaaaaatcatttaagtgaaagtgtcatatttgtttttgcactactctttttaaaataatcaaaataggacggaaatttatttgtttttattttcagcatttgtatcttaacgaatgaatggggcaattagcaaatgccattcaacaagtgcgcacatttaaatgaactggaaaaaagtaatggcgtaagaaaggaagctgcaaaagaaagagcaaattgttatttgaaaatgataattttttattattattcaattatttaaaaaacaaaaaatatttaattattcataaaaattattttattatcttatttcgactaaagttttcattttatttaactgttaaatttatttatgaaaatttattttttaaatttatatttaatttatttaataaataaaattattaattcaaattaaaaattagaaagaaatttccttaaataaaattatttagttataatataaaaatgcatatgatttttcagtctccattaaacaattttttaaattggattttatggcaaaatgctaatttcaggcgtccacctaaaaaatatatgtgtaaaaaatgcagcaaaaaaaaaaaaacaaaaaaatgctgtttgtgacagctgacttaattaagaatgtctgctaaattcagattattcgtgcttttataaatataaacatttttcaaaaatacgattaacaattttcgaaatttgaagaatttttattagaatgatttctgacgaggaaaaagctcgtcttaaatttatgcatgttaattgaaatgataataaatgataattaggtttcctagcgaatctcagtgatgtggcaatgcttctaataacaaaagtacattatttgaaaactactttttttaaattttgtacttttcaaatctttttattttcgagtcgatattttaagaaagttttaggtttgcaaatttgtactttttcattgaattttggtaaaattatattaaatccaatgagtgaataagtatataaaaagattcaattagtaaaaatgaatcatttttatacctatgaaaagaaaaagaaatttacgtaattatttttgttcaatttattttgcttgttttatttatttttttaaattttgctttataaaatggataaaatattgatttatatgccgttttataagttaatactcacaattagttgaagaaaataaatttagcaaatatggaaaattgtgtcagaataatgagttaaaatatagagctttttaattaaaaattcatctaaacaaactgaaaatttattgaacgtcttctgtttacagaattaattaatagaaataaatggttaattattttcgtgaatgaattgattcttggaatttcaatagaatagattagtcaaacaaaaatttgtgccttagcaaaaagagccgtcattttaagaatgaaacaaaaggcattcaatttattcacgtaaagacagtgctaatgtgtaattattcagctaattatttccgatttattacaattgcgcatttaagaagcaattagcatctttgtaaataaatggggcaatgatgtgaagtgacgaagaatgatgccacataaaatacctagtgttagacaaaattgctcataacgcaaatagcgtaattggcgtaaattatttcgtgcgaattcaaatttacgctgagcactgccattttgattgtttattttgatcagtcataaccttcttcatttccaactanattgaataaaatttgtatctanaaattctttttgannaggagagtatntttctaagcgaatggtaagtaatttgactcgtttcaatcactcaaatttttttgaatgaaaagtgaaaaaatatttataaagtgaggtgaaaatttg

SEQ ID NO: 6459 - DNA, 1687 bp, Heterodera glycines
atcgaagaaaaacaaaaatttccgaaattcataaattttttttgtgaaaaatcttagaaaatagagcttaattccaaaatttagcgctgcctatcggcatcacagggcccaaaaagtcataaaccttattaaaaaattggcgcaaaatcgcaaaaatttagcatattttggacaaaatctgctaacagatctaaccaaattttcaaaattttcccggcggcgcctatcggcaccgccggacgccgtaccctttctccttaagcgccgccgcagctcgtcgaatatatggacttaaaaataatgaaaatgaaatgatttaaacaactaaatttttgatgaaatttctcactcaccatcgtcgagaccgaagccaccggcgccttttgatgtcgatggtgtcgtcatcagctcacaacgtgccgtggatgttgacggcattggttcggcttgttggtcgtcgtcggcaggagttgaagggaatggcacatcaatttccaacatctccaccgacggcacgtccatttcctgcgatgtcatcggtgttggagttgatggtggtcgtccgtcgttgtcccgcgccggtgcctctgatgtgacggctcttcttcggatggttgtggcgtttctgcatcagtgttcggctggggagcggctaaaaatttggaaacttaggattttatgaaaaatgaatggaaaaactcacttttcttggcccatcgggcttgtctcgccctctccgtcttctcgcgtctctcctcccgtttttgttcacgcttttgcgttgaatttcgtgcattaattttgcttaataactttctcttaggcatctaaatttagaaaaataaattattacttgtttttggcttataattttagatctgagcgtaaaaaaaataattcgagcgttaaaaatgttcgtaatttttttctctatcgctatgcaaaatttggtgcggatttaacatagagaaaaaaagctagacatagaaaagtaaatgttgtttttacaccattaaaattgaagagatagtacgccaaagtgagagaaattacaaagaaaaagagtaacgacgagatagtactaggcttttctctgcacagtggagttgacccatagtgcaagaatttatgttgaaaatttgaagattaatttaaatatatggaatagtccaataaaaaataataatttaaattacgcgagccctttggacattaagaaattcgttcaaaacatgtccaccgatgagagaaaaaatttcacatttttgatgaaaacccaaatccatggggaacaattcttatccacctgccccctgtttgaaaatagtttttttggaaaaaaaacttgctgctaaaaaacatttttattggtttttttcatttgaaataaaatttttctaaatgctggcttttgacccctaatgattattttttaggccaatactgattttgaaaattttcagttgatgtccctgattttgaaatggtaaaaaaatttttttttaaaggttttaaaattttctgacttttttatcaaaaatttccgaaatgggaattgttcggggaaatcggaattccgaccctaaaaatatccgaaaccggaagtcggattccgtagcgtcactaatcactagtactcgctactctttcggcaccggcatgatcaagacactaatacccgcagaaa

SEQ ID NO: 6460 - DNA, 1966 bp, Heterodera glycines
tgcaactgcacaccgccgcaagtgatcagctggtttcgttgcgcgaactgttcaagccattgccaaccgtatttgtccacaatctttttgaatggaatttgatatacggtagcaataatacatgtagcattacttataagttaaattgatttaatttagggttttaagccatttagggtaatttccatttagggtaatttgttaataggcgaatttaacgaccgatgctcctcctacctgtttgtaaatgaacaaaactgcgtcatcatggtttgggtcagcagtaccaacagtgccattagcgaattctgctgactgcaataaatcaccgtaggtcggcggattggtcgaatttgagaccaaatttttgttgatactaatgcctagtgtcatcaccttcaaatgaatttgaattaattattcctttttaattataattattaaagctggaattgtatgaaaaagaaatctcaaaatacaaattttttataatatttttttcacaaaaaatctttgaaaagaatgaataagaccaaaatgccataaaaatgaacttattaggcctagaataatgttttaatactttaatttaatttttgataacaaggtgacatttaaaaaaatattttttgaattttttatttaaaaaatatgttaaaaagtgggaaatatttaaaaatatgtaaataaaagaaccattcacaaacacctattcagagcacttagaaatcagaaaatataatatcttaatttacaaccctaataattatttttcacaaaaagtttgttaaaaaaagcaaaattaatagtttttttaaaaagttttaattggcttttacaaaaaattttagattattaaaaataatatttttaaaaattttattttacaatatttttcagaaaaaataattttaaatttagaatatattttaaaaaggtgatgttctcaggctgttttttaataaaatatttgacttttttaaaaactgttatttcacaaaataaatttttacttttttttaattttttattaaaatgaaattttaacgtttgaaaattaaggaaattattttttcaaaacgatttttaggacaactttacagcacacatacgtataatccggtgaagtagccatccgggtcgcggaatgcgcggtacactttgtcccatccgcgcggtttgtatgccaacaattttccgagccgtttccatcgcgcaaattcttgcaatgtttgcaacgacacaatgtccggcacaacaccgcccggcgtgaccatttgcaggttcacgcgtggcgcatggttaacggagtaatccacgggaatgtccaaggtcatgttcggaaagcgttgctcaaacatttgcttaacgctgtcctggaaatcacaaattttggctttctgacaaactgttttcgagatttcgctcgcatttttaataactgttctgttgggctcgggctctcaaatatctcaaaaagtctcggactcaatttcagtcttgaggtcaattatgtctagggatgtcaaaaatatgtacaaaaagtggtcaaaatatgtacataaatatgtaaaaaaattccggaaatatgtaagaaatatatataaaaaccttaaaatatgtacgaaaatataaataaaaaattttttaaacagttattttttttgaaaaaaatattggtaaagtgttaaatcagggatgcgatcgaaaatttttcaaaatcagaacatcgagcccaaaaaatcagattttgggtcgaaaatcaggacattttgcttcattgcttcaaaacagttatttttacaatttattcaatcaaaaatgtattaaatattatattttcacctcccattaacgattttaacaattttggggaggaaattagcaaatcgtaaattttaatgcaattttttagcggcgtaattttcccaaaaaacttctgaggaatgggcgaggggagagggtc

SEQ ID NO: 6461 - DNA, 2027 bp, Heterodera glycines
ccatttttggtgataaccccgaccccgaaccccgacgcttcataccccgacaaccccgaaccccgacccttaaccccgatcggggtcggggttaaatatacacccctaagaatggcattttcgtgggagaaaatgcaaaaaagttagacgaaatttgaatttttttaaccatttgccaaatttttattaaataaagaagatttgctcaatttcggacatttggaatgtggtgtagaggttagtgccattgacattactttctgtcgtgagttcgataccgtttgacgttttcttctttaattattttctttgtgacaaattgttttttttaaattaaatactcatagaaatcgaccaatcttggcatattttgacaaaatacatatcgaagaaaaacaaaaatttccgaaattcataaatttttttggtgaaaaatcttagaaaatagagcttaattccaaaatttagcgctgcctatcggcatcacagggcccaaaaagtcataaaccttattaaaaaattggcgcaaaatcgcaaaaatttagcatattttggacaaaatctgctaacagatctaaccaaattttcaaaattttcccggcggcgcctatcggcaccgccggacgccgtaccctttctccttaagtctttagaaaagagcgacgtgaaaaaagatgttttggaaaacaaaaaagtaataaaaaattttaaaatttcaagaaaaaaaaaattaattctatacaaaatttctgataaaaaagaaataaaaaaatataaaaacaatacaaatattattatggaaattaataaatattatttccgaaaaaatattaaaaaaattttgactattaggcataagataaaaattgaaaaaccccgaaccccgaacgatttggcaaccccgaccccgacgcttccaaccccgacaaccccgaaccccgaattttccaaccccgacgtcggggacgcaaccctaatttagaacatggagaagccaggaaaaaaaatgtatttacataaaattgacatccctaattatgtcactaatctcggactcagtttcagcatgagtctcggaaaaagttctcgccattggatcacttgttggcgtggtgcttcaccgccggcgtacaccaccaatttgccaccctcggccaacgccgccgcgtacaattggtccaagcttctgttctccacatcaacattgccatgtttatgcggcttcttctgttgctgcttcttgtcccgttggccaatggcataatgcaatttgcttttgaataattcgtcaaaatcaaaattttcgtcggaatcaaaaaaatcgtcaaaaaagccgaggtgagccgcagcaaattgaccacataataatgttgttatcagtaaaaagcagacgatggaaaatgatttcatttttctgtgaatttttttttcatttttaaagtttttattttaaaatgcaaattaaataaataataattagtcgagatagaatcattattagtgaaatgggggcggggctttggtcaaaaatatttatgaaattgaaagaaataaaaatttttgaataaaaataatttcttttttaaatatttcttcataacaatataattacttactatttctccattttcgattttttgcttaaaacttgtcgaaataaacaaaaatggttaatttctgtgctgttatcaaatcctacaaaatttcaacaaaaaaaaaaaattaacgaggcggcgcttgacggcaccgccggcctcccctcgtttaataaaaaaaagactaatttaaaaaaaattggattttttaatacccggttggacccagatgcttggacccggacccgtacccggctttttgggtccggaaatacccgtgcccgttcaaagcaattaaacgatgatgcgaatgcatcaacaacataaattgcccactacaaacactcaatattaatctatgtatgcagttgatgttaaattgttaatccgatttaatccccagcccatttcatgattggaaaggacccagcc

SEQ ID NO: 6462 - DNA, 7187 bp, Heterodera glycines
  misc_feature (62)..(62): n is a, c, g, or t
  misc_feature (5136)..(5136): n is a, c, g, or t
  misc_feature (5154)..(5154): n is a, c, g, or t
  misc_feature (7170)..(7170): n is a, c, g, or t
tcaaaaattaaaattaaataaaagtttttaaaaatttcatttaaacttcaatattttaagtnatccaatattttttgccctaaaacaaccaaccacatggggaaaattgaacccgagagatcaaaagcttttgaagtcactaattaattaatcccttacagatggattagcatttggagtaacgttcatttaatgtgttaaggaattagtaattaattaaattaatttctgcggattttctgaaatgaactgaaaagaaagcgcaattgaatgacaaaagctttatcaatcaaataggaaaatatgtccatttggtaaattaaggcatgacggtccaaaacttaacaaaacaaatggcatttacttgttttaaatgcaattagcaatcagagcacccaaattaggggcaaaataacgtattcggtggggttttatggacgacatttgaaaacgggtaaaatacggaagtgttggcattaatggccaagaaaaagaagaaaacgaatttaaaaaaatgaaggaaaagaatttccctcaataaaaaattgcaaaaatatttaataaaaaaagaaaatgatttaaaaaagcgcccgatgaaatttacttagtaaaagaacaaataaatatatcgacaaaaagataaatattaaaaacagaattcaaagtggattattattttgtgtcaaaaatcgctttatatagagaaatttttatgagcaatttgactttttgtgtactgaaaattcaatgaagcagatacaaaaaaaaaaatgaaacaatctatgagactttaattaaacagatgaaataacttttggtaattaaaagaaaaattggaggaaaaagggcggccgacaatgtcaaataaatgaaacagacattggacaatttatttgtatgcaaaatacaacaaattttaagatttgattgaagccacacacagattaaacacgcggcatatgcccttcttttggtatttttattttttgaataaataaacaataatttgcattaatttacaaagcgtaaaaagaatatttagaaaaaactaattatcggtacgaaaaattagttaccccacatttgagccaaggaaatttgcgccaagtccaaaatcgggttaaaacttacatttttcaatcccggatgactaaacagtcttaaataaacgatagaaagtgattctatgcaataatatgatcattctcaaatttgaaaaaataattaatctttcaaacaacagaattatcgtttctattaaaccaaaagaacaaattcaaaatttaatgctgttttataactctaagattgaaaaacctaaatttaaatccgatctttgacataggtgcaaatgtctggacacgcaaaaaattaaaatgatatttattcgaaggctcaaagttaagaatggagtcatattttttttatcattgtttagctcctaaaaatgatcgtattttcatcattgcctccgtgaaggattcacaaaacgaaaaacgttaccaactgagccacgaaaaggcacaaataaaaaaaagaataaaatgtaaaataaatgttttatttttttatagtaaaatccccggaattcgtgcgtattcgcacggggaccgttccgtgccgtattatttgtttttgaacagagtcgggggaccgtttcagcgacgccattttggcaaagtaagttttaatccgattttggacataggcgcaaatgttcggggcgcaaatgtctggacacggaaaaaatggtacaaagaaatgggaaaacgctatttcaacggttctattaaattatctttctttttttcaatattttgtgctaaatagtttctcaaaatataatagtgattctcattcattcgttcattcatttacacttaaattggacccaattcccttctcatttggccaattcttttacttgcacaaaaatcctgtgttttgccgggatggattggtcccggaatcccgacttcttcgtgcccaaactcgttttagttgtccaatcgatctgtttgcgcttcatgccaatcgttttccccattttacggccgatgagtcatcactagggccgggatttctagtgaaaaaactttttttttttgcttaattgttttgaagaaaggagctcaaaaaacgcatttctgcgttaaaattttttcatttggacgttatttttcgtcactagaaatccctattttggcgacttcgtcactaaaatagttaaaaatcactattttggcgttttgtcactattttttcacaatttcgacattttttggaaaattccttaacaaaaacgcaataaaaccaaaaaatacacccctaagaatcgacctaaaattttttttcaaaaaatacacccctaagaatcgacataaaaattttcaaaaatcactcctaagaaatgaaaaaaattttctcaaaaagctattttcgtggcaagaattttaatttaaaaaattattttttaggtacctattttgtttttttgcccttaaaaatcccagccctactcatttgcaatgcaatcagtgaataaaaattagttttgctcaatttttggctgaaaattatgtcactattcgtcactattttggactttttggcactatttcgtcactattttggcattgttactcactattttagttaactataaaaatatttatagaaaatttttaataacaaaaaatagttaactaataaaagcaatctctttctttattacatgacgtaaagttatttaatatttttgaaaattaacttatgcatttaaatgtgagaagttttgccttataatttttggtcataatattttcttatagcagagctaattaaatccaaatgagttctctagaaaaatcttatttaaaaatacttattaaacgagatgaaatggcaaagagtcctaaaagagaccgaacaaacccgggaattttgttgacgcatttataaattgcgccaaatgatcagaaaataaaaaaataaaataaataaattcacaattataattttaataaaactcatcaaattttaaaaattataaaaataaatgttgaaaatgaaaattactttggccagactttgagaacactttgagttaccgaaagatattaagaacataaattttgatgctttttaggtaaagttatgaatttatttatattttttgtagttttttgatcataaagagaattataaaacgcattagcacctccgagatcgagtctcgaacattttttaaaaaacataaaaagtgtcagccaaagaataggcataaaagtgacaaattaatttaaaaaattagcaaaaaatagaaacagaaaatatagaactttaaattcctcaattgtgaaagcgtattccctggagtttaaacgtcgttaatctcggatatggccttcatttttgccaattcgaattcccgatcccgaatttcgacataaagccgaacttcaattcttttttcatgtttttttatatagaagtcagatttgagatcagagactccaaaaacccctgggaacaagtttttaagagttattatcacaaaaaaattgcaaacttaaggatactaatgataatactaattacaatactaatgataatactaattacatacaatactaattataattccctctcattttctttgctttaccctcaacgctcacaacactttggaacatttccgcttgtgaatcactcattggccatatgctttttgcggccaattgtcgtgaatatgcgtggaatttgcacagattgacggagcattggacggactcggcaaaaggcgcggcacaaaacgatgggaaagaggaggactaaaaagtatcacttttgaaatttaaacagcaatattttttaccaaatcttgttgtggctttggtgccgtttctggcggcatctttggcatttgctttgtccattgcggcaaacattcatacgccgattgccattcatctccactgcttgatgtcattggtgggggcagaaaatgggtggactgttcttgttgttgttttggcaatttgtcaaaaatgggcatctaaaagccgaaaaaaaagataggggtaattaaggatatttgaaatgtgcgaaaagattaggggtaattagggtaattaaaattttattaattgaaaataaattatttaattagtcctccccaactttccccttgtgaactgactctgtgctgcgacgtcgtcatggacactgacatttcctccttcggcggtgccattgcccagggctttgtgccgtcgtacgtcgcctgtggaggcacacttttctgccgcggctgcggtgccatcgtcgcaccgctgcctccgcttatgctgtcggtgatgaacgggccgaacaccgggaacggactgaagccgcgcgagttggcgctgcggtcgtaccgacgctctaccgtgtccgccagctgatgaacactttggacgagttggggcggaaagcggtccaacaccaactcgtgcggcatctgttgctgcgcctgcaacaggcggaggcgttccaacggaggcatcgacgagtgttgcctgaagcaaagtgccaattgcacgcagtctcgatttcgcgaagcgactcgtgcgatttcttttccaaatattaaattttttcccgacagtgccagcgaatcaccgatttttatttcctaaaagttgactcgctcgaatatcttaaaattagcatttttggcaaaatctattaataaatccttcaaaaaccactcggggacccttcccttactgtgccgggctctgttttttgcttactgatattcgctttgcataactctgaaggggagggcattaaacaaagaaagaaccacgtgacacaaatgaggtaaaaacgcatcattattaaaataaaaatgttattaattcgaaggctcaaaatcccaaatcgtacaattaaaagttgtcattgttcagctaaactaaacgcctttgctttttcatcattgccttcgcgaaggattcacaaaacgcaaagcgttaccaactgagtcacgaaagggcacaaagacaaaaagaataaaatgcaaaataaatgttttatttattgtcaaatccccggaattcctgcgtatccgcgtggaattcactttgtctntatatcaaaatattaatncttaaatttcttacaaaatataaaaaattattttcttaaaatttaaaaattttaaattaacaaaatttcattattattttttattaaattattaatattatttaatttaccaaaatttaaaaaaaaatttttaaagttttcaaaaattttcaagaattttcttgaaatgaggggggggggggggtggctgttttaagaaacgcactagcacctctatgatttacgaattttgcaaatttttaattcctcacttttgccccacaattcctctctttctctgctgtctctcttccccaagcacatatttttggtaccgtaagggaaattctttgaaaataaataacataaaaaaacagtcagaccaaattaaataattaatttgataattcaatggcagaaaaaaatgttatccgaaggctcagctatgttatgaaattattgtcattgtttagctcctaaaaacatgcagatattttcatcattgccttcgcgaaggattcaaaatgcaaagcgttaccaactgagccacgaaaaggcacgaagacaaaaagcataaaatgcagatgcagaataaatgttttattttttcgtcaaatccccggaattcgtgcgtatgccgtattatttgcttttgatccgagtcgggggaccgtttcagcgacgccgttttggcgtcaagtatgtattacatccaagtcacaacaattagtgatgcttcaaagtgtatgctgacatttgcgctgggggcatttgcgcctatgtccaaaatcggatttaaatttgagtttttttcaatccgagaggtaaagaaaatactaaagttaaaaaagatggtcttctagtttattaggagcattaattctgctgtttgaatttaattgataatgattttttcaaaaattgacatgaaaagaataattatataatttgcttaatatgtgtataattatattttcttgcaaaatatttcgtaaaaacaatactttcacactgctcgctaacctttcaaaatatgataattaaattagtaaacaaaaataacatttaaaaagttggaaccatctaattgttctcccaaaaacacatagcttaactttttgaagaaatattctcggttggctaatattctctaattaaaaaatcactctttttgcatttattattagctataattttttaattcttttaattcttttaattttacttaatttattaattttgtattttacatgtttcttttgcatgtcacatacaatttaagacgaagaagcgaaaatggccatttttgtgaaatgccaacaaaaattaaattggacaaatttaaactaattaatattattttaaaatgaatttatctgacaatctttcggcaagtcgaaaattaaattaaataataattttaaaaattaaattgtctgtttttagttctatgattctttcaaagatgctgatttccccgccagttttatcgcaatttgcgctgcccgagctctgatttcattttttggagtgattttgaatgggatattgcttttcgtcactcttcggagcaagtgaaactttgattggatatttaaatatttatttattatttttaaaagaaactttatttatttaaaaggacaaattaacttcttgttttaatattttataatttttgcaaaaaattactgatcatcaaattatcagacacaacacttattaaatgctgtttaggctatcagggattaattggaaaaacttaagtttcagcccgattttggacataggcgcaaatgtaaccaatttattattaaatatcattttcattatttatttgatgaattttctcttttccccctttgggcgtcttcggtgccgttgcaatgctttgttggcatttgactccgtctgttccgccttggccatgtgcactaacttcgtcacattttgccgtggttttcttcgggccaatgtttatcgaactccgccactgcttttggctacaatttgtgccgacattttttcgtcattttngctgttaatgcatgctt

SEQ ID NO: 6463 - DNA, 1375 bp, Heterodera glycines
  misc_feature (72)..(72): n is a, c, g, or t
acatggcaaaatgtaaaaaataataaatgaattcttcaaattttggcaaaatgtttttaaaacaatataatntagaccaaattgactacactaagcgcattttcaaggcattgctggtcaatgtgctttttgtgtccaccggttactttctgaacgccggctttttaattttactccgaaaactttcgctgagccaagtccaaattgtgtttggcacttacatcctcggcattttcacctgcatttcggcaattagcaacccattaacactttatctcttcaggtggtgggcaattcgaccttttaatttgcagaaacaattgaaattcagttcggattatcgaactgcgttcaacaaacatctttttggacgataagcattcattttatacgagagattctgatgcgatttgtggtggaaatgtcatggcgaaacgacaaattgaccagcgaaatggcagagttggaaatgttcggttggcatgaacaaaataagaaaaaacctcattttttaaaacattttcaaccatttttttgtgaatttgttaattcttgacagaagagattactgaaaaagcaaagaaaatgtgaaattctgaattcacaattattaccaaaagattaaaaacaatttattcatttatcaggtataattgtaaaaatttttgtcaggcgcattgttttttctttttcaaaatgcattggtaactcaaaatttaatccgatttttcgtccgtcactttgcccaaaaattttacacacacttcgcgtcgcgtgggaaatttctgcgggcgttggcccacgtttttgagttggtcaccagcgggaggagaagcagcggcagcagcagcttcagcgggggttgtcagcagccaattcacttggacatcgacgggagggaagtcgcgcagaatgaaaaccttccaagaaaccaattaaaggtaattatagaattagttaattaattgaaataagcgaaccgaccgattgccggtaccaatacgtttggcctggctcaagtgggcaagtgatattactgtcgacacacgcattttctgacaatgagggtgattagttaatgatcagccaatttgctaaattaacaaattgtcaccgttttccatatggaatttggtcagtgcgccgtgcgcatcgcccaaatgcgaccaaaccgccgtttgcaattgatcgacacggcgatctaaaaataccattcgaaaataattaaaaaaagaccaaaaaataatttaaaaaatatttctaaatcttattctaagcctaataagttatttttgtggcattttttcttattcactcttttctaagatttttaaccaaaaaaccataatagaaagttttatttataaattttggt

SEQ ID NO: 6464 - DNA, 3820 bp, Heterodera glycines
attattaaaagtttggaactaatatgtgaattattttacttattttaatttgaaagttaaaaaattatagatacctaatactgaatataaatttaaatatgcattttttaaatattttatctgtttaaaatgaaatcaattgacaaattaacttacttctgaaaagtaaaaacatatattaaattttggtaaattatcgaaaaattttctttttttggtccaaatagtaattatcaaataaaaacgaaatcatacaaaatgaatgttcattactttaataaaaagaaaatatataaaatttacaatttaaatatttaaaaataatgttgaaaacaattaatgaatcaaacttgctttaaagactattcagaagacaaataaaggatgttgaagaattaagcactgaacaagattaattttttataattaatgaaaatgccaaagaaataatacgaaaataataaaaaaatcttattcaaaacgaatcaaaaaagttgctgtttaataaataattaataggttttaatttaataattaaatttaagccattggactacatcccaacaaaggaaaattggagattaatttttaaaacacagacaaaattgtgttttacagttaacaaaagctacaaaaaagtaattaaaatcaaattttctaatttaaataatagtaaggttagttaaaaataaaattatttactcagaattgtcataaactaacaatattaataagaaaaactataaaaagtcgagaccatttttgaatgccaaccagtttcttcaacaagattaaaaaaagaacctttaattgtacttataaaaaactttatataatacaaataaatcgactaaaaattacattgtttattatctaaaaggtcaaattccaaattccaaaatcaaaattaatttaaatattaatgttaattttttacttttaaaacaaaaaataataactcgcttattataattatacaaaaacacattccatacaaaaaaaaaaatgattagaaatttccatataaacattttacgaaaaaggtaaccttcaataataataataaatatttttgtgcctaaattgcgattaaattttttactaggcaatatcagggtgctgacaaatgatcacaaatatcaatctttttaaacggagacaaattgatagtcattttctttttttaaagaaaataaatttactattgttgcaaaatactatctatctaaaaatgttctcgaacagaaatttaaatatcaaaatatatagatgattctttatattaacaaatatgacaacatttgaaatacaataaaatttaaataagaaaactaacttattgaaaaaaacattgcaaattaaaggaaataacttttttaaaataatataaagtgaaataatataattacataaataataactttatattatgaaagtaatcattattagagaccggacgagcccggggggccgcccgggcccgggcccggtaaattttcaaaaaaaccgggctcgggccgcccggtaaaacgggcttttaaaaaaacctctattagaacggcccccagcagctaaattagcctttttgagcccaaaacccgaaaaatttttcaaaaaaatttatgtccatattttgacatttttgccatttatgtccatatttcgcgatttttgccatttatgtccatattttgcgatttttggtccatattttatggccatatttcgcgatttatatccatataattacactccctaatcatgataatttaatatattttagaaatcgagcttaaatttcaaaattcgccaggcggcctatcggcaccgccggcccccccaaaaacctatttttttttaaaaaattagccaaaaatctctaaaatttggtaattctttagacaaaatctgtgtaatttatgccaaaaggtattgaattgaggcgatacattgactaaagtaatgtggagccatcacatcattcataaaaaattaattttttgtaaaattcaaagagtacgaccagtaacacaaagaaaatttcaaaaattcaaaatgtgacattttacattatgtgtcacactctacctttaatatgatttcccaaaaaatttattcaattcggttaaatattttaaaatttacggtatttttaatatcctctacagattcatgagaatttttgcaagttaacatttgatttctatatttgcgtttttgaaattgtttattttattggaattttttacatataataatgtttgatatgaaatcatttaaatatttttctatttttatttgctactaggtggaagaaaagtttcgctgattaaatattttaaaattaaataaataactttggagtgaaatttattttcatttaaatgtctaaagatttttatatattgtttaaaactcgtcgccaccatcggatgcaatgatgggtgcagcgagatcggctgcctcggcaatttatgttggattttgagtattattaatgtcttttaaagtttttttcttttatctgcaatatggatttaatttttatctacaaattatttttatttgttttgattttgttttttactgaaaataaaatgttttcaatgtgatttattttatatttaaaaacatttaatgtgctggtgaaaatgataagcattttggggtcaaattaccatataactcacatgattttccataaaatgaattagttttaaatatatatttttattataattatttaatcaacttcattattaatttttttataattaatattaatggtcagtttttattatttaagataattaaattggctaattacttttatctaaatttataatattttttaaggtctataacctttaattttattatcatatcctaatatacttaattacatttagtcatatgttttgctaaaaagtattttataagttcccataagttgacatttaattagatttttctttttctatgtttaattttttatttgtttatcgagtaaccgacaacgccaatacgttgtattcacggtcttctttgatctataatattcttttctttttaatattataattattcctatcaattaaagatgtttgttttcaattctcttgccaaaaaagctatgtttattcaaaaaatataatttttttaccaaaattagtgatttttttttttgatttatatttatgcattaactatttgtgagttggcgtgaaaccttttttgtttctaattatttttatatttatatttttacgattaattagtttaatgatttaccaaaattcacatctcattaaaaaaattttaatatgatttcaattaaatatatacgaatgttaaccaaaatctaaataattctataactcatttttaattctacaaagttaaaagcaattaaattaaactgtatgtgcctgatgcactgttattaattatccgcttaaaaatgttcaaaaatatagtcaaaacataaattatacaatttaaaatatataaagttaatattatcaaaaataaaatattacaatccataaaattattttaagaaggcattttaataattattgtgcattttactgtcggattgtccactgtccgatagtccacctctgtcggattgtccaatgtccgatcgtccacctctgtcggattgtccagtcacgccatgactgtaccttttatgatgcaaaaaatttggtttttttctattttttttaatttataataaatccttttcagaattgagtgctgatttttttaaaaattgaaaatcataaagttctctagcgatttgcttttgaatgat

SEQ ID NO: 6465 - DNA, 2018 bp, Heterodera glycines
  misc_feature (1812)..(1812): n is a, c, g, or t
  misc_feature (1864)..(1864): n is a, c, g, or t
  misc_feature (1872)..(1872): n is a, c, g, or t
  misc_feature (1901)..(1902): n is a, c, g, or t
  misc_feature (1912)..(1912): n is a, c, g, or t
  misc_feature (1928)..(1929): n is a, c, g, or t
  misc_feature (1980)..(1980): n is a, c, g, or t
gagcactttgatttcggtgtcttcaaaaatttctgtatttcctaaggaaatagtgcattatacactagaacgatcagcatcaaaattgaagtgcccatgcctcagtgggttgaagtcgtagacccatcatccaaaaccaaatcggtagagaattcaaggcactttctaatcggtacacttaaaatttccagaaaaattttccaatcccctaggaattttttttcggaaattttcccgatttcactgtatattggggtgtcccgatcacatgaaggagtgtacggaataagttactgtaaaagacttttttgatcagcacccaaagttaccttagtatgaattttttctgaattttaggcctgcagaatattgagatttaaaaaaaataaaatcttatgctaaatatatgaccatgactgtaatttaatgctaaaagattaaatgggaaaattaaaaccttggatattttaaaaatattaattaagacaatgaaaagaccaaataaatcctgataaaatgattagccttttagtttattaaacttccaagaagaaaacataaattataactagtaatttctatagaatttcttaatgtacattttttaatttaagatttgagcatcatttcaatagtttatctcgagacgcgtggtcggtccttgaaaagctgaaggcactcccccagcatgaaacaataatttcaaaattaagaaaatttattttttttaaatatactgaagaatagaaatttactaacctattgcacaagagttcaattgggcaagttggaaataataaaaattatgcaataaaaaattataaaactgactgtttataataattttggcaaatctaagaaattaatttaaaattattaaaataaaaactggattaagaaaatccaaaagaaatccctttgtcgacaaatgaaacaaaatcatttatattaagtaaaattcaaagtaattcttaattattaatgaaatatctattccaagtaattcttaatttgtaaaaataagtttactaattttttgataaagttgataaacagaacaaagcgaaaacggagaaggagcaatgagagggacacgaaaatcggcagacggagacggacttttccaatagacgtgaaaagaattttttccaatttccatcgttttatattttccatattcaattggtaaaaaatttgtacattaaaaacccaaattaataataaaaacaattaaaaaacaagtcactccaataatgaatacttaaaaaatacccctttatattttaatgtttttaataaattctttttataactgtagattacaaaaagaaaaaaaaacttccctagaaaaacatttggattaccaattaaaaaacccagatcaattaaaagtaaaacgaaaaaaaaaattcttataaaatcacaattggtactttaagaataaagaaatcgggttgagcttgctaatttccaaaactttcaaattttgctacgcgtcatattatatattagaatcaatcatgaaacggtgattatcatataaataaataatttttttatgaatatttgatgacagacaatataatttgttttgaaattataaattatacgaaaacaatttatacaaataatgatattgaacaatattttatttttattaaataaaaaagaatggaattgagaaataattaaattaacttcaataaaatatactaaaggatttaaataatccttgtcgacctttatatgttaataaatctaataaaaattaattgaaaatagggtttaaaaaaattttgtttgcttattttnaaacgtcataaatgtaattaaaataataaatggcctaagaaattttgcctanacagtgtngaagcaagattttattagaaatagcaccnnaagaatatcnaacatcctacagaaanntttaatttcaaaacaaacaaaactaaatatataaataataattttcatcangtattaaaaataaaaaattattaattacggattttatt

SEQ ID NO: 6466 - DNA, 3237 bp, Heterodera glycines
  misc_feature (20)..(20): n is a, c, g, or t
gataaagttgataaccagancaaagcgaaaacggagaaggagcaatgagagggacacgaaaatcggcagacggagacggacttttccaatagacgtgaaaagaattttttccaatttccatcgttttatattttccatattcaattggtaaaaaatttgtacattaaaaacccaaattaataataaaaacaattaaaaaacaagtcactccaataatgaatacttaaaaaatacccctttatattttaatgtttttaataaattctttttataactgtagattacaaaaagaaaaaaaacttccctagaaaaacatttggattaccaattaaaaaacccagatcaattaaaagtaaaacgaaaaaaaaaattcttataaaatcacaattggtactttaagaataaagaaatcgggttgagcttgctaatttccaaaactttcaaattttgctacgcgtcatattatatattagaatcaatcatgaaacggtgattatcatataaataaataatttttttatgaatatagcattataagcaacagtaaaagagaaaaatttactaaaattagaacgaaataaaaaatatattaaccaaaattttaattgctgttgtacgatgtacacttaattttaaattgatgacagacaatataatttgttttgaaattataaattatacgaaaacaatttatacaaataatgatattgaacaatattttatttttattaaataaaaaagaatggaattgagaaataattaaattaacttcaataaaatatactaaaggatttaaataatccttgtcgacctttatatgttaataaatctaataaaaattaattgaaaatagggtttaaaaaaattttgtttgcttattttaaaacgtcataaatgtaattaaaataataaatggcctaagaaattttgcctaaacagtgtgaaagcaagattttattagaatagccaccaaagaaatatcaaacatcctacagaaattttaaattttcaaaacaaaacaaaactaaaatatataaataataattttcatcagttattaaaaataaaaaattattaattacggattttatttaattgaatattatagatttaataaaattatcatgcctgaaacaaatattcaaaaaagtaagcagttaaactaataaaacataattacagatacttttataataatttaattacaacaataaatatgggcatatttgaatgcaaaaattttaattgaaaataaacgcgattaaatattgttacaaagtaattatttttaaattatgctgaaaaacgcttaattgattaaaaaattaattaactcaaatttgtttgcgagccgtgtaaaaacggaacggataagataacattttaaaatttaaattggaatcaaatgggtgcctcgaatgctgaatgacaagtatcattgacgcacaaaggaggagcattgattgctgattacgtggagcccatgttcggaaaattgtggtattagtgactctttgaccctttatttgattgtttgaatttgtttggcataatgtttatttgaattcgacccaaatattttggttttcttcaagagtagttagtggatttttttggttatcgtcggtgataatttttagccgttttgttggtcgtcgatttatttgtgtttttattaatttgttgttgattgaattttatttattttggattgtcttttaattatttgttgcataaatttattttgtttggtattggatttttaaagcaggttttggccaattcatagactatttgtgcaaaatttagaagcgtggcaaagaaacccccgacaaattgattcttcttttccaacatggcgctcctggtaacaaaggttagctaggtggcggacggcttggtttttcttcagtgatatttcttatattttttttaaaagcaactaatttggaaaaaccctcgtgttgggttcatcgactgctcgtcaaatttttaataccctcgtgttgggtttatcgactgttcttcaaatttttaataccctcgtgttgggtttgtttttcttcatccgccttatttggtccacttttacaacttatcgtcgaaagcactcgtgttgtgctacaccaattaaattttgtaaaagctcgtgttgctttaaattggatttttgttttatctcgtgttgataaaacaaaattatgccgacttcatcttcaccaacaaatttgcatccattgctttacggttcgtatgagaggctcaaaaaacatgcctgcgacattgacaaacgattgctttattcacttcgccgtctcgacaattttacgcggctcaactttttggtggaagtcgaatggaaaggaaaaacaaaaatgcaggaagggaaagaagaggatgcatacatcctgtacagccgagccatgaccatttatcttatgataagtgagtcaattgacgacgaattcaaacaaagccgcggaggtcatcttttctatgaaacttcacagcgtttgtgtggattttgacaaagttgctgtgagtttacaacagcggttcaaggatgggaaaggcgagttgcctaaattttgtgatccgttgggactgcgttgggccgaaattgttgaagaaccgatttccgaaaatttggaatgtggtaaggactccaattcgtcggatgcccagaacaaaattctgtccattttgccggcaaatgaaacagtacctccagcaaccgaagaattttccatggtggataataaaaatcaaaaggaggaaaaagaggagggcagagacaaagagacgccggcggacgaagtgttcgagggcgagttgggtttcagtcggcaagtgggcggggtcgaagttgtgctgagtcgggccgagttggagaagctgcgccgattggaaaaaccgggaattgttgtgatcggcttcaaaccgttgcatttgctgaaggattcgcatcggatgggcgccaccgtttttgtatatcccatcaaatcggtaatctccggcagttggccattggtcaatgcggaccaagtggagacggccaagcagttcgtcaagaaattgaccaacaccaaattcttaccggatgattttgcaaattccatgctccaacagcattacaaagctgtcgaaatggtaatggatttgccatttgacagtgaacagttcaaaaaagaggcagcggagaatgacaaattaattacgtacttcaaaaatcagact

SEQ ID NO: 6467 - DNA, 1743 bp, Heterodera glycines
atggaaatatgttttagctttatctgtccttgaaaagagaaatttaaaaccggtgctcttttgctatgtcgcacgcgcttttttcaaaaaactttttgggaacatgggagggggtcacacgactttggtcaaatttgacacggacccccattcttaccagtatacttttggacccagatctaccgggtcgggtattgggttttcaaacgggccttgaaaaacccgggtcgggtacccggacccgtctaaccctaaccaatgcaatagtatgttaattatggcgccgcaagtgtcacttttctctgaactttcctccttttggctctgagttcgaatccaaccgtttttatattctacagaatgtattattcaactgtttctttataaacctttttaagaatattttaaatgtaaaattcaacaattttctgatattttttttcatttacgcagaattagtcaagaaatgacgtcgcttgattaaaaatttttcataaatatttccatatgcatttcatatgaatgaacatgtgaagataagattgccaaatattataaatttgctatgtatttatcgatacttatattatttcataaaaaaatttttagaggaaaaataattaaataaaaaatgaaaataaaaataattttgattttacttttcgtatgtgaaaatgtaaagtcggtgataaagaacaagcccgttttcaataatctaaacgaactcggccaagaaaagccctacggcaatggcacaacgaacgaactgcaggagagagaccgcacagaaggcaattagcaccatcattaactcactaattaacactgattaaatgctttagtcgagccgcaaatctatccgccagtacagcagcaaatgaaaagggggcaaggcaatgaacacattttgcaatggtttaatgattatgaaacccagcaaaagcaaagccaaagaaagggggaaaatgccaaagacgacgacggcaccacggaggaaaacccattcaaattcatcaaaatacacatcaatgaaatggcaaacagtttgacaattgacgcacatgtgacggaggagaagggggcagtggtcgaaatttgcttatgtgacgagaaatacgtaaaacaaaaactgttttaattggaaatttaataatttaagggaatttgtgacggtccgtttgaggcgacggaaaattttggtggaaaaattaacccaaaagcaacggaatgtgttaaatttgattataaaactattaacattttgaatcaaatcgtcaaaaaagagaacaaattgtcggtattagcacaatttcgcatgaattataagaaaggcggcaaaaacaaagcaaaaaatgcaatttttggtggtttgttcaaaaaggtaaacactcaaaacgaaaaggaaatggcacagaaaatgatcgatgttcgcaattggcacattggcaatttgttagcggcaaacgatgagcgcaattcgagaagattggaccgggaattcttcctcagaatttcatttgccaatgagagcaaatcaaacccaaaagtaaataaattaataattaatgtaaaataaatttttaaattttgaaggtcatccttggggagtgggcagtgcaaaaatccgtcaaatttgaaatgattccctcgccgaattggtccaaattgtgaacaaagtcagacgaagccaaattcagatgggaatacgatattggtgtactttgtttttgttcataagtgcaa

SEQ ID NO: 6468 - DNA, 2342 bp, Heterodera glycines
  misc_feature (2277)..(2277): n is a, c, g, or t
  misc_feature (2283)..(2284): n is a, c, g, or t
  misc_feature (2329)..(2329): n is a, c, g, or t
ccccccccctctctattaatgatgctatcttttaagaattgtcctcctcaaatgtgtccttttagcagctgtgttatgctcaactcctcctcattttcgtttcatcatcctcatctcatcctcctcctcatctcttcgttcgttcgtcatttctcccttttcctccgtccccactttttcgctctctcttcggtcgcgcgtcgcctccattcgatgaatgttcccactgatcacccccccccccaaccaacaatcatttggtacgaagcgccggactaataaatcacaaatgcacatgcgataggtcccctcggggatggacggcgatcggagtttgtgtggtggggggagggggggggggaagagaagggatggatggcctttggcttcagaaaaggaatattacgtgttaaaatgataaccataataatactaccatcacagccccaccaaaatcaacccataaaaatgatcgccgcctccgtttgtccgccgatcgatcaggccatttgatcaactcgcggtttctgctgcactcgtccttctcgttttgcctctctctctctattcacagtcattccaacagaacaaccgccgaatgccaaaagcgattcagccaatcactaccagcaataactctttgaacaatgccttcagaaatgatcgtcgatttttttgctggatgcctaggaggtaagcagaagagaaacagaaacagaaactgaccgaccggcggaagaataaaatagaaaaaatatttaatttgattttccgtttctccctttgaaggcgtcgccggtgttttggctggtcacccgcttgacaccgttaaggtgcgacttcaaacccaaaactcacattgtccaatctatcggaacacttttcactgtctgaaaaaaattgttcaaaccgaagggccatcagccctttataaaggtgaagaatttcttctccaaattttgttgataaatgaattaaaatatggtttaggcatgtcttccccattgaccagtttggcactaataaatgctgtaatattcggcgttcatggcaacattagcaagcagttcgacgacccaaatgctttgcatgtccaatttttcgcgggtgcggtggcgggtgccgcgcagggattcatttcctcgccaatggcgagcaaaagacattttcggtgtttagtcattgttttttaggaattgcttaaacttcgtgcacaaatttgtccagaaatttcggagaattcaaattcggcccaaaagcgatgttcttcttcgccctttacgatggcatgccaaatttggcgccaaaagggactcaggcatttcagccggtaaggaatcatagaaatcactccgtttaataagtaatcaaaagagaccggaaatcagtgacggaatttcgaggtcttaaaaaatagacaatcggaaaccgaaattctgatatatatttttaaaattcactttacctttttggcattttacaaaatttgagaaaagtttattgttttgacaattgtgattctgcactaaaataaaataaaatttatgtacaatactttattaaaaattttggtgacttggcccatgctgaggaaactcgacttgaaacgagaaacaaaaccgatcgaaatataaaagccaattttttcttgtcaaattcttaaacagcatgaaattatcaaatagatcaagttccaccaccaatatgtaatttcagcggccttctgatcactcagctgagggattgtcctgcgatgggcgtttattttgcttcctatgcttttttgaggcgttcaatggactccgaaaatgaacaatcgcaaggaatgtccaatttgcaattgctttttgctggaggagcagcgggaatgtgttcatggctgagcaattatccaactgatgtggtcaaaacccggttccaatcggacgatgcgtatgaaaattgtgagaaaaattggggaggatggaatgcgaaaagaaaaattttcaaaccaaatttcctgggcgcgtaaatttttttgagaaaaacttgaacaaatagtttttcagatcgagaagttgtcaaaaaagcttactcggaacacggctggcgaacattctttgctggacttggctcaactttgattaggtgctaatttgattttattcgttggatcttaagcttcctaattacctttttgtttaggggctgtccccgacaacgctgccattttcttcgcagtcgagtggactttatcgatatttagcagaaaagtatgcagaccgaagcattgacaanagaacnngagtcacagcagtcaaaagtggcgaaactaaagacatcagcccgngggttttcttttt

SEQ ID NO: 6469 - DNA, 3277 bp, Heterodera glycines
  misc_feature (3175)..(3175): n is a, c, g, or t
  misc_feature (3215)..(3215): n is a, c, g, or t
gaaaaaatatgtatttacataaaattgacatccctagtgatttgtatgcatttttcgactctctactaatacttttttcctctgtaaatgtctaagaagcttttttcagcggactcgaattttgattattttaaattagacattaaaaaatttattttaaaatttgccattttttaactcgataaaaataagagaattcaaatgacaactgttcaaaagaaaaacaaagcacagaaatgaatgaatgttcatgaaatttgagtccaaaaatgctttaatttactcaaaagctcaaattttcgccgacacaatttgttgaaagtcggagttttaaaatccaaatgaacttttaaattatttttaagttaaaatttaaagtaaaattttttaatgttttagcctttttctccgctgatcgctgtaaaatgagtcaacaaaatgaagaagcacttggcaaggatcaaaaggaacttcgagcagttcaacacgacatggaacgccttttcaaagcacgagacgcgaaaggactttccgagctgtacactgtcgacgccatcttcgcgagcaatttaaatttttaaattaaatttttacaataattgggtttaatgtttgttaaaatgatttgtttaggcccatccgccgatcaaaagtcgtgcagagattgaaaagctatggatcaaattccttgacacagactctgccgaattgcatgtgaatattattaatccatcaaaactttaaatcaaatacttttgctttaaggtaacttttgacgaagtttacttttgcggcgatttgggcgtcgaaaatggcacttataaatttacgaagtaaaagaattggaaaaatagatttagttttaaatgatatgatttttacagcaacgacggcacagtgacacagaacggacttttcatccaaacttttaagcgcggttcggacggaaaatggcttatccacaacgatttttacacatgttgaaaaagaatgaatcacaatgaaggcatcagaagaaaaagaaaaaacatttatgtgtgaaattaggcataattaggcactcattaaattaaggtgataataatgaccgaattaaacaaataaaaaaaataatataaaacaatttccattttatttcatttttaatttattaaaaacataatagttttgctaatcctttttaaaaaatataaatttattcaactttattcgaaaatataaaaatgatctttattcaaagagaattttataattggaaattgaattaaggtttatttttatgcttaattatccactaattttcgatggcacttccgctggttgtgttttgttgtgtcaaatcatcaccatcaccagcaaaaaacaaaaacaaaacgcacagaggcgaagaatgactcatttatttactgtacaaattcggtaattacaatgcaaagggatttgattgtttgctgttttttcatggcacaattgccaatggatgaatcataaatataaaatgcgataaatattcaataataacaatgttatcattaggaatgatatttttaggttctaaaaaatccaaaatgttgctaaaaacaagaaaatggttgttaaaagttgcaaatttatggtgtaaaatgactaaattttattcaaacccaacaaaattaagtcaaatcagtattcagatacataatataaaatctaaattattgtcaaaaaaataaataaataattttgggaatgaatttttaagtaaatttttcatttcttaggggttattttctggaattttttcgggtcaattcttgggggtgtatttttcgtttttattatttaacaacactaaaaatacataaggcagctcagcaggaaaaaatattcaaaacccctaaaaatatcatccctgttatcatctgcttttgctttttattattattttttttattgttgtcattttcttgccgttgttcccgcgcaaaatgagtctcttgccgagtttcgtgccgattcggaaacagtgcggtgcaatttgtgtgccgcgttgctgccggtgctgattttcttgcgcattacggtatggaaggcggaggtcacctgaaaatgggcatttggtttgaataccgtattccaaatcacttaaaaaatattagccgccagctcaaagatttttttcggaaacaattaagctcaagaaagaacacagaaaattgagaattttgtttataattttggtttatagaaaattctcaaaaaattgggctaaaaatataaatttgggagtttaaatcggtaaatttcttcacagttctttgctccttttcgtcgttctttggccccccttttttgaaccttcttagtttgattaattccaatttgtcgttttcgttttgccaccttttcctcctccccgtcgtcgttggcccttcgctgtgtccctctcattgaactattcccactgttcagtctcgatgtgctgttgttgtggttgttcaggctgttgctggtgttccgtccttcgtttccgtcgctgctccccgtgcttaatgtcggcgaatgggcgtttcgatcgcgcaacgaatgcggcacccaatctgatcaaaaagtgttgtgccaattcacttattagcatcgtatttttaagaataaaaatgatttattgatcactattaccagccgcttcaaaaaggtccaaagctttgtccccatgggcacatccatcggtgtcgaattggacaacgaccggctcatagaaaagcaacacgtacagcttggggccaaacacaaaagcgagcagaatggagccggtcaagtgtagctccaacactgacagatattccatgtgctgaacactgaccttaaaaagcaaaaaattattttattaattaaataattttattaattaatttaatatagccaaattcaagtttgattaattaattatataattaaaaccaaagtgtgaaacaccgcccaagcgataagaattagcgaacaaatgagagaagtgataaacagccatttggcctccttaataagaacgccaaatttgcatttaaataaaacaattcctcccaaatttgccttataatttcgtttgatgctccgattttgcgcggacaaaaacaaagccaaaaagaggaggaagaaagtgtaagtttgggcgagaagaaacaatgccgaagaatgngggcaacggagggcgaaaaagggcgatgccattgacttgngaggagggggagagaggggccaaaaaacgtcggggagaatccaccggaagcaaattacagtc

SEQ ID NO: 6470 - DNA, 1334 bp, Heterodera glycines
  misc_feature (41)..(41): n is a, c, g, or t
  misc_feature (1108)..(1108): n is a, c, g, or t
  misc_feature (1288)..(1288): n is a, c, g, or t
cggaggaaggacagcaattcggccatttcgaagttggacgnccttcacaataattacgccgaagcaaatggcatgtgccatagcggggaaggcaattcggagaagacacagctaagattggttgtttaggcattcaattgacaattaatggtcattagcacatacaaagggttcatttgcgccttcggtggtgaacagaaaggcgctgagatgcattgtgatgatgccgagcagaagcaaaatgccaagcgattgactgccgcggattgtgcgacgccatattttgaacagaatgcacagcaaagtgccgacggcaatggcactgagcagcgcggacagtgacaagagaatggcacggattgcccacgccacctcgcggtcgacggcatcggcactcaattcgcggatttcctgcaatggcaattcattagggacacgaacacaaaagaaaattttatactggttcgtcggccatgttttccctcaacaggaattcatcgtcttcgcttatctctgccattctttgcctcgaaggctctctacgaaagaccgaattatggccaagccaagcggagacatcggcaccgaagtgaaagtcgtcgcttaattacttaattggaattgccaattcgtctgtaatcacctcatcatcagcggacatttacagaatggcgatttgcatcgtgaaatcacggtggccgacggcgaatcacgcgtaattgggacaccgtaggcaaagggacggtaatcggccaaaaagttgatggcgatgttcgatattgaaggattattatttggtgaaaatgccccgccggcggacgaatcgatcgaagttcggggcaaagacaaattggccatcagagaatagtcgaaattgcctaaatcacctcagtgataaatccaatatgttttgttttattttaccatgatgatcaatcggcacaaattcgaacacttcgaacatttcggcactttcttctttggcactttttctcaaatattcccgcgttaatttgcgtccgttttcaatgaattcgtcgcataatttttcccgaatacaaagcctataaatttaattaattaaaaatgattccgttcctaattggtncattaattactttttgtgtgccttgtcaatggctttcaacagtctgtccacccctttggccaaattgcccgctttgcttagtcggcccattcccttcacatttaagcgttcttcgcccgtgcacatcccgtccgttgaaatgtgaaaaactgtttcggaatctgaacaattatcaatttngttgttttatttatccgttttctaaactgtcccctccctccctttt

SEQ ID NO: 6471 - DNA, 3379 bp, Heterodera glycines
  misc_feature (3242)..(3242): n is a, c, g, or t
  misc_feature (3244)..(3244): n is a, c, g, or t
  misc_feature (3268)..(3268): n is a, c, g, or t
  misc_feature (3274)..(3275): n is a, c, g, or t
  misc_feature (3282)..(3282): n is a, c, g, or t
  misc_feature (3316)..(3316): n is a, c, g, or t
gtgggcgaacaaaaagcgcaggtaggaaaatcctcaaaattgatttaaatattcaaaattaagatgacaagtttaatggttaaaaacggacgattgtgcgaaaagcttggcgaacaccaaaagggactgaaagcagttcaaaatcggattgaattgctggagcagtgccatctgcgcgagttcgttgcgggtcttccgcccgttcatgaggacggctcattggttggtgccgaaatcaaacaaaatttgccacttcaatttcaggttttgtctcaatttgaaaatggcaattatttcgcagagatgaaaatactgttccagtcgggttctcgcttttgttcgggctttgccatcaaaagctcggcacactttcgcaattatccgtcgaatttattcaaccaaataattgaggtcgctttatgtgttaatacgtcattaattagcacagcatttaatatttagcatgctctgaccactcgccaagttcaaaaaatgacccgttgggctgttatgaacttcccggccaacgaaatgtgcctgtggccccaggcacttttatatggcactaacgatgacaacaacaacaataagtacaactatcggaaattgattcgaagacgcgaagtgctttcagaccgggtgagaaagacaataacagaaacaagaggggtcgcattgatgtgctaaagggaggggacccgctatggattttcctatttaaatttttcttaaaaatttatacctccgtgggagaggaggcgaggggggcgggggctacatcggtgcaccctatgacgtcactgcccaaaaagtcgccggacaattagttctttgagaaatttcaaaatattctcttcaatgcggccctatgttttgagtaaattatttttgtacaatttgtcgcgtggtttttcacgcgtttctctctctctttgggtcgggttgcaggggaggcgtacccttttttgtctgaataacagtgccaatgccttttgcttatgctactccatttcccaggtggtctattctctgttcaaccaacattccgcccacaaattcgttgtgaacatttactattcctccgagtcggatctgttcaagcaaatgcactgcttcaccatccgtcgtcatcgtccttcccgctgattttgagattgactttaatcggctgaaattgttcattcgctttttgttctttggtttcattcctatcaatgggtttaaaagtgcttttctcttttatttgcatggaaaacatctccataatttaattcattattttaaatgacaatttttgaaattaagctctgttggcgtttaccgatatttgtaatttcgaattctttcccattttctaaatgacaaattcatttatcataattttcaacaataaagttcaattcagtgctttgttaatccctctgctgttgattgggtcgcgtctcttttgaaattcggggaatggaatcggtgccaaagttcgtctgcctttgacttcaagtcgtaaaagcggtggcccataaaattttaatgagcattcaaaaaaataaaattgtttgtttaattataatttgcacacaaagcggaaaagggcatttactcctgccgaatgccattacgattaattttccctccgtcctcaaaatttgtttgttctggtgaattattgtaatttgagtcgtttttttcatccatcacgacttgtacacggactcttacagcttggctttttgttttattttcgaccaattttcggctctattccaatttacgtgtccaatcagtgaccatccttagtttcttaggccataaattttttattactcgatacaacccatactttttggtatcaataaagttaaaagtctcgggaattttatgtataactaaattctgagctaaaggaatagacaaaaaaatatactcgaaaaaagttgaatttcattttctcattgtaatttcacggtatatctgtcgtttgtcgtaagttatttctttcagttaatagaaaatttcagaaaatgcaaaaaatatgaaaacttgtttgtctttttattgttttttgaggtttagattccgaataccgtatttactcgattataccccctcccccctcgaatggaagccccccttgtagggggggttgaaaaatagaagcccccccctcgagtagaagcccccttcgaatataagccccctttggaggggggttgaacaatagaagccccggggcttataatcgaggaaatacggtataacatttattttcttcgaattccaatcctgaacatgaattcaatagactcagataacttgatgaaaaaacagataatgaaagtctggcatcggattcatgatcagcgaactcatttacccctaggaacataattttaacatgaaataaaatttttagacgaaaataatttggtaggtttttggccatttctttgatgacaaatttgaggggtgatgttgagcgatcccaaatatttgttgtttttcgtctgaatttggcgtttgtcgtaaaaaccaatcagaattttataataaacgaaaatcataatttttttattctgattggtgataatttatatttcggtgtttgtctctgtctttgtaattctaactgtcgacttcttcggttcttttctgttttgtgaccccccctgaaattttcaaataaaaagtcatttctagggtaatttggggcgctgatcacgaatatgacatttatttttcataattccgaatcccgaacccgaatcgaaccaaaattcgaaattcataaattacaaggaaaacatatttttatgggttttcgaggtcgctgaaaacggttatgacatccattttgaccaattaaataaccttaactcgagaaatcggagttttttttcagcaaacacaaaatcatcaaaatattggccaaactgccgagaaatgcgtaataaaatttgcgctaatttggtggcatgtatctaggcttaggcttcagcttaggcttcagcttgcctaagcctaggcttttttgaaattgaaatctgttttttctttctttgtagaggaattgttgttttgataacaaaaaatcatatttaaataaaataattgcatttttcttaaattaaaaagcttagctaattgtaagcctttaaaaatcaaattaattttctgtaataatttgacaggaaattgaatttaaacgtaaatgcacaacttctaggaaaataccttcttctccncnttctctccattcttttctctttcnttttcnnttttttnctttatggtttttaaagattttatctattttttnaaaaaaaaatatatttttctttaaagatattttttctggcacttaaatttttcatatctctct

SEQ ID NO: 6472 - DNA, 3716 bp, Heterodera glycines
  misc_feature (8)..(8): n is a, c, g, or t
aataattntggtaggtttttggccatttctttgatgaccatttgaggggtgatgttgagcgatcccaaatatttgttgtttttcgtctgaatttggcgtttgtcgtaaaaaccaatcagaattttataataaacgaaaatcataattttttaattctgattggtgataatttatatttcggtgtttgtctctgtctttctaattctctcttctgacatcgcctcggggttaattaacaataatacacatgctattgttatcatcatcattgccatcattaattagttcgttagttgacatctttagtgagtgccttcgctctaattgccaaattgggctattttcttccctatattttgtgtcagtgctcaaagcgtaccattcggacgaccacaaaagcgtcgttcgtttgcttaaggtcatgacgctgcttctccatttgtattcgctactgtaccatttgtgaatgtaaaaaggcgttttccttgcctaagggcggctttagctgaataattttaatggcttagaaataataattaatgggacattctttgaatggtaattaattgagtatttaacgagaaaaggagggaaaggtcgtcgaaaagagtgccgcccatttaaacgaccgacaagtttcacagcccatcacttttcagtttatcaaattcaaaaagggtaataattaacgaactaaaaaccaatattcatacacaaaatacctctcacacctttattaaaccaaatgtgagcattttaattcacataataatcccctcttaacgtggccattgcgaattaaaatttctattttcggtttttgcctctaaaattgacgcatttttccaattttatttacaaattacaaaaattaaatttgacttttggagcaacagccaaaaaatgttttatgttttgtacttttaaaataaaaataaatttcggcggctcttttcggcactgccgggccttcctttattggcacttttctgtcaatttaagtgcttatttgttataatttgttaggcgcttttaaaccaagaattataatagcacgacaatccgccggcggtagacaattgagcagcgacaattgggcaaatttttttaaaaatttcttaaactaaaattcttaaaatatttcaattgaaaaagtaattatttatgaatttcttcgttatttttcacatttggcttttacataaagtgatttgtgaatttatagcttaatttacctaaataaaacagataatttagtaacccctccccctggcaattcaattattccaaaacaattccataccgtaatcacacatcttgttccccaaaaacagtattcttttttcaattaatccctttaaagctgttaaaaaaggcctttccccacaaaaatgtccaatttgtttgtggcttcttctgctgttgtttttctccttctccaattgcatttcgtcgtcactttcgcatcatcctttgaaggggcgccgccaaaagcaaatgaagaagcaatgccaacgacgggggaacaaaacggaggtgccgaatttggtggaagcaagcagaaaatggcacggaaaatgatgcgatacaatggcaacaattttgacaaggtcagaccaaaagaaacaaaagaaaagaagcagtgcaaccgcacacaatggcattttcaaaaatgaaattcgaaatgacacaaataattccggataataattcagagtaattaattaatacaagcggaatgactaaacgatttatattaattaaaatttaatttataaattgtttcatttttttcgttttttcgtcactgcggcgacaaagcaaccaaaaaaagttgatgctgattgtgagccccaggaagaaaataagggattttaatgagtcttaattccctattttgctggtttttaatgtttcgtccgtctgataatttgtcatttacccccccccccccccacataacacataattacctaattaacaccctcaaattagcaggtgtccgtcctcttcattcgacgtgaaatggcactgcgaaaacttcagctccaaatcaacgttttggagcagcaattggccaatgctttgtcgtccgctttcgccgccggctgtcccccctccggcgtttcttccgtttccgatggcatttcgcaccgacgccatttgccaatgccccgcgagtgaaagtgcgacagagaaaggaacacaacccgatcagtgaacgcatcagatgagaaaatatcagaaaagagtctccccccccccatttttgatcatttgagtaatttataatgtatccatccataatcaatggttttgataacgaggattaacaaatattgtaattttgtctaggatattccgcataaattctgtcttttgtttccgtccgtttttttcagtttgttttggcaattcgcttttccctttcccatggcattcaattttttaaatgtttagcatttaaaaaaggaattccaaacaattcaaatttaattggcgttccgtttgatcattcttttgcgattgatcagtcgcgcctttatttctgtgtgccctccgttttctgctcaaaatcggccccggtcgaccaattcctccgcgatgcaatcttcggcatttgaagtgcttctgtcctcctccgtttcccgggtcaagcgaaagtcgaaccattccaagtggggaaaagccaccgaattgaacaccaaatacgcattttggcattgcacgtgccatgggccgtacatatcggaatgacctgcaaattaaaaaataaataaaacatacccaattaatacactttgaaattgcaccaatttgaaaataaccaaccgctgctcaatttgattttaccttcgaaaatgcgtccggtccacatgggcaaatacgcttgtgaggagccggccataacgccgacaaaagtctgaaattaaatgaatattttggatatattaaaaagattaaatatttttatttcaacgaatcagttaaagtttaaattttcaattggttttatgcaatttgaggccggccaatcataccatggtaatttgaccaaaataatgaaatcatttggaaaaagacaaatttattgtccttcaaacacttatgtaagctttccatattaatttttattattttaaattttgaataagagaattattaccgaaaatttagccagggactataaatataaaaaagtaaataatgttataaatatttaacaaattactaatattagagtttaatagtttaatttaatttaataattgcttaattatttaattaatatatttgttaatttatcatgatgaaattattttctcactgtttatttttttaaattttatggataaaattttgtatatttttgttttttaattttgttttttaataaattattgctcccgatttttaaatttctgccatttaccccccccccccccctgcccaaattaaccccctgatttttggtgtgcatccgttccacggtgaaccgcgtcccggttgggatgcgcagaaggcaggcacgctcccgcagctgttccgtattgttcaggcgatagaggcgcgactcgtccacgaaggattcgtccaattgggtgtagcaactgatcggactgatcggagtgccgtcctcggcactttgctgtggcaacagttcggccaaaggccaatcgaacaactgaattaaataggaaattagttaagctaat

SEQ ID NO: 6473 - DNA, 4905 bp, Heterodera glycines
  misc_feature (74)..(74): n is a, c, g, or t
cgataaaaaattagaaaatatgcaaaaaatgcatacaaatactcaaaaaaaaagtttctttatcattaagtttntgcagtagaaaaggtcaaaattgtaaaagaacctccattctaaattggtaatatgttagtatttacatttttcgtctaaaaatcggtttaaatccacgaaaaaccattataaaatttctgtgtttttctattgcaaaaattcttagatttttttgaattaactgaaaaatctttaaaatttttaaatttgttcaatctgaagacttttccttcccgcctttttatttgtcggcaaataaagccatttataaattacgtttgccgtttcataatcattttctctttgtaatttttcaaagttttctctcaacaaattgtcaaaatttgaacggcttaagtcaaatgtgagttgttctgatggtgaaattgcagcagccttttcttccaccctttttggactttttcctatttttgccacactttcaaaaactttttggccaattgtcttttcaccactcacttccgattcgtttagtaattttggttccgcatattttttgaaatatttgtccaatttgtaatcgaattcttttgcataagttgggtcaaaaaagaatgccgcaatcccgcataattcacttgccacataaatcaaagacttaattatgtttccacttccaaatgtaaaatttggcctcaccgcggcaaattgttgtggcacttcggaattatccgctaaatgtttaatttattaaatttgagcgataaaaaattagaaaatattgcaaaaatgcatacaaatactcaaaaaaaaagttctttatcattaagtttttgcagtagaaaaggtcaaaattgtaaaagaacctcattctaaattggtaatatgttagtatttacatttttcgtctaaaaatcggtttaaatccacgaaaaaccattataaaatttctgtgtttttctattgcaaaaattcttagatttttttgaattaactgaaaaatctttaaaatttttaaatttgttcaatctgaagacttttccttcccgcctttttatttgtcggcaaataaagccatttataaattacgtttgccgtttcataatcattttctctttgtaatttttcaaagttttctctcaacaaattgtcaaaatttgaacggcttaagtcaaatgtgagttgttctgatggtgaaattgcagcagccttttcttccaccctttttggactttttcctatttttgccacactttcaaaaactttttggccaattgtcttttcaccactcacttccgattcgtttagtaattttggttccgcatattttttgaaatatttgtccaatttgtaatcgaattcttttgcataagttgggtcaaaaaagaatgccgcaatcccgcataattcacttgccacataaatcaaagacttaattatgtttccacttccaaatgtaaaatttggcctcaccgcggcaaattgttgtggcacttcggaattatccgctaaatgtttaatttattaaatttgagcgataaaaaattagaaaatattgcaaaaatgcatacaaatactcaaaaaaaaagttctttatcattaagtttttgcagtagaaaaggtcaaaattgtaaaagaacctcattctaaattggtaatatgttagtatttacatttttcgcctaaaaatcggtttaaatccacgaaaaaccattataaaatttctgtgtttttctattgcaaaaattcttagattttttgaattaactgaaaaatctttaaaatttttaaatttgttcaatctgatgacttttccaaatggtgaggtgggggaaagaattactctcattttctcacaataccttcattgtatgttcggaagagatattcatacaaaaaattgaaatattttcggaattttgtgcattcttttcggtaattctcaatttccgcacattgccatttgagtctcatcaaataaatgattttaagatagagcttgatttccaatttctgtgaatggatcaatgatttggcattggcacttaatggcgccgtttccaatttggcaccaaacttttcaacacgcatttcttttagaacaataagaaatatgttgtcttcgatctaaaaaaattttttggcaaaatttcgtaaaaaagggcattaaaattgaaaaaacacacacccacctaagagttgagtttttggaaattttcaacaaatatttcacacaaaaaaatcaaaaaattaaatggagatttttttggcactattatgatgcatataaataaaattcttcaaaaagaattccggggcttaaaaagtttttcggacatcggaattccgatcataaaaatattgaaaagcgaaaaacggaaatcgaaagtcgagtccctgccatccctggtgcaaagaacaagtgtgcttgagaccaaaaatttccgagaccgagactcaaaaagccgagacgacttgtctcgaggcgagactctcctcaagcatcactgaaagcgccaaaaacacttccagttcatttaccgctttgtctattccataaaatggcttgtgattaatgtgcgaaatcaatgcttcgtttgttattgaagaacattcaattagggccgctccaaaaaaatcatatcgggacaccttctccagtgccatcgtcttcaatttttccattttgaaatcgaacattttgcgaagacggggaaatgaattgtcaaattttgaattggcatttaatttcaatttcatttttggcatgtcaaacaatgattcttgctcataccaattgtttaaatttattccatatttctcaattagcgtttctttattaattaagcgtgtcgttttagaataatttccgcccagccaatgattcctccaaacgaatgcccaatctaggattgcatcacaaaactttatttctctcccgttgctttctaattttggtttaatgggattctttgtaatggaaatttgttcagctaaagttgggtctactgctagaaaattttacgggatttaatttaatttgaaatttcaatttaaaatttgggttcgaaatccgttaccttttacatattcagcaacatattgccagaagaagtattcgtagagaatgaaagcaaattggcgaaagttgtccaattcattaaagacatttatattgtacttaaaataacatggtaaaatttagagaccgaacaagggtccgatcggtttatttcgatacaggatcggaaaaagaccagatccaaaaaaacgaaaaactaaaattttttcgatcgtattatttacgatacaattgaaaaaatgtcgtaaaaaagatccaatcaaaaattaaaaacacattttccaattggtttgaagcttatacgttgccttttattatggtttttttaaattttgtctccggtataattagtaattggccatggttttgcctattatttggacaattgattgtggccgtggataattttggggcagtgatcagactgaatgtggaggagtacagtaaaaatttctgagttccggtaaatcacgaaattgttgaaaattagttttttacaacaatttcccaaactgttcactgtgggcccagtggttccattgcccaattatcgctaaccatttgtcaagtcgagttaattaattaattaattaatatacagagaatttgcttactcgcgtttccgtcacatgattccatttcattcgcataacatacaaaacgccaaggtgggcttcatatttatcagacacaaattggtttttctcattgataattaatcctttatccgcgcaaaatttgttaaaatattcgggtccttttgcaagctcaaccattgcgtcatcttccatctgataaatgattgataaaagcattaaaaataatgtttaatcagaaacacttacggatggatttccaattgtaaaggcaaaaaaaagacaaagattgaataataaaaatattggaataaaataatccatcttttattcaatatttagctggaattatcaatttgaaaatgattcattactaatggaggaagttttctaattaatcaaattgtcgacactcgggcgaaccatccactaccatatataatacctaccgttttactgaaatcgagtccctgggggctttatttttcgaccccactcaaaagggggtatttattcgagggggtctaattcagtaagtacagaattttgcagtttttatacctattaagtacctaggcatttttctatttctcttgccgaaattcggttttcaattcttaggcacaaaaacggcaatactggaacctaaaaaggcagaagaaacaatcgcaaaataggcattaagtaggcactaaaaataggcaaataaaatttttgtaaatgattttatgttccaaaatacataaaaaaaattaattaaaacgtaattttgattatatttcaattgtaaatgaaataatataacaaatgaaaatcaaaatttatcaaaaaaaaattatattttagggaattaacttttgggaaattttttcatttcttagatcttttgaaatggcatgaacaagtgtatttcactataattattcttttatatatttattgggtaaatcaattcctcactattaatttatctttaagtcaatgtttcactaatgggcaaatcaattcttcactattatttcattttattttttaaaatagaatttttggataaattatattttcactatacgtatacctagggaatcatcttattgaatcgaaattttcaaaaatatttaaaacgtaatttgttgtaaaatatcagccaaagttgtataataaattggttccgagagtccattaaccaccattttttgagaccctgccagg

SEQ ID NO: 6474 - DNA, 938 bp, Heterodera glycines
tgattattttcgaaaaaagaatatggatcaaaatatttttgttttagtcataacttttttgaaacatcataaattttcttgatttttgcttggtaattgtgaatacattggcattttgtttttggctttttagatgacaccaaaaatcccgtttgtttgctgaacaatgtggcggcccagctgggcatcaatctccattaccgggaggaaagcttttcccctttcaacgacaatttctccaaatcgctacaacagtaaattcaatttttttttttttgttaatattaaacatttaaattaattaattaatataatcacacaaaattcacgaatgtgccccttggggcattaaaattgaatttgaaaaatattattatatatattcttaattatcttttgttaatgcctaattattattatcttttgttaatgcctaattatttctatcaaaatgcttcagtccgtcctttctcacttatttgttgctacaagcgttgtgcccggccgctgcgatacaaagtgtcaatgggtcattagcggcaccgcttttcgctaattttccacaccaacaacagcagcagcaaaacacatcggggtaacaaacttttttttgtttaacgtatttctttgatgatggccaatgcaaagcgcttatcgacagagccattattatgcgcataactaaccgtttttatcatgaactatagatatattttacacgtccgctatgttattccaatactataataccgtgtttaatgaattagagccccggggggctctatttttcaaccccctcgaaaggcgggctctaattcagtaaatacggtatatcggtgttagagcgtttcttaaaaactgccacccatgcgcgtttcttaaaactgccagcgcgtttcttaaaactgccaaccatgcgcgtttcttaaaactgccag

SEQ ID NO: 6475 - DNA, 4069 bp, Heterodera glycines
atctttaaataagccttcgtaatttaatcattttgagcattcattctgctgaagcgcagaaggagggaattgaaaattggaatcgattatgcgactcgggggaacggaaagggagggaccaaagaaaggctgcaaaagagcggggagggagatattatcaccaaccaaatgcgtagctgtatattggcaaaaatgcactaaaattgggatctgtaatttgaacaacaacaaaaagcaacaattaatttatttgaatgagaaaccggtgctagcgcgtttcttaaaactgccaaccatgcgcgtttcttaaaactgccacccatgcgcgtttcttaaaactgccagcgcgtttcttaaaactgccagcgcatttcttaaaactgccagcgcgtttcttaaaactgccaaaaaagataataatatgacagaaagagtttgggtaattatttattcaaaaattgttggatgtgttatttttttaatctacataatacaaaactacaattgtttcactgttctttaaagtgttcaccaaaaattttaaccgaccagcataacaaattctaaagataaattaagtctttaaatactgtaaagacagacttttgtcagaaaacaatcagtactttcatacagacatttgcaaaagctattgtcgcaatcatattgtttttgatatttgtttatatagcatatatcatggttataacagcaacgattaactataatatttaaataatacatttataaatctattaaatttataactttttttaaagtcgcaaaaccatattacaggggctatcatgcaagaatcaaatatagaagtgccacaataagtgccacaatatttctttgcaacttacaaaagggaattttgaatacaatataaaaaaataaaaataataattaatttatcttttgtgggtgttttatgagttcaaagtggctgtggcgataatataaaaatattgatgcagtcgactccttttgactcagatttgaaagctaaagtttcaaatatgaatttgcacaattaaacaattctaacccgttgttccaaatttggcgaatacacttgccaacggtaaatttcttccactagccattcacacacaaatatatttattcgaaacattttgatgactgctgctaaatctaaattattcatccatttttcggtttcgtgtgccccagttgcgggtgtgattgctttttctagatgttctctaatatatatattgctgccaaatagcgctaaaattagcatattcactcagtactgatttatattatacttacaccaccaagaattttctgtataagaattttggttaatggtttcttgcaaatactcaatgacatctcttcggatttcggtgtgatttgattctgttccagtcatagcaagagagacagctcgccaaccgcaattaccatctcctaatatactgataacttcaccgagtccgtactcagaagaaacaaaatcaaacggtactggatattcaatcggtgcatcacctatatttgctattacttttgatcagaaataaatcttactaaatctgtaaaaccacgtttcacatagttcttgtctttgatcttcatttataggattaaaaacaaatttaataacagaacgcatcatggtagcaacatgttgaactattatgagttcattaatttttaatattttgattttaaaatttattttggttttaaaatttaatatttatttattagttatattttatatttccttttaagtaaattaaacccccttgagtttcttggctagaaatgctgttttcagtgctttcacttgaaaatatctcttcttcagaatttcttaaaaaattgttaatatattttttataatggttgtatatacgttttcaattttataaatatataattaatgttggcaaatattttgtagttggctataatttaaggctggcaaacaattttccataattttagctaacatatgaaagtcacgtctgttacgtattaacttaaacaaaaaatttaatttatattatcgattagcacgaaatcataaattatttatttatatttaaattaaaaaataggaaataatatgttagtatcttttttggcagttttaagaaacgcgctggcagttttaagaaacgcgcatgggtggcagttttaagaaacgcgctggcagttttaagaaacgcgctggcagttttaagaaacgcgcatgggtggcagtttttaagaaacgcgccagcacgcggtatatctatgttcacgtgttttgtttttattcgctcacatatattttttctctttttccttgttttcatgagtatgcataacaattatattatatttctatgtttatttgtgtttttctgacttcttttacgtgtttggttgtcctatttttacgtgtttttctgctttccaatgtactttatttttattagtttaacaatattacttcatgttttacacacgtccgctttgttgcactaatatatgttctatgtttttttacgtgtttcgctcacttattttatatgtctatgattaatttttctcttttattttacgtatttgttaacgtgttttttcctgcaattttacgtgtttttctgtattccaatgtgttttacaattaattaacaataagatgttttttcgtgttttacacacccgaatatatgttcacgtgttttgtgtttttacgtatttcactcattattttattcaatcttccaacattttcatttatatttaataacaattattcatatctctatgtttacatgtattttttgttccattttcacgtgttttacatgtcaatgtttatacctatatcttttttgacttcttttacgtgtttatttgtttgttctaatttcacttgttttttcttcgttaccattttactattatactaacaacaaaatgtgtatttataatgtttacacgttcgctttttatttaatacatgcattttatcaggcgttcaaatatgttttacacgtccactttttacacaatactaatatatatgttcactgttttgctttttgtttttacgtgtttggctaacatttgtttatttatatttcttagttttcatgaatatgcataacaattatttttatgtctatgtttagatatattttactcatttcttttttcgtgttttcgtgtttattaggtctttttcacgtgtttttctgcattccaatgtgttagctattaaattaacaataagatgtgttttcgttttacacgtccgctttgtcatattaattccaggtatttgtctcgcctatgtttacgtgtattattgtgttttacacgtccttttattgcactaatatatgtttaagtgttttagctcatttattttattcaattttcctacattttcatgaatatgcaataacaatattttatgtttttgtttttctcatttatttacgtgtttgtttgttttattttcacgagtttttcttttttacattttactattaacaataaaatatgtatttacaatgttttatacgtccacttatgttatattaacacaaaagattttatgtgttttacctgtagttttcacgtgtgtttgtttttatgcgttccaatgtgttttacgggccagctttattatatctctaacattgtgttttcacttattttaacttggcttgttattcaattgtttttacacacgcgtttttatgcgtcctatgtttttatattatttgtgtgtttttattgtcatgttttggtgtattttttacttacgtgacttacatgtgtttatgaatagtctctgtaattttctttgaacagcacgtttcaaccgcctccctttggttcgccgccaccacatgcttcggccattctgccaacgtcacaaatgaacactgcgcaaaatggcgctgcagggcttttatcaaatgctttgatgttaccgccgccgccaccgtccgcgttccatcattccttggcattggcaaatccgcaatgggcatctttattcaatccctagccttggtcaattggtaca

SEQ ID NO: 6476 - DNA, 1088 bp, Heterodera glycines
aatcatgcctataaagtttgttgtgatttaaaaaataattaaaacttgcattgaatattttcttaaatatttttattcaatttgaaaaattaaaaattttttttttttgttttgcgatacatttatgaatattctcctttaattcataaatttgtcttgtttttcatggacaatgaaaccgttcttttattaggcggagatgaatcaaattttgactgatcaaaaaaagagaaaatcacaaaaaaccatggctaaattttttgaaaaaatccccaatcattgtttggaaaataaaattactatccacttattcatcacccacatttttaacgatttaccaggtgacggtccgactgagcaaagatggcactgagcacaccgcgcttggtccaacattgactacagccaagcaaaaagctgccactttggcactggcacatcttcgtcccgagttggagcagctgaaactcttgttaaaggaggcggagggcacagaggaagaaaaacaaattgtgccaaaattggtgaccaaaattgatggcacagatcaacagcagcaacaaaggcaacatttgttgggttgtgatgccgcatcaaaattccatcatttatcttcatcatcaccgactgatgaaatggatcaacagcaacagtatgatggactcaacgatgatgatgatgaagaagcagtagcagcagaattggtcgaaccggtgccgctggaagaagcggaaagttgccgagaagagcggcggcagagtgccaacaaaaatggcaagtgctgccaaattttgatcaagttttggtatcattcggtgcagaataacaagttgttgaaaaaagctaattttaactcgaataattaaaatttaaaaaactgatgggcaaaaaatgaaaaatcaaagatttgtccaaatcattgatttttaaaatcatatgacaaacattcgaaatatttcagctgatttggatggcgatgatcatgttggtgatcagcagcagaaaattaatgcaaaatttgctgtatcgactgttgatcacatcaaacagggggaacaacaaaaatgaatcagactctagaggtcccc

SEQ ID NO: 6477 - DNA, 1695 bp, Heterodera glycines
taattctaacaaaaatatttatgataaaaaataataaaaaaacacataaaattattaatgaataataaaaaaaatttaagcaaaaataatgtaaagttttttgactatatggcataaggcaaaaattgaaaaaccccgaccccgaacgatttggcaaccccgatcccgaaccccgacacttccaaccccgacaaccccgaaccccgaattttccaaccccgacgtcggggttgcaaccctagtttaaagaaaactaaaattttattaagaaagaaatcacgatttttaaccaatttcacacattctaaatcatttgttcatctcccaattgttttttccaattttcaatgcttttaatttttaacaatttggcaatttctttgtcattcattttatgtcattctttttttatttgccaatattttttcattttttccaatttttccttctccgttataaatttactcattccaaattgtttcttccatttcttaattactgaacggctaactccgattttcttaccaatttccgcataattttgttcccattcttttgccgaaaatttcttttttgttaaattcattttttcgctaaatcagtagagttatgatgcttcatataattttttaaattagaaaaattcatttttattcccaaaattgaatctgtgaacaaaaagtttcaacaaaagtcatttggcgaaatatttggagaaaaatgggaagaaaaaagagaaaataattgagaacagcaacattcttcggcgtaaaatctctttagatggtagtgaattctttttatttttattgaaaaaatgtttatgatttttgagtgagctccaatagaaattaattaaactttatttaatcaaattattttccaattggcaattatttggtcaataggataaaattattattaatattcattgaaattaaacaggatttccttattttatgagttaaatcagtagaattatgaattacgtcagattttaatcagaaaaattcatttatatgcctcaaaaaatgaattgcgatttaattgaagaaaaaataaaatcattttaagacgacaaaaatgaaattattccctttattatttttaattatatttttaataattgtcaaaattgaatcagaaaagaaaaagttacaacaaaagtcatttggcgaaatatttggagaaaaatgggaagaaaaagaagaagaaaaaagaaatgaactcaaaaaaagagaaataattgcaaaattttataaaataaaagaaaaaataaagcaaaaaggacgaaaacattcaacaaaagaatggaataaaattaattcaaaaatagcgaaaaaattggggacaaatcgaatgaaaatttatgaatggattaaagaatatggtcttcaaaaaaagaaatgctacaaattaagaactgatgaagaaaaactcgcaattgtacaaaaatttaatgaaatggcaaatgaatttaaacaaaacagaaaatattcaagaaaagaatggcgacaaaattatgccgaaatttgcaagaaaattggagtaggccgtgaaacacttagaaaatggaagaaacaatttggcatttgctgcaaaaaaataacggagaaagaaaaaatggaaaaaatgaaagtttattggcaaacaaaaaaagaatatccaaaaatgactgacaaagaaattgcaaaa

SEQ ID NO: 6478 - DNA, 5010 bp, Heterodera glycines
  misc_feature (6)..(6): n is a, c, g, or t
tatttntgtggtctaataattgaaaatatgtgaaacccccccagcattcatttcaatttcttgaaaatttaaatttgctttatgtgaaaattccaaatatgtaaaataatggcattttctataaaaaaaagttatttaatatacataaaggtatgcttttaagtataaagacattaaaatttcatttcataatcaaattaaaaagtaaaattttcggcaaattatcccttagaataaacttttcatttttagtcccaccacttgttcaaaatcgcgaaatatggagataaaattgcgaaaatctcaaaatggacataaaatggcaaaaatatggacataaatttttcaaaattaggggtacaatttcttaaatttcttcattttcgctgaatgtaattaaaattttcaaaaatgggaaatatggtatcaaagccattttagaataaaaaatacacgataaagccaagatttactcatttttagcgaaaaatcaaccggaatttttttgcttatttttgacatttcaaaaagcttttgattctgtccctcacaatttactattatataaattagaaaaaattggtattaggggcaaacttttaaaatggataaaagaattcttaagtaacagaatttttcgcgttaaaataggggattcattatcctctataaaaaaagttggctctggcgtcccacagggctccgtcctgggtcccttacttttcttaatttatataaatgatcttcctgatgttataccatcaggagttaatattaaattatatgctgatgatgttaaaatatatatatgctataaaacaagatctgaaattgaaattatgcataaaacattgcataatttatttgaatgggcaaataaatggcaaataaaagtttcagttcaaaaaacttttatattatatttgggtttcaaaaacccaaaagaaacatataaatttgatgggaatacaataaatgctgtggatacaattagagacttaggggtaaatatcgataataaattactgttttctgatcacattttacaaataacaaagaatgcatattcacatatacgatccttgtttagaataataaaatcaaaatcttcaaaaatttggattattttatacaaaatttttaagccatctggtcgctttaactccccctcttatagacttaacacaaaatataacaaaaaatatattccatttacgtgagggcaaccaaactgtggaatcaattagataaagaacttgcaaaaataaattcattaaaacaatttaaaacaaaaatcaaaaattctttagagtaattaaaagcaggactgaaaaaaattttttttaataaatagttacataagcgattcgataattttgataaatttgagccgctttgacttatctttattttaattgtgtgacttgtgatctctcttttaatattttattcattttttattttatccgaattacttttggacaattaatttatacatatgttgtccacaaagtaagcggattttcccttttgtggaccttttctttattgaataaataaataagtaagtgaaaaaactcagtgaaaaataatatagtagaaaaaacttatatgaaaaatatgtcaatgaaaaatacatcagtgacaatacgtcaatagaaaatgctttaatggaaaattcgtcaatagcaactttaatgctaatattaacataacaaatttttcccaggcggcacttatcggcaccgctggactccaaaattaaataaaatgccgacgctaatttaaaaaatcatttattctggtttttatataaaaacgaaaggacgcattgatttttaaatggccattgccatgcaactaatggatacggtaataatgccaaatcaaatcttaaggtatcaaaaaaattcccaaatattttcggctttgacttgaaaaatgacatactttttaatacagcttttagaccggtttaacattagtttccaaataatgctgaatcctgtcaactgagattttaccaaaatcgttaagattgaccgatattagacaaagttacgacaaaaaacactttgattataaacacatgcatcatactgtatatcagggatgggccaaatcgaatgataccgaaccgtcgcacccagtaaaaatggtgaggaaatcactccaaatggtactcttttaaaacgtagaaccaaaagattttcttgtgtaattggttttcttatatctcttacccaaaaattttacaaattctctgtcttcctcttttaactacaatgtccaaaatgctcgttgaatatcagtccataaagcaatttttggtattcgtgaacgcattaaaagccctgggagctgtggcatttcgattgggccacgaaaaagcatgtcatttaggcatttaccactcctttttttgctgagccatcataaacaatccatggctttatttcccggtgcgaagacacaatgatgagggagaaaatgttcgccaaaccattttattgaagattcttcgacaatttgctcttttaaattttctttaaatgactcttccaacgctttaagctgacttggggttactctcattttttctaacatactcattaaacgccggtatgctatggcaaaatttgttggtaattcttctttagggcttttccatgaccaacttaccatgtatctcccattttttcgttgaaccgtttctttaaacattttcaaggcaatctcatcatccttctcttccgggttatcccatactcccatagtttctaaattccaaaattgttttggttccttattctttacactgattgtggctgttatattttcaaataatgattccaatttacccgaattatttttcatttgaccgcaaataatagggccgactgatgtgtctaccttaaacaaatttcctttaatgtgttcgacccctttaaagaacttttccaaaattctgccataccaatcagtatgtcaggtctttcatcaataacttcagttttgcccgaatcgatgtcaattctcttgagtttacccgtaatctgatcaattctgttgacaattaagctttctctttttccattacttaattctagctgtaccaaatattttggagatttaattcgagttgatgatgtctctctgcttggcaacaagtctacccatttcaattctaggtggactcaaaattctaattaattcgtcactgataaacggaatttgacttccaccatcaaaaatacagttgccaaaacactttttcctgtattaaaacccgaataaatctttatttttttagtcattaatatagtttcttttttcacattattcatcctggtaagggcgaccaaatttacgtttcgtatttccgtctgaaaacgattctgactttgtctgttccccaaatcggttgcatttgtacctgttctgaatctgttttgacctcgtggacagattgccttatggtgatcttggtgagatatcacacaatttttcccatacaactggtcatttcgtgacttttcttaaagatttaaggcatcttccctgctcattaatgattttaagcagtgcttctctgccaactatctgtctgcaatttgctgcccaatgtggtctcccacataagaaacaattcggcattgtccctgtttccctcatatttcttcggtcattttcttggaccgaaaatactctttttacatcgccgactctgttataattatttggtctgaaaccatttcctttgaatcgattattgcttttttgtatttcttcaaatctcttttgagcaaataaattagggtttaagcttaagcttctcgtacagcgcagtgcttcttctcttaatgatattacttcgcttaggcactctctccatctcgaaaccttccatttgaatcccgattctttttccttttttaaaatttctaagattatggtccttgttaaattatatttttcactgccagtaacaaaaattcaccgccttcttccttcatgtttttccaaattatgtattcgtctactactacatatgaattctccatagcaagcattgagagaaattccataatactcttttgatgaagagacaaataaaactatatggattagaaaaaattccggcaccgtaaaaatgttataatttattatcttggatgcttggaatgtactaatttttcgccactatttgcgataatttcgctttttaattaataaatttgggattttttgcgcttaaaatttgcatccgattgattatgattactctcaaataaggattaaataaaatttttgtgatttgtagtttgtttttattaaaaaaaatccaatttattaatatgaaaatcatttcacgaataataaatgcccattcattcataaaattaaatcatattggattttattaaagaaatcatacaacattttgagaatattttgaagaaaatgaaattattccctctattattttgtttaattttaattttcattgccctaattaatcaaattaaatcagcaaagaaaaagttacaacaaaagtcatttggcgaaatatttggagaaaaatgggaagaaaaagaagaagaaaaacgaaatgaactcaaaaaaagagaaataattggaaaattttataaaataaaagagaaaataaagcaaaaaggaagaaaatattcaacaaaagaatggggaaaaattaactcaaaaatagcgaagaaattggggacaaaacgccaatatattcaaaaatggatcaaagaattggggcttaaccaaaataaatgttataaatcaacaactgatgaagaaaagttagaaattgtacaaaaattcattgaaatgacaaatgaatttaaacaaaaaggaaaatattctttaaaagaatggaacaaaaattatgccgaaatttgtaagtaaattggagtaagcaaagggacaattatcaaatggaaaaaacagtttggcattagtcttaagagaataacggaaaaagaa

SEQ ID NO: 6479 - DNA, 1238 bp, Heterodera glycines
agctatatttggcctaccgttttgtcggtccgtccgccgatttgattgtgccggccattgcgctgtatttggttgtgattgttggcattgtgttgaatggcactgttttggtggtcactgtcaaatccaggaaaatgccatggcatttttaaacccttaaatttcattttgaattatttccatttttcagttccctccgcggctccgccaattttctgatggcactgatttgtctttgtgaagtggtccaccaaactgggcacacttttttcttgtttgttgtcatttcgggcacaaattttgtcagtttgctcaccgctgacttatttatgacggtaaattttgcatttttcaaatttaatttttaaattttccattttttagccaatgatttttgctttgaattgcggcttaatggcaatgttttgtgctgcttttgatcgactttttgccgtcatttcgccttttaagtatgttaatgtatttttattgaataaataatttatagaactgtcatacaaatataatataaaatttttcttttctttttttttaattccagtcataatgccattttcaccaaatacaaatcactgtatttgcttggtcatctgtttatttgcacaatttactcatcatttattcagtattgtgtgattgtatatgcatatgaaaatgcgggaaagtatggcacaattaaaatattattaataattgagtttcaacccgtaatcaaggcctgggtttttcctggacctggattttcatatatttttgtccaagataggtccaggcccaggtcaaataactaaaaaaaaatctatgttcagttcaaggttaggcacgaaaagtctgggtttcctggatacttttgagcatttgtcatttcaaaaacaattttgatttcaatttttcaaaaaatgattaaaataaatttagaaacttttattttcttttaaaaataattaagttttttaaacatttgggttactttgtaacaaatttcaaaaaaaaaatccaggtaaggcttgagtccaggatctggactccagatcccgacaagcctgagttttccatagacctggcattttgtcaatatattcagggcagcaggccaaggcccggcttttttaaatgtctaacctaataaaattttgttttttagtccaaccaccggtgtcgtggccgatactttgcatggccctgtcggttatatattcttggcggagcatttgtgg

SEQ ID NO: 6480 - DNA, 1915 bp, Heterodera glycines
cataatcaacatttgattttttaacaatgcagttctgatgaggaaattttctgatggcatccatgcatttaagcgaagcctctaaatattataggcctgaatatggtacctaattccttccataaaatgagttgcatttgccattgtcccgtgattttagtcccaaaattggggtatattcccaacccgtgattagacgaaatgtgaaaaggaaagggccaaaaaacgtatttttcttggctttttaaatttgtaattgtttgccacataattagggacctaattaaataattaaaaggcatttaaatttgttcaagtgaaaccattctttgaagacgctgaatcgaatgaattggcttttgccggcatttttagtgtcactaatttgcagcaggcatttcgcttttacatgctttcgtttgagaaaatgagagagagggtagttaaaaaatacaagaaaatgatggatcgtaaagaaaagttagctttggctttcgaatcaaaaaaatgccgggattatttcccgaaccgaaaacagctcggccaaaaaaacacaatagtcacatttttactaaaaaaagagcaatttcgatattctccttttcaacatgagaagtcaaatgagaagtcatttttgcgcgacagaaattaaattgtcaaattttgaaaagttttagagaagggaatggcgaaagtatcaaagtcagtgcccctgttgttattcgcattggtagataaatatataattacacatacttttatctcgtagaatatcaaaaaactataattaaatataatttggtctgtgtcctcttatcaatgttaagtggagcgaataatacgccaaaatcactttttgatggcaaaatgaaagtgccctttaatttattcgcctcttttaaggacccaaaaattcccttgagttcaaaactggccagaaaatacaataatacaaagttggtgtaaaattaagccaattaaaaataagaaaaacaaaacaaatcaaacgcccatttatcgcatcgcaaaaaaatggacgcgaaaatcattggcagtgaaaaggtgaaaactgacaacgacaaaatgggagagatgaggaggaattaatgaagagaatgggaatgaatttgatgatgcggtgacacgggctaaattggcggggggagggcgatgggacagagagtcattaggacgaaaatgaatggacggaggagaaaagtttgaatcgattaaaagtggccaatcaaatgccaaaaatattccgaaaatagcaaaatgcaaaatcaaatagggaaacgcggaattcaaagattgatttcattcacaaaaaagagaggataattccacctattaaaaaatagttattgatatgaaaacaaataataaaattaggagaaattaatcaaaaaagggaaaaaaacaaatcacgatttgtccaccacaacaacacaaagtactgatgatgaacgcgcaaaatgtgagcgaaaactcgtttcttttctaaaggctgtttgtctgtgagttacgcacgtcattccatcaaatggaaaacaaattattaattgaatcaattaaaatttaattgaaaaaagggagagaaagtgttttgaaagtgaaaattgaaagaaaaacaataatttttaactaaaaacgattaaagaaaggccgagagttttctcgagccgagacggcactctcgagggtgcgatgacgatagtcaaaaaccatcaaatgataatttttttttaatatattagggctatcgaatggggtccacctcgtttgggcgcgctcgtttgggcgccagcccaagtttctggaatataacttttttctttgtaaaccaaatctaacattcttggtgtcattcgaaagcttaacatgtttagaagctttttctaagctattgcttagc

SEQ ID NO: 6481 - DNA, 5511 bp, Heterodera glycines
aaaaaagtggaaattttagaaattttttcttaataaatttttttcaggcttgaaaatctgttcgccttttgtaaggctaatagagcatgtgaggagctttcgaatgataccaagatcgttagatttggtcgacaaagaaaaaagttatagcccaaaaacttgggctggcgcccaaacgagtgtgtccctatcgaatgatatcaagaataaaaatatggttcattttgagcgaagtatgtcaaaaattttccatttgattgtttttgactaacttcccagcacctctcgaatagcagcaccccaaagggcgaacgaacacagcctaattagcacatattaacccccatttattggccatccgccaatggttttcgcgtgaccacaactcaccatcattttgtggccaatttcgactcgagagcaatgtttgttggtcttctcgcgttacacagcaaatggaggcacaaccgagcggaggagcacagagcggcggggcgtgtgaatgtaattattcgctgctgctggagggtggcggaattttttatttttgccgaaatcaatggcaaaaatgggacaaaaatagaggggtataatttctagtgttagtggttggtttgaaatctattttttataatggggggagggcgatcagcagaccttttttgggttacacaattttataaaaattttcatctgttcattgaaaaaatatgcaattttgttatctttttaaaagtgaaacaaaaattttaaaaaatttcgcgacaacgaagcccaaacgaaaacataaaattttaaaaagaaaatttgacggacaaaatttgagtcaatttattaacagtttttgtgcaattttcagttataaacataataatttatttattcttccattttttgactttgaaaagaaaaacgaaaccaaattagacgaaattcgtggaaccttttatccagcagggccgatatttggtggaggagaaaaattttgaaatttttaacaaattaaaggttttggaaatttaactggaaaatagttgtaaaaattcgcctccccccccccccaatatttatttaattttgaatcgcagtagatttggattatgttgtgagttttattcaattaaattttttttttcatttattcaccaacttccccccgataatcttctcatatgattaatcctctctttcattgaacaggttttttcacaaaattcaaaaaataaattaaatccattaaaattattcaaataattttcaataaaatattggaggctaaaaaataaaaactataaaaacaataagagtcgaattttgaattgtgaaacgaaatttgccacttttaaaatgaaattctcaaataaaataaattttaaagaaaacaaaattgttgacaaaacctgcaaaaatgcttactaaaacataatctatgcaatgtgttgtttgttgttggtttatgtcaattaattatgtaataaataaaagttaatttcaaagaaaaatgaatcgaaaaataatggacgaaaataggaaaatgaatggtgaagaatgattgtgcacattgtgctatttttgtggggttatattgcagaagatgcccatcgaccctcattacccctcattaccaccatcatgagcggaatggagagtcgtcagtccatgctccagccatgtgattgatacacattcacgagcaaagaacggcacaaccaacgattgattttcatttatttttattacttataattagatatttttataaaaaaattattattcatttttatccaccttcgaaaaccgaagcaacaagaaaactgctgaacgtgcttagttgtatttttgcatggttttgaagcgaagtttttataaatattttatataataaatagaatatatgcagaacttaataaatctagtttaatatgaactttaataattagtgttttaatctcaagttgagataaagcatttgttggaaattggaaaaatttttatttgggcccaaacgtgagggagggcccaactgacgtagaccgcggtgcaaatgtccaaaatcgaattcaaataaaatgttccatgccctgaactaccaaattaccagacacaaccactttctattactttaggttataagggactgaaaacatggacataggcgcaaatgtcgggtaacccaaaactcactttatatttacttttgtcggtcccgcaattctgcagtttgtccataaataaaaaccttagggaaagggttctccaatcgtgttttttctgggtattcttgtgaatacagtgatcaaagaaaggaaaattatgaataaataaactctggatttttgtgcaacaaaagtgatcagaaaatagtaaaatgaatgtttgttatttaatggtactttatgtaatcagaaagcgcagctgacatgtgcttaattcccgtcccttccgtgctttttatgtacttttagcattagccaataaaaatttttaagtttaatttaacatctattaaacattcaagcgacacgaatattaaaaattttttacaataagaaattgaaaaagtttcaatagaaaataacaaaaaaaaaaataaaaattgtaaatatcaatgatcacattcacgcataaaagtcaaaatgtctttttttgtgattattcccagtaatcggccgttggaagtgaccatcgttgttcgaagactcaacttcctgaacatgtcgatcactgtctccatgggtgtttggtcggctactgtcattggtgcctaaatgagcagcgatttacttcgaattttcttgacaattttttgagaagacccgaagtgtttttataacgtaaaagttacaacttatgtcgaaatggagtcaaatttccaaaaaataatggtaaaatggggtatggaggagccgttaaagcctcctgaatttttttttttgaaattttaatgttttcatttcgggcccacactcactcaccacgtccataatgtggccaagttgcaggggcgcagatacgccagcggcatacgtcgacgcagccgtgccaatgtcgtcggggacgaaggacggagacggtgggagaactgtagcgccgccaccgttgaggacagtgccgtcgtcggccaccaaaaattgcggagggagcgattggctggcgaggcccgcttctgtggagaagtgcaccgtggaattggtggtcacatttggctgcattttgcgtgcattcctcaacaccaagctgagatccattctgaacaaacgggaaggagatgtgtgttaatcacttatattaatattaaacaaataaaatgaaaaaaaaactaaaaaggatgggagcaggtccatgccagtgttatttttcaaatttcagcgccaaagcgaaaaaataggaatttgtggcggttttacgccaaaatggcaaatttttgtcattttagggtaaaaattttcaaaaatatggtggggtccggtcgtccggtggtgccactaggagccgccgagattgacaattttaataaaatatgttaagaaattttgcaaaattttcaaaaaaataattacataaaaccaatgcaaaatgattaccgtgtgcagaagccaacgacgagcatttcacgctggtcgttcaccaccggaaatccgttgcagtttgtgtcccggagcaacgtctccaactcgccgactgtcattttgtgctgttcaatcagtcgcatttccgcgctcggccgcatcacttggcccgcaacggttgagtagggatactcgcctttgttgtccaggaatgggtagccgttcagctcaatgtgtgcgtcgtaaataccctgaaaagttaataatatataagggtccatttttaataaaaaaatattcaaatgataattttttttagtatttttagagtaacaaactaatggaatgaatatatgcttttttgataatcaaaaataaaaaaatacagaattcaaactgtaataataataataacaacaatataaagcaaataaattcccattaatttcccaccattctgtagatggcgtcgcctacccatttggcaaacatcaccgcagccattgttggcacaatgaacctgaaagcaactaatagcattgtttattataccatataaaaattataaattagcgcattaattgtattttttaatctttttaaatttcgccattttcactcactcgagacttccggtcagctcaaacataatgacaaccagcgaaacagtcattctgaattcataaattaagagatacaatccaattttttttacaattctaaaatgtacttaaaattcccagaaaaaaagtcaaaactttcacaagttcctaaaacaataaatatatatatttttttttgatgggatgacggggtgaatggcttgtttcccaatacccaccgtgtgacaccgcctaacactgcggcagcgccgaccattgcgtacagcccgggcatggcacaatcacggccaatctgacaagtccacagctcactgttcgggtaggactgctgcaacgcgtaggtgagcccttccactttgatgccgagcagacgaccagcaatggcaccctgaaaattgaaaacccaattaaaaatgtcattttacaataagttttttttgttaataaaacgggattctttaactttataactgaaaaattcaaaataaatttatatactttcccgttttgtgcctatcccttaaaatattgaaaattgcctcaattttgggctaaaattgatcattctttctaaaatatcgacacgctctttcttttgtgcttccgtatgctgatgttttaaattttgagatatatttaaaaaattataccatagccaagctgggcacaaaaagacccgacggcactttgacaccaaaagtgaaaatggtgaacaacagtttggcaaaaagtgccatgatcaattgaagaaaagcggtctaaataaaaaatgaaaccaaatacgaatggtttttgttactcgtcatttacatgcaatccgttgccgagatcaccggtgtggtaattgtcgtccactttgtccacaacaactccgtacgtcaggtttcggttgtaatcgcacaaatccatggtgtagtcctcgggaccacatcggtcaaacaactgaaacagaaattgcattttgaaaattcctccgtacggattgtccgccagcaatttaattattccaagggattataaggaaaagaaacaaaaaggggaaacaatgggagcagctcgatccatcccggatcgtttcccctccgagaaataaaaaaaaattattagcttagaaaatctccaagaaaaaaaatatcttacaattagaaaggttttatgagaaagttcttaggaaaaaaattttcaaagaattttaagcgatttttttttgaaaaatctcaatcaattatttgttttcgaatcgttaaaaatttagagaaaataaaggctaaattttgaccaaaatggaataaaggtagcaaactggtcgctgcttgcct

SEQ ID NO: 6482 - DNA, 1717 bp, Heterodera glycines
atcccgactttgtccgtgcttcgcttgacaaaagtccgcttaaaattgtcccccgtcgcccctcaatctccgcttttcctgtcgatggttgcaaattcgaatacaacagtcacaaattacgcttggttatcgaatgttccgaaggactcatcgcattgaatggcattgagaaggggcagaaacggactttgcgatggcacaattcgatcagagggcgaatttgatcaatctgagagagaaaaacggcaaaatgagccaaatttattatttattattccatcttttgtattgaacattcatagtaaatattactgaataaattgaagcaaatcgtcaattgattgacccatcattaaatttttccattaatttttttctttattttgcctattttatttttccattgctttttcttttaccttttttcgccaatgcatctttttcaatgtttgccttttcttttattatttttgccgctttttcggcactttttgaacattcaattcgccgtttcatttgcttctgatcagtttctttctgagagttcgtcggaagcgaaccaatgcgaattttcacttcaaaaggtcccaggactgagcccactggtgaaaactgatcggaacggacgtttgtgccgaggagaagtcaaattgccattctgtcggggattgtgcaaaagcaaagaggtgggcaaaggacggggagggagcttaaggagcttaattcctttcccaacactttgtccacaaattgcttttctgtggcactgtgtatttgaatatttctcacttcgtttctttgtttttagtccggtacccatgcttttcctcaccgcgaacaagaaggtgcggtgcgttcgtcttccttttttgattatcattttatttcaacatttttggaccaaattcagcatatttttgtggcattgttactgacaatgcgcaaatgaaaaatgtgactttggacgaatgtgaggagggcgcggacgaagaagcgcgcctcgtgcaaatatccaccgcaacggaatgcaaatgcatcaaaatgacataatttcccgtacatttaataaagtagtttattttaattgattgaattctcaattaaatgcttttgccctttgtcgtcgcattttttcaatttaaaaataaatgacaaatgcaccttttaatctcgaaatggcaccttaatttccaaatgactgataaatacaatgaaacataaagcaatgcattttaattgcattgagtaatcgacgctcaattcagagcgaatgaatttctgacattttggtgattgttggccgaggagaagcatttaaatgaacattcaaaagcacctttcaagtcattaccataacaaatgggattgattaattgttctttgttgaatgcctaaattattcatttttattttttaattttttttattcattttaattaaagatgcttttgtctcctccactgctcttcgtgctcagtctgtgttcattgtgcgtctttggccataaaacgccgaatgcgtcggatggcccggcaatgccggaactgccgaaagcgctgcaaaagctgagcgacgcggagaggaactgtttgttcaccatttacacaatgtccaaactgttcgagaacaaaaaggtgcagaaaacgctggccaaacaggtgaaattggcaaatcatttaaatttgaaaataaaatgccaatgctaaagttaaagtca

SEQ ID NO: 6483 - DNA, 4793 bp, Heterodera glycines
catttaaattctgaaaataaaatgccaatgctacccttcctttcatgcgacagcaaagacacttctgagccggacatttcccaagagtcgggagaagagcaacggatggtgtgaggtgaacttggaaaggatcgacaggtgaagcggaaaaagagcagcacttaattagctgtaattaaaagacaaacaaatgcatttttcaaaataataacagcgaatatggccccgtaattatgcacgcccatggctcaatcgcctctatcaacggcgcccgtctatttgtgaagtcgacctcggggggcatttggatagcgatttatcagccggaatgcctaaaagagaaggatgagtcgaaaaaatcggaggaaggtaaaaaaacaatggaaatggacagccaagcgaaccgaattttggtccgggtttttggtctttctccttttttggtcattttttctcggataattaattggtcaattaatttatttgtttgatttgtcaggtgttgtgagcaacactttggaccgagtccgacgttgggttttgttaaaatgagaagaaaaggaagtgaaagccgacggaccaacaattataaattaacagacaactgctaatgatcaatgattgattttaagtgtaaatttgtttcaattggttttttaaataaaaattattttatttttcttcaaaaatgtttttccatttgttcaaaagtcttgtttgtttgttttccttttatcctttcattttactgaacatgcttttccattaattgattattttttcccaatttcccctcattttcagttaactcttttaaattcaaaagtgtaattagtttataattaattgcatattctgctaatgatggtaattgctcccttatcaatgccatccaatcaatcacttattattctgtgtttatttatgggaatgcagcaccatcctacgcactttgattctttttatcatttttaatttaccttcacttatctttccatctttgcctttttttaattttttcaccattttaaaattattttaaattaaatttgttctttttaattgcccaataatggcattattcgctaattttgctctctccgcttccctcgcttttctcgctttcgctgtttggtttaattcgagcgatttcaaaccaaaagaatttcagtaaataataattaatatccttttaattttcaatttggttcccatttttaaattcgtttcccttttttagtttgccccctccgcccgctttggtcggtcctttggctccaaataaaccaaaaattttggaaaaattattggaaggtcaaatttcgggccccgaatcaattgttatcgagaaaagtaaagaatgaattaaaaaatgaatcaaattaaataattcattcatttttagatgttttatacacttgcacaaccgacggaaaatgtgtgaaaattgtggacggaaaaattcagaaaactgtcccaatgacgggacataaaaattgtgacggtaataattgaagaaatactaattaattaaaaaaatatattacaaaatacatattcgaggcaagcgacaaaccttgccatattgtggccgtccgctgggaatccgtcgttacaatgccaatttattcgtcgttgccgatgccattttgggaatattcgttgtcgatttcgaaaagggtgaaaggaagttcgaattcaaattccaattcgaatttccttttctaggctcggccgagttgttggtctccagttccaagcttgtggatggcaaaaggctgctcttccccgacgacttggactttgtggacaacgacaccattctgttcagcgacgcgtccactcgctttggcatttccgattttctgctcgcttttatggaacacgcggaggatggccggtgaaactttccgatttttttaaagacttgtaataatgttcttttgaccccaaatttcagactaattgaatataaaatttcgaccggacaattgcgcgttgtcgctgatggcttaagttttgcgaacggagttcaaattcacccggacagacaggtgaaactgaggaaaagcccctaattggcgaaaatgaatttaattattcagtcggtccttttctgtgaaagtgccaactcgcgaatccaacggtcacttttttaccattttgaatttgattttgtgcttttcagcttttattatgcgggcccaaaaaagggacgtcaagagattttcgtagacaatttgccgggctttcccgacaacattcgcctttccgccgcccgtcgctccttttacgtggctttgtttggccaccgcagcaaagaccttccggacgcgttagattggcttgggccacggccgtgggcccgtaaatttttgggagaggtgcgtttaattagactcattaatctatcatgcaattgtcttgctattagctgataatggcttttcccgcatcgttgcgtcgctttgtctattctctcgcgccttatggcattgccttggaaattgacctcgacggaaacattttgcgctctttccacgacgaagacggcgaagtgatacagcgcatttcgcaggtaaagccaaaaaacaaattgacaccaattaattaatattttaattggcggtttaattttgaatgtttggcttttaaggtgtgcgacgatggcggagattacctttatttggccagttttgaaaatgattacatcggccgtatttccaagaaaacggaataaaaagacgcaaaataggtcattcattcccatagttttcgcaatttcagcttttctcttaatttgcagtagtaatatacaatattttaatgtcctatcaaaacttttgtcattatttccttttacaagcgataagaaaagcatttgttgtagtaaaagttaaattaataatttatttattattttaattgattttaactttttgttaaatgtgcttaaaagagacggacaaataaattgcggacccacccaatcagtgccattttaaggtgtgccatgttcatgtaaattggagtattattggtaatttcttaccactttaacgaagggggataaaatataaaaagaaagaatttatgcgacaaaaaatgttcggctaatttcatcaatttttccataggcaaagcaaacccttctctaaatgcccccctcttttagcccttttgctgtcctcctcccccttctgtgtttctccgtttgttttggttttgttttagaatgttaagttgtttcattttctatttcgaatgtttgtttgcttaattgtttttgttttgtccatttgttaaagtatttcccccggatatccccccccctcttttttagcttttgttcattgaacttcaattagtttgcccaaaaatcaggcattggtatggctacaaaatttatgcgaaactaaatttgtcactttaaaacaaaccaaaccgaaaaacgagaaaattgatgcggtcattcgcttctgtcaaaaacataaattaattaccgctacacatttttacgcttttctttctgctgataaatcagtaaatgttaaaatttcgttttttgttttgtcaaatttttgcttgcattttttattttattttgtatttttttgtttgttttgttaataatttgctttccatttcctttcggttttttgtttatttttttattttaataatgtaaaaataagaaaatcaaaataaaaaatcaaaatttcatttcaaattcatgctcaattagaaattgaataataataattattattataataatatgataataattatattataataataataatcaatcttatctatttttttttttgctatttttgctttctcattcgatttgctaagctaaactcgcttcctccaccatttattccatttatttataattttctattttttccattttgcaaatggtcgctgtttcgcccctctcggcccctttttcctcccctccgccctcttccgcttcgtcttccgctcgtccgtccctcgtcccgtccctttccgccgatgtccccaactttttcctccgatcggtcagttggatttgctcaatcggcggctttttgttcggatattcggcttctgtcatcaacggatcggtgttttattattgcatttattttctgattttgatgtatttttccttttagcttatgtttatggaaagagaattgggcctcaattcgttcaccaagggggtggtgacaagttcgatcattgtcggcgctgccattggcgcgccgatcggcggacatttggccgatcactttggccgaaaaagggtgatgatcagtcttgacttgctgttcattgctggggtttttgccaccacgtttgcgcctaagttttgggtattttggtgttagaaacttttgtaatggtcttttcatctttttcaagtgcctcattcctttccgtgccattcttggctttgccgccggagggcattgttcggtgggccccgtttttctggctgaaatttccacgcccgaaaatcgttcacaaaatgtgactttgaattcgctgttcatcgttttgggtgaattggtcgcttttgctgtttgtgcttctctcggcaacattttcctacaatatgtgtggttctaacacaaaattaaaaagtcatttccattaaatattttatatttttaagcgatttaatttggcgatggatgaatttggtcgttgtgttgcctgccgtcattttgctgttttgtcgctgccttttggtgagggagagtcctccgttggcttgtcggagctaatcgcat

SEQ ID NO: 6484 - DNA, 2068 bp, Heterodera glycines
tgattggtcaattcggcgccatctgctcccacttggccattgtcgtttgtgcgcaatgcattcccgaagggccaacccgcgcgtgggctattttgggatgccttttggtgtttctcgtctttttccaggccagcattgggcccgtcacgtggtcagagttttgaaaaagaaaagaggggagaaatttaaagagaaaaaaggagggttttaattccaaataaattggccattagccgtggaattttaccctaaaattggtgccttctatttgccaactattttcgaatttctctcattactgagttcgaataatgaaaatgaccaaatgcccatcgacccaattaaaatattttttttaggcttttgcttgccgaaattttcccgcttgaaattcggggaattggcatgggtttgtcgactttggccatttgggtaaggaaattacgaaaatattgaaacctttttaaatatgaacaaaaaattcaatataacacaaaattgaaatgataacactttttgccaaggtcacgagattctgacaaaaataaacaaataacccgaaaatggactctttttttgataagactcacaaatcatttgcttttggaagtttaacttaaatatttaatcaattcctttttgattttgtccaaatgttaatttgccatttgctaattgaggtcactaattgtgccgaaggcctcctctttccgatggcattggatcagctcggctaccccggcacttttctgctgttggctctgctcggactgtttgccttggcatttgtgtggcgttttatgccggagacgagacgaaaatcactggaagaattggagaaagaattccaacacggcgattggcaagcactgaaaaagccgggtgaaaagcggagaaatctgcgacggaaagtggagaggacattaagcaaaattgaggaggaggagaggggggaaaggtactgaattagcagggcggaggagaaacgacgatttgattaattaattggttgatcagcatctgatcaattgattaattgatcattgaaattttatttcacgatttgaccaatcattttttggtagtatctgatcactgagtaattgctcaatgaaattttttatttttggaacgatttgccaattgattatttgctactgttaatacaatttggtgccttctgttaccgtatctttggtaccgtactctctctgtctttgcgtgcctttcattctcttattttttttctttttctttttctcaacaaatgcattttacgacaaattccattttggtttctttcgtttgcccccacaaaaacaatgccttttttggaggccttcgctaactccgccgatcgctcggtattttgcggtgattaatgattaatggacagtgagtgatcagccgaagaaatcaacgaacacagcggcaaaggaaaggcattgctgtagggaataattcgtggaaataaatttgtgtaaaattaggcatggacagctgagagaatccatcgcatcagcagcacaaccctcgtgctattcgagcacatttggaagtataaaataaataccggcaattaaagttgcattaatctaaacacattttgttactgaaaaccatggcaaggaaaatgccaaaattccacgcattaataaatcgagataagcgcaaaaaaacaccttatactttttaaagatgccttttttcggcgggaaacgatacgggtgagggggaactgatcagtggggggggggggggggaggatcagctggctacagccgattgcgtgatcaaagaggctgaaacattgggcgtatgcattgcgcgggcgggagttatataattggacctatttgattttaaatgtttattacgattataaactgaactagttcttaaagaggggaatttgaatcgaaaaatgctcagcttttcgctaaaaaatatgaaaatattattccaggaaatttaggttggaaaatcagaggttgttgaaaaaaggctggatccggacctggctggatccaggaaaaacttatgcctgtgtccaggtccaagtccagct

SEQ ID NO: 6485 - DNA, 1344 bp, Heterodera glycines
  misc_feature (26)..(26): n is a, c, g, or t
attcactactgtacatcgcaataatntaataatattgtgcacaattaagttccagtcattttacacacagcaaaagcattttatttccgctccaaaaagtcagtgaggaaaaaagggggggggcggaaagcagcgaagaggagcgagggggaggggtcggaaaaagtgagctcttttggataataaaaaatgctaacatttctttttttgcgactaaaacccaatagatttacacaattttgtgctgctaatatatcctcccttctgtttgcattataatcgtataattctgccaattaatttccggcggcttccaactaaacattttttggcagaagctgcacccggggcatgtgcacagcagcagcagttggcttttctttttcctcctcccactctttcccccccccccaaattctcccaattcgttccaatttctataaaaaagctctaccaaatcgatgtggttttctgtttttacttaaggccaatttaattgtttaaaaagtaattttttaattttttggcattacaaaatctgtccacggagtcaccgcaataaatcattcgtcctccttttttgacctcaatttccattttttgtcttcaaaatttcagcgattaccttttcgccgtttaaagttaaaattcgttcgccgctgcgcgacgaattcatttcgtttattcgtccgttcattctttcgttcattcatttaccacgcaaaagttgctgggtcggacaattaattttgctgcagcgatttgctaaaaaaccaaagcaaaggcaaagagaaaaataaaggaaggcaaaggaagaaaagaaggaaaaggagaaaatagcgaaagaaaagagatgcaataagggaaaaagagtcgccggagggcattcaaaaagagagaaataatatacaggaaaagagagaggaaaagaaaaacaaaaaggaaaagattaaaataaacgagaaaaagagaattgagaaaaattcaattttgcattatttaattgttggctttttcattttccattttaaatgttcgtcttttcttacgcttttcattttcgtcggcttcgtcaaaatgatcggttgcttttccctcccccgtcattttccgtgccatccgtcaattacccccccccccccctgaattgcccccccccccccctcaaatccgggttaccccgtgctatttttcatttccgatcaccgctctcgatcttttagtccgattttcggcgaaagcttattttttgctgttccatcttcatcatttttgcagcagaaattgctttgacgttacttgggatttgtgctcgctcactgattaaaatgattaaatatcatt

SEQ ID NO: 6486 - DNA, 3282 bp, Heterodera glycines
aaccaaattaaaccaatttgtgatataatatgtacgccataaaagtgatttccttcccagacattatttataattttggctcaaagatgctgaaaattagtcaaatgtttttaaatcccaattcattttttatatttattaattgaaatttgaaattcttttcttatttctcttcacatccatcctttgttcattggcactcttctctcatatcacaacgttgtactattggccacctgctaatcagcccaggtcagagaaagcaactgacgataaagagcagttgacaatggcaaaatgacccctaaattatttgtttttaattttttgccaaataatattataataattaataaaaataaattacaatagagaaaggaaaggacaaaaagtagactgacagaagcgcgaacatccgaatctgttattaataaataattgaaagtattttttgaatttaaaaattcaccggccattggcgttggttccgtcgggtccatcttgtaaatgtgttcgttgcccatttcctccccaacttggccaaattcgcacacgcaatgccaatcatccgactgaggaagcccatggtccactcttacgctatttgccgtgttggggccatctttttgtgggcatttgtcctttttgctgaatgtcgcacaatcccattggatgaataaaagggaatggtctgtgataattataattagtaatttaattacaatcggccagattgcatggatcggtttcattaaattttgacaaatttcaaaaaaaacttatggcacaaaaattatttttaattactcgctacgcagaagaacgcacgacaaacgtcttggccattctcacaaagaacagaatcttttgattgcttgccatttttctccattatcgaacggcttttgcaagtcaatgctttattaaaaaagcaattaaatatattgagattgaaaatgtttttttaccatggcaaaggtccaaaaaagcgcaagtgaaaagtaccaccgctacaaaagtggccgtaatgatgatgcttggcattggggaaattttatagctgaaagaccaaatttaatttaatgcgtggcgtacacaataaaaagtaattaaaaaattaattaaaagcgattaaaaggatgatcaggtttaattcactaaatccattgaaaggtacgttttccaaatttatttcgaataattttttgactatttttattgggattttatatttttgttttataatatctaaaatttaaaaaatattattattatttttggtgaattattattgcataatttttttgaaaataatagtgaagcgatgacaaaattaaagcggcgtaaaggaatgaatcactcgatgcatattttatgataaatatcatttgacagatcaaataaattttttcacaaaaaacctaagctcctaaaaatgcattattagttagttagtaattttaaaataaaaaaatgagaaattttactttaagagttaaataatcataaaatcatacaattattttatggacttgcactttcgtcagttttggtccacaggattaattgatttgaatgtactttttagagaaaattgtaagcaaattgagacaaattaataacaaaaatttcccaccttcgcctgtcggcacagcttaccacaaaatcctgctttatgggttttttaaaattccgaaaattttttaagagaaaagaaattcttcggattccaattcacttctgaccggttaaaagatttaatttggatttctctggctcttttttcataatacatattctatcatttgaatccaaaaaattttcgacattaaaaaatagtgatgtgatttttgattaaaaatattttaacttttgcctttatgaaaggaaaatgaaatctttcattttcaagatagaactttggattttttgaatggggcaatttctccaaaatcaatacgaaagaaagtaaaatgttcataacttttttttaccaaaaagatttccaaatttccattaaaagtcaaaatttttcctcagcgtcgcctagtaccaaaaaactaagtttttttctcaaaaattagctctaaatagcaaaatttggtcatttttggtgtaaatctgttaacagaaaacacataaaattttgctgaaaaatgcgctgtaaaaagtcttttgaaaagcataaaggttgatttagatggcttgacataattctaaactaaaataaaagactaatttttttttattaatcaaaatttccaaaaaagcccggtcaaaattttggaccaggcccgggacgacggcttctttctccttctctttcgaaaaattttaccgtgaatatagaccgagaaataacaaaaaatattttacttgggttgaattgaattagtaatgctaaagtgcaaaaaaacccgagaaatttctcgaactaacactcttgcacattactagtattattatataatttagccaatgctaatgccaagcatcattaccacggcaatttttgtaacgatggtatttacagttgcgtttttttgtacttggacatggtaaaaaacactttcaatcgcaatggattaatatttttaaggttctttcaaatatattttcgcttttttggataattgcttgttattcagtgattttcaacagaatctttttacatgtcaatttacattgtttctgtatgttattgggaaagagattaatttacacatttttgaaaatgtctaacttttttttttatttgccaaaaatacggcaaatagcgcaagagcggaccatgggcttcctccgtcggatgattggcattgcgtgtgcgaatttggccaagttgggaaggaaatgggcaacgaacacatttacaagagggacccgccggaaccaaaaaaaaaaaaaatcaacgccaatggccggtgaatttttaaattcaaaaaatactttcaattatttattattagggatgcgatatttaggcacaaaaaatcgccaaataggcacctaaaatggcattaaaaaatcgcaaaaaaggcattaaataggcactaaaataggcaaaaaaaaattttattaacgctttttaggtagcaaaacacataaaaattaatcaaaaaaattattttgcttatatttcaattgtttaaagttttttttcgttaaaaataatttttttaaaccaaaaatttttatgaagaaaaataattaatttttggggaagaatttttgtaaaatttttttcaattcttaggggtgtatcttctgaatttttttcag

SEQ ID NO: 6487 - DNA, 2262 bp, Heterodera glycines
  misc_feature (63)..(63): n is a, c, g, or t
  misc_feature (77)..(77): n is a, c, g, or t
  misc_feature (134)..(134): n is a, c, g, or t
  misc_feature (178)..(178): n is a, c, g, or t
ttttaccataattttttttgagttatatttgtgtggaaatatacttgggagtgcagtccaacncaaatgtttttgcnaaatcgataaattatttctgtgacatcagctaaaaatctctaaaaaacaaattttcncaactttatttgataaatttttagatctgaaataattatttcanggtatatatcccatttcggttaatgcgcgcaaaataaagtgcgcatcgtaacgccctaaaattttattataaaaatttttaattttttgattttaccggcgaaatgagcataacaatggtttcaaaatgtttaaacgatagcacccattttaaaaactcgaagacgggttcacagttgtcaaccgtacaccatgtgtggtgtctaattccctttggcccgcaaatatcacagtccttgttttccccatcgcaatccgaacatgtaatacgagccgataaaaaaacgactttatgttcaaaaatcccctcatttttcccattttctattaaattatccgtctaaatttgctaagataattttttgtttattattttacatactgaacactctgtgtcgtagcttatgatacgataacgtggcagatttttcggaatgataatcttcttaatataacaaccctctgattttgaatgttttgttttacatatattacaaaatttcgaacctaaattagtaaatttctttatttattttttttaccgcaaatatgtttttcctttgtattatattcactattgcattgtacacatcgtttataaagtttgcaagcaattttaaatggttttgatagcaaaataggttaaagaaatatctattgcattttaggcattcttttaacacattttcctcgtttttacatggaaaattcaaccctaaacatttttatatttaattttatttctgtatttattttaccccatccaccacaccgttgacattttattatgcaggtaacggaatgttttattttttcacgaaatgattgttcacaataaacacagtaataatgttttatatcaaaaaattgttttacactttttaagcctaaaaaattttggaacagaaaaataattcataataaaattaccatctcaatgtccattttcgagaaaaatacatattatatattttttggtccctgacccttaaacatcggttttaaaccccattcctaaatttatttttaaatgttaagatttttcttttttaacctttgaaaatgcaacaataagaaattttcctggaaattctttgtcgtaaaactcttggacagtcaaaagatcatctatgccgtaatttgttctattcgaatcaattttagtctcttggattaattgcaaaacatgaattttttgtcgttttttatttctgtaaattctccgaaactgatcgtatgaaatgccgaatgactcgttggctccaattatttgataaaatctgcttagaattatcccgtaaaaaagacaataattatcgtcatttgcaaccaaaattctgccattttcttttattttaaaataatttgttgaatttaattgattccctaaaaaataaataactgaagtttaattatttttttaattacttgagccactcgggattgcgtatgtggttattattattgagatttgttcattcaataaatcaatttcgctaaagctttgttgaatgtggtaaaacgattccattaccacatcctcattgttctggaccaaatccctagggggaatgattaatgggtcagttaacgcctcacaataaaggtcgtaagaaattttttttatttcccatcctttttcattttttccattgcattttttgttaaatattcgattatctttttgaaattcttttttgagtttttttctgtatttttaaatataaatctcacaatattttcctttattccaaattttctattctcttttatcgtatttgaaatttctgtgtaataacttccgtctggtatattatttgttttcgaaaaataattttttttgtttctcagctgtcttttttctttaggtacttttaaaaatcttttttcatccatttttaatctataataaaactaaatttgcaaattaaaattaagaatttaaatatttttggacaatgaaacctttttttaaactatcaaattaaaatgtttatttatacctaaaacaattaaatgcaaaatgaataaattaacatatgaaaaaagaaaacccaaatctatcgatgaatctgacctgtaacc

SEQ ID NO: 6488 - DNA, 2453 bp, Heterodera glycines
  misc_feature (1396)..(1396): n is a, c, g, or t
ataatccattaaatatatctatcgaatagattctgacccctatatctaatattcttaattgcaccttagctcttaatgaatggaaaattatcgtaatttcttcataaatttcttcaattatttatttttattcacatataataaagcacttttaatcaaacttttcaagattatccccttttatattagccctagtttttcaccaattgatttgcatattcatattttgcgatttacatgcatatagtgcatatttgggcattctcaaaaaaatcctctatcaaagcggcgccttttgacctcaaaggaccgaaaaactaaaaaaaaaattcatttactcaatttcgtcaaaattcattaatcttcgcttcagtattacttctaaaatgatttttttataccagatttagctatgttggagattcttagcttaaatttaggcgaatttaaagaaattgaaaaattataccattcaattcagaaaatttatgtgcctatttttcactttttgttgcatattttatgcggatattttgagattttttatgcaaatttttgactgccttagttatggcaatatgaagaaattatcctgaaattgcaactatattttctaattcgcttagagcaataaaaaggattaatattagactcagaatctacacgatacatttagaaatagaataaagaatattcatttctctcgcattaagttcaacccgtgcaaaaaaatctgcaaatcttttactgatgtatttataatccgattttttgccgtgccccatgccccatccggcgccggccaatgatgattaaaaaccaaagatcaattgctcaactaggctcttccgaaaatatatgtataataatgagaaggacaacgggaatctgaggccggacatttttaaatatttttattaatttttatcattatggaatacatttaattttagagccggaattttgaaagtactgggcccgggaccgggctcacacaattgaccgggaccgggcagcccggtaaaggcacgccgggcggtgcccggaaaatataaaaacgagttcattgccttttgggggggctcgaaccacgattccggcatccatttcggcgccaattccgaaccccggacccgaattcaaacaaaaagttgaaagtccacattttcgaatttagcatttttggttcaaaaacggcataaatgatttcttattgaagaattaatgacttttagtttgtttccgtgtatttaaacctatttttaataaaaaacctaatttcgaatacttttcgactttttctaagtgtgcctaaaattggcagccctcctgatcagaatgatcgactgttagagtaaatcaaaattcttttaagttttttaaagtcaaacccganaagctaaaacaaaaaagttttatttcgcaaatttggaatacaaaattttttgaattgaaccttttcggttaaaaatacccaaattccaaacactgggactcaaatctccggcattccaaacactgggactcaaatctcaggcattccaaacactgggactcaaatctgcggcattctaaacactgggactcaaatctgcggcattccaaacactgggactcaaatctccggcattccaaacactgggactcaaatctgcggcattctaaacattgggactcaacccaccagcatttcaatctctggtactcaattctccggcattccaaacactgggactcaaatctccggcattccaatcactgggactcaaatctccggcattccaaacactgggactcaaatctccggcattccaaacactgggactcaaatctgcggcattctaaacactgggactcaacccaccaactgtcaatgacattccaatctctaggactcaacccaccagcatttcaatctctgggactcaattctcaggctttccaatcactgggactcaacccaccagcatttcaatctctgggactcaattctccggcattccaaacactgggactcaaatctccggcattccaatcactgggactcaaatctccggcattccaatctctgggactcaaatctccggcattctaaacattgggactcaactcaccaactttcaatgacattccaatcactgaaacttaacccaccagcatttcaatctctgggactcaattctcaggctttccaatcactgggactcaattctcaagctttccaatcactgaaactcaattctccggcattccaatctctgggactcaattctccggcattccaatctctgggactcaaatctccttttctttttgtgtgacttgggatgttcgcggcctcgtacgggaacaacaatttctgcgccaaaagtactcggcctcgaagcggccgagtacgggggccttcggcccccctcaccaatttccgactgcggcttggctttttcaaacta

SEQ ID NO: 6489 - DNA, 4564 bp, Heterodera glycines
tttccggaaatttagcacttgtgacacgtcaatatgtggcagacatgaccagagcacggttggaaggacttttgaacgcttttcccaagcttatcacttcggataaaggtaaaaatgaagtcaatttttgtcgaatttagtttttagctcagcgccaacatactttcgttgagacaaattctgtacgatatgtctatcagccgatggacaacatttacatggtaattctattgttttttgttcatttaacagttaattttcaggttttgatcaccacgaaagcatctaatattttggaggacctggagacgcttcgtctgttttcccgagtggtgggttagggttattattactaacatttgaatcagagcgcgggaaagatttgttctcccttgaagggttcgaggcataactttgaatatacacagtatgcgataaaagggccccctcaccaatttccgactgcggcttggctttttcaaactaattctcattcattcatttaagtgcacgccataagcaaaatttcttatcatttacataaacaaaacaatagctttttacactaaactgaccaaacaaaaaagcaaaacaaacatttcattttacaaatcattattcaacaatgtgctatctctaaaacatgaaagacacagtagtgtgcatctcaaaccaatacattttttaaaaaacttgacaaatttcagttctgtgtctcatggatgagaggcacaatagtgtacatctcaaacaatatattttaaaaacttggacaaaatttcacacttctgtgggtttacaaaacttttagtgtacatcgcaaaacaattcactaacaaagaattcttttgacaaaagttcacactctgtgggtttctaaaacttggtaggcacattagtgtggatctcaaaacaattctaataattacatataacaggtaatatgattgactaacataagccacacaccacactaatgaattttctaaccaataataacaaataattcatttaataaattcaacatttttctgacaaatcaacaattttaaagcgcaattacaaaatgaaaattatatccgtatttgataatgtgtgaggatcacaaatataattaaataacaataacgaacaaaatatcaaaaatcaaacataaaatacgtaatcgaaaaggtatgagtcacaaatcaaatctaagcaacggacaacaaacgaaatactacccatttttttgcgacttcttaattggctccaaagtttccgaactacgacgtttaattggtgtcgtcaaaatcgcctcaagattaacgcgcccagcaccaattttaacggatgaaatctcgcaatggagctgaaggcattcatctatgataataaaaaaaacttgaaaactcaaattaaaaccaaaggtaatgccgacacaattacaattaccttcaactttcacaaaaaaaatttgaagttcgatctgtgtgttcttaacgcatgaaccaagacgttctaccaattcttcgccattgacgtacaaatcagccctcattcctttcttgtccgcaacgactgcagcgaaatgtttcccgactggcgaaaacgatgaagcgagagcacaattcattgctttaaaaaattaaaagtcaaaaacatttatttatctctcacacaaaagtcacagaacaaaccactaatgttttatcaaaaacatgacccacattattgtgtcacacgaaagtcacacaacaaacactaatgttttatcaaaaacatgacccacattattgtgtcacacgaaagtcacacaacaaacactaatgttttatcaaaagcatgacacacattagtgtctcacacgaaagtcacacaacaaacactaatgttttatcaaaaacatgacgcacattattgtgtcacacgaaagtcacacaacaaacactaatgttttatcaaaagcatgacacacattagtgtctcacacgaaagtcacagaacaaaccactaatgttttatcaagagcatgacacacattagtgacttacacgaaagtcacagaacaaaccactaatgctttatcaaaagcatgacacacattagtgacttacacgaaagtcacagaacaaaccactaatgctttatcaaaagcatgacacacattagtgtctcacacgaaagtcacagaacaaacactaatgtttatcaaaagcacgaagagtatattattgctttataaacacttttacaaaccaagtaatatattataaattaataaaaaaaattaaaactcacaataaatgcaacccgaagtcaatttctcaaatgaatccgcagtcgcaatggcacattgaatcacctccattcttgtgaaagtcatcaccacaaattcataatccagtggcgtaacgtaaattgtctttccatcgaaacgctcttgaaagcgttgagctttcagcatgtaaaatttgacgacctgtatttagtaaggtaagcactgtaaaaagaaacagcaaacttacaattccaagggaacaaatttttgaaaatttggacgacacgctcttaaattctgtgagaacaacattctccccagaagcacacgccaacaaagccgtcaacttcttctcagacggtaaaatgcttacaatctgcccacaaaaagaccttaacaattttacttaaaacaaattactaattcaagcacttacgcaagctgagtgccacatggtgtggctttgagctcttccagagtcgtaagcatggcaacaggctggcaccagatttgaaaaagcctaaccggtagaaaaaatgagccgtagcggcagaaaaacaacgataaattgtttagtcaccagatttttgaccaaactggtagaaaaaatgagccgtatcggcagaaaaacaattctctaattgtttaacaattctaaaataaaacaaaaattaaagtaatatatgaaataatgtgtatacaacaaaaataaatactttttctaaccaatacataaccataaaattttacgacaaacagactttgaatttaaaaaaataagcaatattaaacctttaaattaaacaatgaaagacaaaaacaaaaaattaaaatgatgaatggaggtgtggacgattttggcgttatatttgaacatacacaaaaaagcgaataaatgactaagaatgttttttgcaaaacaaactgaaaaatcaaaatcaaacatttccatttttcaaatcattttttaacgcaaaaaaaaaaaaacaaacattttcatttttcaaataatattttaacgcaaaaacaaaacatttccatttttcaaattcatttataacgcaaaacaattacaaaacgccagacacatacatagcctcattcatctttatatatatagattttgatactaaaaagtagagagcagaccggaacggatccggtaacggttttttctggtcccgaatctggattgaccggttttctggattggtcggatttaaaaaataaagggaatgttaaatgctgtctagtaaacataaggtcaataatgaataaaatcgatgaaatagcacttattttagaaaccgaaaaaattgacatccttttaattactgagacttggaccaaagacggggaagaaatcaatttttgcccttgggtaaaagatcattacaattatatttttcatcaaggaaatcaaaaacttgtgggggcggttgtggtattctaatcagaaaagaaattggattttttacaaaattttcggattcaaaatttaattctgaaatcttagttattcagctgcaaaatttacagtgtatcagatttgttttggtgtatagaccacccaaaacaacacttaaacaaacagaaaatttgtttaaatttttacaaaaattttttaatgaaaattcagtgactttaggagattttaattttctgaataaggatttggtatggaaaaatgggcatccctattcaatgagtaaatgtggtgaaatattttgtgactttttcaataaattttcttatgttttggccacgaacgagccaacaaggattaactcctggctagatttgatttttacggccaatgaaaaaattattactgattgtactgttaaaggaggcatattttcatcggatcatttaacacaatttttcacattaattactcctaaaacaaaaccgaaaacaaagatcgtaaactttcgttggttttgtccatcgaatgtgttacattttaatatagtcatagcatcaaggctaaatgccttgtcatatgaatgccttagcataaatcaaaaatattccgcctttaacagcatgttgttagaaaatttaaatgagtgtattccaataaagcgtttaaccaagaatgatttgactcctaaatacccacaacatttattagcatcaatcaaagaaaaggctaaattattcaggctagctaaaactgacccatccaaaaaagcactatacgatagcatttctttatatataaaaatacaaacaaataaataccatagccaaattgagaaaaaggctatttcaaagggaagaaattcaatttatatatat

SEQ ID NO: 6490 - DNA, 3740 bp, Heterodera glycines
aaaaacccattagtgcccccgggcgatgaagtgccatgactttttgtgcgatgagtgcacaaaattggcttttcttgcgggttattttaatgtgcgtgttggttaaagctgctgtgccgcttccttttccgttcacaaaaatcacggcgccatttcaatggcactttggggatatgccgcaccgcgcccagtcacgagggcaatgtgctggctaatgagcgggactaattaggtagggtgcggtaattagcccaattaattaattggtccgggggcttaaagactaggaaggttatattagtatgaagcaaacattttgtattttaacaaatttaaaattggcaattaaattttcattaattatcatctgatgaattttttgtgcccttttcagaattacaggccgtcgatctttcgttcttggcactttttggtacaaaaccagtgctaaaaattcgcctaggttttcggcaccgccgcgccccacccattactcaaaatttcctaaaattatagtcattctcagtgccgtgcttctctcctattagagactcattacgactggtttttccgattccctaaatttttgaaattttttaggattaggcaataattgccgcctccccctccccctcgtccggttttcggcacacgcgatgagttacgattttcaaaaaaaaattgtctggcatgacgctaaatgagtcaattaactgggagcaaatgatcatctacatattatccccgggggacgaaagggaggggcggcaaacataaaaagggcccccaaaggcattaatttcgtcaattgtcagtttttacgatttgcagggggtacaattaggagggttcatgaccaccatcatcatcatcgtcctcagaaatgatttttgttatgtgtttgatggtgccacgcgtggcggcatttccatgccgccatccccgacggtggcggtaaaatttcgcgcaaaataaaattaatttttcttccaccctctttttgccgttgccgccgccgcacacaaaatgccctccctcctcccatactttttgaaaattgtgacttacggcacggcacatttgtgccggtagcctctccgcctcattttatttgtgcactcactacacaggaatacacactaaaaaaatgtagctgaaaattaagcactcaatttttttgtttgcgacatagtacagtaattaccgtactgtatgtttcaaatgaattttccgagaaattttcggtgcccacgaaaaaaaagcaattcaattttttcgtgaaaacccctccagttcctcaaaaattctaaagtttcaaatttttcctaaatgaacatttttacattcaaatgcaaaaataccgatttccaagtaaaatcttgcaaataagtttacaattaaaattttccaagcacaaaagccgaaatccaagtacgtacttggcacatccaagtacataaaaaaaaagcgcgccgcaaaaaagtggcagcaaaaaaaaaaggtcgtcgcccgggggcgttaccttacccatccaagtcgaaactcgaatcttgggaccattcctgggagaaccccgcgctttgtaatacctattttttcacattttgtcccattttttttccaaaaatggtttattaacattttgaaatgattacaaaaaaattaaaaccaacttttcttcgcacattaattatcatcgtctaattgcgtctcatttttactcaaaattttatgcttttttgcacaaactcattaattaatgctaattaactccaattaacttccctctccagtcttttcgtattaaaaatgttgccaccttcgtcttcacccgtgtccaattattatcattttttttgttgctaaaaatgggtgcaagaaatgcgcggcgcgcaatttcccatcactttttttttatacccataaacggcacaattaaccccctcccccgcccattttataaaattttccattttggcatccatctgacggggatggtggcacttttttttgtgtgtgtgccgtcgtcgtgtaatatccggcccaactcatttcccacgccgaaatagcgtaattgttggtcccacgttccgctaccctcgcgcaatttaaggtgtattcttagcacccaaatcagcagtttgtgcccgtgctgtacataggccccaaaagggtgccaatgtcatttttggcatggcatggctcctcccccttaaagtgttaaaaaatttagttaaaatcatttggaatttcaatttttgaatcacataattgtgaccacagtgccattctctcctctcaaaatttttgaaagttaattattttacctgaaatttaattaattaattttttcagtttttctttttttgcgggggggggggctttgccgtgccatcgccggtgttttccggccccccatttaaaagtgcgcgaagccaatggaagcagcacaaaacactttggactgttgtagcacaacgcaaatggcggcacggcacaacccccggcggggcggcagtcatgccattttttaattttgcgtttggcgttccgtgaatttttttttggcatatgatgacaacagcgcgccaaaagttggcaccattcaagtgcttgcgtgcctatgatacaataattggtgataattggggtgccaacggtggatggtggcacggcacacgctgtgcccgatttgtcaggcggtggccccaaactctcgacaaaaagcgcgtccgctgacgagatcttggtctcggtatatgcttgtcacctagttcaatggcacataacttttaaagtttgtaagaagttgacaaaatgatcattgccccatccccgccccctcgccccgagggcactgatgcgagcaaattctcgacataattcttgggccaacaaaatcctatttaaatggccaaatggcatttttttcgcccgcaaaatccatgaaccccgttttatttctccgcatttcaataccaccatctaaatttgtcagttcggcagaaaataaccccaaatcgatgattggatgatccaatccattgtgggataaatatgcttaggtagatcaccctcctctacctgctgatcagggcttggcacaatcacggacaacgcgttacggcaataacggcatttttgtaccacttccgtaattataaattattacggatttcctatctataattgaaaaagctctgtaattgcagattatggattttcctaatccaattaggcccagctcggccccggactcatttatgagcttgcttggtttctagaatccaatcccgactttccgatcccgaaccaattaacgagcttttgttggtcccgaacttcaatctcgagttccaaacccggatcttgccaatcccgaaccccggtctcaaatttgaatttttatcttccgaaccccaatagatttggaaaaatatttttctgaggagttttcgtttttcacataattaggcctcgatttcatttgtctcacttcccttacatcgcttttgctccgagaattttttttttctttttccccctaaaaattcgtcgatgtttttgttgttgattgccggctaatgcattaaaatgagctttaatttatttgggtggggtggtgataaatgcatttccgacctctcattaatctgtgcccgcaatttatggcacatattcccggcaaaaactttctcaaaagtttgtttggcatgggaacgtggggggggggggggggg

SEQ ID NO: 6491 - DNA, 1542 bp, Heterodera glycines
  misc_feature (113)..(113): n is a, c, g, or t
tatcactactccatttatcaatggctccgaattctaagcatttatttatttttgaaatattgagtggttctgtggtcttgggaaagaaaaaattggcaaaaatggccatttgngcataaatctcccaacaatttcgaaaaattccaagcatttttaacggcaattgcctccaggcaccttgggttatttgaacagttcaaaaagtaccaaaaccattcagtgatttataagtacatcatgtttatactgttattcgagctgatggcaattctatactaattaaaataatattatttttcttaaaatgaaaatgccaaaaacgtcaaactgtgctcgttcaaaatgatgattttgccgtcatctctccacccgccgccgtcggcgtctcccctctcccccaatttgtttaattacccttcaaatttgtatggtacaacaccatttaattacacgtaattgcaacttgcattttaaacattggcacccaccagtaaaaatgccgtcaaatttttgtagtccctctcccctaaatgtgccattgtttcgccaattagcatatttttcccgcattttcccgcccccgggcgctggaccggtgccaattgttcgcattttttgccattgtctctacccgtgaagctgttgaggttgggttggcacctccacaattggccgtccaatgtttcatttctcacgcgcacaccttcgcctcccatcccgtctttggcacatttttttcacaccagaaaatttgggcctatttgtccctcaattttggtgccaaatgtttttctcgtccattttacccaccgaatactaaaaatatatggtgggcatttgatgtaaaattatgttttgaaaaagcgtgccgccaatatgtgttaggaaattttgtttgttttcttcaattcagtctcaagacctgctaaagtctcgcctctttgtaagaccccaccattcccgagccttgtcaagacttcagtcttgagtcatggtaaaagttgcgtgtcttaataagattacacatttccgagtcttggaaaatttcgcctctttgtaagaccccaccattcccgagccttgtcaagacttcagtcttgagtcatggtaaaagttgcgtgtcttcgagactcatcccgagtcttggaaagagttcgcgcgtcttcgtaagactccaccattcccgagtcgtctgtcaaggcttcagtcttgagccaagaaagtgccaacaaatctggcattgatccagttttgccaaattttactaaaccgttttttcaaaatgccacaaatttcaattcattcctttgcatccgcacaaatttgacggtccgagaacaaaatgttttgccaaaaaagaatgtaccgtaatttgtacttttttttgccaacaaattaccgtagtaatttatataattttaatttcattttttttttgcctatacaattggccaatatttcgtgactcgctgtttctgtttaaaaaattcttaaaaatgcggacaaattccatcttattttttcttgcgcctgtcggtaggg

SEQ ID NO: 6492 - DNA, 825 bp, Heterodera glycines
gcaatgagcggcaccaattcttcagtcggccgcgctggcgcggcaaaacttcactcgtccgttgagttcctccacccaggcatctcagtaccgatgtggtcgcgcaatccgttggccaatttgttgcgacgctcaaagcgcaaagaggaaaagcatcgtcggattggcaccagtgagcaggaggaggagggcgaggacgtaccacaagcagcacaatgagaaggacggggccagcagcagcaacacgaaaagggttgacaaggctcggaaacgggtgagtgccaacctagggttaggtctcgagtaaaggtatctttttatatccttgtctctatataccggggcagcgttcaggcaattacaaaaaaagatttgattaattaagcacattgttgattattttggtttgtaactttcttgaaatgttagaattctcttgttttctcgtattattacattatttagactttgtgctttcgaatgataccaaaaagataggatttgttcgaacatgaacaaagttattgtataaaaacacgggaatgtcaattgattggactcataaaactcaattggactcataaaagtcgattggactcataaagtgcactagagccaaaatttgtacgggaaaaaaagcaaataaattcttaaaaatgtacaaaagttgcacacttgtagtaaaacgctaaccagtagaatgtaaaaaacaaatacttgagaaattaggaaattttttagcaaaaaatctcaacttaaaatttttgtttttaccgaaaaatcgcatttgtcaaagcagcacaataaaaacaatgaaaaatgagt

SEQ ID NO: 6493 - DNA, 290 bp, Heterodera glycines
cggtgtcatctatgttactagatcggggatcgatccccgggcggccgctcgagcaggacctgcagaagctagcttgatggggatcagattgtcgtttcccgccttcagtttaaactatcaagagagggaggagagggttggagaaggaaaggaaaaaaaatgaaggaggagaaagggtgggtggcggaagaagaaaagggtggggggagtatgagtatgatggtcaatatggagaaaaagaaagagtaattaccaaccgcggcccaagccaaaaacgcagacgcccgcag

SEQ ID NO: 6494 - DNA, 2835 bp, Heterodera glycines
acaatgatactcatatttttgatacgaaaaatgattagtttcatgaatataaaattatctcagcaaattctggttgctatgttcggaagcaaaataaataaaagtaataggcaaattttactttataaatgtaacattatttaaaactgctaaaatcgcaagaatagatacgaatattagctttttttgtgtgcggaatataaaaattgcattttaagtcaagttttaacgcgttttgcatgcatgaatttaataaaattaataattggttttattttactagctgtgcaccaacaagttttggtatgtattgagaataataaaaattttaattctttataagtttataagacctttcattttaatgtaaataagtgatacattattttatcagcaaataattggaccaaagacaatgatagtcatatttttgatccgaaaaatgattaatatcataaatataaaattatttcaagaaattctggttgctaaattcggaaacaaaataaataaaagtaataggcaattttactttataaatgtaacattatttaaaactgctaaaattgtcgcgacaacgcgaaatcctaagataaaacccaaaataaaaaagaggaaaaataaaaaacaatagaaaataaaatggggaaaaataaaacataaataataaaaaatatttttacatttattttggaaaaataatattagaaaaaactatcaaaaatataattataaaaaatgaatgaaatgaataacggaaaattgtttgaaaaggaaaagtgcattccctcaggaatgaaaggaacgaaaattaattaatattaaattgcgaattctgttaaggattgttcgtaaacaaattattaataattaatatattaaagaaattggaattgtaaagggaaaacggaaaagcaaacaattaatgggaaaatggcaaatccaaacggataacacacaaaaacatattttaattaaaatgagaaattgtagcgtactttggtgcaaaaaaaatcgtatttaaaggggtggacttttccggaaatttcagattcgagacaaacggttccctccgaagtttcccggcacccgcccaccgcctttcactgcacccggccttcgctgctctctgtctgtgcgagtgccctccctgtccgcgcctgctcgagtgccctccctttcctttgccattgtgtggccccttttggaccagccgttgcccgaatgcccttccttttcccatcgccgtttcgccgttctgaccccttttgattttgccacatttttcaatttgtgatttatttactgtcaccgtttttgtgcccccttttccccgttcacattatcatgtttgtcccccatttttcgtttccctcaccgtcccgattgggacggtttaattacccaagtttgaggtcgacacaataaacatactcttattaaaattgtgcccaacttggtctatttgcctggacgaaaaccggcacgactcatcgctctccgatcggtcccgaccccctacgttcccccgaccggctactctgcgcgcctcgcccatttcatccccttcccgtccccttcaccccgcagagttcgacgcaaatttcttgtcgccacgacaaaaatcgcaagaatagatacgaatattagctttttcgtgtgcggaatataaaaattgcattttaagtcaagttttaacgcgttttgcatgcatgaatttaataaaattaataattggttttattttactagctgtgcaccaacaagttttggtatgtattgagaataataaaaattttaattctttataagtttataagacctttcattttaatgtaaataagtgatacattattttatcagcaaataattggaccaaagacaatgatagtcatatttttgatccgaaaaatgattaatatcataaatataaaattatttcaagaaattctggttgctaaattcggaaacaaaataaataaaagtaataggcaattttactttataaatgtaacattatttaaaactgctaaaatcgcaagaatagatacgaatattagcttttttcgtgtgcggaatattaaaattgcattttaattcaagttttaacgcgttttgcatgcatgattttaataaaattaataattggttttattttactagctgtgcaccaacaagttttggtatgtattgagaataataaaaattttaattctttataagtttataagacctttcattttaatgtaaataagtgatacattattttatcagcaaataattggaccaaagacaatgatagtcatatttttgatccgaaaaatgattaatatcataaatataaaattatttcaagaaattctggttgctaaattcggaaacaaaataaataaaagtaataggcaattttactttataaatgtaacattatttaaaactgctaaaatcgcaagaatagatacgaatattagcttttttcgtgtgcggaatataaaaattgcattttaagtcaagttttaacgcgttttgcatgcatgaatttaataaaattaataattggttttattttactagctgtgcaccaacaagttttggtatgtattgagaataataaaaattttaattctttataagtttataagacctttcattttaatgtaaataagtgatacattattttatcagcaaataattggaccaaagacaatgatagtcatatttttgatcagaaatgattaagatcataaatataaaattatttcaagaaattctggttgctaaattcggaaacgggaagaaataaaagtaataggcaattttactttataaatgtaa

SEQ ID NO: 6495 - DNA, 1342 bp, Heterodera glycines
acaaaacattaatttaaaaaatgtcctcaagaaagcgcaaaacaattaaaaacgagatcgccgccaaaaaataaaatataatatgaaatcaatacaaataagcaagcgatgggatccatttgaaaaaaattaagtaatcatttttataatggatttttcttcgttgattaatttaacccagctgaacaaggattgttcaggtatttagaattcacttaattaaggtaaaaataaaaagaaaaattggatattttttcaaaataaaagagcaaaaagtttggaattttgtcatcttttttaacaaattcccgaactggcaatttggaagaaaaattgaaaaatggattacaaacaaaatttggctaagaaaaaatgggtttggtggtggttttaagaaagtcacatccgccattttagtggttaaagcagggctcggatcgggcaacctccctttccaaggacgggtataccagtttccaaggacataagggaaaagttccattaaattcaaggacgtttaaaattttatcatatgtatgaaaaatgattacattttatccaatggtttatatttttcgccggaatgaaatttttacaaatattttttttgtttctgttggtcattttcctcatttcaccgcatatgcactttttttgcggcgcgctttttctgaaaaattttcgagttacaggagggttcggcggtgccgataggcgccgccggaaaattttttgagaattagagtgtaatttgttaacacattttcagcaaaaaaaaacaggcggattttgcgattttgaaataatggcgatgaccattttttacttttaactcagtctcttcagtatcatcatttttgtgcgtttttgttgctgttcctcattaatagttggccacattgcgaatgttcgtcacaatggcttggcgttgcaaaatgttttggactgatgtcacctcattctgtggccaaaaggtggcacggaatgcgtgtcgatactccaggcttaatggacaattaatttaattaattaatcattttaatttttaaattagactgtcaaatttaaatattgaattgcctgcaaatgaaaaggattggcgcactgctgcaatggcctatggaaaataagatgaaggcaatgggcataaaaatgtgagtggccgtaaatgcgctcaaattgaaccaatcaattgcaaaaatgaacaaaatggcattcttaacaagaaaagtaatttaaataaacttaaatattatcaaactccgatgtaaaagaagagatcgctatgatcagactgagcgaatggagcagccttttgccatgctcttctgagaaaactgaa

SEQ ID NO: 6496 - DNA, 2503 bp, Heterodera glycines
tttcagcttggtttagatgttctgcgatgacttttataatgcctagttttacggggctttttgtgcttacttaaaaatggaatccctaatcataagaattcgaaaagaatggtctataaataggttgcattctttctctaacacaaataaactgttgattgcatattttccatgtgtaattaattaattgattaattaattattgtttgactgaccctgtgcatttcgacaccatgtgatcagccaaatcattgcgtagcatataagttcggcaacatttataatcagtgtgttgtttgctgtgtaattaatgatttccggatgatttgccggatcggcaagatcacatctgacaaatctaaatcaaacaattgaaaatgaaatattccaattaacaaacgtttcccaatgtttggagctcccgtaaaactggatgcatttgtcaacgatcactttgatcacacaaatgccaatcaaaattttgaaaactgtgtatttgccatcaattttgtacctgaaaatagtcattctttcaatcctttcaactttttaattaactccgataatcctcccatcaaagtttaattattttaaatgttaccaaattggaaatgcaacaccggctaatcggtccaatccgatgcacaattgcattgctaatgcgaaactgcttgcggataagctaacgaattgcatgtagtagcaatgttcaagtgtgatgtaattgatgccgaaaagaaagatgaaaaatttaacacacaatccgccgaggaggaaaatggctaagaaagcatacaaagcgatcagaatgttgcattgggaatggagagtcctgatcagcaaattgataacaaaattaaataatttatattaggaaatccagtcaaattaaaaaaaagcccaagaaattgcaattttattaatttaggttaatgaattattaaattatgaaatatcgaaatatcagcactttcttttcacagtcacatggacaagcgacgcgtttagtgcaattccaataaagcaaatgaacgcatttaggccaattaaaacggcttcaattggtggaacaaaagcaacctcctttttggttgtgaaatgggggaattgttttgttttgtttcatttaatttttaccttctgctgattcgttgaatttgttgacataattatgagcagaaaagatgaaaattacggatgaattataatttgatggatgaaaaaattatttattattttttatttatgattatgaaaaggtaaaaggtgtcaaaaaactaatagaaacccgaaaaaagaaaagaaaaagataaagctgaaaagactctttgaaaatacgacaccaaacttagattgtgcaccgtcatgctccaacttctcattgtttcgttttgttttaattacttgctgttggttcattttagtaattatcaaaacctaatttggtcaaaacattaaaaagcataattaaacattagtaatatgtataatttaaatgcaattgttttatttattttttgaatatcctctcgtacgaaaacggcccggcccctctatcaagagcttttgaatgataccaatattatccaattgataggcaaaaaccttcaaaacaatttttcaacataaccagctaggcgtccgagagcatgcgtgccggcagagggaaccggtaaaccggcacggcacagacagttgcggttgttagtacagtagcattctgcatcacactcattattgtttttaaaaatctaagtttggtgtcgcattttcaagctcccgctgaaaaggtggtcggggttgggcggcttatttttgtcttatgccaaagactcaaaaaaaagttttcggtatatttgcttgaaaaaataaaaatatttattcgctgatttcatttttaaatttttttggttttttcggtgctgataggcgagaaattttcacaaatatataaaacttaaaaatttttatgcctttcccctataaaaatgccattcacagagatagagggtgtaaaagtcattcatctttaactccaaaaagtgaaagatgaaaagtgaaagggccaaaaaggtaaataaaaaaaagaagagtgaaagcgaaactcagccctggttttattaacaatttaacaatattcaaacaaaaaaggcgaatgaattcgcattgaaaaatgtaaatatgaaaagtgtcatttcttctaattagctaattacacagtacacagtctcgtctctaattaaccatttaatgctccattgcattctttgaaaatgtaatattaaaagtgtcatttcttctaattacacagcctcgtctctaattaaccatttaatgcttcattgcgttcttcacagctttgctaattggcaattaaaattctgttttttaccgcatatatttgtatattatattaaataatgctaattgatgatgatgctcaggagtaggattatccaaatggtattttttaccgcatatatttgtatattatattaaataa

SEQ ID NO: 6497 - DNA, 4159 bp, Heterodera glycines
gcggcagaatatctttcaaagacgcggcgataattaaccaaatttattgcaaaggcaaatcaattaaatataattaagtaaattttccttttgttcagactcatgcaaagaccatgaggacaagtgccaaaacgggggctatttgaatccgaatgattgcacaaaatgccattgtccggacggatacggtggcgaatactgtaaagaactcgaagagagtgagtaaaaaatttaaaattatattaaattttacaaaattgaagaattgaattgttagaaaaatggttttattaaatcgattaagtggcagataaaatatcccaaaaatgttcctcccatttattagatgagaactgcgagattttgggcgatgagtcgagggaattaaaatctgatcagaccgccaaagtgttgaaaccggtgatcgggtgcacttctgccggcaaagaatgccgttgccattggcgaattgcggcaaatttttatttattaaaaatgataattaaaatgataagaattaacaatataaaataagcgaaaaggattttagcctatgtctagcacaaaagtgcgaattcaattcaaaagcttgaacaattcgctcatctgctcacacccatgcacaccaccgtacgtcgagatcaaataccgtaccgacaaaagggcacaaggcaaaaaaattaatgaactgattaattattacttagcaaaatgatggctcattaaggtgccaaactttgctgtccccgtgcacttacttgatctgaacggtaatgaatacaaaaattggattgcggcggaaaagccggaccatggacattgtccatttccgcgcacctttcaccaaaatggaccgtaccatcaaccgtattcgaactgaccatttgaatcgaggcgaggaaaattgtaaaataattttatttgttttttaaattaaaaaaattttaaatttgtattttaaaatgctttacatatctaatggaaaattgttctaaaaatctgttaaggcaacgtcaaactcataaattcgagcaaatgcgtgaaaatcgaaaatttgtatgccgagaaaaggagaaaaggaaccccgagcaccggcactttgcgttgttataacccgacgaagaatcaatattataactgctcctgtaacggtgataagaaatgcctcgctgaagaaaaatgggcacacgacgcgtttctttgtcaaataatacgggtgattaattaattaattaatttattattaatgccaaaagacactgccacagaaacatttcatataatattggcaatttaattttttttggctgtaaaaattaccactttttgtatcaaaaagcggaaataaggacaaatgagaacataaatgaaaaaaatgccgccatgtatttattgatttgtaaattcaaggtcaatggaattcaaatccaaattgattatcggtacaattggactcgtcttgatgttgattgttatgtgagttgggtcttcctaatttctcaaaccctttttaattgactaattttacagaaggccgaaggaggtaccgtaagcttttggggctacagtaagccggagaccaaagaaatcattcgtgtggacgaagtccactgtttgacttttgaagctgctggagtaacaccaccgtcacagaaacggttcaagagtttgcaagtcgaagaacagctgtcgatgaaattgaatccaagtacattattggacaatgcttcatcacttatccatgtgttcgtgccatttgttggccatccatgaaagaaaagggggagatcagtgatcagtggatgtgatctgtctgctgctgatcatttggccaatttccaatcagcaaatttattttttttaattttaagggtgtcactgttttatgtaagtccctctcatatttgtatttttaacgcctcatacaccagcatggactatataattttttggctaaaaatacaaaaatatctctcccctaaatagacaaaagtgatgcaagaaggaacggagtgtgggagaaagtgggataaaggacatgggagaaccgctaaaagtagcgcccgtagctcagttggttagagcacggcacggattgctggagtcttgggttcgagtcccaccggcggacgagttaccttttatgtttgttatacacaaaaaaatgacaaattttgatttaaatgtatataaacaattaaaaatttatttaatgcgtgtggagatgtctttttgtttaatttttccaattgtaaataagtattttattcatttaattatttattattttgttctttataaaatccgtgtcaaaatctattgaagacaaaaaagttcaatgaaaaatttacgtacaaaaaatgaatttcaaataaaataaaattaaaagaacaaaagaaaatataaatattttttaatttttgggagtgtttgaaaatttattagaaattgtaacatattcaaattattacccatgagcgaagacgaaccgaacccttcacacatttccctttttggccaatcgatgttattcatcttttcgatattcccccgttcatcatttcattcactatttctcttttctctaactctcacaaatccccgcaaatctccgccccttttccgttcaatttttcccccaccaatcagtcagtcgagtcggaggagatgatagtcggacgttggagcgatcaaaatacaaattaattatttattaattcatttaattattcacatatttcgcgcattataatccgacaataaagagccatacaaacgattggaccctttggacttcttggggatcagggcccgattcctaagattaagacctttcagtcctgggacaatccgtctcctcccatcccactctggcatggatcctcacgtcttactgttagcaccggatggttcgactttcgagtcgaaggaaagacgatccagcgaggggatgaaatccgactggctcaagctgcagaggcttagaatcacatttgaatattttacaaattaatttttatatatcattttttgaaaaaaatcgattttttagggatacattttcaaaaaaaaattttaaattttttacaaaaaatttctataaattctcaaaaatcctcaaaatatgtaaaaaaaatgaaaaatatgtacgaaaaattgcgaaatatgtacgaaaaagtccaaaatatgtaaaatatgtatttacataaaattagcatccctaattataacccggccgttaaatatatttgaaagaaaatcaaaagtcaaaacaaaaaaaatcatcagtaaaagaaatcattcattcaaaagaaaagtttaaaaaaatcagttctaaatcagtcaaaaaaaagagggagttcattcattcaaaaatcattctaacacacacaaaaaaaaccgtcataacttgaacactaataaatattttttaatttttgggagtgtttgaaaatttattaaaaatgttttcatattttttcattattcacttttgttgtgttgtttaattgctgtttaatcttaaaaattagtccacttcgtcctcctcggttgccagagaagggcaacaacaaaatgagcaacgacggcatcaaaggcagcctccgccgggtgctgagccgttataaaaaagccatcaaatgaaaattttcaacaaaaaactagccctaactttgctcaaaaccaactaaacggataattgtggctttatcagctgagtaatgattgatcattttttaagacaatcacaatcctgatcagtcagtccagttaaaatgaccccggcggcggcgcttacgctaatgaagacgatacactttttctatgctttatcttatcacagcatcatttattcaattctatcattttgttttatcatcacaaatacgtacaattattaattatgcaataaataattaattatgtattcattcacattttacgccaaattatccgataaaaaagtgctggaaattgtcgacgaatgattttgtgatgatttggccaaggtgtaaaaaatgaataaattactttgtcatttatcggtgtccacaatctctgctatggtcgtttgtccgctttttcttctgttggtggcttttccccccatttttttacacgtcgacacaaaaattcagtgattggtccaacggattca

SEQ ID NO: 6498 - DNA, 2042 bp, Heterodera glycines
aatttatgacacaatgcgatcggaaaatggagaacaaaatgaaggagttgctccactatcagcagctgatcagcagcaactgaaggcgcgtgaaaaacggagaagggcaattaattgttaaaataaataaaaatgaaaatcgaaattttattttatttattttaatttttttaggaatttcgtcaaaactttggcaaaatgcaaatggaattacgggaaacaatcgaaaaacttgtggctaaagttggcgaattggagaagcaacaacagcgccaaaaagtcaattaaatgggagggaggggacaaagtccacaatattctaaaaatttaatttaatttaaaattttctattttttcaatttaatatataaataaataagaatttttccattaaatatttaaaaaaaaatgttatttcatttgacagaacaacgcgggagtgttcacaaaagtgaccgttgcaatggttggaaataattttaaattataataaattttaaattcagcagcaaaattgttgggatggcaccgcttgccccagagaattggaaatcattggtgccaaacgtttgatggtccaatacaaaggaaatcgcttaaaaggtaattgtcacaaattaacaaaaaaattattaaagaaatttaataattaaaattaaaatcactttaaatacgattattttaattgaaaggaagtcgctcaatgttcacaaaacgctgcattctgagcacaaattcgtccatttcttacgtcgaagtgaaaatcatcagtatgaaaatgtaaataaatcttagaaaaataaaaatataatttaaagtttataatttataataatttttaggtgcgcaatgattggacttgcgaccaaagaaatgccattgtacggaagggttggcacttatcctaacagttacggacaccgaagcgatggccttttttgggtcaacggttcctgccaaattggcagtcaaagtgccaaatttggcatcggagatgtcatcggatgtggcattatattggccacgcgccaaatttttttcacgaaaaacggacaccgtttgggttgacaaatgactaaaacggcatttttaatgggattttttcagattccgccgattttgtggcactttttccttctgaagatgtccctcttttcacttgtgtcactttgcacgattccgaggacaaaattgaggcgaattttgggccggaattcaactttaatcttaacactctctgaagaaacctttaaaaaacgtaatccatttgtatttttcatttttgtaagcctttttacttaatcttttaaaacaatttaattttttgtcatttttaatgtatttaaaaaatatgcgaaaaaggtgattccgagaattaaaaaacaatgacgaaattgaggagggacactgaaaatccggcaaatttgtcgagaacaccgagactctcgcgcggcaccatttacacaccatcaaaattcaatcagaactcaaaaaacaaaatacgctaagtatttaatacaattgatgcagaaaaagcaaatatttgtataccataatcaatatattaacaggcaaataaaaattttctgaacacgaataaaccattttttatattttcaattgaagacaaacaaattcgataattaaataattttataaaaaaggaaatttaaaaatcataatttgtaatggtttacaaaacaaagatttaaagatggatgtttttacctatatatctatttattcaatagttccggtctcataattatcggaagaaatatttaaattttgtatggctttcttggttttcctgatctcattgttatatagttgaaaattctgaatggctattgtaaattctttttccaatgctaattgatttaacaaagatttacatattctattctcagagattattactaaatccaattttcctctaggatttatttattaaaagtttaattgaagtaatttttttctaggtcaacattttggctcgataattaagggaaaaaaaagtaataatggtaaaaggacaaaaa

SEQ ID NO: 6499 - DNA, 2149 bp, Heterodera glycines
  misc_feature (71)..(71): n is a, c, g, or t
  misc_feature (92)..(92): n is a, c, g, or t
  misc_feature (133)..(133): n is a, c, g, or t
tgtcatagtttttttaattggtctaagcttacactttcttggtatcaaacgaatttcttaagcgtctcganaacccgcaatttcagcatttntaaatatattaggaataattttctttctgttgcttataacncaaaataagtgatacaaaaattataaacttcaagtgctttcaatgcgtaccaaaaatgtgactttttagcaagtaatggcctaaaaactgagaattggcattcattgaacgcgtaaagtgcagagagcttaaaaataaaataaatcagctaattgccattaaatgggaagttttttgttaactgcgaccaacacttttgtcttcccggaaaaaatgtactacctttttggagtgggttttttggggtaattaggcactaatctcggatatgactatattggtaggttttcatacaaatcagcaataaatgctttctgccgttcattcattaaatgctaacaaatgaggatggccagaaagtgtaagcatagacaaaaagcgatttatttattttttcaaaaatggaaaataaaaaaaacaacaacaaaagtggtcttcttaatttatgcaactcgcttccatgtttttctgttctctttttaaatgtctgggagaagaaatttgggcccaaaatttgccacgattttgtcaccaaagccacacaaagaaacgaaggaaaacaacggaacagcgaaagaagcgaccaacgaattggagacatctgaaaagcataaattaaaattttaatttaatttttttttccaacccaaaagacgtccgtttttcgtgaaaatgatttgtcggttggccaaattaacgccacagccgacaatgtcttcacgataaaactgattagaagacccatagagcgaggaaccgttaatgtaaaaagtgccattgtttgggtaagcgtaagtgccaatgcggcttaaaaccgacagaaacggtttctgtttagcggccaatccgatcagtacaccgccgtcactgcaaaaagtaataaaaaaaaccattatgcatatttagtgaagtaattttctaacaattccatgtgttcaactccaatttcaaagtaaaaaatgcctgaagaatgatcttcgctgggaattgggtgttctgcgaaaacagtacgccaacctgttgaattttgaattaaattagcaattgtcagagattttgccttaccaggcgttttcgacagtgattgatttcggcagtagttttaaattcatttttctacgaatttactgttcaaatgaattaattttaattttcaaaattttactagacgtaccatataggacaagttttttaaaagcaaaagtttactgtcgaatcaccgctgtcgaaaactaacagcaccgattttgctactcccccaaaaaagttaatttttatgcatttttgaatttcaatttaattggtttgtcctgcggcggcgccaaagacataagggcgtaccaaggatttttgttttccttccatttacctgttgaatgtttttgcttattgaccactgtaagaccgtcgtcgccagtgatttcgagctcattttggcaaaacttgacatcccaataattttgttggagttttagaaaaagcttaaaataattaatttattttaattaaaaatatttaaattaattatttatttcaaattttaatttcccagcccattcatttatcattttttgtcattaatttaccattttctgctgttcttttttcatttgcatttccattgctttgaccttttctgacagcgttttttgggaattttgtaattcccttaatttatcggcagacacttaaaataaaagtattgcaaccgtgctaggatgtttcctgaatccgccatcagaagaagaaaaacaaaaaacatagactaatatcaattcaaaattttggcacgataatttgacactaagtcctactcatttgcaactgcaatcagtgaataaaaattatttttgctcaatttttggctgaaaattatgtcactatttgtcactatttcggacttttttcactattttgtcacttttttggcactttttcgtcactattttagttaactattttgggatttttcgtcactaaaagtcgcgaccctagtgaaaacacttactcacaggg

SEQ ID NO: 6500 - DNA, 2515 bp, Heterodera glycines
cagggttcccagatcaaaaatttcaaaagcctcatttggcaggcgaaaaagcctcattttgtgtcaaaaagcctcatttttataaagtttattaaaacacgcttaaaattttcaaatgatttatttttgattgtccatgatcaatttgagcaattttttgttcgaaataaacattttgtgaaattctaagcatgaaaaaccgaagttgatttttttgcggcgcttttttcaaaaaacttttggggaacaaggtgggccggcggtgccgataggcgccgccgggaaaaattttgtgatttttaatacgatttgttaacagatttgtcgacaaatatggccaaaaacattatgccaatttatcaaaattaatcaaaatttaaaaaatctgacgaattttccccaaaaatcttcaaaatttcttaaaaaaccacaaaaagcctcaaattgaaaatttagcctcattgacctatcaaaaaaccacaaaatgaggctaaagcctcagatctgggaaccctgctaactcatctgacaactgttatgagtaaaacattcaatgatgtgccccgaaaattctccacacagcttgaggttagcttaattaatgaataattaaaaaatagtcaaatttatattttaactgtatttttccatttgaagcttttccttttccttctccaatctgtcaattttgtccttcaactcaatgttttctgccatcagcctttgctgttttaattctgtttgaagcgatttctgtcaaattaaaatttaagaaaatccattttttattttaaataaaaatatttaaggttttttatgttttgctggaaatccccatgcctcttcaagttccattttggtgaacgcgcacatttgtttggccaccttcaattccatttccagtttctctaacttctcccaaaactgaattcaattgaatttatttaaattttattttcatttttttttaccaaaatgccatcttcatcatcgtcctgctgtttgcttttggcctccttcctcagctgctcatctccaacttgttcagcattttcatctttatatccaaagtcatccaaactgaacgcatcgccaatcacttgagaaaagaattcacattatttattatgtattctctaatctttaatttatttaatgtatttttttcttcattttaaaagaatttttattaaattttctgtaaagttttcttttggcctttttaagaaatttcgcaaaaaaaccctaagctttacaaaagtgccaaatagttacaaaaatgaattgcgtttgttgtttattttggcgttttactcgcaaagatcggcatttacctataattccttagtaatttattttcatattaagaaaaaaatcttgtcataataattaatctcttctgaaccttgaaactgctgatcagctgcttctgctggtataaagccgtcatttgtcgaatcattcgaaattgacatttgaatttctgttgaaatttattttatttttttttctaaaataaaataataattatttattatattccttattgttagtttggttgagaaactgagaaattgctgcataaaagcactttttgtgtattagaggtcacttatttgtgagggcaaatggaaatataataaatgaggctaaatgatgaccccaaaataaagggaaaatgacagatagaaaaaaagtttttttttttaaattattaccgcatgcattaaacatttatttatacttaagccaaatctactgcaattccaatgcttatttatccccccccccactaatgggattcagtcactcataccagggatggcacggaattccgacttccgaaaatttttggggcctcggaatcccgacttccgacttccgaaatttttgatgaaaagtcggaatttttcggaatttttttgagtttttttttcaaaaaattagcaatttttgtacaatttatgttaataaattgcatagaaattttcaattttttttccgacggcacctatcggcaccgccggactcaaaaaaaaacttaattttcttgaaaatttgctcaaaatcgctaaattttccattttttggacaaaatttgttaacaatttacattaaaattacaaaatttttcccggcggcgcatatcggcaccgccggacccttccttccccacagtttctcaaattctctttggataaagcgcgccgcaaaaaaagggtgtaactttcccaaaaaaaatccaaaataatgtaaaattacttaaaatattttgatctttttaaaaaacatagaaataaactaaaaacagtttgaaattaccttttacatggttaaaaatttaaaaatttagcctattaaatatttttttaaaaatttattatatttttttttgaaaaattccgacttccgaaaatttttggggcatcggaattccgacttccgacttccgaaaatttttggggcatcggaattccgacttccgacttccgaaaatttttagtgcctcggaact

SEQ ID NO: 6501 - DNA, 1087 bp, Heterodera glycines
ttattttatttgaaagtttatgaaaagaaaaatcaattgataattagaataaggtccattattttgtgaaatgatttttgtttattggcaaaaccaataaaagcacccgtactgaaaataaagaacaattcgttgaaataattaaatgaaataattaaaacacttttgtgttgagatttgctattcaaaaattaagaaaaaatcgaatttgaagttaattatacgaaaaggaccacaaatttcaaggtgaaaaatgcaaccccttggaagcaatgagtgggtgacctttcaaaattcaaagtaaaaaaaattgagataaatttttaaaatatttttgaacttatctctcttctcagttccatttcattccgtgttcgaagacaccttacaaattcatttccattttttaataatttatttttccatttttaatttctcaaattttgttttcatggaattgttaattctcttctctgtcggctctcctatcgatattttggtaaatggttttccagaaaattcatgaatttttttttgtgtggggaaaacccgaatttcgaacaaattcaaaatcttttctatgccaaaataaagacaattatttggtttggaagtaaaaaaattgcaaaagagctttgtttcgtcaacacttaacaaattattttattaagttaatattttttttaataacgataaataagtattgatttcgaaattgacctattgatttattttgccatagataatcttgttaataaattgaataaattttagtcatatcgaatatttcaatttgtataatattcaaattaattaagcaaatccaattttggttccagaataattgaaaaaaaatttcattaatgcaaacgatataccgtattttctcttattatcaccccgggggtattatttttcaacctcctcagaaagggggggggggataattagacacggggggataaatggagaaggggaaattatttttcgaccgatttattttgtgtaaatttaaaaaaaaatttgaatatgtcgccaaaaaatgtcatcgagtcaaagaaaaatcattttttattgtattttttaa

SEQ ID NO: 6502 - DNA, 6472 bp, Heterodera glycines
atttattgcctttttttcgccctaaaaatgactaatttttgccatttttgggccaaattttcaaaaaattgtggtaaaattggggttagggggtgccgttagccgccaccaggagaaattcttggaaattttaatgcaatttatcgagggaattgataaatttaaaaaaaaaattagtccattttttcttcaatttttattctctcccccacacctccgctctctgaaaacctgaaaaaaaaaaatttcaaatcaattttttgggtcaaccgatgtaaaattggccattttttttgtcaagttcatgtcacgactggaccaacgggcgggcaaatttctgcgaattgtgccgttcaaagagccgcgctcaaaccgaaccgaagtgttggcacgggacgcggaaattgacggatttgacaccgccaaattcgttttcaccgacatttcattcgacgccacagatatggttagattcaaaaaaaaaaaatttttttttaaatttcggcgtggaaattttttttttttgttacttttgtttaggtattaattttcttcgttattattattattttttaaatgggtttgactctgaaaaaagaaaaaattctcaaaaagtttggcttgagaaaataagaatgttttgccatcgttcaaaaatgccgagaaaaaattcttgaacatccaatagcttacaaaattagcttattgcatctataacacgcaaaagaccccacccaaaccgatcaattctttgatttttatgatttttttacacaaaaattctcatattttttttttaaatgccgactttctgatgaggattttcacaatttttgaaaaatgatttcaaatgctgagagtcttttggtcatgtttatctcccccaaggatcgcactgtcgttgtccgggagcaggacggaacgctacgaacggcgttgccggaagaacacgatcggatgaatcggctgttttttgtgcaacccaatcggcctgtcaacgaaccgccgctgtttgcaatgaccgacgaatggttacaggtgcccaagaaaccctttttttatataaaaaaacaaaaaaattttttttattgctctggcaaattggcatccaattactgaccattcacaatttttaggccctaacttttttttcttactttgtcaatgcctaatttttggtatcaaacgaaagcttaaagtctcgggaatttataaataatttgcaaatattgacattagaaaaaaaaatgacaatcagagaacacgacaatcaactcttttttttcgagtatagccaagaataatttttgccgttgcttttagcccggaatttaggtctatcaaaaactatagactttaagtttattttgataccaagactttttaggcattaacaaagtaagaaagttaaggcctaagaaattgaggatggtcagtggttggacggtaagctgctgtatagccaaatatttcagatttcgcaatttttttgaattttaaaattttttcacatcctttaactagagtgccacgggaccgggaattttgggcaaacccgggaccttttcgggttgaaaacccgggaatttttggcaaacccgggaccgggaccttttcgggttgaaaaccttttccccttttttccagaagacgctggaccgtgatgagcatgagtttgtgctggactgggcctgtcatttttacgagccggacgctcccaaatttgttgaggtccatcattttttgtcagaaatcggtggcatttttcggggggactggacaaaatctcgccgccggaatctcgccgggacaaaatctcgccgcagaaatttcaaacaaatttttcaaggaaaaaattcctagaaaatttttaataaggaaaaattttcaaaaaaaacttaacaaatattttttttttttgaaattttcttataaaaaattttctaagaattttttccttgaaaaatttctgtttgaaaaaattttttttgaaatttctgcggcgagatttcggcggcgagattttgggatgtaccctttttcggaatttttttcgtaattcgaaaaatttatttcactcccttcttttcttttcaaaattaaacgactttgtttagctttgtaagtacatttttgaccacacattggaaaatgacaagttggacgtgctgtactccaccagacatttcggcacattggccttctatttggtgatcaacggcaaaatggacaaactattggaattctatgagcagaagaacaggtggtcaccagcgttttcatatcatcaaaaagaaaagttaccatttcccacaaatccttttgatcacatttatggccaaaaaggtggaaaatctggttttttggaaaaaatttatgtctcaaatcatgagcaattttcagaataagcataaaaattctatgataaaactcgtacgctttccatataacccgctaatggattaattaaattaacccaccttaaacacaacttgtctaactttttttataagaaaatttaaagaaaaataattgaaaattttcaactatttttggaaaacaaattttaaaaaatcagaaattcatcataaaatttaaaaaatttcaaattctgtgtctccataaagacgacttaattttacattttcttatgtaaaaaattttaaaaaataatccgttttcctcctcttttgcagaaatgacggcgtagatcaaacgcgacaactttggcagatactttcttgttattgaagttttaattggatttctttctaaatgtgtcgacaattttttgaataaattttgttcattttcggtttatttttgtgtttggaacaacattaacctggtgaacaacatgcatgttacataatatttttaatgaaaaaaatatctattttttccacactaaaaaaattttttgcgatgggaaaaaatacgaaaaatttttcgcttttattgcgcaagggcaattcgcgtgtgccaatgcgtcgactgcgcgacggatcagcagcagccgccggcacagatgtggcggccacaacggcggcgagcagttcaacaaatgcggcaggtggttgtacaattagggaacgattaatgggagagtgggttaattaacggagaaaaagtggcctaaaaagttggcacttcagtgtcgcccagggcaacctaattgaaactcatttggctaattgtttttcatttcttgttctgtagttaaattagtaatacgaaatgtggttggctcagtggtggtttctttgaaattggctctaaattgggttgggttcggtgccgccgatgtgtggtgctgcatttaattttaataaaattaaaagcttgagaaggaatgatgagaaaagttttgtgggaatctctctgaagatttcatgattataaaccaaaacaaaattgatccataatctgaccttcttgcaaagaaatgttttttttaaaatttttctcagtttccatggcacacaaatgaacctttttccggcaatacaatcgatgggggcccctaagctgaaaattttggcattttttgtgcattttgttgaacatttgaattttcaacttctattcgagcctagttttcggggttcgaactggtgtcaaaattggatggatgtcataatttcctatgtaaaattattgttttttttttacacaggacagtcgcataataatcagactgaaatggatgtgccgtcgtcaaacagtgaatggaaacgcgtggacaaacgaataattgacatggactggacaatgtcaagatcagctgcattaaaagtctggaaaattgttttcggtatttccgggttttgtcacccccccccccccttcgaaaaaattatatagataactttgtcaaatcgatgaccagatgtcatcagaattgcaaaacaaacaccaccatattcgtgcgtgtcaaattcgtgatcagcatcaaaaattagcctagaaaaaattattagaaaaaaaaaatttaaggggagggggtggcaaaacccggaaggtacccttttttcgataacagcgaaaatagggccaggatttttgaaatccttatcgcctctgacctcaggctccgatttcatggccaaaatctatttaaaatgggacaatctctccgccgttccctctcccagaaaaaaaaaaattttttttttttgagtttttggattgtttaaaaattgttttgccacagattttgctgtccgttcggctgtccgcttcgctgtggtccatcatttcggactgtgacgaggtgttcaactactgggagccgctgcacctggtgctgttcggccgcggcttccaaacatgggaatatgcgcccgactacgcaattcggtacggggctcgaacgcaagttgagcagggacgtccagggtggcccatttccgaaaattcataaaataaacaattcttaatgaaaatatgttaaaaattgtaaaaaattcaaaaaaaaaaatttccaccgcgctggacccctcctgttcctcaaaaattaaaaaaaacgacgtaaaaaatcttcattctgagactataccccctccaagtcgaaatcctgggcctgtccctgaggatgagggtagaattaacgaaaaaattcgctttccgtatttttaacataattttcaaaaaaaatgtaaaaaatttaaaaatacttttcaagttcgtggctttatgtgctgctgtatgcgctgcctgcccaaccacttttgtttttgattggcacctcttcaaagttggcactgttttttgccatccgttttctgattgggtgagttttgcatttttttttttttggttttttgtataattatttagctgctttgaattgtgtttattttctcaacattttaaacctacaatttttgggagcaattcggttccaccccccttcccccttttccccccacccgaaaatgtttttaaaaagaatttccaaacatttttcaaggaaaattgcaaaaaaaaatgaaaattttttcacgcttttttgggaaaattttttgaaaaaataatttaagtatcataaagttttcaaaattgctagagaatttttcaaagatttattagaaatatttctgtttgatttttttaaattttttgttgggggggggcggcgaagaaacgaactgtaccctaaaatttttccaatattttttttttcattttcaaaattaattttggactaaattccgattttttgtataaatttttaaaaatttttcaataaaaaagtcctgtttgaactgtattgtatgtaacatttggctttgtgcagctccgtgtgcctcttctctgagctgtgtctgtacgaaagtgtgtgccgcagggcgggcaattccgttggccgtgcctttctgctgttcactgtgctgtcgcccgcaatgttcagcgcctcgtgcgcctttttgccctcctcgttcagcatggcattcaacgcactcgcaatggcactttggctgcgcgaaaaatggtgccaactaatgttttttgtttagctttttttggaaaatttaaaaaaaatcatgctaaaaatgacaatgaaaggtgttgccactgtgcgtgcaaatagcgcagtcggttaagcgccagtttcagtgcattggtgaagggtttcgaaccctttactccgcgcgccaattttttttcttttgctatttttaattcaattttcatttggcaatttctctttagtttttgaaaaaaaaaacaatttttttttgagaaatattccgcaaagcatgcccaaaaatgccaaaatatatgttcaaaagtagacaaaccaatgaccttattgccattgtaggccaattgtcatgcaaatttgtgcctcgggcatttgcgcccctagcgaaaatcggacatttgcgcccaggatatttttcttttatttttattcacagttgtcccattttttttctcattcataacgacattgaaatcgaaatttttaaaatttagacattatttaaacagaaatgagcatgcattttttccttcttttttttgccaggtttctctccatctttttgaccgcgttcagtgcgctgctcggctggccctttgccgcactgcttggcctcccaattgctgtccaaatggtgctgttgccgctccgtcgggccaatctttggaccaaatttgctggattttccgccatttctggcaccattctgttgggcctgctctgtgccgtggacacgcatttgttcggcaaatttgtcattgtaaatttccagcatttttcaattttttttttgaaattttacaatttttcaaaaatttatgcaaaaaaaaatttctaagatttttcttcattcatcaattaaaaaaaaattcccatttacaggctcccctcaacattgtgctgtacaacattttctctgctcatggaacaactctttatgggtataattagaaaataaaaataaaatgactctagaggtccccg

SEQ ID NO: 6503 - DNA, 6572 bp, Heterodera glycines
gcaaaactgttgatagacaaagaaaacttgactgtttcccaaaggggagaaagtgatgaatttagaccgttgctacacaaaaaggttttcttgattatttctgcgcagtgattaagcgaggtataactttacggcattcactgaattataattggtcaactgcactgcatttatgacatcaaactatatagaatttataatgaatacaaattttttttttaaaaaaaaaatgtaaattaaaaatatgatgcaaaaaaaaaaattaatgcaaatgcattgattaaaaattaattgcgcttttaatcactataatcttgactgtaacctccaagggagcaaatttttttttaaaagactaaaaaataatcgacttaaaacctaggtaaacacattctcaaaatattttgcattaagcacatcgattttttttttaaattcaaaaaagggtaatagttaaaacctttttaatcattctgaaaaaaatgatgcgtctggatactgacttctttttggtgtaaaaaaaaacttatacttgtaggcactttcttaaaaaaactaatgtcttgacagctttcccctaagagaatagaataaaaaatagtttaagtaatgacaaaaaaaatttcggaccaaaattctggtatgtagaaggggagaatttaaatctcgagctaatatgaaataatcagaaagggcacctaaaataatagtttatggaattgtgccaaaaatgaaatccatgtactatcaaacataattttggtatctggtttatttataaatttatataaattttttatccaatccacatgaccaatgataggttaaatagtgatagttggcacctcttggctctcaaccttagctttgcttgacgacaaggttcgttttaaagattaaaggttctcactgttcacttgaggataatcgaactgatagaaatctggcgggttgttaaatcaattttttgaggtattggaccattactgacaagattatacatttactttttttaacactttcgactgcaattaaataatttttttttaatagctcctgtcccttcattcttgacagagttgcccgagggctttgatcataaaaactcagattcgaaatggctcggatgagcggtcaataattcaaatattaaatccttcagcttcccctgtgaggtctccttgttaataagctgttgtgagtcatttgtactgaaagtttcatttcgttttttgctaataaacctatctctatccatgatgatttcttccattaaaaaatcagggatttatcgggtacctaaggagccaaattcgcatggtaaacccagtgttttctgaacctttagattattctcacttgtcttttttggtttgccaatacagttacagtaccccttaaaaattcggaaatggtccatctttggaagctaagagatctccaagcttctcagtctgagaatagacttggtataaaattgatcaggtttaagaaagccaaaaggattaaaaaaacaaatccatgttaggagcctatcaaaaatttcaaaattctcctttcctgtgagcttaatgaggaattcgcaaaatccttccgctttttgaatttgcaaagagccctttgtgattagtgaattaaggcttgatttctgtttttttgtttgtcatatcattaaggatttgtatcattcaaaatttgagattagggtaaactgaccaaaagaataataattataattcaaattttatttctattccataacttgacagattgccctagagccaaaattctgaaaaataaatattcaataatttgtgatgactaaactgtctcacaaaaaaaaaaaaaatcaatgccataattataactccggtacagtcggtgagagtaataaaaaaaattttatgcatgcacgggcaaacttcatggcgaaatgggtatccaatgacccaaaaaataaaatgttttcacccaccatattttgacaaaaggcacaaaagccgtgaatattttttttattcagagatccgagaaagcagaatcagaattttttggccttttttcaactaaattttgccttatgcaaaaaatggatcatcacaaaaaaaattgtacttctgctgatcataacaatgttagggcggtctgaaagttcctcaatgtaaaaaattgaaaaaaaaaaaaaaaattggccgtgagcggttttaattttctgtttaaatttggaagcatataaaatattttttttaataatttgagtggcctaataacttctggagcagtctgttttagtgagtgcacgcagggtaaagctcagcaaaatgtctccaatattatgtccaaacaaaaaacatcaaaagcggatttttttttctcttataaggcttttttttggcgattaaatttcaaaattttaaatcgcccgtttaacaaaacattttctgccttagtttggattcttaaggctctttggcacataaattttcaatttcgccattcaacatgacagaactcccgaaggagcgacgttccttaaatgtctaggcttttgctgatatgaattaaattgcctcacaaaaaagaactaaaaaaataataattattgcctgtaaaaaaaataacattcaattgcattgaagcctcattcactcgaagccattgaactaccaaattaaacgcttgaaatggtccatctttgggtagctaaaagagattcaagtttctcagcttgaattttgtttgtccttaatatatttggtagcctttcagcaaaaaaaagtttggttttaaatttcaaattcttcacaaattatatcgattaatgaattgagctgcttgtaaaataacctatttatgttaatttaatttccatgcaattaaggctctgactggaatagtttcggataaaaaataatggcatccacaaatcattttctagtccaatttaagatagtcccaaaattgaagaattagactaaaatcggaatcaaaataattctctgataaagaaatattgaatttttttaccatttcttgacaaataacctaggtccgcaatttagttaaataaatatttaaaaagatacaggactgaatatgtaagagagacttagaatgttagcctttttgctaaaataaataaaattcctcaaaaatctcaaaaataacaataaaattatattgacaaatttttgtaattaattgcttttgcattttaatttgaaaggctgagaaaatttcagaaaatcgctttaagtggcttgccttcacattccattcttcggcgttttcaggggtgtaatgcatttccggtacagtcggtgagaataatgaaaagaaaaaaaattttatgcacgcaagggcaaagttcacaatagccactgggtattcattacctcagttggcaaaataaataattgagtactttttcatcatccaaaacttgacaaatggcccaaaggccgcaaaaatattctttattctgatgagagccaaaagcgagcagaaacatgctgcttgaatttgtttggcctttttcctcatagacttggcctggcctataaaataattttgacttagcataacattaggcggctctgaatgccttttcctcaatataaatttaaaaaaaaaatagcccggagcgctttgagtttgctattaaattatggggagcagcacagaaaataaatcatcctttcgcttaattatttccggagcagtcggccttttacgcgcagggcaaagttcatcaaaaattccaaatactagggcaaagatttttatgtaagagaaaaaaaacgctaattacaattattaaataaattatacattaaaattgccaaagtaccagttttaaaaaaagtatattaacatataaatctttgccctcttaatatgcccaaacaaaaattaaccaatcggcgcaatcatcaaatctgtggcttcaactgataaataaattggggctgtcctcaaaatttataaatttatttggccattgagcgcgcggcaattcataaaagttatttaggcttaaaataggtcttttcacggcacttcacaaaatcttggccattaaaaaattggaccggtccttgacagaactcccgaaggagcggcgcgcctcattccgttctcgttcccctacacacgcaaattcccgctcgtcctcctggggatggattgccagcggcgtgccagcaaccatccggtgctaccagtgaaggtgctgatgtccagccctgaatatgaggaagggacgagggaaattggggattggatttgggggaaaaaggaataagccaaaatccgggccctggataaatgacctccccaaatttgtaatcccatgggcgcctattagatctaatacgcgtgcggggatgggcgagaaggagtaaaataataatataaatattggccaattacattaataataattccgccgcgttctgctctcggctctcgctcgccgattaactgcccgctcaactgactccttatcgagagaatgctcccgattaaatagttggacttatggaacggaataaagatggggaaaagcggggataaatggtgtgagaaagagattgaacggatgtgataaattgcgccttacaatcgtttcttcattaaataaaacaattttattttaatatttaaaaaaatcactattacaacacattattatataaaaaaatcaattgcaatttaaaataaaaacaaaataattattaattaattcctaacacataaaaatttgaaaccataaatgaaaaaaagaattgacaaaatttttaacaaaatttaaaaaaataaataaataaaaataataaataaatataaaaaataatgaattaattaacacatataaactcatttacctcagaaatggcaaactaaactattttcgtgggagagcatgtgataaataaaaacacaagaaatgaatccaatttatataataaattgacgacattaaaatataaataattaaaaaaaaaagtaaaaaatcacataaaaattttctaaaaaattaacattttcttgtttttttgtttccctatggaaccgtcgccttataaatcagaattattttgtataaaaaaagaatttttcgtttttttccatggaaggaaatcccttatatttatttttagtttttagatcctaaaatctcatgccttttagccccgcgaaggatttgtctgtttttctctggtcccatgatcttttaatcctttttctcagctgttctctctctctcttttccccgctttttctctattctcaaattttcttttaaactgaataaatcttcaaaaatttttcttaaccttttttcatcaaaaaaacgtgataaaaatatttgttttgagctcctttttcttaggtgctgttgttaagctatttttcgagcatttacgccttattttaagtatttattttgggctttaatatccctaaaataaaaatttgttttgaatttcctgagaaaaaaagaatcgtcctaaatgttctctaaattcattatctttttttttaaattaaataaatgctatttgcatcattagcctttcaaaataaaagaaaaaatgataaataaaaatgcaataaaaaaaaataaaaaaagaaacctcaagaatttacaataattaattttttttttttaaatacacccaataatgttttttaaattttattttgcctttttttggcctcggtagtgcgtaaagaacctaaaaataggcattggtaataattttggttggtgagaattattttaaaacgtctttttaacttattagcagcatattatcatttttgctttggttcactccctaccgtcgacaaaattatattttctgttttctctccccaaacgaacaataattataatttcggtattatttattataaaagaaccatttctaacgcgcccctaattcggtttcaaatatcattatgggattttggcttcataaaaaattgcaattttgaaaaaaaaaaattaattaaaaagtatttggaaatatttttagataatattcaaaaataagtatagtataaccaaggcgaatatgaagctaatagagtaattttctaaaaaattaacattttcttgtttttttgtttccctatggaaccgtcgccttataaatcagaattattttgtataaaaaaagaatttttcgtttttttccatggaaggaaatcccttatatttatttttagtttttagatcctaaaatctcatgccttttagccccgcgaaggatttgtctgtttttctctggtcccatgatcttttaatcctttttctcagctgttctctctctctcttttccccgctttttctctattctcaaattttcttttaaactgaataaatcttcaaaaatttttcttaaccttttttcatcaaaaaaacgtgataaaaatatttgttttgagctcctttttcttatgtgctgttgttaagctatttttcgagcatttacgccttattttaagtatttattttggaatttaatatccctaaaataaaaatttgttttgaatttcctgag

SEQ ID NO: 6504 - DNA, 2787 bp, Heterodera glycines
ccccggtgtccaaaaatttttaaggaaaaataatattttggctgaaaattttaggttttccttgctgggctggtaccccccccccctccagacctagccacacccaaattttccaagaaatttcgctaattttttcaaaaaatccacagatttttgatgaaactatgcttaaaatggctcaaaatcacaaaatttggtcattttttggacaaaatctgttaacaaaccggatttaaaaccgtgaaaattttcccggtgactgctatttccagagaccttcccactgtgtatggcaattctttagaaaatttcgcaccactatggataaaagggctcgccatcgatatgtgcataaaaatgggcgaaatctgtgcataggcataactatataaaacacaatagcgatatatgtatataaaacctcaaatatgcactcaattatgtaaatccaatttttaaaattggttaatttttagataaatctcttcccatagggtgaaataggaattaaatggcttattgatagaatcatttttattatacaatattatctgggcatttttttccggtacattctaaatagaaatttcttttttgacaagaaatttctataaattttctaaatcacctagtatttaaaatatgtacgaaaaattagcagaattttggattttttgatgatttctaaaaatttccgtaaatgttcccagaatatgtaaaaaataaaaatttgtaagaattaatttcaaaacaggtaccaaatgtgttaaaatcccgaaatgtaaattatgtataaaagtccccgaaatatgtaaataaaagtcccaatttttgttcgcaaacacaaaaaagaaagtgtttttcctattatttcgaccatagaacccaggggaaaaaatatctatttacataaattcccagcctaattattatcatttaatttaatatttttgaaattttcgtgaatattttttttgaattgaaaaatttgcaaaaatttttaaaaaagggtaaagagataaggggctattagaaattaaacagagaaaattttacaacaaaactttatgcgcttattaaaaaagaatgtggactgaataccatgacaaagatcattcgaatttcaatgcatagcaaaacccgcagactcttaaaacgagttcggcactcagtccgaatttatttaccagcccgttttggcactgtttggccacaacaaagttgagagagccaaagtgcggtcaaactggagaggaaatggggagaggggcgggggaatcgaaccgatgtctcacacaaacaaaacaaaggcactaaccactgagcctagcacaaattcaaagaaaaacaaatgtttgaaagaagtgatgtaattggcagtttttctaaaaatttaatttgaggaaaacatattttttaatgaatttatgaagaatttgcaaatgttgactattttttctaatttgactaaaaaattttctgatttaaaaaaaaaaatcgaatttggcaattgatgagggaagtttaaggccgaattgtgccgacagacgccgaaataataaatgggattcttaattgttttctcagaacacccttggcacagtgccaaatcgaaaggaaaaataaataaaaatgttaaaagacattttgaatagggttgatcgggaccggggaattttgggcaaaaccgggacctgtacttttcgggttggttgaaaaaccaggactttttggctgggaaaaacgggaaaaaaccgggaatttcccggcctcggtctaacgggtcaaaaccgtgacttcggtactcatttgtccatgttttggtcccggtcccggccaaccataaaaactaaaaattttacaaaaaagttacaatttggccaacaaatttgagaaagtcaatgcattcaaaatagtaaaaaatttcgagtttctttttgaacaaaattttggattttttcccccattttcgtaaaatacatctttccagtgttttttcaattttcgccgaaagtttaacgaaattgcctcggaatcccgtacaatttcgaaattgacctcccacccccgttttccacctatatttataatgtcaatagtatatattaataaacggctttttgggcattaaaacagccaaaaaaagcaccaaaagtgagtaaaaagtaacttcaaattttatattccaaaactgatcaaaaaaaaaagaaatcctcagccagtagaaaagcctaaaaaatagttagtaaaattcgaaataatttagaaaaaaaagaaaattgtagactaaatgatcacgtcaaagaacatgaacttcaacgcatcagcggaaccctgtccgacacaacaagttctgcactcagtccaaattgatttacccgcgttgtaagcacttggccacaacaaagttgggagagccaaagtgcggtcaaacgggagaaatgggaaatgatgaagagtggaaccgaaccaacagcacatataaacacaacaaaggcactaaccactttgccaggcagtatacactatgcaaaatgtataaattcattgaaaaacgcattaaaaaatttttttgattttttttggggaatttagggtcagtggtgttaaaaactccgaaaaaaatgggattcttaattgttgtctaatatatttggaaaaatgcgccaaattcaaggaaaaatttaaaataaaaatgtttaaaaagtttattttaatgatgcttttttaaggaagacattgtggtttttaaagccaaagtaaaccctggagaagatttttgataat

SEQ ID NO: 6505 - DNA, 1255 bp, Heterodera glycines
ttaaaacaaaaaaagaagacgtttttggcacatttttttcaaatgccaaatgaatggggaaaagacaaaaaaaaagttaattgaccggaatatttttgtttgaatttttaaaaattaacacaaagtgaaaaataacctggcagccttgaaacagttatatgctcattattagggatgcgatttttaggcaaatgcctaaaattttgcgcatttgataagcaaagataaacacgaaaaacgcgttttccgtttggtttggggtgtctaggatgacttttgatgcctaactttgcctatttcggggtttttgtgcctgaggtgcctattttaggattttgaaaaaatccttaacaaaaatgcaataaaaacgaaaacacacccctaagaaatgacccaaaaaaaaaaaattcagaaaatacacccctaagaattgaaaaagttttcaaaaaattgatcatcgaatttaatatttttttcatgataaaaatttttggctaaaaatttgtccttattcgaaaaaacgttaaaacaattggaatataagcaaaattaagttttttgattaattttacgtgatttactacctgaaaacgttaataaaaaagttttatttgcctattttagtgcttattcgaggatttttgttcctatttaatgcctattttgagatttttttatgccgttttaggtgcctatttcgcgattttttgtgcctaaaaatcgcatccctactcattatcacaacgagttttgaaaaaaaagaagcaagtttttagaaattttgcgcaaataagtaaaataaaatattaaaaaaccacttcgcagagaaaatggcaaaccctaataatccctaatttattccgtacataaaatgcccaaattaataggaaaaaggcaaaaaagaattgacatttctgtttttttccctcacaatttacatatgttgagaaaaacatgaatatttaagaatttttagggaagaatttcaaaagtttattttttacagtttttttatctttcatgaaaactttttctaaatttttaaaaattaaatttgtcgttgaaaaatttttttttgaaaaattatggactgaaatgaccgcgctaaatcaattttgaagccattcaacgcatcaaggaactcggggtgtgaggtgacgagttcggcactaagtccgaatttatttaccagcccgttttggaactgtttggccacaacaaagttgggagagccaaagtgcggtcagacgggaga

SEQ ID NO: 6506 - DNA, 3371 bp, Heterodera glycines
  misc_feature (31)..(31): n is a, c, g, or t
ggaaatccgtggaagcggtgatcacgggggnctttaaaaaaaaaatccgtgacccgtgaaccgtgattataaaaaaaatttctaatgattttttatttaaatttatttagaaaacgcatttaatcgctggaaaaattcccaaaaaatattttaaagaaaccaaaacatataaaccgctttttttgcggcgtacctttttcaaaaaatgactaaatttacgatttttggccaattttttgaggaaaattagagctttttgtaggaatctccaaggaaaattttttattttttaactaagtttattaagaaaatttttcaaatttttcttaaatttaaccaaaaatctatttatgtagagcaaaaaatttcctctaatttgtaagctaacttttgatgctgaacaaaaaaatcttttggaccaacatgatcagattactccttcatggcgatctgaacaccccaaaagatactgaaagtcgggaaaattttagaaaaaatattagggggttgggaaaattttgtgaaaattttgattaggcctgtcattttaaatttatgcgacggagagaaaaaatagggatttttagccgtttttgtgccaaaaatgggctattttttttgccattttggggtcaaaatttcaaaaatacggtaaaatgggggtccgcctgccggtggtgccgacaggcgccgccgggaaaaattttgaaattttgagtgaatttgttaagagattttgtccaaaatatgtccaatcattggttaatttattggtctatggacgttttaaaaataaagaaaaataattttcaatattaggaaatttcttgttaataaaatttcaattaaattatcaaaacaaaatataaaaattatcctatcccaatggggaattgaacccaagggacagacagcgaaagacagaaggcttaaccaccagactacatatatatatatatatatatatgtttactccctaaacagaaataatttatttatttttttctcaaaaaatttcttttcacacaccactttcctattttcgtctcaataaaaattccctatataaaatgccaatcacggatcaaaatcacggaaaaattgaaaaaatccgtgacccgtgatctgagatcacggcaccccaaaaaccccgtgatttccgtgatcacggccagccctggtccgaggcctcttacgacgagaggggggggggggtgtctcgagacaccccttgtatatgatgctcaaaataacagcgataaagaaaaaaatttgaaaagccattttcaagataaaaaacataacaattttttgtttcgaccgagtaatatcgaagggaatttgggggttcagcgggcgctgccagtaattttttttgaaatttaacgaattttgttttaatataattaaaaaaaaattaatttggacaaagatttttgtaaaattagcataaactatatatttttttaattaagaaacattatttatttatttttatttcatattttttgcactttttgttttataaaaatcgacgttattaatggttttataatgtctaagggtagtatttgggggttcggcgctgcgtttaaattttttttttttttttgaaattctaaaggattttgtttttcctaaatccactctctctcacccgccagccctccggtggcggcggacacgccgaagaagcccgccttgggcagaaaaatgtgctccgcgcggatgcacatttcaaagcgcggcgtcgcgctcatcccgtcggacacgtgcacagtgagcgtgttgcggaagtattccaccttgatgtgcaccgggtactgcttgttgcggaagtcgcgttggcatgctgggacaaataatagtggcattttttgttgaaaaaggaaggtgcaattatttttttctggaaaatcaaggaaagaggaatagggttagcaaataatggtgcgcttcatttcccccagaaattttttttttgaaaaacgttcaaacagaaattttcaaaaaaaacaaacttttttatttacaattttggcaatggtaaggcattgtggcccacaaatttttttttctttatttaaaaatattcccaaagatttttgttttgaaaatttatttttgaaaaatttaaaacaaaaccctcggaggtgaaacggcctattccgagcaaagagtggaaagaaaataccaatgaatttttttttttaatttcataggtcgcggggaaactacaattagttaaaagtatttttttaaattaattggtaaaacgcactgctcaacacttggttggacccgtccgtgtgatggtcaaacgcgcgagtgcctggtaaaaaaggacaaaatcaaataatgccattgtaatttgaagactcaaagcttgcagcaaattttcccagcgacttcttaaatgcttttttaatattttgcaaacattttaggttacttaaacgctgaaaatttgggttttcctgtttttagggggttcggttttgagtccaactcatttgtcagtaacttttcccaacgaattcttttttttctgagtccaactcatttgtcagtaacttttcccagcgaattcttttttttctaatttcaattttgattaactgttcaaacccataaaaaagaattaaccaatcggggcaccataatggacgaaaatctctcgccccccctccaaaaaatgcaatttttcaaccatttaggacatagcacagaaaatttgacgaaaaagggcaactctgagcgctggccatgtttttgaggtataactccatttgggtttacttcagttgggccccgaacacgtttgggccacagccatgtttttggactcgaacttttttctttgtaaacaaaatccaacattgttggtatcattcgatagccctaagtgtgctcaattagcctacaaatttccaaaaaaaatcgtaaattttgaacaaacgaatgaccaaaagaatggcagaaaccaggttttagtaattttagccatcactttttgaaccttaacgaaaattttcgaaattttgcaggctactaaggacacttaaggctatcgaatgataccaacaattttgaattttataatccggggcccaaacgtgtcgggtcccaactgacgtagtccgctccattttcatagttgtacaaagcgaaccaatttgctacctataatgaccgtaaatgtttctatgtatattattctgcaaaatttcgaataaatgggccaaaaacacggtaggggtcaactccgtctggccaactccgtctcagcaatgttcaaaaagctataacttttttctttgttggccaaacttcacaatcatggtatcattcgaaagactctagaggtcccc

SEQ ID NO: 6507 - DNA, 623 bp, Heterodera glycines
accctcaaatttccccctccttccctcacccctcattcacttttattctttaaattctccccccccccccccttttcccatataaatccctttagtatacggattacttatgacgacaacaatgaaaaaaaacaaaaattaaatgcaatcaaaagctaattcgaccggaaagatgagaatattatcggttcgctcttttgtcgctttgctcatacggcgaagtccccagacagaacgaatgaatgattgctcaaattatgtccaaatccgattccaaattgcccatgccccgggcaattcttcggcttgtccataatcaacattttccctcgtgcgaaaagtcggaagagaaaataaagggaaaggccaattacgaacggctataagacaaagaagaagaggaagacggagataatggggaaacaagagcaaatggagaagaggaatagaagcagagagagggcgagagagagaagagagaggggggggagagagaaagagagagaggaagagagagagaagggggagagagagagagatgggagggggcgaaggcgccggagggggggggggagaacgaatgccttaccataacgccaatcggcgccgatccaacaatcccc

SEQ ID NO: 6508 - DNA, 2321 bp, Heterodera glycines
gccccccccccatctcaaaacaataatcgatgccccaaggggaaaagtgtcataaaattgccaatcggcggcaaaagccaattaaaagaaaatgaaatttaaataattgttttctccatctactcaatttgaagaatgtttgcgttggtcttgcttcttctcctcctatttaccaccaaaattaatttgtttcttgccgacggaatgcgcgtcgatccaaatcgaattgcggcccggttgagaatagagaaaaagtgggacaacgacggaagaacagaaaaagcggacgacgattttgggatgggaggacgaaatcggcgacaactgatcggagggactcccaaagaggaaacaattcaggcaaaaactggcaattaaatacaaatcggcaattaggggcaattagcggcatctatttgcctaattgggtttgcgagaatcgcccagcaatttttttgtgcgtgctcactttctgaaaccgttcaaggtcaccgccccgctgttctcctcgcgtctctttgaattcggtccaaaattgggcgacaaagaattgagcggaggcattgacatggccaaaagaatgcatctgaaccatccgatcactttcttcgggcattcccactcgaccgtttgggttttgagtaacggaggcatcggattcgacaatggcataaagcagtacaagccaaacgcattgccaagcatgggacagaagctgatagcaccgttttggaacagaaacgacttgagaaatgggggcaaagtgttgttcagagaagtgaacggtgagagagggggggggggcaattcgatcagagatcatgatcaatcggaagtgggcgaaagtgcaaaaacaaaaataattaattaaataaattaattaattgcccacaggcggtcgtgttttggagcggggtcaaagtgaaattcgctaccaatacgacagagaagtgaaggtggtgtccgctgttgtggtcacttacgaaaaaatgcaggtgaagaagaccggttggccattcataaattaatcaattaaacttttaattgtctataatcaattgccaaattgatcaattaaacttttaattgactatatataatcaatgtttttttagcccgtcggttcgtcgcccctcccagacgaagttggtgatcaaatgagtaaagaaaccaaacagaattttaatgttcgcctcccatagaatacaaacagtttccaattggtgctgttcatcaccagcaatggcacttttgccaatttcatctacagtaacatcgggtggacgcagggagccgaagtgaccgtttcaaaattggcatgcgaaaacaattcccaattttcaggccggctttaatgccggcgacggcaccaatcattttgcattgcccacctccggcaccggaaacatcatgtacttggaggagtacgggaacacgggaatcccaggagaatggatgtttattttggaggaggaacgtgtggtacggtgcaaggccggcataaaaggggacacttgcgacgagggtaagcggttactgatcagctattgatcattcagtgatcactcactaaatatcactcggaatcactcataatctcattaatcgcggttctcactgactgatcattcggtgattaatattattcacttggtgatcatcgctcacccaacacgcagtgatcacgtactgacttatcattcgttgattattcgttggcttttcatacggtgaagcctatttaatgatcggccgatgatcacttagtgatcgtatgatactcactgatatccagtgatcactcgttgaataaacatccggggatcacgcactaacttattactcactgatcactcgtttactgtgaataagtccattagcctcgacctttgctgcatcctgttgatcattttcagcatgttcgcctggtgaatggggcgaggattgtgtgaagtgagtcactgatgaatagcagacaaagatattcactaaaatgagaataaagcttaataatctcatgatctccactcatttctaagatgttgccattgtgcgaccggctcgtgccacgaagtgagcggcgaatgcaaatcggacggatgcgcgcggtgttggcacggcagagactgccaacagagggacggcagttgcgacgcgccacgcaaatgcgggaaaaatgcgcagccaaaagtcgtgacgaacatcggcacattgggcagccgttgtggggagccgcctcagtcgcagtgcgaatgtttgccgggttacgagggaaacgcggaggaaagctgtgcaggtgggggggggcaattgaaaaggga

SEQ ID NO: 6509 - DNA, 2200 bp, Heterodera glycines
  misc_feature (2117)..(2118): n is a, c, g, or t
gtaatgaaattgttaagcaataaatgaccttttgtaggtgttccctttcttcgcccccatcgatttggcccagcaaggacaaatttttgtggaagagaccaccgacccttcgctgttggccaaggccagccgtacgatcaacgaaaaattgaccgattcgcgacagtcgccttttgagggatcacacgcactgatggtcacttacgtaaatgtcagcttagccaacaccgagtcgaaggtgcgttgcggacagagcccatttggctgatcactctctgaaaattctttcccctcgagtcacactgatcacccctttcttttctgttcaacatctaattagttcgttctcctctgatcaccaccggattaattctgatcacttttccccctttctcttccacctgatcagttctccaacactttccaaactctgctaattgctggccgtgacaagttgaaacacgagaacatgacctttgtccaattcctctaccgggacattgcctggagcgaaggggccgaggcgggaataatggcgccggataagtccagctccattctgttgcccggatccggcaccatcggcattgagcagctgtcccagttgagcaatgttcggtatgttccccatttgtaactctctgatcagtgagtgaccaatgatcgccaattgcccgcgctccctttagctcccagggcatttggcttttccgtgtcgacttggcctcccttttgccctgcatgcagcccgacctgcagcctccctattgcgatggtcggtcgccaacgctggtcaatcggctgccgcctttccattcgaccactccgatgatcacgacaatggcacagacaagcgcaaaatcagtggaaaagacaaatgaagaggaaatggcacaatcaaagaaaggaaaagcaaaagcgacgacagccgaattttcaggagatgaaaaagaaacggacgaaggcgaagaggaaaaagacaaaggaggaaaagtagaaaagaaagagaaacagcaaaaaggaagtgacaaggaaaaggagggacaaagacaacagaagatactgccccaattggagcaaattgaagaacagacggaatggcaaccggtgagagaggaggaggcaaagaaagagacagacgacgaaagagcacagcaagacggagaaaatgaaagaggaaaagaaaaggagcgtcaggaggaagagggagccaaagaaaaagagggaagggaacacgaacaacaaaagtcggcacaacgcaaaaagacaacgaacgtcccgggcaatgccattgagccggcaattatcagcagtcggaagccggccattgtgaccatccaaagcaaagagatagaggaaatgccgccggatgcatttgacgatggcagcatcaggacggcaccgacccctcgggcgcaacaaatggaagagttggagagagaaatatccggaagcattgtgccggaactgattgtgccacaagtgatcgtaggagggaaacggaaagaggaaaaaggggaggacgaagaggaaaagggagacggaaggcaaaaaggaaatggaaaacggaaagaggaaggaggaaaagggaaagaagaaaaaggggacaaagaagagcaaaaaggaaaaggaggggaaaaagaaaacggaaaagggaaagaggaagaggaagaaggaaatggcagcaaaacatcggcatttttgcaagagaaaaccgacgaacacaacgccaatggcaatgataaggtattatcgtgttagaagaatgaatctgaacagaaattggttaagggaacaacaaattccaaggcgaaaaacgaaattcgaattgagccaattgggacaaaaggacggacaaatgccaaggcaaagcctacggcaattcccgcggaggaggcagaagagggccgagaagacgagcagaggcaacagcaagccgaagaaaagccggaacagcacgagccggcgtcgtcgagtgccgtgccgccatctccgccacaaaggcaacggccgacgacccccgaggcgaagagaacggcacggccatcgacagaaatggcaacaacggaggaacagagggaaacaccaaaagggaaaattgacaaagaaaaggcaanncactcaggaacacaccagcagaagtgagccgaacattcattctgatcacgaacagcacgaacaagcccaattcgccgtcccc

SEQ ID NO: 6510 - DNA, 937 bp, Heterodera glycines
catcgaacggcgttggggggacagagcgggagacggcgcaatcggaatactttgccaccagtcaagtagaggcaaataacaaattaatactaattgcgaaaacaattagcaaatgtttagagaaatacgaaccgtttcagcagtaataacaacggaaatggacggatttgaggagaaaaacagaaaagaagagaagagatggtgaaaaaggaggacaaaaaggagaagaaaaagcaacttttagtgccattcattgttattttattccaaattccaaccgaacattttgcttaaaggacgcaaatgcctcagtttcataattttcatttttgaaaccatccacacttttgtatgtaaatgaattatttttgaataaatttataaattattaataatttttaattattttatttttataattttgattatatttttgtgggggtaaaaactttaaataataataaattgcgtaatttttttttctttaggggtttaaaatctgaatttgtggggaacacccatcaatagggttccaatttttaggctctaagaaccgccaaaataggtaggctttaggctctaaaaaaccccaaaaataggctctaaaaatggaaaataggctctaaaaaatcttaaatttagggggtgtaaaatgacaaaattcattcaaaaaggtaaaaaaaaataagtcaaatcagtattgagttacattattttttaaattcaaaaatttgtccaaaaaaacttttaaagacgatttttgagaaaatttttcatttcctagggcgtttattttcagaaatttttgggtcgattcttaggggtgtatttttaaaattcccaaaaaagcgattcttaggggtgtatttttcgtttttattgcatttttgttaacaaattttgggcaaaacgccaaaataggcaaaaatagctcttt

SEQ ID NO: 6511 - DNA, 1085 bp, Heterodera glycines
ttttctgaagaaactctcaaggagtaggcaaatcttttattcgttatcacgacgttttgtcctgctcaatgttgaattacacatagttcttggtcattatttaacaataatatgtgtgttaaatttaatgaaaaaacaatctaacgcgtaagcaaaatatgtaaaaatgtgttatcaaataacataaaaatggggttcccatgggattatgaattctttccaattgtggcagatttgtttcttaatttaaagaaggcattaatccgagtccactcacattcgtcatgtattctgtcgtatacatcaataccgggggaagtccgcgtgcacctgcaacgcccatgcatccattccggccacaatgtcccgcacgatgaaccggtcaccagataaatggcctctgccaaaacggtccacgccgaaacgtcctggcccgtcaaaatacggtacattgacctttatttttatttcctatttaaaatttggcgaaatgtttttttctcgttgtgtcctatgatcgaaattgaaaaccaaatttcaggctgattgtaagcttaattgaaacagttttcttactatgaataactggctgcagaatattaagggtcaaatcacagaactcgccaccgaagttcttaacgatgccaccgaagagggacaagtttcggtctccagtgaacttcaggtcagttttgggtaataaaaagttgaaattttcctatttattctaagacaatatttcaggttgagaaaaagaaatgtgccgaagtggaaaggcaatttttgtcagaaaaagcaaaaaacgaagcattagagaagagagtcaaagagttggaggagcaattgttcaacacaaacgaagaaaacgacgccataaaggaaaagttcacgggaattgtcagcgatcgggagcagcaaatacagcgattgaatgtgaattaattggcaaatttcaaactaacttttaccatttaagtgggaaattgaacggttccgatattctgaagatgtcgaattcaaaaacgtacatttgggaagtccgccaaaaacgggctcattttccacgaatgcggaggtttggatat

SEQ ID NO: 6512 - DNA, 6283 bp, Heterodera glycines
ttttgaaacgcctctctcattcattggtcccattctcttctctcagatttgtaccgcgagggcggcgcgcgcaatttcagctgcaaatggagcagtcgcaacgcgcgttccgcgtacaattgtccgctgaggggactgttcgtgccggagcgcaacgcgctcttccgccgacagaatcacaaccatccgatgccaatgacagcgggaagaagcggtaggaaaagccaaacgcaccaccgccgagatggcatggaaaaataaaccctattttttaatttttggtttagaattttaaaattagccaattaaatatttaaaatcaatacatttttatatttttttcaaaaattccgactttcggggtcagatttacgacttccgaaaaatttttgggcctcggaatgccatcactggcacacacccaaaagggcttgtcaaaacccagcgaccttggactgtaatgtcctaattgaactcaagaaaggaattcccgacactatgtccaatttttcgagattttgccttttttgttataagaaaaggatggaacatcttgccttttaaggacatgcagtggtgccgaacagtgtctatgtggacagaaagggcaaggattggcaactgttggcggaaatcctttccaagggcgacttggcgcgcgtgtgccgtgccaacgggctcgtccagaacggcccacgcaatgtggtcggcaaggcgtacttcggctgtcagcgggcaaagagcggcaggacgacgaacgcggcgggcggcactctgtgcccttaccgcgcgctgtacgtggccaagcggaaggccattttccatcggttggagcataaccatgaacagaagaagaagctttgatggccaaatgacgagagaaagagagataaaacatttcgtatttatcgctttatcaaattccaaaattttcattcattcattaattgtccatttatgccgaaacatcgatgacacattctgctgattataaccatttttgacttcctcatacaaaacaaatggacagattaggaaaccaactaaagaaggttaccaaaaaccgaaacaaataaacccgagaatgaagtagcgaaagacgggccttgtcaaatttacaaatacctatatttgtcacacaacaaatactaggtcgttgcataaaaaagggcgcttttttataatggcttataaaaaattttgttgttaacataataaaatgttttatataccgttttgttaagctaattgttgtctacaaaatagtatattgattttgttcatatctcaatttgcaaattttttatagctaaaaaaatgaacgctaataaggagcacgcacataagctattacaccagcaatttaaaaaaggcgaaaaagcggcgcctgcggcgcgaaaagtgaatgaatttctcggcgcggatgtgatctctcctcgtcaagcgcaaaaatggttccaacaattccgggcggggagaaactgcaccaaacgcaaacttggtacataagccaactgcgggcggtggatatcgcttaccgcatccggcgccagcagggccaatttgacggtcccctactctttcaccatgacaatgctccgccacaccgttctcatttgacaacccagtacatttcccagacattgaattggaatgtgttgccccacccgccttatagccctgacctagccccctcggattaccacctttttctttctctcaaaaactttttacggggtagacgcttcactgaagacgccgaggtcgaggaggcggtggggcagtacctgacctcaaagatcggcacagattttttcggtcgcggcattaggaaacttccttctcgttggagaaaggttgttagggtccagggaaactattttgttgagtgatattgtatttacagttgttatgattgttatttttgatattttatttataaaattttttttctaaaaaagcgcccttttttatgcaacgacctagtacaaatataattgattatatttaatagacttatttttgaaaaattctaaaatatgaatagtgaattagaaaaatcaaatgaattattttattatcaatctatactttctatttgggtaaaaatttatttaatattaaattatttaagcaatgaaagcgaagcaaagcaaaaacaattaaaaatttatatcttcaacaataaagtctttagaaagtggtggcacacaccttagaagactatgacttttttatggagaacgaagcattttaaaaatttattaaataaaaggtacgaaaattaaaatatgaatttactaatacactgtgtaacattagaatagggacaccctattttttgggagtttgaccacttcccatgagccgatcgagctgaatttttaactgtacgtagcaattctgaaaatatcaagattctgaaagtgagaaaccgaaatgacgacggaaaaatattttacgaattttttttccaatggggggtgtaacattagaatagggacactttggaaaactaagaaaaatctcaacaactaccaaaaagaaactgataaaacaagctaaataagaaagaacaaatcttttttcacatttctgtttattttgcgtacagaaatatgtcttttggggagagttatgttgaattttctaagttttcaggagaaattaagggccaaaaggcttaaatcgcctctaacatttgcccaaccgaatcaaactgacagcaatcagctctaagataacgtacagacatcctttaagcattttttattcattttatgccataaaaaaggcattaaacacaaaatttttgcgggtgaaaaaatacgaaaatctgagtaaattcgaaaaaaagattctaggaggttgggaaaaattttccgtagaagatgattatgaggaacagaaagagcacaaaattctctacaaaatggcctttgaatgattgctctatagcaagtattcgctgaggggtgccttgttaaataccgactatccaaaaaaagacccaattcaaggcatttttcctcatttttgagacatccattttcagcaagacgcgccttcgcggagacgcgacgtagagacctcattcaatgtgttttgttgaaattcaaaaaaaaaatttaaaaaaaaaaatttgggtatcaaaaattatgttccaccctaagtacttaattatttttctttaattttctgtactctgtttttgttaaagtttttaccggtaaacataatttctttttactttaagagatcgaaatttttatgtcttctctacattcgtattcctgttgggctgatcctcgaatgcaaaaacaatatgaacgagaattcgtccaacaattttcagcctcaaaatatttgtacggagtcagcagaactaaatacgaagacgtatatgaatttatcagaaaacattaaaaattttatatacctatagttgatcaagagagtcggaaacacctgtggtccaagtgacaaaataaggaacgtttttgaagtgagggactgtcctatcaatggagaatgggttgtgagacttgtggacaaggaacaaaaacgcattttacttcctctggaggatgttttttccgaaattgaaaggtttgttcgcttcaacgaattatgtaagaatccaaattcttaaattcgaccggtcccaagtcctcgataaggatttgaaatttggcttattcattgttttaatttgtatggtttttttccattttatatgttgatcaatgttcaactatatcgatcatttcttataacttaacgacttggttctcaaaaaaacccataatacccacggaaaattgaaaaaaaaagttgtccaaatctgtcatcagatttgcccataacttaaattgcttcatatatttaggtaggacaatatttatgagaggcacaaatcaatagcaaaaaaaataattttccaaattaagtgttcatgtgaaaggtaatcacaaggcgaagacaccccttcacaatgagctgaagcaaaattacttttacccaactaagccaatggtggaattcgttttggacagatgtccggtttgcttagaaaagaagaaaaagcaagagaacaaagtgcccgatgaacccatccattcgaattcggcaccgactttggaatcgaacgcgaatttccagcgcaaacaattggtgtgatttgtgttttaagttaatctattcagtggttcctaatttcagaatgttccacaagacccaattactgaaagccgcaaaataaattctgctgccaaaactaaaggctctgtttcggttgaagcgactgcggagagggcctttactatgattaaaaatcttgtcgactcatcgacttctaacggtatgaaaagggatttgtttaatcttcgttggacatgacccgatgaaaacccaaagagggaaccatttgatttacaataataggtcaaagtaaataacatgtacctatttggtcaatgaccctgcaaatataaaatagtttgaaaattaaaaaaacaagggtctctctttggttttgctttttcatcgggccacttaatctgcaaaagtgccgtgctctctattgcttttcaaatctttcactatttagtgccttcttcgtctcgtggtccacttgctccaccccattgtgtgaactcgccgattcctttttttgaaaaacctttgcctgcgactgcccaatcgaaacgcatgccgtcatttttgacgtctacgccagttaatcgaaccaattatggaatgcccaaactgagtaaggttgttaactcattgtaaaaatatccgtttttctctttagttcctcccgagtcttcccccttttctccaaatctgtccttaccaaatgacagcagaatgtccgtggacagcaatttcatccattttctgaacgacagcaataatcagcctggcaatcagtattcgaatatcatccgagaagaaatgatgatgatgaacaactcaacgacaggcgaaatggtccaaggcaacagtaaaaggacagacaaagggacggaaggagtcggaagagggagcagcggacgacgaaaccaaccgaatttggaggagaaagcaccgggttggcacaatttcaacatttaggggttgaaataatggacgacgcgttttgggaaggacaagagtttcttccacaatcacttcgttatttatttttagataaatcagtgcgtccgattggaggagggtccaatgtttgccaagaaatgccagtgcaaataaaaaaagtttgtcgagaaattattattaattgcgtagcgataaataaattattaaggagcccgaagatttcgagtttgagacttctcttcttgtcgacgaggaaataaaggacaaaattctgcttgcgctcgaggaggagaaatttgggggttggcgcaaaatgcggtcgaggtccaatccgacgcatcagtactattacaatgggaggacggggacgagccaaaacgaactgccgaagtcatgggaaaaggaaatccaggaacgagcgaaaaaggcattaactaaaatgacagtccaaaccaactttaattttactgtaggagtccaacaaaaagtgtttatcgtccgacaaagcaaatcccgcccaaagtgagcactccgtcgcaagcgaaggaattgcggacaccaccgatggcaatgccaagaaggctcctgagtttgacggaggtccttttcttccatacataaggggacggggtcgacgcctaattttacgaagcgattctgccatgtaaatcaacgatttctttttattttgcttttaaaagcgttttttgcggcgtttttaaacttcgggaccagaggggtcccatggtgacgataggcgccccccagggtaaattttttgataacagattttgtctgggaatttgagccaatttataaaacaattttcgagagtcctcttcccctcccccctctccttcatttatttttccttcctcttctcggcttcaccgtttgcaaatttagataaaaagatcgctgaagaagtttgtagtacattgccctctgaagtttctgtgacaaggcctttcaacgacactaatgacgtgatgaatatccttttccctaatgacgggaaccaagaaaagtctgcgaatgatccgacaattgaatatgacggggatggagttgagggacatctgtgaacagttccaacaggaatttgcagacgagttccaaattgaggctcagggaatagtgccactcatttcaaaggacggaagtcaaaacatgcaccggc

SEQ ID NO: 6513 - DNA, 4431 bp, Heterodera glycines
gagccattacttatgcgaactatccgcataagtgtccagccctaattagtcaaacgggatggatgcgttgtccacgatgttctgggccacatccgattggatacccatgttttatacaacctctgaaagatgaacctactagcggaagaagaagaagagagagaagaatgcgacaaccaaatcatcataatgataataataataatgatgatgatagtggtaacgatagaggccatgatgatgatggtaatgaagtggaggaggaggaggaggaggaggaagatgatgatgatgatgacgcaaacagtccaaaaaaggcagtcaggctttgtttttttgatgctgaaacgtcccaggatttaccacttcaacttcgcaccaaggttgtacagaagcatgtcccgctgctcattattgctgaaataatctgcgaagcgtgcataaatgaaggaatttcggttcactctggtgttggacaatacgcaaatggatgtgtgtgcagtccccctgtgggaccaaggggacgtcgttggtgttccccgccatttttaaatgtgcctggagatgacagtgctctaccagcctatgtcaattacaacccacgaagactgtttttccatagttttgacaatgccaacaatgacccagtggacgactttatcaattttctcacgggaactggcccgcatggtgtcaaaacaatttgtttgtctcataatggtggaaaatacgacattcacttgatactggagacacttcaccggcgcaatttaccaccaaagcgtatttgcacaacagggctgaaaattttttcgatgactttgaaggggaaccaccaacggcatgtggtgttcaaagattcgctgaacttttttttctgtgagttggatgccctgccacgcacatttggattgaacaccgaagttgcgacaacaaaaccgttttttccttatctgttcattcggcgtgaaaatttgcatcaaagattgcgtggtttaccgcccaaagaattttatcaacctgatcacatgaaagcacaaaaaagagatgccttttttcattggtgggaggccgagaatcgcgcttcacgctttcaattacgtgaacaactcatcctatactgtatgaatgacgtggcaattctacgcgaaagtgtgctccaatttcgcaaaattattgctgagaatacgaatgggctcgatccgttcaaagtcgcatccacagcagctggccttgctttggcaactctgcgtcgctgctttcttccaatgaataagctggttaacgcgccagagggtggctatctaagggggaggagagcatctgctgaatcggcacgttacattcgttactatgaaatgacccatcctggggtgcatgttcaatctgcacagtggtccattggtgaagctaacgttgaggacactggttaccgccttgatggattagtcacacgagatccacctgaacgggaccttgccattgagtatatgggctgcttttatcacggtaaaaaatgttattattctttttctttaattttcataaaacggtgaaggctgtccaaaatgttacgtaaacgacagacaacaaaaattggcgggtggtaagacagctgaagacttgtatgaacgaacaaagaggcgattatttgaactggagaatcaacatgggtttgaattggaggttgtctggggatgtgaagtgaagcaacgccttcgagtagacccagaatttcggcggctgtataatgcctcatttgttccaagaccacttgatccaagagaggatgcactacgtggtggtcgcactgaaccatttattcttcattacacatgcaactcggacgaggagataatcctcattgatatagttataaaataataataattgagcaaaaaaaattttaattatttatttttaggtaagcttgtatccatatgtgatgaaggcattctcgtttcctgttggtaaccctcgtgttcttacccgtgaaacgctactaagcccacccacgtcaccgcttccctggtgctcacccgacgctaactcattctcgggcctgttgtttgtccgtgttcttccgcccgatcctgttacacgcccgctaacaatccctttgcttccataccggacgacagacggacgcctaacttttccgctttgcgcgcgctgtgctgacaatcggcaacaacgggcatgtcaacacgttgatgcagcaagggcatgggtttccgcgtaattttgggaattttttgcggctgtcaatctcttttttttttgcctcaggtacactcatgccgaattgaacaaagccctacagcttggttataaagtagttgacttatatgaggtaaaaaaatgactttcagtgcatcgagcctttaaaaaaaatataggtttggcattatgaagagtgggacaatgaactttttcgtgaatacgttaacacttttgtgggccttaaagtacaagcaagcggctggccacccggttgtgattccgatgaacagcgcagagcatatgttgatgaatttaagcggattgagggcattcagctggaccccaacaaaatttcaaacaatcccgggcttcgaatggttgcggtaaataatttagagaaattttcgtataaaatcgagtaaaaaaaaaaacagaaaattctggcaaactcactctggggaaaacttgcacaacgagttggtggtacggaagtacgttatactcggactccagctgaatttcatgcactgctcgaaaatcacaccatcgacattattgactttcatcacgtctcacctcatatggaccgagttgttgtgaggaaaaaagcggaatttgcgaaagcgccgtcaaccaactgcctgccaattgcaatttttgtcacttcatatgctcgtctacatctttacagctatatggagcaggtgcagacattgggccataagcttctttattgtggtaagttcaacaaaaaaaaaaacgctactttctcattgtgatcattttcaaagataccgactcaatctattacgtggcaagcagtgggagacaacacgtacctgaaggcgaagcgctgggccaaatgaagagggaacattgttcgaggcgaatatatgaatttgtgtcgggtggcccaaaaaattatggctttcgtcattgtgatagcgcaagtggggaggatgagcgtgctgaactgaaagtccgaagttttcgtctttcttattccgcccagcaactgctaaacttcgagtccatgaagcacattgttttggaacattacaacattgatggacaaatgtaattttttttttacaattccacaaaacactccgcctaacattgtatgccacagtgacgatgtgcttaacatggaagatgttcatgttgttccgggaagcagtgcgtcaataagaatcaaatttcctcaaattggtcgaactccctgttcggacctgtacacccacgaagctcacaaagactatcagccccattatgtgaaggggcgcattcgacccggcatgaagacaaccccgtttggattccgagaagcgcaaacagttcagcatcagcaggggcaagaattacagcaatttaatgccgatgatggtggtgatgatgatgatgatgatgatgcctttttaatttctaaccgtcctgggtgctcaacttggaatcaataaaaaaaaatcagttgcaaaaacaaaaaagtgtttattacaattggatgaacaaatcaattatttaagacagctaagaatgaatgcaaagcgtggttcaaattgtcctgccttttagatcctgttaaaatgatttttccagaatgataggctagacaagtgaccaaagtgtgatcgtcgtcgtcgtcaatgactattttacaacgcatggcgggaaaaattgtaggatcatatttgatgttgcggaacctgtgtgggtccagtgttggtaaaaagttcagcatggacaatcgatgtgataaagtgcaagaaccaacaacatttgtaacacgtaactcgtggattcctagctgggagcccaacgcatgctgcaccctccgtctgattttttgtgcctcgcgcaccgctctgtctggacaaggcacaccagtcaacacagcacgggctgatcgaaataaaagacatgcaagagtgcgttttttggggagacgtagtcgtatgatgattgcatgaaatcgttgggggtcgtactcggaattgaagccattttttgcaattttcaaaaactgctcttttgtgaaaggcaacagctgtaatttaaacaccgcggtacaattttgaataattaacattttttatctaggagaaattaaaaaaaaacaacaacaacaataacacagcaaacttaatcacatataaaacacccgatgcgtattaatcaagcatcttttatgacgctcagacactcaag

SEQ ID NO: 6514 - DNA, 2461 bp, Heterodera glycines
caattttttgcaaagaaaaaattggagttttggggggccggcggtgccgataggcgccaccgaaaagttttttcggtatttttaattaatattaagaaaattgttcaaaatttcataaattttaatcctttccccccttcgttgttgaattaactttttaaatttttacaacgctcggagtccccaattccccgaattagtgtcggggagtcggggcgcggaataggcccaaaaatgtcggggatcggggtcggggagcagaaaagtagaataaaatattcctttcattaaggtgaccaatcatccaaggaatcggcaaaatatcctcaatcgcccaccattaaccccagtcggcttcaccaccgtcgtcagcagcaccaaatgcaattgcactcccagcaaaagggcgaaagggggcacactgtcaacagcaaagcccacacagcgaacaataaagacgccaccatggctatgacgtttatgcttgggaaggacaacggcattggcattgttggtgtctcttctgcgaatgccggaacatcgctgcccattgctaacaatgccatcgctacttcggcgtctgagtcggcgagttgttcctccgtgacgccttcaccatcgccttcaccgattgttgccttcaatgctaccaacgacgctctcaattcatcatcacctttcgtaactctccgtaaacagccgtaaggggggggggagcgaaataggcatttgacttaataatttcttttttaggtttatcggaataaagctagttttggtgataatttaattgttgtaggcaatgtcagcagtcgacgccaccgactcagccaatttcgagcagggaaagtgaagcggagcgtaaggccaagtcgcgtctgaagcgttccacccgacgttctacgcaggtgtacttcctaccttacttatattaaagctcttcttatttgatttagggtgttactttggaacaattgggcgaggtgaatatgcgaaatcattcaccaaaacaccacggacgagcggagattggcaaggaacagaagcaaaggatggcaattggacatgacggcagctgcgaattggtcagttggaatcatcttttctttttcatgaagcattttcaagcaaatgccggcttctccctgctcgtctacgtcgtcgtcctccgcctatttgacggccgcctctcaccgcgccgttgaccaacataattccaaagtcgaacgcgtcaaggagaattacaatagcactaaaaatgaagctactccatcgccctcttctaccgcttcactgattgacgatttggaaaagtacaaagaattgtacgaattggaacggagtgaaagcgaaagactgcggactgaacggcgaatgtttgaacgacgtatttcggcgttggaatacgaattggaggtgagatttagtgatttagagtaattaataatgaaaaatgaattcagaagagcaggcaattgcagacggacaatgagaagttgaaggacgagaacattgcgttggtccgagttttggcaaaactttcgaaataatctccgggtccccttttacactgcaaaaccccatatgtgatgcacttatgaattcgaagaccattttttctcgtaaaccaaatgtcttcctttttaatgtcagtagtcagtccgtcttccaaaggtccctaattttcaagcacaaattaactcactctcctaccaattcactgctgctaattttgtttattattggacttttaataaagttgattttttatattattagggaattaagctgagtattatttttccttccaatgttccgattagataggctatctattatgccaaaggcgtggtcattagtcaaaaatgtgacacggagaaataatttattatagcgaccatttaaaaacatcacagttaaacgggagcgttcatattaaaaatcacttcttcaagagcgtcttttccaccttaaacgcaatcttacaaattgtttcaattgttttattgcatttaattcatcacctcttcaacgcttctcatctgctccatttgttggtactcattctctggcgtcgtcaccttctcccaaatagtgcgataagcgccgacgatgtgttcaaaagtgcgtctttggacggactcgcggattctggggattatttagaaacaaaggttttcatcgacacggatttgtcataccttgcagccgagatttttatcatctgaggacagttgtaactctcggggcagtcgaggaacttctcaaagcgaatgaacgatgcgcggacccgcgaaggctccatgttggggattttggacaaaggacccttaggtttttcatggattctccgtacactttccatgccttccccaacttggttcgcctgatgcgcttgggcctttgtgtacagctccaacatgtcgcattccaccaatgccttcgacgcttgctcgcttac

SEQ ID NO: 6515 - DNA, 1917 bp, Heterodera glycines
  misc_feature (1260)..(1260): n is a, c, g, or t
gtgtctgcgacaattttgttttgggtttatcgtagaattaatagctaatctctttttttggggctgaggggaaattctcgtataaacataatttttgccaaaatttactaatctcgggcttggcccactttttccctccccctcgtttgactaatcccacaggcattggcatcttatcaacgggatctttggtggaaatgtgccgtctgttgttcttccactcggccccatcgcggcactgaacatcacaccccgcccgtcttcgccatcggcccaccgtaccatcgctcgccctttggcccaagcccatataaaagaaagatggatgagtctcgagatcataacactttttcctcatcgttttttgccttgctcttcgaagatcttcaactctcgacaaacccactttttcaccactttcgcttataaattttgggaagaacaaaaataaaaaatcaaacaaaaaaaaattgtctctttatttcatttcgcctttttgcattgctcacattttctttgtcgttttcccttggccacctttgggcctccgattctttgcttttccagcggctcgctctgccgttggccacttggtctcgttccccacccgaacccagcattcctgattcgggccttcccagcttattttgccgttgtccataccatttttgggcatcccaccaaggccagcaattcctctgacttgggtactattgttgttctgattttttggcccctcgccttttgcccatatcctttttttgggcccataccccaccgttaggggtttcattttctgacaccttttgccaccttttcaagtgcaggacgaccggcggggaatttatcctccaacacccattgtttgaagctctcacagaacacgggcgatgcgtcttcgatgccgtgtttttgttggcacgcgacgcgttcaatgtcccaggtcaccggcgtaatccgatcgaccattccgttcggaaatgccacattttccgaaatccaatcagccaattccttttttgggaaaaaaaatatttttgaatgtgtacaggtacatttccggaaaaaaaattcggaggggggcaacaacggaaaaaaacaatttttttggtctttggccaagatttatttttctagtgtaattttaaaaatttaaattatcgctggagaaaaataaaaatttgctcacaaaatggcatgaatttccagaattttgtttatttttcctcgtacattttaatttagggggggggggggggngaatgaaatgtttttcattgttaccactttaacgttgaaaaaacgggtttggagtttctagaatgattttttttaatgactatttctgggctgattatgactttttatttttcgcataatcaagagctgataaaaagacattccaatgaatattggtaaaaattgaaatttctcatcatcagtggttaaattgaagcttttatgaatttgattttgaagaacaaattcattaatacattcgtaaatttggtttcaaatatttttgaattgtttcccgatgcttgttttgattttggattttatgaaatttaacttcgcatttgtctccaaagattttgccaaatgacttttgatgtaaattttttattttctgatacaaatggactaattagggcaattataattaaaataaacagaataacaggaataaattcattttttctggatatatttcccaatatgaattaatataatttttatttaaaatccaaattatcattttgtccattaaaagactttttattcatttgaaaaaataaaaatttacatgaaattccggaaaaataacaattttatttgaaaaaaagaaaaaaatgatcctccttccctacacatcacattaaaattaaaccaaaaaatatttcttaatttaatttt

SEQ ID NO: 6516 - DNA, 2626 bp, Heterodera glycines
tcttttgcgtcctcaagaattgccggatgcgtcgcgttaattggccggtggctgcgttgatgaaatagccgccctccgtcacggtcatcgacacaattcgaatgttcggctgggagagttgggccaaaaccgccgcggaatttgccaccggaaggaagtcgatcatggaagcaacgatctgaataaaaaccaatggaaatttaactaaaaatgggaaattaatgaaaaaaagaaatttgacaaatttcgaaccaaatctgaaaattacaaatttatacaaatgttatgtaaaaacaaaaaccaacttaaacacaacgacggaaaattgacatttgtagttttagtttataagtacctgacactcattctgacaaattccgtatctttatggtccctagtcccaaaaagcttgacctaccatagacgagaaaattttcgaaaaattctataaatgcaatatttgaattttcattttttaccgaatttggattcgaggtttggaattggtcgaaatgagcagcatatcaaattcgtgataagactcagataccttcgcaagattttttgaaacaattttttcaagaaatgaagacacaaaaaaatttgaaatttcttttggaggaagggtacattattcggtggtgccccctcttgtcaccgtggagatggtacacaaaacacaacacctgcaccgtggtgttgtgctcgtcctggctgaccaccgtcgtcatgaagtcctgtccgctcaggtagcaacgcattcgctcgtccgatgccctcattccgacgccaacgacggcccagtccaagtcacggcccgtgttgaacagttcggtgaggtacaaagcctgaaaaccaaaaaattatgttacgacgaatagaaagaaaaggaaatttcaatttaaccattttttggttatattgtttatgcgttttaatggcaggagagttcgtttctggacccaatttcaaccattgtttcaaacaaaaacaaaattttggccataactttttttcttatttggtaaatgtctttattcttagcatcaaacaaacgcttaaagtctataaaagttgttatacaggtaaaaatttgggctaaaagcaacagacaaaaaattattcataaatatactcgaagaaaaactgaatttcatcttttctattgtaatttttttcgttttgtctgtttttgctcttttctggtttttataattcccgagactttaagctttcgtttgataccaagaagataggtttagactaataagtaagaaaaaagttatggccaaaaaactgagaaaattggacgcctaaggcaatggagtcaaaaaattctgaaacaattcgtaaacaaggctaaatgaacttgaaatttgagtgtaaattccaaaaactcgcctgatggctccggtggaaattgccaacgccaaagtgcacaatgccggccgacagggcgtcgcgcgcgaagttcggcaccacaattttcgggttggccgctgcaattgcgcccaaattgagcgcagacaatttcaccgtcgttttcaaagtgtttaccattataattaggctaaacttcgattagtaaagtgaatatggtttaattttataaataacaacaatcatatcatccacgagccttctttctatcaacataattcatgttcatttgtcagcggacaaatgcaaaaattcgacaaatttattatttattgtgtgtgtaaacggggaggggggggggggatttttaagcagaattataaaaatgctaagattggttttctgaaattttagaacgatttgcgaaactctagcttaaaaatgctcttttggcataatgtttgcaatatttaaaaatataagattctgttacaggatcctgctaaaaattagaatttccgggttcctgtaacgcttatctaaaaatccttaataaaaatttttaaatgccttttttcatgcctttttcgggcttttcgtgccgtttcatgcctttttttcaattttttggtgcctattttagtgcctttttctcgatttttggtgcctttttagtcgtgctctaataatgggaaaaattagtgaatttgtattattcgctggaatgaattttttccaatattttttttggtgatcactttgctaatttcaccgcatctgaatttttttttttttttgcatttttgaaaaatagaagcaatttgttaaagactccgtaattgatcaaatttgaacgctttttggggcgttttgggcccaaattaaaaaaaaatacagtgaaaatcggggaaattttcgaaaaaaatccctagggggttgtgaaattttttggaaaattttaaccagcccattggaaaggggacaaaatttgctacgatatgcaaaaaccgcaagtctctaagacttaaaccaaattaggtatgggcacttcaatttcagtgttggtcattttactgtaaaatgcactattttcttaagaaatacagtactttttgaagacacagaaattgaagtacccatatctcagcggatgtaagtcatagacgcaccattcaaaaggcaattggtagagaattttgtgctctttctgattggcctactcaaactttcccaaaaaattttcaca

SEQ ID NO: 6517 - DNA, 3526 bp, Heterodera glycines
ggggacctctagagtcacttttgtgacttgtacttaattttatttatcttatctctactttcgatcttcaaatttattttttctagaatagtacttttttattttcaaattcttcaattaatttggagtgatcagaatttctagtgtacggactatctaatttggactgtacttttttttattacatgatttatttcgaatagtttttgactttttgctgtttgttttgttttgaattgtttgttattattttttgaaatatccagcttaaactttatttaataaaaattccttttaacaatttttattcaacaatttcacaatagtatctgatcgccttcgaaattagtacaattaatggtatctgatcaccttcaaatgaattatgatgagcttggatcgtcaaggacaatttctggtttgacagaatcaggattgtcaacaatgtcgaataattttcgaatagattttacagaacgatttagaccaagaacaaatcgatcaaagtgggtataattgttagacaatgtgtcgaattgcaatttgagtgtttctattccagatcgagtattgactcgtgcgggggaattgattaatgcttgaatttgaccaatcagacgttgattaaaattggaggctttttgagccttttccacagaaatcagaatggaatttgtgcgggtgtcgacaattttcagcttcttttgcaattcttttctcgtggtgtgtgagggcagcgtcgaacagttgctgtttctttgtttggacacgatcaagctcgtccaacacttctgtgttagtcgtcggatcgaatgaatcaaggaagtcctcgaccttttctggtgctcctggcttgatagaatatagtgcacgagtatattctattaagtctttgtttttattaaattttattgttttcttgacctctttaattgcccggtcaagttgacgttttgctgcttcttcctcttgtttgaagtattgcttgagttcagcaatttgttcggccggcaattgtctttttgctggtgcaaatagagctttcggctttttcaatggcggtgtcgaagattttttcacttcggtcgttgtaatctcgtcgcttttggcagcgattgatgaacttctcttgccacgtgtttgtggttttttggtcggctctttgtccactgaatttattaatttttattgttttttttcttttctgatttaaatctcagcgtttaaatcagactttttggtttgaagaacagcggttggcagaagaaggtttttttagttgtttcgcagaacagtgatgaacagatgaccggcttttttgtctgcttgatcagtttggcagctgttgtcgttggtggtgtccgtccttgtgttgccgtgttcccgggtcgtggcaccaaaatttgacgcgaccgcaaaggaatgaagtcggagtcaaaatttattagaaaaatgggacaaggcaatggaacaaggacaaatggaaatgccggaaaatttttgatctctcaatcgattgtcgattgttgatccgatgcctcaattggaccaatcggcgaccagtagttaagtcgtattgtgcgtggtcaaaccagtagtcaagtcgtatttgattggtttgaagtggtgtcggagcgctggattagagctgagacttgtcgaggcatgccaactgaggaaatcgggctccttaaatacctggaaaaatggctggggaaaggggaggggttgtttggggcccatttggccatttgtttaccaggcccatttgggccgttttggtcggttgaattttctcaattttatcttttttccaatttagcttttcgttaatattttattttatttgaatatttatttatttcccattatttcccatcgttccaattatgttttgggccttcttcgccaaacacaattggtttcaaatgatatttttggcttgtttgtcgccgatcgtcaattctcattatttgttattgctttccttcttccatctctcattttctcattctgcatttcccattttattatatgttgaatttcatttttattaaatttatctttattaaaatttatagtaaaaaaccctttatttaatttaaaaaatttatttaatttagaacagatttttctaggtagattttattattttattatatttattttattcattattttgcattttgtaggcaaatttttattattttattttagatttatttttattaatagttttgtattttttcggattaaatccgacaggggatagacatgaacggcaaacctttgctggcaaccgcccgctccacggtggatgagcggcgaatgaccggcttgcgcacattagcaggagtagtgcctataaagtaagggataaaatgggcacgaacagcaccgacgcctaacttatctgcaaccgccctctcaactgagggatgccgaactgctgcagcaggacgccgaggcaccggcggcgtagctcggtcagcagtggcgatcccctcctcgacgagacgagctagcaagaatgctgccggcggcgatgctcatctccgctgcgatgatcgcatcttcagccacaacttgtgccatggctgcttcagccgcactagtgtcggcactgtggccaggcccaggggagggggaattattcaccttcctataaatgtaccatttttatacatatattacttgtaaaaataaaagtgttgccacatacaaaataaatgcacccccttacatacctgatgccgcaaattgctgtttcgcaaccgcctcttgcggctgctgcggcggcggcgagacgctctgccgcttcttcttcttacgagccttcacttcgtcagtgtcgccgaggacgaaactcagcaaggccgggtcgtcccccaagcggcgcaattgttcgtcctcaccaatcatttgcaggattccctttctgccaatgtgacgcaacagcccacgttggaacctcaacagctcaagagtctttcaaagggaatataatatttacccgtattgtctactgccaataaagattaaaaaatacctgtttgacctgcaaaaccacctcattgttgcagtcctccaggtgctcgacgtcctttcgcagttgtttgttgtctttgttcagttgactgatctgcttatccttctgggcaaccgcccagcgcaatcgacgctttgcttcggaactctcagcatactttaaaatgttataatgttggaagtattgttggaaaaaaatacatacgtagtcctgcaactgtctcatctgagcggcgacgcggagcgagcgctccaccagccggttgcagagcacgtttcgctccgcctcagatttggccttcctgccggtgatggcgttcaggtcgtccgccccagcgacgatggtgtcctaaaacaacaagaattatacctttattggcagttgcccacaagggtattctatgtacactaccccttagcctgggactgtcaaaggcaaacgaacctcctcgaaagggtaaatttttgatcaaaaatt

SEQ ID NO: 6518 - DNA, 2095 bp, Heterodera glycines
atttattgttatttttataaccatttgaattgttatatcttctttgttgcatttaaaaaatacatttattgtttgtttttttaattttatgatagaataaaggcatttataatcttaattattttgtaatcatcagaattgagtgtttctattccagatcgagtattgactcgtgcgggggaattgattaatgcttgaatttgaccaatcagacgttgattaaaattggaggctttttgagccttttccacagaaatcagaatggaatttgtgcgggtgtcgacaattttcagcttcttttgcaattcttttctcgtggtgtgtgagggcagcgtcgaacagttgctgtttctttgtttggacacgatcaagctcgtccaacacttctgtgttagtcgtcggatcgaatgaatcaaggaagtcctcgacctcttctggtgctcctggcttgatagaatatagtgcacgagtatattctattaagtctttgtttttattaaattttattgttttcttgacctctttaattgcccggtcaagttgacgttttgctgcttaatatttacccgtattgtctactgccaataaagattaaaaaatacctgtttgacctgcagaaccacctcattgttgcagtcctccaggtgctcgacgtcctttcgcagttgtttgttgtctttgttcagttgactgatctgcttatccttctgggcaaccgcccagcgcaatcgacgctttgcttcggaactctcagcatactttaaaatgttataatgttggaagtattgttggaaaaaaatacatacgtagtcctgcaactgtctcatctgagcggcgacgcggagcgagcgctccaccagccggttgcagagcacgtttcgctccgcctcagatttggccttcctgccggtgatggcgttcaggtcgtccgccccagcgacgatggtgtcctaaaacaacaagaattatacctttattggcagttgcccacaagggtattctatgtacactaccccttagcctgggactgtcaaaggcaaacaaacctcctcgaaagggtaaatttttgatcaaaaattttacaaaaaattgaaaaaattttaccttccaatgggcttactctaattttcaaaaaaaaaaattccgaaccccataaattttttttggtaaaattgaagaatactaccaattttgatttttcatataaattatatatatcattcgattagtctcgatgagacaaatcgaatgaaggagtgatctgatcaacttgccgaaaagatttttttgatcaacctgtaaattgacttagcaaaaattttcagctctttcctacaaaaaatgtcaaaacattgtggcgcttaatttttttctgttaaaatttcaaaaaagtttgtgattataaacataaccttaacggtatatttaagaaattagaacaaaatttgttcactaccccaagatttggaccctccaaattaaaacagttctgataaaacaaaacagatacaatctatatgttcaaaaaccctttttgttcgaaatcgagtccgggcttcgcagttgtcaaaatgaataccatattcgtgattagcgacccagaaaactacgagaccgggaagcgaaaaacccgagaaatttcccgagtcgggaaccgagaaccgagactcgcacatctctaaaaattgcaaataattttgacttttaaaaatatatgtgccatttctaattaaacttttttataatatgctaacaataaaccttttaataaattaaatcttttccaaaattctttaaataagttcaaaatttttctcgaatatacccagaatatgcgtttataccttaaaaaactttaccaaatcataaattttaacgtaaatagctatttttgagccaccttcttcatagcatatgcgcagaagaaaaatacgaaagcatataatttattgttatttttataaccatttgaattgttatatacatattttgcatttaaaaaatacatttattgtttgtttttttaattttatgatagaataaaggcatttataatcttaatttattttgtaatcatcagaaaaatatacatcaa

SEQ ID NO: 6519 - DNA, 714 bp, Heterodera glycines
aaaaattatttatttttttttttgtttaatttggaggtttaaaattttatgtatctccaatactgatttgggcttaattgttaatttttgggaaaaaattttacgcttttacacaactaaatgtgaaatttaattacttttttactgtcgaaaaatcttctgtcgaaaagtcccctcctgaattttataatatttctgtcgaaatgtcttttgctgtcgaaaagtccttctgtcgaaaagtcctctgtcgaaaaatccactgtcgaaaagtccggcgccccccttctttaccaagcaaaagaaataaaaaacttttttttttaaattgaacaatatattttcgtcgttttagcatttaaatgcaagcgaaaaatataatttaaagatggataaactaaaagttattttcgatttttaatttattttcctaaataaatttaatatattttatattttatcttctgaatttagtaaagctagaaattatgaaacaaaaatgaaaagctgtaaaccaaaaaatgtggaatatgtacgaaaaagtccaaaatatttgcatatgtaatatatagaaaaaccccgaaatatgtaaaaatatgtaaataaaagtcccaacttttgttcgcaaacacaaaaaagagtgtttttcctattaattaggattttcaaattttttggcataatttttgtagcctaacaaaattttttgaaaataaa

SEQ ID NO: 6520 - DNA, 2637 bp, Heterodera glycines
  misc_feature (5)..(5): n is a, c, g, or t
tatantttttgatttaataattgtaagttatataatgcatcttcaatgcggcccttcccccaattttttttattttaatatacctcaataagaaaatatttaaaaaatttccagcgaattttgccaggagttaaaaattttaggggaaaaaattatgcaaggatttaaatattaccattttgtcaaggatctgctgcaacaattcggacaaccgttggggcttccgatgctcggtaagcacttcaacattttgtttgatgttgtggttggcgctcagctccaacgagccaacagtcaaatggaccggctgacgctgaaagtcggcggccaatttgcgcacttcctttggccatgtggctgagaacatcagtgtttggcgatccgtctaaattccattttaaaaagtttttggaatattttttatgggtaagaaatggtggatgaccaccgctgtatgagaatttgcggtgttatgaaaaaatctccgatttttcaccaagaatgatatatatataatatatggcaaatttttctctagaatgatacatattttttcccgtaaaatccgaaaaatttccatgtaggatattggaaaggggatgcctaatccaaaatccaattatgatccatagtaggttggacccaaaaaggatttacaaaattttgactcaaaaaatggatttacaaaacacaaattgtcattcaaattgctattcatagtcgcgaaaaaacaaacccgaattttcgagatgatttgccgaatttggggctcaaaacccatgtccaacatgcggtccgcctcgtccagcaccaggaaactgcaccggtccattgacacagcgttggaactgatgaaatcgttgagtcgaccgggcgttgcaatgcagatgtccacgcctaaattttggaaagtttagtgacgaaatttcaggaagtttcgggttatgttggcccgactcccttcggaagaattacatttcaaacaaaataatttttttttgggggggggggggggttccgcactaccaagcaacaaattttttcttaaatgtcgaacgtaccgcgcttcagcgcacccatttggggccactttgatgcaccgccatagcacgcgaccacattgagccgcatcagttggccatattcacgggccaccgtctccacctgttgggccagctcacgggttggcaacagcacaacaacagccggaccttcgccaggacgacgctgctgctgcggtcgttggttgttcagcacgtggacaatggctgaaaatgaaatggtaatcaaagaaagaaaaattgggtcaattaaaacttatgtgcccagtatttttcacaaaaaacccgggacagagagttcctgctaattgtaagtggatgcggaaccctggccatgtccggtacatgtttttatcgggcccggcaaaaccggaccgccactttttgaagaatccggtttgactggttttggaaaggtcgggccatggaaccggttgtattaaatgccaacctgctcggcgaaattttgaccggtttatgatcaattcaaaattcttcatttttcttagtttcattgaaaatatattttttatataatgggtaatgaaacccatagctctcttcgctcccattttcgaagaatacaaaaatttgttgtcctaaaagtttgtttatgaacatgttgtctgggttggttttgagtttgactgatcaccgaacatgaccaccaattttgacaaaatcagaaacatataccatgaatttggatgaaaatttattttatttaaatgatggttgttttgtaaaccaaacaacaggatgaaacttgaaattttttgaataacgattaccaccggcggggcacatttatcagcactaaaaaatcggggaaaggaaatccgaaacctggcaaagtgaagcccagcgttttgccactgcccgtttttgcgatggagatcaagtcctttccggccagtgcgacgggccacgaaattgcctggatggcagtgggcgcggagaacacgctggacagttgggcaacaattggtgctgaaagaaaaaaaaatgagtattttctgtataaaattttagatgacacgagactgtgtcaatgcaatttaggaaaattttttgtaaaaaattttttctccgcattttacgaatcaccaaacacaataaattttggcatttattcaacttgagacaagaataaatttagaaatcggggattaaaccaacttatcccacacaatttatccatatcccaattcatccatacacaaaaatgcctcgtccgcattgtgccgtggatgtgttgggcatggctcaaaaaatcaataatttttgaaaatcaaatattatttttcggttttgctattggtcagtgccaataaaagagggacaaatcaccccaaaaaggtgccccaaatcaccaaatgcaaacctgggaatgtcgactcctggaaactggtcactggtcctgtcaaactatggccactcagtttcacttcgttgtccgccatccatttgtccacctcggcccttggcacggttcagcaccaactcgtgggcctgataatttgtccttttgatcgcccgattgagtggcaaatgatgacgaagccgcctttggctg

SEQ ID NO: 6521 - DNA, 1814 bp, Heterodera glycines
  misc_feature (26)..(26): n is a, c, g, or t
ctttagaaggtatatgcccctaactntggatcgttatccgaaagaaaatgtcaaaaatgaaaccaccgactgataaaacccagtttttttccaaaatttggtgccactggtggcattttttgaataaatcatcactattcggagaaacttatattgccaaaaccgtaggttggtctcaaaaaccaatacctatgaaattgaattgccatcaattccaatcgaaatccttggtaaataataaaaaacaaaaaatggtcgttttcctaatttatgtaaatggtttccacttcacttacactgttccaattactgttattgttgctgtaatttggttgtccactaaagaaatttttgttgttgctttgggtggcccccgctgggcttggctggccattgaaaaaatgataattgcttgtattcagttgcatttcaactgaattaaatcgtcgtccaagtttgatttactgatctgaaaactaggccaaatcttagcaagatttttatggattttgtaaaaattcttggtatcaaagaaagcttaagcacttcaggaaattataaatatatacaagaaaagagtaattctaacagaaatgagaataaacggaacttagtttttgaaaaagttgtggcctaagaaactgaggatagtcattgactaattgattgattgatttgacgcataaactggaatagaactgtacatcatgtatatgtatgtttatcccatccatagcaagtttacttatttcaagacttggactgatttgacggggatgaggctaaaatcttagaaagcaacagtcaaattttacaaattttaaaataattatctagaaagatattttaattaatttagagtttgagaaacaaaaagaaaaatattgattggattaagcagcagagtcagaaggatttggaatgcaaatgcaaagaaattctatgatgaaatgcaattagtccatttctgttttctctctatacgtatccccggttgcatttgttaaaccatgaatttttttcaaattttatttgtctctgttttcaatccctcctcctcctttcacacactgtctaacgaaaaaaaaaggaaaataaacatacaagtaaaagagactagagaaaaaaaacctctcattttgacgtaatatttctttatctctgttagtagagaaacccgaattttctaagctctacaacttttttttttaagattttcttttgaattatttccttcgaatgaaccaaagattgtcaaattggttggcaaaaaactccaaaaattattttaaattttcatggagcggacttgaacctccatccttttttttacataactatactaaaaaacaactgtgccaaacatataatttttttttgtttacgggctcattttcagacgctttatccagccgtagatttaaatttaataattttaaaaattacaaatttggtaaaaattttcaaaatgtttaaaatatttttttacaaaaatatgaacaaatatatttcctcaaccagtggaatctaatttttcaaacttcctgttttctgcctcgcatattaaaattttcaaattcttttggcgcaatgaactgcaaacggcgtggcgatgatccatctatgtatgacattttggcacaaatcgtggcttttatgccattctaagcctaagtaatgaatggcacgcattgaagtactttttgcgcgccattttcttcgttttatttttatttttggtgtgcctgccaccccaaaacaggaaagcatcctccttttgatattctttcataatgaaaggatcatatgtatcc

SEQ ID NO: 6522 - DNA, 2467 bp, Heterodera glycines
cccaaactccgatccctgaagtgccaattttgattacattcatagatggggatattgtgccgatttgcggtgattattggatcgaaaagtccgaaccagagtaatacaaaagatgatggatgctaaaatttctgaatattttaagggtactgattttccaagttactaaattacaggtctccgatacatcccttatatgtcaaaaacatacgtattttgaaaaaaaaacggtaaatgtttaaaaatggaccgacatgcattacctgacgctccatcaaaaaactgagaaaaaaaaatttagatggctaaagaacctcgtcagtggaaacagggtccaggagaactgaccaagaaaggtttaaaaaatggattaaaaaaaaaattttttttttttaaacagtaaattgaaattcgattaggcatgggccaattgtaccgacttggccaatggattcgtcatcgttatgatggaggtgtgtatatataagagaaataaaaaaagaattcaaactaaaatcattaaaatttgatagaaatttcatggttgaaaaaggcagtttaaaaataaatattttaaaatacccaagcctggggaatccatgtttttcgtgccgaacctggacctggattttttttttcatattttacctggaccttgctttcctggataaaaacgcagaaaaatccaggtccaggaaatgtccaggttgcgcaaaattggcgtgaacatggaccttgtgaccaaggaaaaatccagacctggacccaggtccagcggtcaagccctaagcaattaaaaaaactttaaaactataaaaaataaaataaaatttcaaaaatattccaagttacccatgcttgattgaaggctttttatcgccggattacaatgttaatgagctctatgtgcggagttccgacttcaaccggacactgatgtccgcacaggcgctgctcgccggcctctatccgccgaggccggacagagcgttcgaaccgggcctgaaatggcagcccattccggtacacaccgaagcgcgagagaccgaccgagtaagcaatgccgaaaaagtgtgccgaaccggaacttatttgttagcgctatttttcggcaacccgaattttggcacagaaatatcgggtcggctcgcattatggcgggcgctgtgttcgtccttgcttcaaaaaaaaaaacttggaaatttaaaacgaaaatgtttttgaaaagactagaaaacccaaaaaaaaaatgacaaatttctcagagaaaggttttttttttcttgttttttctaaattttttggatttttttgggtcattcttagaaaggaaaaaaattcttcgaaaaatttcttggaaaattattaacatttggtaattttctcaattcgattctcatgcggagggaatgaactgctccgtttcgatgtatttgagccttgtcttgtcgaccattgcaattgaaccaccaggtgatctttgacggttcgaattgtgcgccaatgttggaggaggaacggcgagtgttcagcagtgccgaagtgaaagaaattgagcgccaaaatgccgactttttgcgcttccttgccatccagtcggggttcgaacaaattccgttaccatttcgcgaaacgcgctacgtgttcgacccgctgatttgcattgtaagagacgaacggaagaagatgaattggttcttggattagggttgtccccgtcgcgctgtgacccccaaatcccggactagacaaatccctccatttatatccaattccggaaaacgatacccccccccccccctcctcctaccattcaacattcgacttcgaaattttcgggacacaaaattcggaattcttggcccccaaaaagttcgaaagtcgtaactccattatatatttataaattcttcgactgattttgtgaagcccattaattaagttgaaaccacggcataataatttttgaaaaaagtatcgttttcctttttttcagaaatttaacggggagggcaaagaattgccaaaatgggcaaacgaatcagtaattgaacgcatttggcaactcaacgacctttcatccaactacctttacaagacaacaaaattggtccgttttcgagccggtgagttttttttttaaattttcgacaaatttgttagccctttgtgtttgctatttgcctgcaaaattttataaaatgtcatggccaaaaatagtttttcataaaatgaagctaaaattattttcaaaaaatacacccctaagaaacgaaaaatttctcaaaaattcattttccaaaatttaatttatttactttattgaaaagaatttttaattttaaaaattatttatctcaatactgatttggcctaattttttacttttttgaataaattttgtcattttacaccgccctaaattcgaggctttttagtgcctattttcccattttttttgagccta

SEQ ID NO: 6523 - DNA, 782 bp, Heterodera glycines
  misc_feature (15)..(15): n is a, c, g, or t
taattaattagtatntaataattagggctgccaaaaatatgtacaaaaaagtggtcaaaatatgtacataaatatgtaagaaaaatcccgaaatatgtgtacaaaaaaccccaaatatgtaccaaataattaagtaaaatttttttaatggttattattttggaaaaaaattcccccctgaatgataaaataggtacaaaatgtcataaaaatgacttaaatagacttataaaatcaccttttaatatttaaaaaattattttttggtatttcaggcgtacattttcaaaattattttttcactaaattttcaaaaattttcaaaatgtaaaaaatgaaaaaatgtataaaaatatttgccgaaattttggatttattttttaggatttccaaaaaatcttcaaaatataaaaaaaatgaaaatatatatatgaaaaaaatccaaatatatataccaaatatgtaagaaaatcccgaaatatgtaaataaaagtcaacttttgttcgcaaacataaaaaagaaagtgtttttcctattatttagagcatggacgaaaccaggaaaaaatatgtatttacataaaattgacatccctattaattatatttggcataaataaaaataattcttttgagaatgattcatttttttgaataatttaatctgattttacgaagaccaaaaatgaaagaattcgtcgctaaattaaaagtaatttgaaaaatattaaaaaatagacgaggcgggggcggaaacttgtcggaatggatgttggattagt

SEQ ID NO: 6524 - DNA, 1148 bp, Heterodera glycines
ataaggacaaagggtaaccctgaattaaatcataatttgaatttgaattatttaatttatcaaaatgttggcacttttccccccccccgcccctttcccccctttcattttcattttgtacgatttgccccccccccccccgaaattatttatttccaaataaataataaattcactcgccaatcactgtttgttttgttgatctacacataatgttgtaaatagcaattccatccattctctctctgctgtgctgtattattttgcctcacttttcctccgttgcgatttttaaattatttttttatttttattcactgagaaaattaatttataaagaaataaaaataaaatattaaaaatatttctccgtttgaatggtttcctcgtttttggtccctacttttgacaatggttttgcttattttattgtcaatttatttttagcccaccttttttgtccgatttgctcacaaaacattcaatgcctttttttggtttattttattaataaattattattaaaaataatttaatttgtcttttttatttttgttaatgcatttgccctcccaaacaatgctttatttcattttccaattgtcatttattcattcattcgtttattctttcttttttgcgttctttttccatttatttttttgcacttttattttttccattttttaaatagcaaaaatcagcagaaggaattgagtgggttgactttgtaaatcgcattagtggtgcattatttataaatttatttgccttaataatgtaaattaaaaagggaattcgaaaaacggcgaattattttattttgccacggccctcccaaaacaaatgccaaattctcccccccccccaattccttcgtcattttgccctttccattaataatttgcgtgtccttttttggctttgatttggcccattttcattcatttttcattttgttttctcagccaaacattcgttgtcatttcttcgcatttgcagcacattccctcccccttttgtgctccataattttcataataataataataataattattattattattattgttattattttattattcactctcatattatttaatattttccccattttatggtaaatttaatctcccccctcc

SEQ ID NO: 6525 - DNA, 2120 bp, Heterodera glycines
cttcctccaaccgacccatccgctcgcaacggacgccattgaaggaaatcatcacgctggacgacccaaccgagctgcttttggagagcgggaggcaaagactcatcattgaacacgcacctaaccagtttatggcccggggcgaggagcagtgcattcacgcgatgcgcgcgttcatcacgcaattctctctgcgacagaccacggtggccaccatgacgggcgtgtcgcagccgtacatctccaaactgctgaatggaaaccacagggagctgtcgctgcgctgtcgaaagaacatctactgctggtacttgaactgccgcagacaccccgagaaattgggtcagtctggggggcgggcgatgcagcgcaacgcagtgactcgtaccctccagcgatgttcgtgcaagacccgtgcacgcggctggagacctctgccgagggcgagttggtcccgcaacgtcgcgagcgttacgtgttccgacccgtgcttctgcgcgttctcgagacgtacttccaaaaatgcccatttccggacatagcgaaacgcgttgagatcgcaaatgcctgcaacgcgcacttgcaggtggacaaaagaggtggggaggcgagccgacagaggccacgacggaacggtcggccacagttttttaatccgttcgcttccgtaaggtgtccaactgatgccgaaggaggtggtcactccacaagtaatcgccaattggttcgccaacaaacggaaggaaatgcgccgacgcatgggagggacggaagcgggacggagtcggttgaacagtttggtaaggatggacactgagcactctaagcactcgggcctattcagtcggcgggccgctccaactcgccatcgtcgcccaactcagccgcacactctcgggagggccccttcgagttgcgccagaataaccaacagagtggcaacgtggacgaggcagtgctggcacattgtgagcagctgcaggcaatgccaatgtctgtccccactgcgtccaatcagcagcaaatggtgtaaaagccccacttggtcatggtcacccgccccgttcagcttctgatcagtgatcagcccgagtcagtgccatccgcagccgacctggcccttgtgctgcccccgctggggccccctcaccacccaaactgctgcccacccgcaactccgctgctgcccccaaatgttgtgcagttctgcccttccgtggaccagcaactgctccatctgctccaggcccaacctgtggccaatcagctgctgttcctccagcaattgctggtcggcacttcgtcagcagacaatgactacctcaagcaggaccagcaacatctgttgatggccattcatgaccaatgaatcatcacccacttttagccgatttgttttgctttcgcactttcccttttctttgctttttctttcgatttaaatacaaccattaaatttgtgttaattgtttcacattttacttttggtgaattttgaagcgttcctttctcatccgtggaaacaaatcgcatttattagcacttaatttgctaattcgacttttaaaccttcgatattttcggcggcgcccatttttttttgcatcacaaaaaaattcgaaaaaattgattcaagaaatctttgaaattattttttggtgaatccattcagtcattttataaaaataaaacggaaacttaagtccgcaatttgcgagaattcaatgacaagtatataaaaattataaaacaaagaattttcggcgacatgaagtttgggcaccagagggagggatttaaaaaaataaaacaatataaatatataaaatgttatatgtataaagcattaaaatttggcatccctttaacaaatttaagtcgatgcaattgaagagcaatctcataaatactcactctaacgggtcgcgatgatgcaaaccctctctccctctctctccctccactctttctttctttcttactctctcacctctccctcctttctctctcccctctttctctcccccctccctcctcccactttctttctttctatctctcgcactctctcacctctccctcctttctttctctcattctctctctttcccctctctctc

SEQ ID NO: 6526 - DNA, 1661 bp, Heterodera glycines
  misc_feature (23)..(23): n is a, c, g, or t
  misc_feature (1493)..(1494): n is a, c, g, or t
  misc_feature (1612)..(1612): n is a, c, g, or t
  misc_feature (1650)..(1650): n is a, c, g, or t
atattaatattttcaaaattaanttatgttacgtttatttcggttttctaaattttatctctcgagacgcaaacttcgttcatgttagcttacatcaatcgggcattttttgagtaacattaacttcagtgcgtctttttttatcttttttaaaatttatgcatattgcagtaattaatatttgaattttttcattagagattaataatttatttaaatagctgtttaaaaattgaaacaaaaaatatatcacagataaagggaccgaaacatatcataattataaataactaaaccaaaattaatttattttgccaaatggataattacagggctgccatccgtccttgaatggcaaggacgtccttgaaattgggccctctttcttgaaaataaaaaatgtccttggatgccaaggacgtccttgaaaatgaacatttagaaaagttttaaaaaaattcaaagaaatttgataatttttgtaattttcaacaatatttggattaaattatggcattatgtcaataaaatgcaaatttaattgcccaaaatctcaaaatttggtcattttttggacaaaatctactaacaaacagcattaaaaatacaaaattcttccggcgccgccggaccctcccctatcctcaaaattaaaaaaaaaagcgcgccgtaaaaaaaccttttttgtcaacaaaaaaaaaagtcgtcgcatggcttaaaatcgcaaaaattaggcagtttttggtgaaaatctgttaacaaattgcattcaaattttcaaaatttttccccggcggcgcctgtcggcaccgccagaccccccccccctttttcccggaaatttttggaaaaagcgcgccgcaaaaaagcgtttttaaagcagaaaaaagtcgtcgcaaatgaggaaaatgatcagtgaaaacaaaaaatgttggaaaaaatccattccggtgaaaaatacaagtcatttgaataatattaaccatttttcactgcatataataaaaatttgaaatgtccttggatttcatgaattttccccactatgtccttgcaaatcggcatacccgtccttggaaacggagcatggacgatgggagccctgatatacttgtcattgaattctcgcaaattgcggacttaagtttccgttttatttttataaaatgactgaatggattcaccaaaaaataatttcaaagatttcttgaatcaattttttcgattttttttgtgatgcaaaaaaaatgggcgccgccgaaaatatcgaaggtttaaaagtcgaattagcaaattaagtgctaataaatgcgatttgtttccacggatgagaaaggaacgcttcaaaattcaccaaaagtaaaatgtgaaacaattaacacaaatttaatggttgtatttaaatcgaaagaaaagcaaagaaaagggaaagtgcgaaagcaaaacaaatcggctaaaagtgggtgatgattcattggtcatgaatggccatnncacagatgtgctggtcctgcttgaggtagtcattgtctgctgacgaagtgccgaccagcaattgctggaggaacagcagctgattggccacagggtgggcctggagcagatggagcangtgctggtccacggaagggcagactgcacaacatttgngggcagcagcg

SEQ ID NO: 6527 - DNA, 1892 bp, Heterodera glycines
aattcccccccccctcatttgtcagggttttctgcgatgcattcctttggcattttgtccaatcctttccccaattataaatggcactgaccatccaaaatgtccttgagattgttttattgtccacaaatttattcccggtttaagtgcacatttattttcttattgcttttccttatatgtaaaatattcctcaaaaaatgggctaatttaaaatagcttaaagcattaaatatgtggacatgaaaaatggcataaattttttaaaaatttagcgcatttttttttcaaatcgcaaacaatgcttctcctcattttattcccatgcattttcccccaaattgcttctctcaatttcaattggtggcatcaacatcctcaatcgaggcatcagtcgataaaaaatagtaatttaattttattatttattattttaattttaattaaaattcaaaattaaaaattcattgtttatagccatccaaaaatgctgccccaagtatgaaggaacatcgactccaatattttgctgtgtcgacgaaatgttcgacaaggcaccggaatttccccaacagatgtgcaaggacgacaatgttgaaatggtaaaaaaaattatatttaattaaaaaataaataaattataaaaaatattaaaaaagttttcctaaatttgtgagatggtaacaaaaaaattaatttgtatttaataatatttgtttaaaaattattttagtatttaaaataagaaacaaaaaactcatagttttatttttcaaaattttttttttaaaatatttcttttaattaattttcctgaaaattttaaaaagttttttatgtaacttgtatacatatatcctagaaaaattaattgtaaaattgaatttgctcataaaatttaaataagaaattaaaaaaataatattttttattttgcaaaaatattttttttaattttttactttaataaatttctaaaaaaactaaaaataaataaatgattattaattaattcatttattgttttaatttcctacttatttatttaaaaatatattttgtaaaatttatttattataattaatttttgaaaaagcattaaaattatttatttatagtttttttaattttaagacaaccattttcaagacgataagttgtgcgcagactgaattccatcgtcagaccggccgagtacatccgccgacggacatttgccgtaattttaaataatttaaattaaaaataaacaaaaaaaaaatgttttacgattttttgaaattgcttttccattttgtttttcaatttctctagctttaaaatgtttaaaaattttctatgatatgcaaaatgaagaggcagagaaaaataaaaaaaattttccacgaaatttgaatttgtttttttaataaatttattttaaattaatataatttttttcatttccccaggcaattattgctgcgatttgctgatgaatgtccaaggcccggtcaaagaaactgcctgctcccgaaagtgtgccatggcatcgtttgccattggcaaaagtgtcaacagacagctgatggacttgagtaagatgggctgcgatgctgcaaaaacgcaatttgccgtaagtttctcagtactttttaatatattaaattgaaatttatttatattatttattattatttttattttccattattttaaaaatgaattttacattaaaagtttaaaatttttaggccttggaggattgtctgaagggcccggcccagtacttcaacgacaacagcagaagcagcaccaccaacgacgacgagcagcaggacgtggaaatggcaaaaatgatggcactgaatgaagtgtgccgacaaagggcggaggagcaaaattcgtaaaaa

SEQ ID NO: 6528 - DNA, 2299 bp, Heterodera glycines
  misc_feature (13)..(13): n is a, c, g, or t
  misc_feature (20)..(21): n is a, c, g, or t
  misc_feature (44)..(44): n is a, c, g, or t
tgcaggtcataantgacatnnttttttgcccataaaaataattnagggatggaataattaattaatttttttggcaaaattgacacgcgaaaatagtttttttttttttggatttgagaaattctcatgaaaaggaagaaattttgaatttcaaaattttcactgacaaaatatttaaatttgccgaaaattaattaatttgttgtcccatcacactttaatcataataatttttcaatgtaaattaattaatcattttaattcgcgttaattgtcatcacttatgatatttgattgtttttttccattttgtcgttttgctttaattgacctgctattaaaaaaatgaaacaaagtattttgtgtccacttttattttattgaaatctaaaaaaataaaaaataatttgtataaaattataaaaaattgacatgctaaaaaaagcattttcaatttgagaaactctcctgaaaagcaaatttttgagatttgatacttaattaatgatttcgaaaaaaattattattattttaactctaattttaataataataataataattttttattaattgtcagtaaaaatttttgattttcctttaccatttcactttttatacatttatatttttggattatttcgcattattattttgacggataaatcgaaaacaaaaattaattttttttttttgaaaatatctaatttaattacttttattaaaaaaatgtttcttaatataaaataatttatatattgtataaagaaaattaaacaaagatagtgagcttttaagataaaaaaattcaaatttcttgacgattttgccgattttttgaatcggtgcctttatccgtcgccactttcaacgattgggttaaacgtgccgcgcctttccccgttttttccgcctttgaacgccattttttggcacttttgcttcttgtgccctcgtataggtcattagcattgattgttatcgatcggctgtttggcctcctcgtgccgtgctcagcgttagcaatggcacatttgctgtacagcaaatgctcggaatgccgtcggtccgtgaaggacaccaatgtgctgttgttgcgctgggcggtgccaattctgtgctaaatttggttacgaaaagcgaaagctaatgagctttgtttaattaggccgccaggggtcattagacattgcggcatacccagtaattaatgatacgttgttaaagaaataaaaggctcagtcttgcggaaagaacatgccggatttgaaacagtaatcaaaatttaaattaaaaatgtcggggaagtgagcgtaagggttgagctaccgcgcttaaatttatttcaaatttcctacttttggcttaggccaagccaggctgccatccaccaccaaaaccgggtcagccaatatcgatacaaccttaaaaaaataaaacaaaattttccaaaaattttttaggcctcaaaattttgtgaaaattaaaaaaattaattgtttcgcaaccgttgtgtgacgatggtgatcagtgggttaacctgtaaaaaaacgtattggtcgatcagcttttgcatttgactctgatcaagctcaccacaatgccaatgacgagcagataataagaaatgttgatcagtaggccgatcagtggcgatggcctactgtctttgtacagaaatgtgatgccaaggtacagtaaccggtacggtaggcaggtggcgaatgtccacgcggtgctggagaacacgaagaacagctgcttgaacaggcgctgtgaaaaggaaaatgatgtaggaattttgagaaatttaaaaatttttataacgtaattttaaataaaaaattctaataccgtactttttgtctcatagtcaaaatttttgcattttcaaactatgaatacaaaatttttataatgtatggtccgaaaaagcgtctttcaccgtaattttttagtataaaaaattgaataccgtagctttttcaaaaatttttcggctcagttattttcttcatttccacaccataagtttaaatttaaaatctatttaaataccgtagttctatattttaaaaccgtaatttgaaaaaattttgaaacgatttctgaataaatgtttttgaattatactttcccattttcacaaataccgaacgcgttgcataagccgtggatcggattcgtgttgaattccgcgcgatacagtagaccctagtggtacacgatcaacgatacggtaaaaatcgacacccgcgcggctggagatgaacagataagttttgcagacaattcaacg

SEQ ID NO: 6529 - DNA, 1863 bp, Heterodera glycines
tctttaataaaaaaaattcaatattttaaaatacaaagcagtgaaaattgcaaaaataaaattaaataaaggaataaaatataaatgttaaattaattgcaatatttgcaatcaaaaatcgttttttttaaatttcaaggactaattgtttgttcaaaaacagtctaaaaaataaaatttttctcaaaaccaggctttttggcaaaaagtgccaatgccaaccaaactgatcattttcagatacttttaacacagatttaatttagggatttattcaaaaaataaaataatgaccaaattaaaaggttcagcagaaaattatgatcagtgatagcatcaaattattataattaataagatattatttttaaaaattaattaaatttaatttactttaatctccatgaatgagtaaagtgtgatcaccaaactgatcaaacaaagccatgacaatgcaatcagaatgagaacccgatcgcgcttcaccagctgataatagtgcagaggacggccaatgaaaatcaatttgtcaacctgaaattacaaaaaataattttcattaaaatttatatgcaacaattttcaattttttattttcaaaaatcaaaaaaataaataaatttaggcgattttttaaaacatgaatgtttaagatttttcagtttctctttgcattcagttttagttgaaaatgttggcattttattaattacattcaaataaattaattttttaaatttttgtaattattttgacggtttttaaaatttaaatccgaattatataatgaccaaaaaagttttacgttaatccacagaagacataggcaactgcacagttgaggagttacaatgcacacataataagggtgacaaagtgaggccggcagccgattgatgtgtaaaaatttggaaaattaaaattggtaaagtttttgaaaaattcaaattttattgataaaattccgaaaaagttactaaagacaggtccaagacaattgagtcccagtctcgaggtcagaaaaatgtccaaaaaccttttttgatatggttgatgaacaaacaacatgtgccgaaaatagttggggattaattaggggtaatttttgaaagaaaaattagtttttgacatttatataaaaaaactgtgaagattaaggggaatggttttaaaatttagtttggaaaataaaatatcaatccaataaaatttaaattaaaaaacaaaaacttatatggtctggtcagcatgtaaaataggcaagtcaataaatcagccaaagtcatgctgattacaatgatctgggatgggattaaataaattaaaacaattaatttaaaatatatttcaaaattttctcagctgatcacaatgagttgggtgggattaaatttgaaaatcaaaattttttcccacttgtcttggcttatccgcagtgtccactttaagcagtccgatcaacagaacaattgaattcaatgcagcaccaacgaaaccttttaattaatcttttatgaatttaattttaatgccaaatcaatttttaaaagtgatcgaagataatttgaatgggttggagggaggacaaaatgccaacacgacaaaacaaattattgaataatttgtattattttattattcccttgttttttggcataaaaactgcaatataaaaatttaattaattttttaattcgtaataaaatttttttgccgaaaattaacaaatcctccaattttttcttgccttatctcggaaaaaaggcctaaggtattatttgtcttccagccttattctgaccaacaaaaatatcgtatcattcattcattagtcatcatcataccgtttataaggtagaaata

SEQ ID NO: 6530 - DNA, 4457 bp, Heterodera glycines
actagaactaaattttctgatcaacagcatttatctgaatacatagatcgttttcgttgatcaatgattcgagaaagattttcttaatcggttttaggtgttggtcccggccagcagtggtacattgaaatatgagcgtgttgaactgttttatcacagtgagccaaacacgagggcgcgttttcttcaaattacaacggaatcgggaaaaacactttcactgacaggcaattttccattcaatttttcgcggaatcccgcccggaaatgggaaagaatttaaataaattcgattttttaattaattatttatagtaaagcttatttaatattaaaaccttttcttttgtatcttcatttcacaaaagataaagcaacaattaactcaaaaataatagtactcgcctctcttcagctttgcatatgcttccatttgggaactgctctgaaatgcgtgctaccactttagacatggaaggcatcgagcgatggatgcaaaagtcaaggtgaacatttttacagcaattcaatgtttggggtttaatttatgctgtatcaaaagattttactgtatatacaaaaaattatttttaactttttttttgaagcgatggaatgaattgaacttttttttgacagatttgtgtataaagcttccgttggcgattgtgtgttcactttggatgatcatcaacatagcaagccttccatgaaggtggagaggataaataaggtacaaagttatgtgtcagcatgctgattgccgatttccgacatttttaatttggaatccgatttttgattgctaaattttttgagtcttcggaatcccaattccaaaattttgtaggccatcggaatgccgttttccgtttatcgaaaacatccctggtacatattcatagtttaattaattccacttttttcagattggtcgtattttttctgtgggaatttataggtgtcgtttataataattataaaaaagaatacttcaaaatatgtctattttttgcagtccaatgacaatggaaggtgctttgatcacgaatggaattctcagttcatgcttctcccaaattgaaagccatacaatacagaaggtagaattaagtttgcccccaaaaaacaagaaaacaatatgaaccaaacatatttgttcagctctcattcgatttgctcatgagtatctacaggacattcggctacatgtcaggtaaaatttacatggtttcaatgacactagcatcaattgtacccagctttttaaataaaattttaaaatattttcttggccattccgaagtggccaccatcattttgggccacgtgctcttgcctaataccgatttatacgagattttaaaaatatataaataataaaaagaatggacatttgcagtgtgccctttaaatctgaatccctattatacatataaatctatttttacttaaataatttttttccaatccctaagaattttctgaacggtctgtgcgaacacaagccatcccaggacttgtggaactacttcacactttcagccgttacataatcccatttgccaaatattaacctataataatataattaattgtttgttgttataatatgtgcaataatcttttatcattttttcattttgatctcgggcagcatacccaaaaaacttaaatatcaattagtctctttttcttaattatgttcatatatatatttgtatatttttaaatcaactattcaaatttcaacaaaaaatattattgttattattattggcaatttaagacaataaaacattgaacatatttatctatgccttaaattctaaaatttatgcatttgtttagctatttattataatttttaattattattaaattaaaatttcaactcttggtccataaatatttatttaaatgttaaaatagtcttccggattctttccgttagtctgtcgattctattgaattttactctgtttcactttatgcatattcaaaggaaaagcatagaagcagcagcaacagcagcaggcattcttttccaggctttgttccgctgcttctccctcgccccctccggcagttcgctgcctttggcccactctcctcgccccaggggccctatttgcgtgtgagaaaatataatggtgatggttctgttggttggtggttgtggataaaatttggcacgaaaagccgagcatcgaccaaagacaggggaaggcatggccagggcggcaaagtcggagaagtgtaaagaggaaggaacgtgagtgggccaaaaaagcggcaaaaataggggaggggtggtggcgcttgctgtgtatttatacaatccaaagtcctcccatggccccggctcggcttcatctcctccctacttttcctcaacttcccaatgcctttctccccatcttcaccaatttcgtgtattcatttcctattctttgcgcctttgaccacacaacttttgtgccaagaacaatcatttaattttgtcaaatattctgcgagaagccaattaaaatataattttgcattttttaaataattaatccctgtgaaatgatttatgtattagcattgtgaatacatgaatataattaatattcagcgaaaatcgattcaatttattttgttatacacgaatcaaaagaacagtagagcctggccttgaccctggatcctgtccaggccaaacatgaaaaaatcaaggtccagattaggcacaaaaacctggacttcttggatattaatcaaaaatttaaattgataaataacaaaaatttttaatttaaggcccaaaatgttcatagtttgcgccactataaaaacaaggattgttttttctttattactgctattattaattaattaccctcaatgttttgtgatgggccgacatcgaatcattgcggcagaggacatggaaacagtgctaaatcgcctgcgcccttctgtggaccgatttgatgccaattttcagcgcacatttaacgaatacggacgtgtggactccgtgcgtgaagtcagttcaaaaatttgttttatttttttacattgtaaattattttaaattatttaatttttaatttaattaataattttcttttctttctcccttatccatcagaagggatttctgaagatttttgaccccattttccaattgatttttttgggcaactgaatttcattttaataattttttgatacttggaattcttttttgaaaaaaaaaaagtttggacatggaatttcgattccgatttttaatataaacaacccctcatggccataggaactcaagaacacaaaaaagcagggttttcaacatttttgttacaactttttgcaaacttcacaaaattttggaatgttggcagaataatagaaagaacatttaggattatcccatgattcaagaattaaaaaacccaaatccccaagtgataagccaaatttatttggttttctgctgtttctttcagcttcttgaggacagtgtggtgccacggtttactgtggaggagcacggtcgtgttgattttgtggacgcttttcaacaattgcagttacgcattcaacaattttttgacaccaaaattcgcgcactccaccgtttggtgggcgccgctgaaaaggcggcacaaaaagtggacatggacaaagtgatgggtccaacgttgggcagtgagggacgctgccgggaccaaatgagggcattgaatgccagctcagtgcacaacccaagcatttggaagaaaagcaatggaaagacgaattcgggaatccatgttggcattttggggatgaaagtgcttggggacgataagcaattaggacatggaatattcaagactttttgagagattatttaagcattgattatgattttttgaactatcaatttttgtgcaagcacttggcatttggcacaaaacaggcattctcacacatattaatttaaaatttccatgccatatgcgccctgttttatgtcgaatcgggatattagccaatgaatatgaaatagattcacaaaaaattactttatttttttgttacattgttaatcaattattaaccaccgtatttactaattcctccgggctctttggggttgctgtattttagggaatacggtatcttagagaatgcttctaatacttttggaagataccattttcgtctacattaaaaaagggtattgagtcttaaatttggttggtgcgcaatcttaacatgccaatttcgcgcgtcacaggtggcactggacgtgtacaaatgcagcggtgcggtaaagcgtgattttaactggaccgggcaagcgaacatcgaacaagcaatggctgaaaatgcgcaaaatgatgcgacactaatgcgacaatacattggcacgtacagcgggctaactcgaatatttccaggtcttcccaattgacacctgc

SEQ ID NO: 6531 - DNA, 3346 bp, Heterodera glycines
  misc_feature (3295)..(3295): n is a, c, g, or t
  misc_feature (3321)..(3321): n is a, c, g, or t
atcttgatcagggaacggatttaagtgctaaaattccctttcttggataaaaagctgctaaaatagggccaaaatggacttaaattagttaaaatccaaattgggccggggaaaatttgtttttcgtgcttgttcaggtaaaaaacacctagaaatttgctccatgatgatgatgagttaaaaaaatttattttttcaattcataaagcgacataagtagtcatacagtaattccgtgtattataattacagtatacatttttatttaaccaggattaattatccaataaagggtacttttggctaatgatgcctcacaggcaggcaatttcacgataattatatctaattatttaattaagaccaagcggtgcttccgccagcgattgaagaaagtttcgcacaatttgtttttgccaatcaacaccagagcagcgacgacaacggcacggcggcacctcctcgccgcagtggtggccatcacttagtgcttctgtttacggatggtgtcgagttttggccaacagatgtggtgcaccggtttcagcaacggcaacaggccgagggtttgccgcccatccgcctgtttggccactccattggccacgggcgcggggcacagccagcgcttggctggctcacctgccagacgcgggccggtctgcatcaggccgaaatcggctcggtggctgaggtccgactgaaggcgcgtgcccatctggccaaattgagcgaagtgttggcattggcatatcgtgaacgtgaggcggcctcagaacggagaccaatttcgtggtcagtatttcagagatacaaaaaatataaaataattgtaatacatataataagacatatgggcaaaatgtcaggccttgggtgggaatcgaacccacgccttaacccagtccgtggccagcagctctagcattgagctacctagacattgttcggcctcaaaatggagtattttctttcactcagcgatcttcaatttcacacaggtcaaccccatacatggacgtgcagaaaggcggtgccgttgtgtccatgtcaatgcctgtgcttggtgcacaaccaggaatttatcgtgacttaaatatgtcacagaaaaaatttgcggatggaaatttgcatgccaaattggatggcttcatcgctgttgcagggctggacattgcatttacagagttggcacgtgcaatggtgctggacagctcggaggacgcaacgttggcatatgcctttttggtggacaacaacggcatcatttatttccatcccaggtcaaaaaagcatatttttatcgctaacaacaccaagaattctggcaaattcatggaaaatgaattgccaagaattctcgaactgcttttaagagactcgacaaaaataattttcccaaaaaattgcgctgattttgaaggctgcacactcgggcagctgatgtgttcgccgtccgacgaacaatgtgccatcgaatttcgtccactctgttacgctccaacactcgcgtgccattcaccaaggcggacgagctggtacaccaacagctgggctacattgactccgtgccacatcgtgacctgcttgaagttgagccggacacaccgctaatgcgccgcttccgggcacgacttgtgcgtcgacagtgcggcattggcacggcaccgttggaggacgcacagcgacaagtcagtgctacgcaggacatcaaaaaaaacaattgttttatgccaaaaaacatttggcacaaattaaaaaaattccatttgagataggtaattaatttattatacagttacgttgtgtagcagtgaatggcacaccgctggtggttggctttgtgttgatgaagcaacgacatcgaatcagcatatcaaaacatcattttcagaacgaagtccgatttgtatgtacaattaaaaaacatgtaaatacgccaaggatatgaaggccaaggtcgaaaaaagtagtagattccggaatttagaaaagtccggattggcataagtcaggataggactaccgaaattaagatcccagttttaccgagatttgaatcaagaccctggagttgacatcatccctattctgtcgggatccattccgggaaaatcccgactggatcgcggtcccctacgggctctaaaaaacataaaattcttaattctcgaaattttctaataaaaaatcagatttctaggcatcaatcaatttttagagtggtctagtttccaacttctttgaaaaacagtttttacaacacaacaggaagatgaggtggacccattccaattggcagaacgcctcaaatccgctgggtttgaatcaaacgggcaacaccagcaacagcaggagggcatcaaagaagaagccgaatttgtcaacaagaataataacaattctcttgcccaacctttggtcggcattctgctttcccctgggtaaaattcacaattcttagtttgctagacacattctctaattagtttaaattagaaacgtgactcagatttatgcattttaagccctatcatgcaatggcaactgtccgccgcactgtcctccgtcctgcgcccgctctcgcgtttccgcgcattgctccgcttgcttccttcattacggcacggacatccttttttggcacatctttccgcgcttgcgcccgactcagtttttccaatctgggcttccgcatggaatagcagttacgcttcactacccaatcatcgcttttctgcttcaacttgcactctgcggccacttccaccgcgcattgatccgcgactgttccggtccgctttcctcctgttccgtgcctcatcgctgcgcgacaaagccgcattggctgcattttttccgcgatggtctgcgtaaaaaatataaatctaaatctctattatactcagggatggcagatctgaggctttagcctcattttgtggttttttgacaggtcaatgaggctaaattttcaaaatgaggaaaaatttgctcaaaatcgcaaaatttggtcatttttcggacaaaatctgttaacaaatcgcattgaaaattacaaaatttttcccggcggcgcctaacggcaccgccggccccccttgtttcccaaaagttttttggaaaaagcgccgcaaaaaaaatcaacttcgtttttcatgttcagaatcccaaaaaatgcttatttctaacaaaaaaaaatgctcaaattgatcatggacaatcaaaaatataacatttgaacattttatacgtgttttgaataaatttgtgaaaatgaggctttttgacccanaaatgaggggggagtgcttgccaaantgaggcttttcaaaattttcatctg

SEQ ID NO: 6532 - DNA, 4316 bp, Heterodera glycines
  misc_feature (7)..(7): n is a, c, g, or t
tgaaatntttcgtataaaaaaattttctaagatttttttcttgaaaaatttaagtttgaaaaattttttttaaatttttggcggcgtgattttgtcccggcgtgattttggggtgcacccaaaagaggtgggcgaggggggtcgccggcgaagggaaaacttctgaaaattttggctattttattaacaaaattattaataattcttaaaattttccccggcggcgcctatcggcaccagcggcccgtcagaaacatatatttcttaaaaaattagcccaaaatctcatttaattttttttttgaaaaaagcgcgcccaaaaaatgcctttaaaaaaaggtcgttagcagtttacatgggtagaccatttcgcaaaacttttagttgaacctcccccccccccatattttgtattgcgtggggtggaaaaaatcaattttttttgcaattttttaggccaaatatttaaagcggtcaaacaaattttttgttgcccttaatgcgctgttaaaatggccaatcaccgacaaattggtaattttgggcgaaaatctaccaaaatggcatgggaataattaagggaaaaatacggaataattgtggttgttgttttttcacctctttgttcgcgtagaacttctgttccccaatcgaatgttcgtccaatttcctcgggtcggtgccctccggcattttgtccacccattttttcatcgtcaaagtgccggacacatcggcacgccatgcgacgtccttacgatagtccgagtgcagtgccaacttcaaagggggggggggcagtttttcatatacaaaggccgggcattttttcagtttggacccgcaaaagttagaaaatctacagaaattgcttctttttctttttttttttgatgaaaccttgagaatgtgtttggaatagcctccgttgtcgtccttgcgaagctggtgcacaagcgaaagtcgccttaaaaaacggagggtaaaaattgaaaaaaaattaatttttcacaattttaattttgttttcgctcaaatggcaattttgttgaaaaaacccaataaaattggcattcctttgggtttcctggaccataacatttcataagtttcaatgaacaaaataattttgactatcatttgaataaaaaattaagcgaaaaaaatgaaaaatttgtcggcatttttttcaaattgcagaaaaatttgtgatattttctctttacagactctgtcttttgacaaatgaatttacaacagtccaaaaaaaacccaggaaattgtattggatctgatgttcttacatacaattagctaaaatcgcatggactcgcaaaattttgatgggacacttaaaagtccataggacgcgtttctgtgaccctaatttttggccggaccgttcctttttcgcgttccttattgaaattttcttgggtagaaaaaagcgcgcaaatttttaacattcaattagtgcctcaaaacattcaccatggaatgcacccaaattcgtggacatccgtcacaattttgggcccttcttttttcgtctgtcccttttgcttctttcttttcccgttgcttttctcgtcactgctgctgctgatcggctccggcggaatgtccaaataggaggcgcacaaaacgatggaaccgacgtcgacgcactgaaatttcaaaaaaataaactattcggcaaaatatcggaagcgccatgaagaatggggggggggggggaagtcccatagaataggggtctcctattcttcatgattgcccatcggaaagcattttcagaggccagatgggaagcctgggatataattttgaaggtgtatcgcatatatttgaaaattttaaaaaatttgcaaaaacggaaaacccaaaaaatcgccatggtttttccggttcattttgccacctcaaaacactccttcagtgttttgggcaacctccgtttcttcttcttctttttttcgtcttccgtcgattttttgtcatcacttttcttggcaatcctttttcgtggaggtctcggcattttccgcgaaaattttggcattttattactaaaacgtaaattagctaaaaatgaacagttttaacaaattaataacacatgaaatgaaatggagtaaatctgtagataagtgagtggatggacaaggcctacagaaatttttaattttggcaaaatgttatttaaatttttaattataaattttaatcgatcagctagggttgtactatcagagtctcggtttttgactctcaaataatgaaaatttctcggtgtttcagggttatccttgaaaatgacaaaattttacgattttgagccaattttttttaaaagaataagaatttttagggggcggcaaaaatccaggttgccgaaaatggcctggacttggattttttaactgaatcatgttattccgtttttttctccaaatttgaccgggaacggagaatggcgatcccgcctgctcgtgccgacctttcagcggtgtccatcttggaactaaaagaaatttgcaaaaaataaattatgtaaatcattttgcaggcaaaaccccaaaaaaatgggtgggacaaaaaataggcatttttggctctttaaaaatattttaaggggtataaaaagtaccaaatttagtgcggtgtaatggtcataatcgtttcttattaaacaaaactttaaaaaattcaattgttattgataaatattccttgcacaaatatttctttgatcatttttgtcgccaattttttgacgaattattttttggccaaaattttgaattaaaaaaaatgtagccgattttaccattaatgaaaaaaaaatgtttcggttaataggccttgccaacgttaaaggatttttcctttttttttgcaatcatttcaataacactgacaaaaagcaattgctgctcgcatcggtttgtgattgtttggacgacgaaacgacgcgcgagattattaaggaaatgtttattaaaaagtaaaataaaaatataatacaattaataaattttaaaaaataaaataaattattcttttattaattaaaaagagagtttgaaacgtacagattgaatatttataaatgaattataataatttaaaagaagtcttcaaattaattaaaaacagtgaaaatagcatagaaaaataatgtacaccgtccggatcccaactgcttgctccccccccccccctcagaatccccaatcacacagggattctgaggtcttatcgatgttaaaagtaaaatctgatcacgtattcgtgatcagcgtcataaaatagccctaatgacatgtttttgaaagatttttggtgaaaaatttttccactcaaaaatcctggtcacccccctttggacccgaagcacaaaatcacttttatttttatatctttttttaaggaagtgataaaaataccaaataaaatttataaaatagagcaaaaaattgcggatttttgtagcattttacttttcctgaatatcttttcagaaccgagttataaatttttttctgaaaatccgaatttttccagaatttctggaataacttttttcatatttatgttagaaaagccaaataaaccccataaaattctcctgatttttctccatttttaatgttttatttactcaaaattggtcaaaccttaggcagatatgaattttcaaattttagcccaaattcccgatggccaaaaaattgaaaaatatttttgaatttttaaaaaaattcaattaaattaaagaatcctggatattattcggtagttcttggatggctctattaacatgaaaaatttcagaaaatttcatttttcagaaagtctgagtaaaaatgtttaaatattgtcatactttctgaaaagcaaatgaaattatctaaaatttctaaactaataaatcaatccaaaagctatcgtatgatacatatcaagattattaaatttggatgtgcttaagaaaaaattatgacgaattttctcgaaaaattttataaaattgtcacttttaacgaaactcccattgtggcatttttactaaacgaaaaccagcaggaacaaagctcagggattgctgccgaaaaatggcctggatctggcggaatagatgaatttactgattaaagtatgagatcatcattgtctgttcattgaaggtattctggtcgactgcccgacacatttgacaacgatcatgcccaggagctaatcgaaattgcggagaagtatggactggaggcaatgaagatcatttgccaggacaaacttggcactcggtaagc

SEQ ID NO: 6533 - DNA, 1036 bp, Heterodera glycines
gcgcccgttttttaatttttgtgtgcttttcggccccttcgcgggccgtttttaaattgtgttgagtcggacgggcgcttcgcgcccgttattaaattttgatggactcagacgggcgcttcgcgcccgtttctaatttttgttgtgcttttcggccgcttcgcggccgttttttaaattgtgttgagtcggacgggcgcttcgcgcccgttattaaattttgatggactcagacgggcgattcgcgccctttttgtggcctttttaggccgatttgcggcctcgaacggccgcttcgcgccgttttttaaattttagaacagatacaaaagtgattaaaagaggtagaactgtgattagaagaggtacaacagagatgagaagaggtacaacagtgatttgaagaggtacaacagtgattataagaggtacaacagtgaaaaagtgatacaaaagtgattagaagaggtgcaaccacggaagggaaaggcacaacagtgatttgaagaggtacaacagtgattagaagaggtgcaacagtgattagaagaggtacaacagagattgaagaggtacatatttgattaaaagaggtacaacagtgatcagaagaggtacaactgtgattaaaagaggtacaactgtgattagaagaggtgcaacagtgatcagaagaggtacaacagagattgaagaggtacatatttgattaaaagaggtacaacagtgatcagaagaggtacaactgtgattaaaagaggtacaactgtgattagaagaggtgcaacagtgatcagaagaggtacaacagagattgaagaggtacaaatttgatgaagaggtacaaaagtgataaaagaggtaaaaaagtgattagaagaggtacaactgtgattaaaagaggtacaactgtgattgaagaggtacaactgtgattaaaagaggtacaacagtgatcagaagaggtacaactgtgattaaaagaggtacaacggtaattagaagaggtagaactgtgattagaagaggtacaaca

SEQ ID NO: 6534 - DNA, 1282 bp, Heterodera glycines
ccgcttaattatggcaaattcattcagagaaagaaaaaaaattgaagtgaatatttcgacgacttaattacaccaataattaatttaattcttcttcataaatatgctgcactttccttcctttcgtctgatcattttatttttattttttggtataatgccaattattcaaaattcggactcagacagagaaaatgagaagcaaaatctttggaatttgcgggggaatggagcaaaagtgaatataaaataatgacagaatattttgggaatattcttgacagaatcctttcgtgccgggcatttttcaacggaaaacgataaattcgttgatgaacagaaaattgaacattttccgagaacgatggacaaatggtggagaaagaaaaatggacaatccatcggaggaatacatggaggaaaatttggggaaagaaatggcacggagaatgggagaaaggcattggaaaaaatgggagaacggagaggaggaggaggaggaaaatgggaaggagccgggagaagaggagggaaaaacatatcggaagaaattggaggaagaagagcaaaaatggaagaaaccgggggaagcgaaggaatggaagaagccggaaaaggaagaggaaaaagtgaagaagctgggcgaagaagaaaaaagccatcggaagaagccgggagaggaagaggaggaaaaatggaagatggggcaagaggaaggaatccgtttccttgaagagtccgcggcatcgtcgtcaacagaacgttccgccggaagggaaaagaatttaaatccctttgaggacacaaaatttgacgaaagattccccattcacaatttgtgcggtccatggaattccggcagacagacgagcgattttgaatggtaaaattgcaaaatgggggaaaaacgaaatcattggacaggggcgaaccagcggacaaactgttgcgattgctgaaccaaaggacgacggacggcaaaaaagggccaagcaatgctaatttcaaatataatatgtttttggcaccaggccaaatgactggtaaatgaaatcagagtaattaactaattaaccaacaaatttattgaatttgaggtgagtccaccaatgtgtcaattgcaatttacatcgaatcgatgagcactttcaaagcacagacgatggttcgttcgttcgttttggttacgcttaagcatgtgtgccactttaggacttcgagatggacatgtacttcgcaatggcatggtctgtctcccctttccctcttttcactctatccc

SEQ ID NO: 6535 - DNA, 2405 bp, Heterodera glycines
ctctctctcctttctctctcctgccacctctctctccgcgccgccttgcttgcgctgatcccattgcccccgccccctccaaaattaggtacgaccgtcggttggcccataattgcacccatccgttgttggtcgctcacaaatccatcgcagaaagaatttggactccaggtcaagaaaagcagagcgtgttcggacaatcaggcgttttattaatttcagatttatactttctaaatgccaaatttgcctatcttcaggaagtgacaatgccaaactttgtgcgttcgtttctttgctaattacccttaatgagttcctcccttacagatgctcgtcatttacccggatggccttgtatttaaaacgttaaggtgtttatttatccatttttgcttcttttgttaccctaataattaaggatcgacgtgactctctcctgcaacatggacttgcaggttgggagcaaaaggcaagcaccaaaactgaacggcacattccgccgccattcagctgttcccattcgatcgtcaggagtgtccaatggtcatccaaccgttcgcttacatcgaaaatttggtgaacctcagttggcacgtggacccaccgtactacccggtacggtggctttgctttcagttttggatttcctactcaacatttaatcataagaacagatcacgaccaatccggagctgaaacttaacgacatggtcatcacggggatgcgcttcgagcggtgcacgagtccgtacactcttttcaggggcattggtcagtcagtgcgcgtcgttcgtcggcatttcatccccccccctttccctcccctcaaggggtttggtcgtgcctgcgcggttacatcgtaatgaaacggctcgtcctcttccacctcatccaaacgtacatcccaagcggtacagtaccaccgtattcccatgctcgcattacggtgtccgtccccttttgttggttgtcctcttcatgttcagccatgttagtctccgtttcgtggatgactttttggttggacccccgggcatcgccagcgcgcattacccttacaatcacaaggcattcattgttctatttttaatgatatttattacataataaagcatttttagtctgctgactttgaccacaatgtctaacggagtgcctttttttattttatttttaaatattttgtaaaataaataaattaattttttaaattaggccagacaagacttaccacaagtcagttacatcaaagcaatggacatttggcaaacgttctcccaagtgactgcctttgaagtgccaattctccccaatttgccctttttaggcactgattttccttgtactgctcgaatattcgttcgtctcttatttcttctcacgacggtcctttgactgtgctcaccgaattttacgcagcgaaagtgccgggaaaatgaaaaagcaaaaggaggaaaggattacagcagaagatgaggaaaagcagatggaagaaggggagaaagaggatcattattattatcataatcaacaaaatgatggaacaaaaacaatggaaatggtaagagaaatgatgggaacagaaagagagtgggagaggaagaaagagacagtgggaaaagagacgaacatttaaagagtaaattgatcagagagagagagagagagagtggggtagagagagaaagacaaagagagagagagaaattgagatgcaaattttagagagaattgatcagagagtgtggaagagcgaaagatagaggagataatgagagacgcacacttaaagaataaattgatcagagagagtgggggtagagagaggaagatagagaagatatagggagtgagagagagagagagagaggcgcacatttcaaatatgatccttttttgtaattctaaattaatctcaagaacaacaacgcccatgccgcgattcggaagcgtggccaacccaaagggacggcggttctgccaaaaagtgccgtttcggcgacacttccgccaaagacggaggcattctcttcagctgaatttggcacaccctcagaaggaaaaaggcgccttttgtgcagaatgagcaacattcgtgaagagataatgacgaggatgggcagaaatcattcggaggagggcattttgatgggattgggaataatggagggggaggagggaatggcaatgccaacgaggaaagggggaggagagggacagggggaggaggggacgagcgcaagggacaggcccaaccccggcagagggggaaggcattgccaacagtgccaatgggaggacgaacggcgcggcagggcggtggaccaatgtgagtggtggcacaattggaacataaatgataaattaacgttccaaaattaccccccccccccccccccccc

SEQ ID NO: 6536 - DNA, 1899 bp, Heterodera glycines
tgcaatattagggggagggggaggaatcgatggaaggatatggagaaaaatataataatatttatgtataataataaaaaataattctaagaggcaaaggaaaccaaaggataaaaaaggtggaattgaaacaaatcagagcatgaaagaactgtcgaagaaagcgagagaatgaaactcatcagaagagagtcaaaagaatgaacaaatgaataaaaggggcaaaaatgaacggaacgaagtcccaacagagcaaaacaacaacaacaattaccataataaatgggggaaaggagactgataaaacagacggccaatttaaggactatcaaacacaacggcatccgtatttttatggcactgcccgacgatgccaatggaaacgaagaattgagaggcaaatggcggtcggttcctcggctgcatcaaaggtgttgcacctgctggtccacgtgaggagtcggattgagctcgaaggtcactcggatgggttggccaagcgtggaacggacaggcaaataagcgacgagttcatcgggaagttgacagttcgaatgaggagaaacgggccgcagagtgaaggattggaggacgaaaggcttcgtgtggtccaacaaagggtgggcaaagccctcgggcagtacaccgccagaacttccggcctgaaccgacacggggctagtcgaaccgctctaaaagagagtaaaaattaaaaaatcctcatacggtaattcgagtggtaccgtatggctgtgcttttcgcctccccccgtgccgccctttgttcgtctctgtgcacgctgctgtcttacttcttcctccactcctccggcgatgtccgtcttttcccccacttctctgactccgtcttcccgatggtgttgttccgccacttcgtcctcttcgccctcctcctccatcttcggcctcttcacttgcggtgctctctcccctccttcctcctcctcttcctgcggttgttcgtcttccgcttcctcttgcttcaatctccccgagcggatgtgcgaaaggactaaatatttgttgcattttggctcagtgtcggtactcaattggcagtgctctcttttaccgtgttcgtcgcattctccgcgacttgcgaaccgtcgcctgcatttgtgacatgaaaacgaactcatcagtttggcaatcttttctgaatttgttactttagtctgataatttgatccgtccccaatgaactcactcggcgaaatgatcgatcgcttcgccggtgacattttggcgacaaaattgtggtgcaccatgcgctggtgcccctccaatctttgcgcacttttgtaaattcttttgcactgtgggcattggtgccttccccctcctcctccgttttcgtcgtctccgtcggcattttcgcctcgcgacagagtgcctttcttcgttttctgttgctgaggcggatgggccgtgccgacttcgccgaaagaggcggccgaagaggacgaagcgccggaggacgcgaccgaagtcttccgtagttgcggaaattgccgttggtgctgatgttgttgttgatgatgatgatggtggtggttgtgactgttagcctctgccatttgcagggccacctaagaagacggaattttctatcaatgatcacttccatctttaaaattatgcctatgataacgtttcaattcgcgaaaagtatcctttgaccaaatatgaatccctaacccgaacaaattaactttagaatggaaatttttgtcaagggataccacttttttttgcagcactttttccaaaaacttttggggaactaggggtccggcggttccgataggcgccgtctggggggggggggggagggttaccagcaaggaaaatctctaaaattttcagcaaaaatactat

SEQ ID NO: 6537 - DNA, 2296 bp, Heterodera glycines
  misc_feature (2262)..(2262): n is a, c, g, or t
  misc_feature (2267)..(2267): n is a, c, g, or t
tttactaattaaatgcactttttgtttcccattttgtaattgtaaaacagacagaaacagtctgtccctttgtcagttttccgttcgatggtttcgattaacaaacaaaaaaagggggagagaagagaaaaagggacagacaaaagccccccttttgcgaattgagaagtgttccctcccctctttcgtcccttttccccgttcttttcttaccctttcccccgtcgttctgagcagacgcgcgcccccgacgagcgacggcggcagcgtctcgtcccctccgatgatagagagcagctgtttcattgggttggcccccgccagcgacggctgctgggcccccgccgcttccctcgtctgctgctgctgcggcgagtgtacccccaggggctgattattctcatcatttgcctccgtcccttcgctcgtcgttctccgctgcgtcgattgttgctgttgctgctgcgtttggtgttcaatggcattgaaattcgaagccgccggcgcaaacgacggcagagcgacccttttctgctgttgttgctggtttgtctctgcggtatccatggacactgccgtcggttgcgaggcggacgacgacgtcgcttttggcactccgcgggctccgccgagtggggccgactgcgacccgccgccacccgcgtgcattccatgcgactccctcttgtgcaacttcagctcctctcgcgtgttcatgctggtatggcaaatgtcacacctaacggtgggaccaaaccaatgacaattcgccacccattccctctgctcatctccaacctgaacttcacctcgcccttccgttctttgtccaccgtgtcaatgttcgctatcagctgtttgttctcgtctatgattatgttgtgcattttcagcatgtgcgtcctcaggaagtacttgttgcacacctctttgttgcacaagtcgcaaaagtttttgctggtggaggaatattgtcgtttctgaggcggcggtttgttggactgaaattgtggcaaacattaaaaagggggaatgaatttcaattataaattcattgctttccgaactttaaagaaatttaccggcgccggcgtatgtcccctgcccattgctccgttttgctgcgtcgacggccctcccgtcgattgtaccgttgtggctgaaatagcgccgctttgaccgtgttgtgcctgggcaaccgcggcgaactctgcgctcagtttcgccaacattgcggcaccgtcaaactctgtcggattaattccgccaaaagcggacgaattgttgaacatcagcgaaggcgttgtgccttgtgagaaagggttggagccgagcaactgtcctgaatttaaagcccactcatctgatgctcttggaactttcaattgtcccctcctttctcaccaaataattgctgctgttgctgttgcgtcgtcccacttcccccgttaattcccgcagctgctaacattgccaatgcgttaacagtcgactgagtgtcgttgctggcggtcgactgttgctgctgctggggcgcatcggtgccgccgatgtgagcgatcaattggtgttggaagagggcggattggctgggaaagtgtttggcacactgtgcacaagcaaacgacgaggaggggacggaggaggacacattctgctgggattggtggtggaggtcagagccggagagagtggcgggcggagaacggacggacgacggggaagggcacctgacgaaggaaatggtcaaaggccgtgatcaggcagaaagaaatgccaagaatgatcagagcaaaaacaacgcgtagtcagtggttccccacctgttcatgtcagtgttctgttgctggttttgagcgtgtgccatcagttcggccaaatggagtccgccactgccaagcagttgctccaacgcattcctttcgccttccgtcgcgtttccgccgttggaaaggccaagttgggctgccaattgttgcatcacagccatttgttgtgaatggtccggagagagtgcttctgaatgaatgggttgaaaatattacgttacgctgcaaactttctcttaattagttttattgaaatgccaattcaccagtaaatgccgtcgtttgattgtcccccggaccatttccgctaattgtgccgggcgtcgatgaaagggataatttcggagccaatcgtccaacgggtggcgattcgttgtggtggtgtgccatcaattccatttggggtggctgaactgattgtgaggcggaatgngacgnacggagtgttcgtcggcagagaattgggc

SEQ ID NO: 6538 - DNA, 1220 bp, Heterodera glycines
  misc_feature (1191)..(1192): n is a, c, g, or t
  misc_feature (1204)..(1205): n is a, c, g, or t
tttgagcatgtgcgttttcataaagtatcggttgcacagccatttgtcgcacaattcgcagtaaacctgtcaaagcaaaaccaatgaatgaatgctttgtttgtttatttgtgtattgctttgtccactcccccccccctttctcctcctccgtttttctcccattgtttctgcttttttacttgttcagctttgctcggacttccgcccgctccgccgacgcccttcagcaattgtgccaaattctcagaggaagtggacgagggaaggccaccggcagcgaacagttcagcaaaaccggacaaggactgcggatttgcaccaggagaaccaagcatctgcagaatttggagctggtcaatcagagacatggacatcggctgctgctgattgtgggaggacgaagagggggactgaaaaggcattcttcaaatggctgtttgccgcgtccgtttttcccacctgagagccaccgtccgtcttgctttggtgttgctgctgttgttgttggtgtgcccctcccgtgccaaattggtgctgtgccgtcatttgtccgtgcgtttccgtccctccgctattcggcacactcgtgccgttcaccaactgtgccatcagttggctgaccatcatttcctccgccgatggcgttgtgcttcctccgctcatttgctgctgattgcctccgcctccacccgctaccgttgtcgccacctccaaaaactgttccatcaatttctgatgagtcaattgttggccaaggagttcagcggaagacagcgacgaatcggcgccgtacattccgccagaggcaccggtggcgccgcacggcttcccatccgttgctgaggaagtggaagatgccgaactcgtggtggtggtggccgagtcggacgcatgacacaccgccgcggaactcgtcggaagatcagcggacgacgaaaagtgctggaagggattgacagcaccggtggaagaggacgaatcgggcggaggagcagcaccagaagcatcggaagcaccgagaccggccaattggctcaaatagagctgctaaagggaggaagcgatgaaagagcaaagagaaaacggacaaatgaaagaaaaaagaaagcaatgtgaagaaaaaaaattaaaagctctaacaaaatttctgcgggagcagtaaaatgagttttttatgccaaaacttannattaaaagaccnntgcaggcccatgcaa

SEQ ID NO: 6539 - DNA, 5157 bp, Heterodera glycines
aaaattgtttggtagattgtcttctatgtcatctcttctccaaaatggtttttatccaaatctgtcgtaaggccagccgaaaaatttttacaataatgttttttttgcaaaattttgtgataaaaattgcttgaaaatggagaacatttgttcaaaaggcagtgccgcgaagagacgatgtgcggggtagtgctaagactctctagtctcgctcgagaaaattctcgggtttttttggtctcgagcagcaaccaaatccaacgatcttgaatcattcgagagcccttcatatgctctattagcctgcaaaattctggtcataacttttttgaaccttaacaaaattttttgaaattttgaagctaatagagaacacatagggctatcgaatgatatgaacatggatttggttgtaaaaaagttatagccaaaaacttgtactcgtacgaaaacgacccggacccgaccccttgtacaattatgctcttaatgtattatggcgaaaaaataaataaattttagaaataagcacccttggaagtggaattaaatgagaagctaaattggtctcttttatttcagagaaaccctttcaaatctcataatcaacaaatttatttgtttctttttgttagcacgtttgtttttaaagaatttttgttgttttttaaggcaatgtgccaaacttttttaaaaaatttttctcagtgacgaaatgatcggccacccttattttaactattttgagattttgattttatgacaaaatttaaccaatcacacgttttatgaacaaaattttaaaccaatcaattcatttaaatttgatttaaaaaaataattttgagttatgtaaagagtgaagtgataaaaatatggagttactcgtttttgtgggacagacgttcaggctgaataataacttcaaatgacccatttgattataaatgaagatagatggtgcttcgcgatcttggatcggattcaaaagctaaaatgataaatttcacggttatgtatctcatccactctgttccgatgattgttttccccattattagttttagagctccaaatttcgttaattgaagccttggtgctacctcaaatgggtctgaagattcagacccatgcgctttttgtcgcttcgcccacacccatatttttgtcgcttcgacatagcaccgaataaatcggagggggagactaattggttgacctttataattgatattgagcccataaaaacgaataaaataaaatgacagaatggccatgaattggatggtcgtcaaaaggcgtcgtccgtccgtcttcccttacgcttttcccttcggtttgcttttcgtcgctttccccttcggtttgcttttcgtcgctttccccttcggtttgcttttcgtcgctttccccttcggtttgcttttcgtcgctttccccttcggtttgcttttcgtcgcttttcccttcgcttttcgtccgttgtcccccccccccccccgcttcttcttcgttccttccccttttcttcttccgttcccttcacaatcggcttattgtccctccgtcttcgctttgctcttccctctccttcctttgctgttcattttttatttgcagaaagcgatcctcgcccaatgacttgcggaaatggtcttccactgaagtgagaaaagccaaagataaatggaaaagaatgatcagtgatcagtgaatgaccgttttggtttggatttggctgtactaattgctaagtgattgtttcccgcccccaactccctgcaactgtatgagtcaactccgtcccggacagcttccaagacgccaaaatgttgtttttgaaagggttgcagtcaggggaagcggggacgggcggatcccaaggattttcatccccttccccattttcctatccccgcactgaatccccgccggggacggggatgaaaataaacctaaagatgggcttggcgaccaaaaaaaaacatcttttttagagtccggtaaaaaaaaatttccgggagcgggagcgggatcgggagttcaaaattttccgggacgggagtcccgaacgggattcccgtaaaaatcccgctcccgttaaaatcccgtccatttttaacgggagtcccgggcgggagcgggagtaattcgaaaatttaattaaaaactcacaaaaatatttttaatgcacaaatttaaagggcaatcaatttattaaattaaaaatatagaaaaatttataaaggagaaatttgaaataaaaaaatcttatttttgagtcaaaaatcagaaaattttttcaaattgcttaaataaattattttttataattaattcgaacaaaacatttattaactttatatttttgactccctttattaattttacaaaattttttgcggtgtatttcttgaaaaaactttttggtgaccaaggaggaggagggaggccggcggtgccggtaggcgccgccgggaaaaaattgaaaattttaatacaatacattgttagattctgttcaaaaatgaccaatttttgcaaattgagcaagttttttaagaaaattaaggattttaaaccgttaaaaatctcgttcaccgaaaaaagcgggagtcgggagcgggacgcccgtaaaatcccgcgggagtcccgatcccgccggactctactccaaaacattaaatattcccggtggcatctattttcggcacttttttaaacttttcctatagagaaaagcaaaggaagggactccaattttggctctctccgaaatttggttgcggattggaatttgcactaattaatcggcgtgttaattattattgggtaattggggcaattaacgctaattatcagctgtgatcagtattatcacttccactgattaccatctgtttgttcttgtgatagtccgtgctcatccacttctgtatgcgctggttgcccaaatgattggcggtcagcagaccggcacccaaactcagaatttcggtgggcgtgttgaacatgatggacacaatgcgttgcatttgatcactgatcaactcataagacacgggaatgaatatggccacaaagccgaagaaaaagctgaaaaacatcttgtcacggttggagtgccagtggcatggaagggataggcatagttggagttttggaattttttgaagagcctcggatttttattttcgaattggcattttgactataattccgaccgatggagggattgagttggacgaatgattactttaacactattaaccgtatgtattttaacttttaaatgttgattgcttccacctaaaaccttgtcagtcctttcgtattgttaattggtctttaattatcagaagattagtctcagggtgcggaaataccgaaaaaagggatttaaattcccccccccccactgattgattgatcaaatgttatcccatttaacctgatcactgcaccaagacccatcgagttgtaagccatcgatgtgatcgagtcaatttgcatgccgtccgccgcacgaagacgacagtatcctctgaccgttttcgcatttaccgtaccagtgatcaattggtctttggtcggtgcgggaaagaagccaatgtcgatcagtttgtagaaggcagcactgcgcagcttgtgccatttctccacttggagaggcaccatcgcagccgaagttgaggcggcaatctgacagatacggatttgaaaaaaatatttaaatagaatttaaataaattttaaaacaaaatcctttaagtgtcatggttttttaaatttagtgaaaattattattttaaatttttggttaatatttttgatgataaattgagccgtcaaaattgaatttagttcaaaaaatatttctcgaaaactctatttatttatttattatttttttcgggtggaggaatttttcgtcaaactgcacctgatttgtaaaagcgttgagtgcaaatacgccaatgtatccaccaatgtttccggacctaaataattattaatgtctttttaagttttccgctgaagccccctccccccataaaaggtaggaaacagattattggcaaaaactccgacctgattaaaccaactaaaaaccgttataagataagttacagtagtcgcaattttgtcccttacttaatgaattgggcgccgggcaacagtgccatgacaatgttgttggggatggcgccaagcgcggcaatgccaccagaaatcaccgattccttcaggtcctccttgaactgcttgaatgtgcgcggcaatagcgatttgccctccaacgcgccaagcgtccgtttgatgacgaaggaatcgaacgtttcggcaaacagcggggttaatgagtcgaggagaaccatcacaataattgtcaccggatgaaagtggcctaattggcaaaggaagtaatgattagacgggaaggggggggaggggaatttgcttgaaaacgctctcagattctcaaaacatttttaaaaacggcgccatagacatcgctttatgcacatagcccagttggtttatccttttttgccattcaataacattcaataatgtatttatttattgggggttttttcaatcaacctaatataattttctttccttgttccaaatccattccgaggtttgtttggcccctgttttaccactttttcgacaaaattattccatcttttatagattttcgactcagttcagtttccattttggatttgttttacattttccttttttctcattttatccaaaagcatagtgcatttgtcccttatccacttctaaatccaccactcaactttgacctattttccatttttaatttggcccaaccatttgaattttctctttcaatttctcactcttttggcccacccattgtgtcactatttaagctcaccaattggcctctaaggataatttgaaatttaatatttagtgaaaaatgaaattcaataaggcacttaataagtctaatttttgttagcctgtggtacccacaaattttcacctaatgccatggccacatggtgcaccaccaaatgccaaaggcccaagtccaacgcggccgcaatgccaccactcccaaccagactcaataccaacgcaaacaacatgttgccctcgaactgcttg

SEQ ID NO: 6540 - DNA, 2287 bp, Heterodera glycines
tacactttattcaataagaggggattgaatcccctcccccccctctccagaatatttatttttaaaattaaagtgatttattcaattttcaccgagtcgtcccctcaagtccaagctggccttctgccggtcctccattccgtacaatgccaattcaatcaacggcttcacattagcgcaactttggttccgctttaaatgccttgtgtagagatttaacacctccgggtcaactcctggtgcctccttgaacttcttcaacttcctgtccccctccatttcgctcggtgcgaatcggttggccggatttgctgccagttccatcagctgctcatagttgagcccgtcgaacattttgtcttgctgtttttggtctacaattttgttgagaatcgagcggaatggctggaagcaaagaaaggtcagtcacaaatttgctggggcagattaatgaaaatttttaaataaaactagcacactcttccttaagatttttaaaatcaacccaaaaacccctcaaattggccctttttgctgcaaaatcactgatcaggtggagcacgccgtttttgggggtccatgatcacggtttgtccgtgattgaaatccagtcaaaatttaaatttattcgactaccttccaaacgttgtgttcaatgtttcgtggctgatagaatcggatcggatgcttaaagaagcgcatcagctgatcaaattgacgctccgttttaagctcatcgaataaaaagcgcaatttggtgccctgaaaaatttaaaattcgaactcaaaattcattggcatttccgcttttcaagtttcttaatgatttttttttataacaatgtttatttttttttccttacaacaaaaaattcattggtacgctctttgatccctttttttgcacttgctggcagcgtttttctgtacttggcgaaaatgtcgctgtccaattgtccttggaatttcgtttcatttttcaacgcgtccttgaattcttttagctgcacaatttgttcaggagtcaaactgctgagcagttcacttttcttgttcaacacttccattacggtgtccttgagagtgtcgtcaaagtttgcattggccaagtactcattagggttctccaggaacagcagaaattgttggtactgttcggtgtccaactcggccaattcttcgtttgagtctttgtcattgaccacacccatcacctctctgtgtaattaatgaattttttaaatggccaaattatttaaaaatgattaagaatttttggtttattgaatttttctttgaacggctctcatccgcgaaattaaccttttggctcttgatataggaaaattttcttaaaaatcattttaaaaaattctaaaagaatatgtttaagtttcattttcttatgaattggtattttgggtcaaaaatatgcaaaagttgaaattttgccattcattttttcgcttcaaaactaataaattttaattattcatgatttgggtccatattttatgtgcctatttaacggttttattctaaattgctaaccgcaatatcataattgattaattaaattctaaattttgtgttaatgattacctgaatttttgaaagactttaacgtccaatttattgtaaaatttgatgggatcatcgaaaaatgccttcaacttttcataatgttccgttgccctctcttccatttttttgtcatcgcttttgcttttttgtgccaccaattttttatcattaattatcgcgtctttgatcactttttcgttttccgcatatgcttttctgagcgcccttatcacgttctcatccaattgttcagttgagcccaaataatcgttagtgtttttcagcaattttactattaattgggaaaagaaattatttttaaatgttaatttttatgtaatttttttggtttggaattcttagcatacgaaaaattcaaatcttatggatatattttaaaaattgcaatgtattcttaggggagtgtctttttgggaaacggaaatgagttttttgcaaaattaggacagacgccgacaaaagttgaacaactactctcatctcattcccattcacttagaataaaaccatgcaaaattaccaaattaaatcataatgaaatggcatttatagaaaatttaccaattttagaggactgatctctcggcaattgttcgcctctgacaatatattaatacttcccgatacatttttttgtttcattctgcattatcttatccaataatcccatttctatcagtgt

SEQ ID NO: 6541 - DNA, 2415 bp, Heterodera glycines
acaattttcctgagaatcatgtggaatggctggaagcaaagaatgatcagtcacaaatttgctgggacagattaatgaaaatttctaaataaaactagcacactgttccttaagattttaaaatcaacccaaaaaacaccctcaaattggccttttgctgcaaaatcactgatcaggtggagcacgccgtttttgggggtccgtgatcacggtttgtccgtgattgaaatccagtcaaaatttaaatttattcgaccaccttccaaacgttgtcttcaatgttccgtggctgatagaatcggatcggatgcttaaagaagcgcatcagctgatcaaattgacgctccgttttaagctcatcgaataaaaagcgcaatttggtgtcctgaaaatttaaaattcgaactcaaaattcattggcatttccgattttcaagtttcttaatgatttttttataacaatgtttattttttttccttacaacaaaaaattcattggtacgctctttgatccctttttttgcacttgctggcagcgtttttctgtacttggcgaaaatgtcgctgtccaattgtccttggaattccgtttcattttccaacgcgtccttgaattcttttagctgcacaatttgttcaggagtcaaactgctgaacagttcacttttcttgttcaacacttccattacggtgtccttgagagtgtcgtcaaagtttgcattggccaagtactcattagggttctccaggaacagcagaaattgttggtactgttcggtgtccaactcggccaattcttcgtttgagtctttgtcattgaccacacccatcacctctctgtgtaattaatgaattttttaaatggccaaattatttaaaaatgattaagaattttcttatgaattggtattttgggtcaaaaatatgcaaaagttgaaattttgccattcattttttcgcttcaaaactaataaattttaattattcatgatttgggtccatattttatgtgcctatttaccggttttattctaaattgctaaccgcaatatcataattgattaattaaattctaaattttgtgttaatgattacctgaatttttgaaagactttaacgtccaatttattgtaaaatttgatgggatcatcgaaaaatgccttcaacttttcataatgttccgttgccctctcttccatttttttgtcatcgcttttgcttttttgtgccaccaattttttatcattaattatcgcgtctttgatcactttttcgttttccgcatatgcttttctgagcacccttatcacgttctcatccaattgttcagttgagcccaaataatcgttagtgtttttcagcaattttactattaattgggaaaataaattatttttaaatgttaatttttatgtattttttttttggtttggaattcttagcatacgaaaaattcaaatcttctggatatattttaaaaattgcaatgtattcttaggggagtgtctttttgggaaacggaaatgagttttttgcaaaattaggacagacgccgacaaaagttgaacaactactctcatctcattcccattcacttagaataaaaccatgcaaaattaccaaattaaatcataatgaaatggcatttatagaaaatttaccaattttataggcctgatctttggtcaattgttcgtctttgacaatatttttatacttttctataaatgtttttgtttcattctgcattatcttgtccaataatcccatttctatcagtgtttctctaagtgcttttttcattgttttgtccaatttgtcgccacgaagataaaatatggccgggtcatcaaagaaatcgtggatctgtgaacaaaggaaaataaagtattctctcatgtgtatctgtttttattagttttgtatatatttgtgtatattttttattgtatatttttcttgggctttttccatatgtctaaatttatatatttatatttttcatgttttgattccctttaaattgtccatattacccccattttataagctaatgttttaccaaataatacggctttttgtacagctccaccaaatgtttattgggctccaccattttgcgcattatgaaaatggtgtcctcgtctaatcttttgtttttgtaaaattcctttggatttcgatagaattccatcaaatcgtcgtattgggtggggtagagctgtttaaacagtttatctgctggtttcacatgaatatcatagtgaacgcctgggaaaaaatgggtccaatttacttaggaacagaaaacaatgtattggaaatgataattactttctaaatatctaatatacattagagatcggaccggttcggtttttttcgggtttttttcgggtttttttcggtattttt

SEQ ID NO: 6542 - DNA, 4301 bp, Heterodera glycines
  misc_feature (36)..(36): n is a, c, g, or t
  misc_feature (39)..(39): n is a, c, g, or t
  misc_feature (4193)..(4193): n is a, c, g, or t
  misc_feature (4248)..(4249): n is a, c, g, or t
ttgttgactttttataaaatttttgtcattttacanccnttaagttcggactttttgggcacctattttcccatttttagcacctatttggggggttttttaaaaaaattttaaaaattaaaaaaataattcaaattttaatttatatcaagtgaaaataatacaaaattatttggttttttataataaattaaattaatgaaaattttcaaacaaattttcttcaattatttcaaacaattaatcatttttggactaaatcatcgaatattaatagaaattcagatttgattttcacatcactttttttcggagcgcttttccaaaaaacttttgggaaagaaggggtccggcagtgccgataggcgccgccgggggaaattttgaaaatttgggtgcaatttgttaacagattttcaacaaaaaaaggttggtttttgcgattattaagctcaattggtaggattttcatttaaaaaaggataaaatatgtatcaatttaaaaaaactatgagtaatcatattttgcccgggggataaatagaatttatatttttttcgaaaaaataacttcttttctatttttataataattaattaattccaagttgaaattctttaaacaatttttttttaaattttcaaacagaaatttttcttgaaaaagcctgcgaaaaatttttctttgaaaattcggtaatagttaagaatgttccccacctttttctgaaaaaaattttcaaaatttttttttcgagaaaatggcgtttttagggttttcagggtcgaggaatccgattctgtgactcaattcgacccattccgaaccacgaacccggattcgaacaaaaattgaaaattcgatttttcaaaaaattaccatttactcaacaaaatcgaacggaaatgcgcgcaaacaacttcttggttttataaatgatgttatagatttttattattgtaatatggctgcattggaagagcttcaaaatttcaatattaaaaaattgcatgaaaagttggcgctagaagacaatgagttcgagcaatggcttgagcaattagggcttttgcattctcgccgcacatgcccacgatttttatccgtgccaataattgattcattcacacattcatgcatttccgttcgattttgttgagtaaatggtaattttttgaaaaatcgaattttcgatttttgttcgaatccgggttcgtggttcggaatgggtcgaattgagtgtcagaatcggattcctcgaccctgaaaaccctaaaaacgccattttctcgaaaaaaaaattttgaaaatttttttcagaaaaaggtggggaacattcttaactattaccgaaaattctattaaaaaattttttcaaaaaattaagcgattttttttttgaaaattctcagaattcgtcataaatttgaaaaaatcgcctgagaattttcaaaaattttttcttgaaaaatttctaaattttaaaattcaaaacggggttctgaattttttcagaaaaataacaaatttcgagaatttcaggaaataaaattctcccgattttctttatttttaagctttataccattaacattgtccaaccatggagtgagcttgaactttgctttattattgacgcgatgacattttttggagaaatattcaaaataaatttcaaaaattttccactaaataaatcattcgaaaaataatctctctgtctccattaatctgccagtatctaattatctccccctttctaagggtgttgataaataatatacccgggcatataattagagaaaatacggtatgtacataagggatggcattccgccgaggctccaaaaatatgcgaaatgaatgtttttgggttagtaggcgaaatgtcaataggcgatatgtcggtaggcgagatgtcgagtaggcaaaatgtccgtacacacagcggcccaattttgtgctctcatttgtcagtgcaaataggtttattatttatttagtaatcagaacgccaaaactttgcaaaacttaaatttttttggggattttcccttgtaaaaatagaagagccgatctcgagttaaaaactagacagctaaaacatgaaatgtttttacgacacttaaacttgaaaattctttgcacccaaatccaacaatcttggtgtcattcgaaagctcgtaacatgctttattagccttacaaaaagcaacaaaattttcaagcctggaaaaaatttattaagaaaaaacttcaaaatttttgttaagctttcgaatgatatcaacaatgttggatttagatgactcagaaaaaacgtttagtggaaaaacgagctggcgccgaaacgaagtggaccccatttcacggtcctaataagtttcaaaaatgggtttaagtgcaaaaaaactccaacatttttttgtcgaaaaaacagtaaaagtcggctttttggcatcattcctctgacatcccaaccccattactcaaaggcctcaaaacacccatcacatattgtacatattatttggaaaagcctgatcatctccatccatccatcatcatcattcaccatgacggacgtgcccgaaacaaaggaccaactcatcaagctgatcaacgtgtgcgagaaggcgcgacgcggcgatgaaaaaggtgtggccatatcccatccgatcagtggtggccgaaaattcacaattttgtgctcgtgaaaatgctttatcccctctccccccatttcagttgatcaaattggaccccaatcttggcctggaggaccgtgtttcgttgtcattggcctacaaaggtgcgatgtcttcacgcttgcgcctaattaaggccattgtctccgccactggcagaagaaacgggacaaagcagcgaaaaaggggcgtcgtctgctgacaaatgagtgacggacaaaacaacaaaaacaatgatcagccgcataagaaagaaatgaattcattaagaatgatcgatcgatcataattcaaatcagtgatcaaatgcaattttatgaagaaaaacctctcaaatatatataaataaatcggatgtataaaaatggcttgctatctatcgaatgaatgcatttttctttcaaaaatacgacaattatttttcgggattttgaagggggatttaagacatccattagcagggaacggatttatatgtttttacttttttttgcgcatatgctatcgcatgaaaagctcaaaaatagcatttttacctgttttcctttcaatcagagcgagtttttagcacatataaaaaacatattttggactttttaggaataaaaacatattttggggtttcggcagtttttgatacatattttggcgattttttgagaaattttgattttttttttacaaaaatttcttttttggcgatcaaattcttggcaaaatgtcccaaaaacgttcaattttttgtattttttacctttttaataattttttcatttttatggcaaaatttaaattttagcgaaaaaattccgaaaataagcattttgctagcgaaatgggtaaaaaaatgagacttttatgcaaatattaagcagtttttttcagtttttggcacatattttggccttttttgggggtttttagcacatatatatgtacatatttggcgttttttaacacatataaatccgttccctgtccattagcaatattcgcaattagtaccgacaaaattaaagtgtcgatttgctgcggtttattggaaagacggaaattgggacaacaattgtaacaatgtgatcatttgtgagcaattaaaaaaaggcatttaattttgtttaaataattaaaattgcgcctaattaaggcaattgtctccgccaccggaagaagaaacgggacaaagcagcgaaaaagggcgaaatgagtgacggacaaaacaacgaaaacagtggtgattagtggaagaagaaatgaacatattcatcagtgatcaaatgcattttatgaagaaaaacctctcaaatcctatataaataaatcggatatataaaaatggcaaaaacgtggactctgttgcagttaacgttttttctttgcacccaattagcaatattagcaccggcacattaaaaagtcgatttgctgctgtttctctctcttttctcctcttccttccaccgaatttttccttttcctctctntctcttccgtctctcctcctttcccacgctatttccctccttttctcctctcccnntgttctccatttttgctgttgtctatcttcatctcctttctcatcaaaattt

SEQ ID NO: 6543 - DNA, 655 bp, Heterodera glycines
gggtgtcagattcatgatcagcgaccccgaaaacccctagaaatgtttaaatatatgattattaaaaactatttttttatggtctgtaaacgacataagtaccgtcagttagttgattggactcataaaatgtaggaaaattaacacattttccgattgtatcgtatatttttttgatccgcaggtgtcgtcgaactcgcaaagggcgcttaccaagaagccatggacatcgccacctccaaaattgcagcgatcaatccgactcgtcttggccttgcactcagcttctccgtgttcaacttcgaaatcttaaaatcggtggacgaggcgcgcaaattggcccaaaaagtgggaccaatttgatgatttccatcatgctttttctttcaatgtggctaaattctccccggattttcaggcaattgacttggcccaggcggagattgccacactgacggtgccattagctgatgacgcctcgatcaacttgcgcatgatgagggaaaacatggaattgtggacaccggagggcggcagccacaccaagacgacctgagaagaaaatgccgaactgactgaccaatcagatggacgatattatgcatacaacaacgatattcaacagattgtgtaaataattatgtatatatatgcc

SEQ ID NO: 6544 - DNA, 3443 bp, Heterodera glycines
caaatgttttaaaaaaccaaaaaattgttttttcaacaaaataagagaaattgttgtgtacataagttgaataaactatatatatatatatacatatatatatatatatatatatttgcttttttttaaattaataaacagagaaataaatttgatttaaaaaaaacataattttttctccatttatttttcgtaataactaaatatgttaattcatatcttgctcacaaatcaacaatgttttgttgaaaaataataatttgttttcccccaattattttgagcaatttgttgaccgtgggcaaagcgactaaaaatgagagaaatttgggggggggggggtcataacgaaacattactttctcctgctgctgacctacataaattatcataaacaaattattggtttttgggtgtgtggcctattagccgattaattctttacgtttttttcgactcgaaaattcctttttcaaatttccttgagaaagttaaatttgcggcagaaaaaaaaacaacttgcgaattggcacaattcggattatatgaattttattttatgcaagtccataataatttggttttttatgaaacaaaattccaaaaaaaaaaatttaaaaaataaaagcatcttaaatattttcattgccaaaaattgccattaataatcagattttgatttttaaaattgttttaatataaattttgcaatctttaattaaattgttaaaaattaattttttattttaatttattcttttgaatttgttatttttaaatgtgagattgttttttattgctttgacaaaatatttttgcaaaaaccttttttctgtttcatttttgtgcatttcattacaaatttgttgtataaaattaaggaaaaaaactattttattataatgaaaagaatcggccaagaaagtgttaatggcgggcaaaagccaaggaaaagcaagaaaatgccaacaaaaacggacagcagcgacgatgagtcagatgaagaaaattcagcagcaggtgggtaaataactaaataatggttaaaaataaatttaaaaatgctatttttttagcattagctttttgtcacaaaactttaaattctttttatgtataataatgacttttgaaaattaaaaacaaaaaagcttatttgtcaagggtgtattattttcgttcaattgttttgaattattttcgagccaattttctgcagaatgttcgacttaaatcatggtgtttggttgtattattaagccgaaatcctccagaaattgacattttttcaacaagattttggggttctaaaatatgaacattttttaatgcgattcaaaaactttaaatagtattttttcaataaaattgaattgttttattttgccagcaatttttctgagaatttttggcttcaaaatattcttatttttttaatattttttgattttgacgtcggtacagctaggagccgacggaagaaattttaaaaattctaaaaatattttagtaggagattttgccaataaaaagcaaatttttaggatttttataaatctattttaaaattctcaaaaattaaacattttttggcaaaatctaacaaatcgtatcaatgtcttcaaaattttcccgccggtgcccccattaccgtcgtttctgaaattttttaatatttaaaagatgcattacggaaattacggcactttttgacccccgtaatactaataacggatttcagtaatttaaattccagttacgcccacccctgctgatgttaagaaccattttgaaacatttatgattgtggatttctttaggacagaattcccaaaaaatatttttatttattttttttgcctgatttttttaaatttacaaatatcatgattatcattttagcagaatcaccagggaataaatggatgaagctaatgttgagcacgggaaagtacgcggatgtgcactttttggtgggggacggagacgcaaaaatggtgagttttaaattgcctaattataatccttttaattgtgaaatcgcccccgacacttcggggaagagattagcgaagatcagggacggaagatgggtcaaaaatgggggttattgttagttaattaattttctttaaagttttaatccttttaagcgcgtgccagcccataagctcattttggaagaggcttccgacgtatttaaggcaatgttccgttttgatgccaaaaaggaaaaagcggagaatggtaaaaatatagtaactaaaataactaagatttaattgtcaattagactctgctaattgcccagctgatgtggagattcccgatgttgaagcagcagcattcaaagtgatgttgagcttcatttatgctggtgatttgagcgaattgaacggagacaatgcaatggcagtgctttacaccggtgaatttattttaaggaaattaaatatttataaattaaatgtttgaaattaaatttaatgagtaatatttttttattagccaaaaaatacatcatccctggcctggtcgaacgatctttgcaaattcccatctccgaattgcgcaatgttttctttgcgtatgcccaggctcgtcttttcgactttgaggtgggagataaataatttaatgataatgaatttaagatgatttaaatgcaataattatttatatatttatattttttataaattttaggactattgcaatgattgtttggattatattgatgggaatgcggacgctttgctcaaatcggatggatttttgcaaattgaccaaaaattgttatgcgaaattttgggacgccaattacaaatccgtgaagaattttcaatttgggaagcagtaatttttttaatttaaaaaagttacaatttcattttaaataacttcctatttaattcgaatttattttcggcactccgttgggccaacgaaaagtgccgtgaaaatggcattgaatgttcagcagagaatcgccgtcaaatgcttggcccggcacttttcaaaattcgctttcctctcttctcacaagaggatttctcggagaaaattggtaaaaataagtcaaaatttcaaatgcattatttgatgactagggatgtcaaaaatatgtacaaaaattggtcaaaatatgcacataaatatgtaaaaaaaaatcccgaaatatgtataaaaacccaaaatatgtaccaaatatttaaataaaattttttaatggtttttttttgaaaaaatcttcgtaaagtgttatataaacacaaaattgcagtaaaatgacctaaatatgtttagaatcaccttataatatttacaaaaatatttttggtattttttatgggtacatttaaaaaaaagttttttttactttttcaaaagaaattctaaaaaaattttcaaaaattctcaaaatatgtataaaaaaatgaaaa

SEQ ID NO: 6545 - DNA, 2883 bp, Heterodera glycines
  misc_feature (2865)..(2865): n is a, c, g, or t
aaagagagagattgaaaattgatgggaatagtacacccactgggggataaattaagcggcagaatgcttgggaaaaaggctttattacatgagaataaatctggagagggagtgaaagtggaggaaatagtgtgggaaagacaaagaagaggattgtgaaaatgtgtgagagaggcagacaagcagagcaagtgaaaatattatataaatctaagagaagagccccagactgggaaaggggaacaaaatagtgcggtggaaagacggcatacagcgaagaaatagtacggctaacagagagctttgatcaatgaaagaaattcagcaaaagctcggtggaccatgcggcgcaagcagtgaaagctgttgaaagaagaagcgacacaaaaagcagcggcgcgcaatgaaaaaaacgcatccgatcgattgatcgcagcgccatcgccccgcgggcgctttctgctgatcatcggcctttggagttgctgttgatgaaataataaatatacaatgaatgacattgatgtacatctgcttttgcttttgctactgcttcttcgctaccacaattaattttcattaaaatatttatgtataattaatattaaatattgtgagggtggtggaaataatttttcaaaaatttttaaaaatttatttgaacgtaaattatgggccccctctgtttatcaatgtcaatttatacttacatacaaatcatattaattgcaaaaattaaattaaattactgataaatcatattaacaaaggaaaaaaacgcaaaaaaaaaaaaaaaattaaaaaacgatttaataattaattttaaaataaacattttttgaataacccccgaaaaaataattgacatgatctccccctatttcccacttgtccttccttctcttgtgctgttttcataaacaaatattatagctgctcatcggatttcaaaaacgatttattatttatttaatttattttttgcaattattacttttttatttattttattaattattttaaattattctttactctatcctttcccttcctctttccctcattttcatctcctttgacttggaatttaattaattattttattgcttctttcaatttcgaaaaaatccttctttctccctgccattagttttaagatatttccggactagtttttacgagttttattaaggcgatgggcgaataatttatattaataattaattcatcaaattaaaacaaattttttttttattgaatttcatcctcaactcacgcattttcgcttttttacggaatcaatttccaattacaatggaattttaaacacatttaattatttttatttatttttactggcctaaaacattttccataatccgattaacaaatcgtttttatggtttattgatcgttgtaaaagcggcagcagaatatttggcctcgtttcacatatgtttatagattttacaccatcttttttttttgctcactataacataaatgaagaataataatggcattttcaaatgcaaaattttggatttacttaataaaaatctaatctcatccttaaatctctttcttttttttaatccaaaaactttaattttttttaatatataaatattttaatttaaatttttatctgtaaaaatattgcattttttttagtaatcacatcttttagcgcaattcagtaaaaattggaaatgcttttatttattttgaggcacttaggcttagttgaatattcatatttcaaatttttcgcctttaaaaaattagaaatccatcttaatgaagtgtcaatgctttaaaataaatttaattattttacacaaaaatttaaattttttaaatttatttattccatatttaattattttacacaaattttgaaattttttaaaccctcttaaaaattcacattgatttatgaacttggaccatctcaattctcgtcattcatcagcagagattacacaacaaattttatgaataaaaagtgcattcaaaaaaaaactcgtcatttttttcgctttcatttcactgccaatgaaaatgcaatggcgagaataataatttattgtgattgattcattatggttacacattctgaaaattatttgtgatcagtcatcccattcttttttttctgttttttgattgcgaatggaatgattttcaaaccacaattatataattttttaattaaaatttttttctggtcggcgtggttttggggccataactactatgtattgccaaccagggatgtgccggaatgcctttccaatgcttttgggctcggaattcggaatgccgaaaattgtcagccgtatgattcttctgggttctggcaatcccctaagtgtattaaatgagagcaagctccgccccctcaattaaattggcatttggcgttttgttatgagagaaattagagaaaaagaaaaagaaagcactattatgaaaaaaggacatacatagaaattgtttatttctttcttctatgtattatgaaattcaaaaaagagaaaaattgttttcatttattgttttgttacattaaagtgaaagggggctgatctacacatacaatgcttttattgtaggttattatttgctattaatgataacagattaaaaatatatttattatttgctattaatgataacagattaaaaatatatttattatttgctattaatgataacagattaaaaatatataattttattaaaatgttaatattttgtataatacggtttttaattataacttggttatttatgtggttggtgtttcgtcatcaactattgacctttttttaataaatgattaatgaattgaatttccanaaattaaaataaagaact

SEQ ID NO: 6546 - DNA, 5783 bp, Heterodera glycines
ggaaaatgaaatgaaaatttacacgacgattttcccgtctcaaaacgccgcacgattgatcacttatgtaaacgcaaaaataatcagaaaagcaatgatcgaaggcaaataattaattacttaatttaattaaattatcatgcattttagcgctgaacaaaatgataaattcggatgattggccaacaattttagcgacaaattcaatgaattttgttgaaaaagtgagagaattttccaatttacaaattattgcccttttcagtacaaaacttttgtcgcaattaattgtcttggtcaaaacggagctttcgtccgcaatttttgccaatttgtcgaaggtcgaattcgtcttcagatgacttatgacattggccacagaggggcgacgacgaattggcacatttacccggcactattccaagaaacatgccaaatcacacacaaattggagcaaattccagcaaaatttcggtagaatttgcaaaaaggctgacaatttaaatgggaaattgaattatattttaattgcccattttccttccagctcaaattaccaccaatgcaaagtttggctgattggctctgatcagtcgctgaatggtactgaccagcggatgatcaatgggcagctgcgcaacttcgactgggccataaaaagggacttcctcaaattcaacggcaaactgtcgaacaaagcctggggtgttgacattgacgaggaatgccaacggatgaacgtcactttgaagtccgtttttgtggaagacttggcacaattgttgagcagcagcaattagcacggaaagggaagcacaaccgaaagaaagacagaacaaagccttttctaattggctaattaataataccacgaaatgtcacaataaataaaataaatgtgtcataataaaattaacaatttgagcaaattaaatggttaatgagaagagaaaagggactgattgactgctgctggacggggatgggcccggggatgggtcagtgacaattggacaatgattaaattgataaaacttaaatattagtgacgtattgtccattgacagattgtctgctgggcatcataaactcacgtagtccatttgtcaatataaaaattcaggaattagataatcgggaatttattggaatttaattgttccattttttaaataatttttttgtgctatgaaaaatctatgcaattaaaacgggaccagagcgtttgggcccccgtttttgggcccccgcgtttgggcccccgtttttgggccccgggggtcgtttgggcccccgttttttgggccccggggtcgtttgggccccaacccaaaaatcgaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatgtacattctgatttggacatttttcagaaatggctaacccaattgcaaccaaaaaacaaaaagtaaaattgtcttacgaaggccacctttacaccttcgctaaaatgagttctgatgggatgacaaaattttggagatgcgagttcaaaaacagcaccgacaaatgcaacggccgaatctggacggacctccacgaccaattcattcgcctcgcaactccgcacacatgtccagcagatgcgtcacgtgttgatgctcaaatggtcacgaccgcaatcaaaagttttccaaccgctgattgactggtgtgtgaactttttttaaatttaaaccccactgaaattacaggctattaatcaattacgttggacagcccaggcccaatggcacatggtatcaaccaacttttcgccctgaacaatggaacgtctacacacgcacgcttaatgccgatgcacggaccaacaaccactccgaggcggagcatcatcgtctacagggcgccttcaattgccgacacccgtcgatttttcacttcattgacgtgctacgtcgtgagcagaagacaacagacgtcaaatacgcgtcattcattgccggagaggagccaccaccaaaaaagcgaaagtttttggcgacagatgaacgaattcttaatttggtgcgcctttacgtcccgatgaatgcaggcaacatcaaccatgatcacaattaccacaatcgcaatcaatttcacattattttggagtttctccggggaatttctcgcaactatcgaatgaacccgtgaatttctgttaatttttacattttttattgttaaaattattgttgaatttatttttaaactgtttattttacatttttatgctgaaatttaaaaagttgtttttactgtgatttttcatttttctgtacttggggcccaaacgaccctggggcccaaacgaccctggggcccaaaaacgagggcccaaaaacgggggcccaaacgcgggggcccaaaactgcgcccccgactcgttaaagtctttacaaatcacagtttctgatgaatgcaattctttatgccgtcagaacatttacaagcgcttaattttgacaataaaagaataaaagagtgaattaccaaatgaaaatttgttagtttagtaaaaaattaaaattaattgagatttaattgtttgagcggactattttttgtttttccaagaaaagagagaagaagaccaagaccattcgtcatcgttttccaacagactgttcagcgaagaataggttctgctccgtaacatttttacgtagtcggaattggccacttcttcgggaatttccgaaataatttcattgagcagctgctgccactgggcttcagtcatcttcttgtttcgtgccattgctgacgtggacggctgacaagtcctgacctgctgaggcactgttgacaaggattgcggcaccgctggcacaatcgacggagggggaggaatctgacaaaattaaaaaatataatcatttgaagacaaaacaattaattatagaagtagtataggacccctaaaggttgcgggttggttgcgggtgtttcccgcacgagcccgtgcctatgggaggggtgcagccctttgaagttgccgccccatcaaaaatccacgatggggggggggggggtgtttcaaaaccaaaacctattggaccactttgaagttgccgcctgaccaaatccgatttcccaaattgttgcgggtgtttttttcccgcgccgcgcagcgccgcgggaaggtcatcaatcatccacctgtcaccaaagtgacaggtggaggaaattcaatttaacttttgcaaattttaatcttttgtttcaaaaccttttagcgttttattttctcaatcctgaaattttttttatgatgattttttgatcctgaaattaaaaattctttttgaaaattagccaaaatcgtgaggttttttcatttccactcactccctgccgatgcgccgcgatgccgagtcgcgcgcaaaaaaaaatcgataacggaatttggaagaagtgcaaattaattgatattggcagcaaataattttgattatgaattggacaataaaattactatttaaatccaatttaaaagtaaaatcaaagaatgaataaataaattaaaaaactttttcaaaagtaggtcacctgtcaactaaaaattgattgatgggttttttatttttcttcccttatttctcaatctgcacgtgactttttgttcaaattatttcgcaatatctcccctaaattaggtcaactgtcaataaaatgtgattgattggtttcttatttaaatgtctccattatttttgggtccaactatttcgcaatatggcccgtaattttgcaaacctgtcaaaaaaaaaaatgattgatgactttcgaaataaggaatatccaaacgatttttgcacggtttttgaataaaatgagacagctgtctaccgaaatgattgatgaccccctaaattaaggcaaccccagacagtcatgtgactagacccctcccctctcgcccaatccgtacacccggcccaaatcgcaaatcattcaactaaatagttggatttcattaaactctcttcacgctctaattttatttctctccgctctatttttatttgcattaattaaatcttctattaaattcccgtctttttcttttcaaatctctgctctctttaattcttctgtttcaatttcttgttttaaaatgtcttttaaacgcgtgaactccttccaacccgcgtgccaatggccaaaaaatgggatttccgatcaatcgggtaagtgatttttaataaattaaataaaaaaataatttcttaaacaattataaatacaattataagataataccccttaagaattatttcaaaaaaaaattttttttttgttcagaaataattttgctgaagaaatggaaaattataaattgatggattaccaatcgacaacttgcgaaaaatttggatttacgaaaaatattacggaatttcgtgtcaacccggacgtggaacgccccgatgaagcgatgaaggatgcgatcgacaacatgataaaggtggctttaaaaactacggaagaaaaaatgaagcgaaaagtgcggatgtttggagtggcaattacgggtgctgggcttgctttcccggtatgagtaccgtatcgggcgtacccgcagaacaatgcggatgttattatgcaggaaattaataagttggggcagagcggggacggagatgaaaataaaatgctgttgctctcggagcctattacgatgaaaattacttgcgttacaatgcccagtggagaagggccgaggaatgtccataaatttgactttggattcaaggaacaccagcggatagggtaagtgtttttaataaaataaaattaaaatagaaaaaactaaaataaaaaaaacaataaataaatttaaaagaaatacattaaatttatttaatgaagcaaaaattctttaaaaattaaatttaaaaaatcaaaaaaaaaataataaagtaaaaaataattaattaaaaaatattaaataaataaaaaatatagtttaaaaaatcaaaataaattaaataataattaaagtaaagaaaaaaagaaataattatttttcattaagcaaagcagcaaaaaaaaaacagaaaaaaaatttaaaaaataaattaaataataaagaaaaaataaatggaaataataataataataattttattaaggattacaaatgcggataaattatgtctgttttacgcgctcgtagcctcgaaattttatctggaattgcatgtggacagcttcaggagatttatgaaaaatattgtgagacagagggatgcagctattgagcttttacataattgtggaattgatattaacgaatatagctatggtgtggagcaattaccgaatgttcagaaatattgggtgggtttaaatgaaaaaatgcaaaattaataaatttttcaggatgagatttaccccggaaagtaccgggttgtggcatttgagaagtcagctgatccgcggaaatcgatccgtgttttgtggaagggccagatggggcgagagaaggtcgtaccgatatttttggagaatggtcattgggatggtctgaagaatttcgtctgcttttttaatcgagggaggaagttttgtattgactgtgagtgcttttattcgagcgatgttcacacgccttggagtgctgggcgagatgttattattgcaataaa

SEQ ID NO: 6547 - DNA, 5340 bp, Heterodera glycines
  misc_feature (5158)..(5158): n is a, c, g, or t
aatttttcgtacatatttttcattttttttacatattttgaggattttttagaatttatagaaattttttgtaaaaaatttaaaaatttttttttgaaaatgtatccctaaaaaatcgattttttcaaaaaataatatatcaaaaattaatttgtaaaaatgtttatcttaaaaaaattctgctctgatctgaaaaattttgatcgaacgccggctaaaataaacaaattaaatattttatcaactcgaatttttcaaaaagcttaattgtataatttaaaattttttatccatcttttaatataattttatttgcgtcaaatttttgttatttttccacaatttctgaaaaaaaaaataattttactcaaatgatgagagtgtatcaccaattaaaatgtgttttcgtgcttatctctgcaataagtgcgcagaattttaggcatttgactaaaaatcgcatccctactaataaatcgaccatttatttagaaatattttatactttatatcacaaatctgatagtatattttaataaataaacgatttttttaaatcattttattttactttatataataattatgcataaatgcttcctaaatatttttgtggtagcgatgattcaatgtgaaagtggataaaattgtccgttttgtccacataaaatgaaaaaaaggcatttgcatcgcttctctcccaaacactgcactgatttgtgaatatggaatggacaaaattccgatcagcagaaagataaagccaataaacgatgagtcaccgtttctattggcttttttggctttttaagcgattgcaaagccagctaaacccactaatttaccaatcattttacccattttcagcaaatttattcctttcccaaaatcaaaatgaatttaatttgcttttcgctcttttttgttgttctggcgacaaatgccatcggtgaagggtaattaaatgaatgcaaatcaattttcaaatgctttctgtttctttagaattgccgaggacaaatggaaaaagtgcgaattgaacggaatgatcagaatgggaaaggacgttaaaaagtaatttgcaaataattttggtgataattaattaattttcccgcattaaaattagtctgctaatttgctacaagagcaaaatggccgataattttggatggaaagtgggaaaagtgttcaaaaggcgcaatttgaataagcaattggctgaaagatgtgttggcacagacggtacgaagggatggcacgcgctaatgatcgaacagaaggaaaacgggcaaaatggtctgatccttaagtcctcttttgggtgagtgatttaattttaaattaaaaacaaatttaattttagaaatgatttatccgtggaaatgggccccgaattttttattcaaggctccgactttttggacattaacatcacaaagggtacagttcgacaacaaattaaatttaatgatcgagtcattagtgttaatgagttcctcttccgctgaattggccgagttccaaaatgctcttccgttcggtgtttttttgaatgatttcgacggcgcagcgcttggaattatcgcatttgaaattcattgtgccattggaacaaatgacgtgaacagttgcaaaacgatggtaaagtgaaatttaaaaaataaatttgaaaattttgaatgaaaaaaatggttggctacgggggaatagaacctatggctacaaaacaactaagatttgaatgtattaagaatttttttttaataaaaattttaattttgtaggctaccgaagaaaaaagtcgaaaattgaccactcggggaattcgaacttccacaaccactcgggcaactccgccaaaaacaaagctgaaaattgtaactccattcaaaactgaaacaccacgcgttgtaatcgttttcattttttaaaaatttaaaaataatgctttttctagtctgaaattgaaaaatcaccgaaactgaccaccctggaaacccatacaaaaacaaacccaaatgtcggaacttcatctgccgtaatcatttccctcaaattaaattaaatttttttagccgaatctgttcactccacgtgattctactgtgaagcatttcggcacaaattgcgtccaaattgattttccagctgaaattgcccaattttcgctgaacgtttccgccgcactattcggcattgcctgtaaacaatacttaaaaaagtacgaaattggacaattgccaaaaaattacgacgaaaaaatggaaataaaagacaaaatggaagcgtgtggaaaagtgccgacagagacaaattgcaaaaagttaaaaaaatggaaattaaaattaaattaacccctaattaaggtcatatgagctgattggatgttatgaaagcaaaagtcagcagaaaattgccaacgaggaaattgccgaagtttgccgaaaacacctcgcaaatgccaagttttcggatgggtttcgaattcggaactgtgccagtcgtaaaccagggacgaaagtgatcgttgtcgaatcaattttggaattttcactcaccgagaaaaagtgaatttaaataagtgttgaaaattttttaatttttttatcaaagttataccatcacccgaaatgcttcaattgatgacgtaaaggaatttgaagctgcaacaaaatcaactcaattatttttcatcgaatttggccaccaaattgggcaaagtgcgctccgtggggaaagcggcggcacgtatttgtcattggacgatttggacaaaaaggcaaaaattatataaaaataatttaaaattgttgtttctttaaatttagaatgaaacaattggccacattttgggctcaatcgctgaacaatcaattgatgggggttgggcgaaatcaattcattttattccgccgtctgacagatttctgaaagcatttttccaaatttggaacccgacgttttcaaggcgaatcaacaacgaaacgagctggatgccatatcaaaacgacccgaacaatgtaagagttgggaaagaaaacagaaaaaggttaaatattactagacgattccgactagttgcgatttgctgggcaaagattgtgatgcgacacgcgaaattctacggaaaattcggaaagttttggagtgctgctccccctctaatgctgctggcccatgtatttgtaaacttccgaagcccgacctggtaaattaataatttaagctaattgtactgtcattttctgttagagtgaatttgcggtgcctccgggtacaaatccgtctcagcaacaaaagtcacgcttcagcagtaacagccaatcggacgacccattggattggtgggacgatattttatatacgaaagaggatgcgcaacaaagatacgactattttatggaaggtgattactgtatgagaaaaaaacattgcttaattggctaattaattaattatgttggttctaatttaagtgtgcgcaccgtgtttcccaccaaaaacgaaggggaaacggagaaggaaaagacaggcaaagccaaatttgagcaaatggaccaaatttccaattgcgatccgtttcagcaaatcatgtagtatatatgtagaatgaatttataaattttttaacaacattcagtgggcgacccgactccgcaacaatatgttgaagctgttgaacaagggataaaattaatcatgtgggatcattttatcaatcattaaaccgataaatagtgagataaatagatactttagataaacttttgtccaatattccttgctttctgttaaaaagccgaaaaataaaacacttctcaaaattaatattgtttaaaaattgtgaactgatagaattattatttagtgaccattttcctcgggtcttcccgcattttatagttttgatcatttaaacaaaaatatactagggacaaaacttgcataacattcaccacggatctgagccatgggccggacgaaggcattgaaattttcgacgcgaaggacggaaactgcggccgatccggggttggacatattaaggaatggcaacgtgtttcaattaactgtaccaatgtttgtttttattatcgttatcaatttaattaagttcatttctcaatttgcagtccgacactgttgcccacgagtttttacatgcgcttgccctctggcatgagcaagaccgggacgatgccaacaaatacatcaaatggaatccaacgccacgaaatgttagccaggattacaagaattttcttttgcaattttacattaaaaaacactggcataatttaatattttagcaaaaagaaccggcgaaaactgaaaattacggctttccctatgattttcattcaattttgcattatgaagctgtgaaaacaagcgggtcagttattttaaaggtataaatgaaaagaaaataatttggcaatgaatcagctattacgacatgattacgctgaaccgtttttaccaacgcacaatgtttcactcaacatatgaactttcgtttaaagacgccgccattatcaacaaaatttattgcgacggtaaatcgaattaattcattataaaatagagtgaattaatttaagaaaattgcaaaaacgttgaaaacaaatgccaaaagggaggatatcccaacccaaaccattgcaaccaatgcctttgcccggtgggatacggtggagaaacatgcgaaatggtcgaaaatggtaaaaaaaaaattaaaatgataaaaattattaatatttcagatggaaattgccaaactgacagggcaaatgaaattgaagcagattggcaaattcgaacgttgaagccaaaagtgagctgcacaaaaaaggatgagtcatgtggatgccattggcaaataaaggcaacatttatatgaaatattaaaaataaaattaaaaaaacgaaaacaaacaaataaaattaatataatattactaaaaattaatttaaagaaaaaaaacatatttacagccacaagatggcaaaaaggtgatcatcaaattgaaatggctgcatgaaaaggtgctcacctgtgatgacccttgcggcacttatcgagtcgaaataaaataccgaaaagacaaaagggcgcggggtaatttaatttaattaaataataattatttanattttgtaaaggtgcatttatttgctgttccaagcaaattgataaagatgaaacaaagaattggattgaggcggatgcacccggcgaggacattctcatttcggcttatcccaatcagactaattttgaaacatttacggaaattgttcgaattgacttacgaaacaagtatggacacataa

SEQ ID NO: 6548 - DNA, 1995 bp, Heterodera glycines
ttttgaacattgacggaattgttcgaattgacttacgaaacgggtatgggcacgtaataattattattttatgctaattgcttttaaattacttagacggcgccaaaattttgccagcgagcgattgtccggacggtgtgaattggaagccggagagatcacccggaaaggttaatatgtgcaatcatcccgataccggcaagcttgttgaatgctgcacgaaggggcacaaatgtccattacgggccaactcagcattcggctgtaaactaattgttggtatggtaaaaaccaaaggggttttagaccgagtacaacttttcactaatcatttacaataagaatttataattcgcatccataatgtactatagactcagtaccctattgctttaacaaatatgttaattctctgggaaattattaaatttttgatcaaaaaaagattttagctttggccatactcttttagacagttttggcacactttgggaaaattttataaaaattttgcgaaatttgggtatggcctagtctcagagagggtatgaataagtaaaatctgaaatgttgaaagaaaattattaagctaaacggccaataccgcgagatcagaggcgtaaacgaaagcaaagtcttctttttcgaatgttttgtaagtgacattaaataatttaattaattaattgtaaaaaaatgcattgtcaattaattaaaaattaattgattaattggttaaatttatttttaaagaggcgagaaggagagatgaaaagcttttggggttattggaaggacaaaagcaaagacccaattcgcattgacgaaatgcaatgcatgagctacgaacaagccggcatcataaatccgccagacaaaacagtgattgattacccattgcgcttcaaaagtgccaacacaaacgaataatgatgccaaagggatgaaccaactgcggagaatggatgtgatgcatagggcggggatttttatttaaaagttattctttttataatattttattttttagtgtatttaactttggttttgtattttaaatttatttgtattgtaaataaattatttaatcatagctctgtgtcccatttcggcactaatgatgaatttaagagtgccaaattcttttattttatgttccttaacatttaatcaatgaaagacaaaaaataaaaagaaaagaatttattattttttagataaaagatactttcgaacaattttatgagatttttcatttaattttcaccacatttatttttttatattttagcacacattttatctttttaagaaatattaattcaagaaaacctttctttctaattatttttaaattaaaaaatggaggattcatttagcataaccatttgctaaaagattatggagaaagaaaatgaaaaagtttagcaaataaaacccaaaaatttgtgaagagaaataacatttaaaaaggaaaataagttttgaagaaatgaatgtgaattaaaaagggatggaaatttaaaaaattgtcaaaaatgaattttataaaataaaaaaataaattttttaaaatttattcccgtcattttgttttcctttttctgaaaaaaatgtcattaattcttttattcgttttaataatattttttggctgtccaattcatcagaaaataaaatattaaatacaaatcatttgatgaaatatttaaaggaaattgagaaaaataataagaaaatttggacgaaaaaaaaaataattgggaaatattcgctgatcttctaaaaaatttacatttcttttaatgcgtagtttattttaaatattgaagttaaatttcaatttgcatttattaaatcataattactgttgttggtcgaccgacgaaaaagtgctaaaatctagcaataatttcatctacacataatttgttgaatttgaaatgaaagttaactacctatgtggaggaaaattaagttttgctgattttcaaa

SEQ ID NO: 6549 - DNA, 8390 bp, Heterodera glycines
tataaattgtaaataaattatagcaaaattataggataactttttacgctgctgtgcagcgctctggcggcgccatcaacactgcggcgcccgctgcttgcgccctcaaagctgttgcggtgggtgctggcgccactaaaactgcggcgccggctgcttgcgctgccatcaaaactgtgcctcggaccgctgtccttcagcaattcctttttgacttcatgcatgaactgctcgaaatccgccacgtcatccatcttcgcttgttccacgtcaaattttatgtcatccgccgccgccggcggtttcacgccatttccgttcgcctcaattgtgtccgcattctcacgcactctgcacgcgggaaaccattcaaaatatttggtgaatttacgtatctcattcgcagtcatctgcttgctgagcacggaaattgcgcgcagaaagactcgcccagggcccgcagcaaacagcaggcgggtgcgcatttcaagcagtgctttcagctctcaaaatttcaattatttaaacttaattcttaattcattaattaaagtctatgcacgtgcagggacacggcccaggagggtacactacttttgctccccgccttccgctccgcgtatcagttgcccccgggtcagtcgccctccgtttatttattagccctccacgctccctccgaaatcaaaaattaattttcaagcagaatttttctaaatccggtggtcattaattataattagtccctgtgttctgcacggcgttttactgcacaaatttgcatcatgctgaaaaactgtgctatgcacaaatgcacagtactacccaatgctggattttcgaaaaatcgttaaaaaagtaataaaaaattttaaagggatgatagaggcaaaaataccttttttaaaaaaaatcagcaaataattctctatcagatagcttgtcgtaaaacaaaattaaataactgaataaaaagattaaaagtgattttaaaatgcgatttggaaactcatagttcgcgaggttcgttagttgtaccggtgctatgtcgattcctaaaaagagcaaaaatcaaaaatctgctttttcctatgattttttttatcatttttaaattataaacatgctaaaatttaattaaattgatgcttaaatacacattcttctaaaagtttttttggttctctaataaaaataattaaaatttacctaatattaataaaatcattaactagattacttaaaattaaagtttcaatggcgcctatattaatattatgtaatttaaatttatttttattctaaatctaaaaaaactttttaaacgaatgtgtatttaagcatcaatttaattaaattctaacatattcttaatttaaaaaattgataaaaaatcataggaaaaatcagatttttggtttttgcacttttttggaatcgaccaatcacggttgtaccgtaccttctccgtcgttgactaagtcatttagctcatcatgaccatgattttcccccgaattgttggtgcccatcagtttagcatcatccaccacttggtttatcccttccgccaagaatttattgttgctcatacgcatgtccttcaagaattcgtcataaaagtcggagaagtcactgaccgaactgcgccgcatgcgttcatactgttcgctaatactgggtaaatttattttgggggtggtgcaggaaaataaaaaaaatttcaaagtaattaatgcgcaagaaaaaaggttaccccgcatttgcgcctcaggcatttggccccagacattgcggctatgtctaaaatcgggttcaaaccaaattttttcgatccctaacatagtaatttaatttattatgagcattaattatgttatttgaataattaagcattaaatgttatttgaataattaacgatttttcaaaaattttctgaagttccaattattagacacaatcaattgctatcatttatttaaggttatttagaatatcagggattgaaatattaagtttgaacccgattttagacataggcgcaaatgtctggggcgcaaatgtccggggcgcaaatgtctggacacgagaaaaaataatattttatttttattttaattgaatgtaatttggcaaaatttatgcaagcttcttaatatttaagttttcatgtaaaatggggcctaaattataaaaatcgtttcaaaatgaatcattttttgcgtgcttggtcttttcgtaaaattcgtcatttagctctttttcgacaaagcatggtataactttgcttaaaacaatcaaaattttttattttttgttgtgtgtgccggtatcccaggtgtattcgcgtatcttgacgatggattaatcgctacaaaaacgcttgatcaacacatcacggcactgtacactctttttggacgcataaaagaatatggtcttcgcatccaactggacaaatgcaaatttttgcagcccgaacttttgttccttgggcatattgtgtcagcaaatggcattcgtcctgacccatcgcgttcggacgcaattcggaaaatgcccgcaccgatcgacaaaagcacgctccgatcattcttgggagctttgaattattatggcagatttgtgaaatgcatgcgtgaattgcgtgcaccgctcgacaaactcctccaaaaggacgtagtttggaattggacgtccgaacagcaaaatgcttttgaaaaagcaaaggaaacgatgacgtccgaccttctgctgacccattacgacccggcacgcccaatcgtcgtatcagcagacgcctccaaggatggaatcggcgccacattaagccacacattccccgacaaaaaggaaaaagtggtagaacacgcagcatgcacattgacagcagcgcaacaaaattacagccaaattgagaaagaggcactggccattgtgtttgccgttcaaaaatttcaccgcatggtgtacggccgaaaatttattttacaaacggaccacaagcctttattggctatttttggctctaaaaagggcatcccgatttatgccgcgagccgcctgcaacgctggtcaatgattttggcgaattacgactttgaaattcgctacgtcaacaccacatcatttggccaagccgacgttttgtcccggctcattgctaattatccgcgtccagaggaagacatcctgatagcaaacatctgtgctgatacagattgcttcataaattctgttttcgaaaatagaatggatcaaatcccagtgacaaccaccgaaattacagcagcaatggcaaatgatcaaccactccaaatggttcttcaatttttaagaaacggatggccaaccaaagtcgccgatccggaaattagtccatattttccaaaacgggacaaaattttggaggtcgacaattgcctattgtatgagggtcgagtgatcatcccaacttcgcttcgcagtcgcatcctaaaggcattgcacatcgcacatccaggcattgtgcgcatgaaagcacttgctcgtcgccacgtgtattggccgggaatggactcagtgatcgaaaaagttgtgagcacttgcgaagagtgtcaattgggccagaaaaaccccaccaaagcacctctttcgccatggccaacgacggacaaagtctttcagcgtgtccacatcgattttgcaggcccctgctcagatggtcaccaatatttaattctggtcgactcattttcaaagtggccagaagtttaccgaatgaacacaatttctgcctatgccacagtatttgtgctccgatcaatcatttttttggctggctcggaatcccagaagaaattttttccgacaatgggacccaatttcgatccgccgaattcgccacattttgtaaagaatttggtattaagcacattttcacaccgccatttcacccacaatcgaatggccaagtcgagcgcttcgttgacaccttcaagcgttcgatgaagaaaatgtcaaaaagcgaaaaggattgtatcgaaaagatgctattctcctacagaaccactccacacgtcgccttgaatggattttcgcccgatcaattatttttcggcagaaaattgcgcacaaaattgtcgctagtccacccgaaaggagaaaaagacgaaaattttgatcgaaactcattcaaaaagggtcaaaacaattacaccgacaaaatggctctaaattttgatcggaagcatgggacaaaaatgatcaatttctttccaaatgatcatgtcctactgataaatatcggaacaacaagacggagtggctgcaaggaaaagttgttgagaggcttcacaaatcgcccacatatcgtgtttatgtgcctgttctgcgtcaactcgttcatcggcacgcgaatcagctaaggcgacgccatcttttggaagaagaagccgaaaaggaggcacctcaaatcgaagagccaccgccggttgtcgaaccgcctcatccgccccaacaaaatcagccggccaattcaccattggttatccgccgatcaacccgagttaaaaagccgcgccaattttattctccaggatgaaaaatttaggcttaaaccttcgggtttcgaatttaagaggggaggtgttagagaaggaagtaattattgattaggtgtatgaccccacgccacttcgccatcttccccctcccattcccctcattcagttttgtgattgtgcccaccaatttgacctctccaatttattctctgcattattttatttatttctccggcaaataaacttatttaatttgttatcttcggacataacagatatttattttttctttaggccttatgtctcggctagacaaagtggtcatcaacctaatattttgcaacaatttgtcgtttaatttgatcaacagtccacaatttcgagcattatgtaagccatggaatgagcaactgaaagatgaatcacactaccgcaaaattttgcccgttgcaagtgaactagtcaagggaaagataaaagaggagttacgaaaatgtgaagcattttcttgtacatctgacatttggagtgggccaaatgaaggatttataaggtagctgaaattttactatttttgaaattttaccatttctgatcaaatgttaagtctaacaatcgaaggagttacgaaccaatgggagcgtgtgagacacattctcgcaattaaaccctttcccggcactcacactggacgtcgcgttgctgaaattttgtccgaaattattgaccagtgggaatgtcgagacaaaattcacgcttttgcaacggatggaggaacaaacatgaaaaaagttggttatgagctaacgagttgtaaatattcgtttgttttttgcaggcatttgtggaagagaacgaaaacgggcgaattttgcctttttatcgatcaaaatgtgcggcgcatttattggaccgtgctgtcaaaaacagttttggcaatcgagagggtgaaatatcgggacttttttgtatgaaatctaaatttctttaaaatttttcttaataattaagcaaattgtcgtcggattgttggaagggttaaacactcgattaaagcatttacagaattgaacgaagcacaaataaaggagggacttccgcagcacaaactgcttcaggtaagctgaaatttcggagtaaaagcaccagtttactgtaaatttaggaaatggcagttcgatggaattcttctctgatcatgataaggcggctttctgagcaaagggctgctattgaccgaatcgcatttgaacagaggaaatttgaattgactttgcaagatggcgagtggcgactgcttaatgcattggagatgctcttggcacctttggaagaagcatcactttatttttgcaaatcaccgctttcaactcaaattccttttgcaaaagcgttaatttcacaattaaaaaatttggaccttcgggcgatatgtgaaaatggatatttacagggaattactgaaattgaagaaatgcgttcaaagcttttggctggacttgaggaaagattcggtcatttggagaatgagaagtgtgtatattttttaaatttcttttaaatttcttttttagattatatgctctttcaacattcttggaccctcggtacaaacatttatttgcaaatgacaatgaccatttcaaactaaagtgcgtatattagggttctaaattatctaaaatgtgaataattaagggtgaaattttggctcgcggaccccggcaacaacgattggaagcgagcaacttttcagtgttgcgcgtgatgtgtttgactatcgtcgatcaaaattgaaggctgaacatgctgaaatgctcatttttttgaacaaatcaattccgaaaattcgattttattgatttaaaattttgcttttttattttttctttaataaacgtattgccgctcaaaatttgtgcattaaaaatatttttgtgagttttaattaaattttcggattactcccgctcccgcccgggactcacgttaaaaatggacgggatttgaacgggatcgggatttttacgggaatcccgttcgggactcccgtcccggaaaattttgaactcccgatcccgctttgatcaaaaaattactaaataaaactgttttttccccataacaaaaaactcaaaatgcctaaaatttcacctcatcggccaaccaaaaaagcctaaaatgaggctaggtaattaaagtaacaaaagtttcccacagagctggaggacggaaaatgaaaaaaggcaatctctgacagatatggaaaaaaaatcataaaaaagattcaaaaatttgatagataaaaaatttttatttatttatttatttattcaaaaataaaaataccaaaagaagggcatatgccacttacacttttggtggaaatgaggttaaatgtgaagtagtgataaaagaaaacaaactgaagaaaacattgtgaaatttgattggaaagtataaagtccgatagcagtgaaataagacaattgaatttggagaaaaatatagtcagacctccaacgaaaagaaatttttttaagagtttaaaaaaagagagagaaaaaaaaaatttttttttttttgaggaaaaattttggtgagaaatgtgaagtactggaataaatgtatttttttgaggaaatgtttgtttggaggtctgaaagaactatttattgaaaagatgagggtattgttctttgagtgattgaatttggtgagaaattttgtcggttggtggcaatgattttaatgcttcataacaaacgatgattgtttggtcaaaaacttccggcggtttggacatgtcttcgctggcctccttctggtttggtgcaacaatgggagtctggtcattcgtcgtttttgggagctgggttggaggtgccggtggagctgggttttgttgacgttttcggagacgcgcttcgtattcctctttgagttgttctttggacagcgccggacggacgaacagacggttcaggttctgttgggaacggagccgaacacgctcgcgcttccatcctccgagtgccacatgttggtgtgtgggcgttggcatgaccaccttgagcgggcgtggtgttgttcgctgcgggtcgtatcgtccgagtcgaaagacggccgttggttgggcctcaacttcaagatggtccagtatttttgtgatggcttccctgtcttcctgaacacgctccaatgggcggatggcattgctttccgggaggccaatgaagaccagggtgcgttggcgttcttgctcttcgagtgtggcagtgttttggtccaggtccagtgcaggtggcattgcacgtttggcgcgaggtggagtgatgtttgatgcgttggttcgcttcatgtcgattaattaggaaagaaaatttgttgtttttttgcgatcttaaggactacagaagagtcaactatgtatattatgtgagattataatttattagtttgagtttatagactataatatattgttttatgtatttaatttgtattaattaatattggtcttttaacttatcgaataaattgaatgactgtgatattgaattgtttttttatgtgttatttctggtcagatttctctaattattttatcattcaccaaagttatggtgcaaagaaagttgcagtttctactaacaattaaatttgaaaatttatattcatttctaatataaatttagtacgcaaatgatttgcaagtaaataatcataatactggtaaaaaattttcataaatttatttttaattcttttttcggcatctctattttattgtttatacaatattctcagtttaacaaatattaaataaaaattatgtaaattat

SEQ ID NO: 6550 - DNA, 1457 bp, Heterodera glycines
  misc_feature (1430)..(1430): n is a, c, g, or t
  misc_feature (1446)..(1447): n is a, c, g, or t
  misc_feature (1454)..(1454): n is a, c, g, or t
tttcgaccctaaaatctgtttttttatttcaactttttgcatattataatttttctgtatcgaataaaatgattgttcttaaaatttgtgcattaaaaatatttttgtgtgtttttaattaaattttgaattactcccgctcccgcccggtactcccgttaaaaatggacgggattttaacgggagcgggattttaacgggattcccgttcgggactcccgtcccgtaaaattttgaactcccgctcccggaaatttttttttaccggtctctaaaattcaccaataaacacagtaaacaatgctaaaaatttaaaaaattgtaaactgcgaatgaatgaaaataaataaatcaaaaagggaaaaaattaaaaaatgattgtcccaaggcattttcatggttcactagaaattttcagaattttgatcgagtatttaacgagttattgacattcaataccaggaattacgatccgaccttaactctgcaaaatgtaatctttttactaatagcctgagctgaatttcttataaaaatttaataatttctaaagtaacatggaaaaatttttgaaatttttattacaatttgttagcatttgcacaacaataaatttttacgtaaatttaactggatatttgaaaagtttaattcagtaaggatcctatattttttccttatcttgaatttttgttttaattccgaaatattgcttcatttaattgcaaccaatttttgaattatttctcttttttctgaacatttacattatgataacttttcgaaatgttcttatcggcataatttctcatttaatcaatttgaccgtttctgttttcttcactatttttatcagaaaaattaaaaaattgcgaattctttttcttcctttaattgatcaataatattgtcattaatgtaaaatcgaattcctatgactattatttttcagatgagtcctgattaacaggcaaataattttcatgtttagtacattatggaagaatagtaaaaaaataaaattcagcatcgacgatttcggcgcggctttcgattgatggtcgtcgttcggccgtgcagtcgcgtcgtaactgctgatgttgttgctgatggagtcatcgatgcttgcgacgtacatcccgcacccggacacggcccaatggcaaatggcgttgggccagcttctccagggttgcctgatctgcggatttatcctcattttgtggctttttgataggtcaatgaggatttttttggaaaatgaggatttgaggatttttgtggctttttgagaaattttgagtatttttgaggcttttggggaaaatcctcagaatcttttaaattttgataaattggcataatgtttggggattatttaatttgaattttggtttttaatagagcatcgtgagggaaatctcacccanaatttagccagaaaannttacaanttt

SEQ ID NO: 6551 - DNA, 3063 bp, Heterodera glycines
gtgcgtcgatgttctgacatttctgcgttttgggaagccatttgtgccaaagataaatttaataaatctgtaaacaattagggagagttaataatattataatttttagaattttattaaaatcctatgatgaacagttggttgtatattgatctttaataaaattcaaaaagagcaacttttaatgcacgcctcgaaaattataggattaatatatgatagaaaatatatgaaaaaatttattattaatataagaaaagacggcaaattcttaaaagttaatataaaaatgaacaataatgcacaatccgacttaaattgtgcataattagcaattttacgactcatccctataaggcccctaagaaatggtcagaaatttccgaatacaactcaaaagaaaaattttctcgaaaattcatcccccgaattttaaaggaatttttattaaattacccatatttgaaaattcgataaatcttcgaaatatatatgctattaattcgtttacaattgaaagattctacaataaaataaaattgtatgttccataaaaacattaataattaaatttaattgcctatttttgtgtgtttatttggcatttgttgtgaatatttaatacctattttgcaatttttctaagcctcgtttttgagttcttctgttacaactttttgaaaataaacgaaattttttgaaatttttcaggctcaaagcgaacacatagcgctaccgagtaatataacgaaatttcaatttttagttttttttttgaaagctgtgaattattttactgaagatttcaagtcgagctgaacatatttgagattaattcttggaattagattaataatttgtgcgaattaaaattccgtcaattttttactgaactcccgacggtaaacaataatgttattttcacttttactaattaaataaatctttttaacgattacgtgtgtatgagaattgattataaaatgttaaagaaaattaattgcttttttgaaatatatttaattcatcaattaatcatccccaaaatattaatagagatattcaaagcttttcgtcgacctcaattaaactttttgctttcaaattggccccatgggacacatttttttttattttaaaggttgacaggctactttaagaaagtataaaggaatcaaaaaaaaacctaaaaaaaaatttaaaaaaaaaatgaccactcaatttcctcttgcgcacacaaatgcatcggcgtaagtctattttttgcgcgggcattgatctgaataatgtgatgtattcatttttgatttgtgctttttgctgttttgtttttgcactgtgttcagatcggatccccaacaccaccaaaaccagtgtggtgattgttggttactgtatctttttgaacttccaccaaattttgatcaaaattcgacatcaaaataatttattggaatttgtggaaaaaatgagaaaaaatttacttaaatgctaaatattatgctgtaaatataaattttaaaattattttttaatgtatgttttttattgaatatgatgtgttattaattattctattgactaatattaaaatgagttgccgctaattaactattgtccaaaaaattgctaatttgtgtcaattttgaaaattttgcgtggacttgctaacagatttgtcctaaaatgtccaaattttggaatttcagccgctaaatttttagttacaaatttcgaaaattatagtcagcttaagaagattctgctaattactcaatttgacgaattaatgtgaatattgtaattggaatttgttgaaaaaaagaagaaaaaaatttataattgaactacaataaaataaagttaatgtaagaaaattaaagttttggtgcatttttaaaaccatccaaagcggaacgggccaactccgtctgagcaaactttgagtcaatataactttttaaattgttaacagaatctaacaatattgatattattcgaaagctcataacaggcttttttagccgaataataattacagaaatgtcgaactgcaaaaaaaaaatatagagataaaaaattttagaaaattatgcttttttgaggttttcaagcgatagatgtttgtgaactgtttcattacttagaaatagcttagaaatatcttctaaacatttaaagctgtaaaatgataccaagtttgttaggtttggtcaacaaaaaaagttatgccttttgaatattgctgagacagagttgaccaaacgtagttgattgaccctactgaccacaaagaactgaaattttaaattatatttctccgacaaaaaatcaatgccaaaaaagagacgaactgaaaacagttacaaatgacactgaagtcgcaaaatatgcacataaaagaaaaatatgcatataaattttctaattaagggataaactttccaaaatttcttaaaattcttaaatcaatgtatatctctaaaaatggcggatttggtgcttctttgtcaggatcgttttgttggcgttcttcccgagcaacagctgaacaacttcttttggccctcatgcaatggacagaaaatttatattaaaaagccatttttatgctaaattgatattatcattattgattttaaataaaagaaattataatatatttcctcaggtataagccacccccctcccactctattagaatccccaccacctcgaatttaaatagttatttttcagaaaaatcgaattttttcaatatttatataataacttatttcattttgaagaaaatacaggtaatttctttaaatatttaattctctcactccatcaaaatcataatgacaagaagcataattaatgagacaagcagtagaattattgttctgaaatttcataactattaggaatttttctaaattgtatgtttaattttgctttttcaaaatgatgtgtttaattttgcttattcactaataaaatcgctcgaaatgaattattagatttttaaaagtataaaatcaatttattgtcatcccaatgtgatttcgtcacagtcag

SEQ ID NO: 6552 - DNA, 1414 bp, Heterodera glycines
  misc_feature (57)..(57): n is a, c, g, or t
ccccgcccacggggtccgaaccctagtaaaattctgaagccgcggggtttgaattcncaattattttcattgagtcgcacacaaaaaaaacgcgaatataagtggttgttggaaccggtttcgggtgcatttaaatatttccaaatttcatatgagtgatcagcgatcatgaaaattttcggatggggaatccgaagaccttttttgctcttcttaccaaaaaattttcaaaaattttaacatcggagcgaaaaataaagaatttttagtggttttggagcaaataatgacaaattttccgttttggggttaaaatttcaaacaaagtaaactgaggtccgtcggtcaggataggcgcgaaattataataaaagatgataagaaaattgtgaaaagtttcaaaaattgcctgtttttaaaaaaaattctgaataaggcattaaaaaaggcataaaaagacagaaaagttacgttcccggcattaagcatcaaaattgcaaaaaaggcatcaaaattttaaattatgtgcggattaaggccctagtaatttagcaaaaaaaggcatattcctcaaaatccggtctttaataataacgagttttatgaattaaataattcaaacacagaagacgaatacggaaataaaatttatttttatttaataattattgaatttgcctaagaatttaaaaaggtaaagcaaaagcttcgtaagggtccgatttaatactataggaaaaatccttttgaaataaatgaaaggaaaaatttttgtgaaaaaattcatcatacgtgccaagtaattcggggggaaagacaaattaattaatgtgactaatccgaaaacttgaaattaattccaaaaacgaggttgattagatattttaatatactgcttttttggtctcttcagtgttttttttttttgaattattcagatttatttctacgtaaaatttgaaatttgatgaaagtctttatcctatataaatccatatttttagagttttcaataacaaatcgagtctctctttttctatttttccttattttggccatttttggaatttttttaaaagaaagataaaataaagccaaattttgatcttttaaagtctaaatatttacacactttgacattaaaagaatttgacagatttaattaattttcaaaattccatgtacaactttgtatgcgagattttatttggccaaattttgatcttttaaagtctgaatattatttacacactttgacattaaaagaatttgacagatttaattaattttcaaaattccatgtacaactttgtatgcgagattttatttggccaaattttaatcttttaaagtctgaatatttacacactttgacattaaaagaatttgacagatttaattaattttcaaaatt

SEQ ID NO: 6553 - DNA, 3805 bp, Heterodera glycines
ggataaattgaaaattcagaattcatattgtttcatatagaaatttggtcatttcgagcaaaatttgctaagaaatggagcaaaactttcaaaaatttctccggcggcgcctaccggcaccctgaaattttctttgaacaaaacacactgccaacattgtgcgaaaagcaacaacaaaaaagctggatgaccccatttaaaactcattaattttctttaaaaaattcgctcgaaataacgttattttcaaataagcacgaaaaatctattgacgcctattttcaggattttcgaaatgaaaatacacccctgagaaattacccaaaaaaatttcagaaaatacaaccctaagaatgaaaatttttttctcaaaaattgatactttattattttttatttatccatttttataaattttttacattgctctgcgtcgatggaataaatgaacataatttttttgtgcctttgcttatttaaaaaatatatgcgcatttatttatagttagggctcgcaactctgctgattggtgttttttaaattcccgccaatgggttcgaaaacaaaaaatgggtaatttatataaattcatatcttggctcaaattcaacctaattaaaatattgtagttcaatagctttaattgttctctttcagaatataattttccaaaatttttccataagtctaaaaaaaattagaaagcattgagcatgctatgttttttgcaatggtcatgcatatataattatttaaaatttgaaagtctttaaaatgcagttgagccaaaactaattatatatttagccctaaaaattctctatttacctttaaaatttcagaaaatttcgttgaatttgagccaaaatatgaatttacatatattacccatttttttgttttcgaacccattggcggatttaagaaacgcaccagcacgctgctgatttatcatcattttgctgcttttcaaggggtcaatgaagatttttttagatgctgattgttgctgcttttttgagaaagtttgctgatttatgattatttttgaaaagaatcctcaaaatggccatttttatgtaaaaaatgctacaaaaaactcccaaattttaaaaatttatggataaatgctaaaaaatcttgttttaacagaacttttcgtcctattgtaagggacttacgaggggtgtgtaccgtgcgtaccagggatgggctttgcttttgcgtttcgaattcgaaaatttcgttttttcggtactttcgcgtttcgcattttggcgcgaaacgcgaatattactcacctaagaatgagagatgaaatttccctcataatttttcagtgaaaacctgtttaaaaaggcccaaaatcgcaaaatttgtaattctttggggaaaatctgttaacaaattgcactgaaattttttaaatttttcccggcgacgcctaccggcgcagccggacccccccccccccccccataagttttttgtaaaaagcgcgccgcaaaaaagcttgtccatcactggtactacgtaccccctcccccaagacctctccacacccgaaatctttgtggaaaaatagcatttttgtcgaaaattttcgattttccttgttggcaccccctccaagactacctcgccgaaattttccaatttgctaaatttccaaaagaatagtgtgaaaagcataaagctgtctccgggggggggggtcctggggccgtccctgcctattgcatttctcaaaagcatacagtacccccagtagggctctgttgcggaaatcacgtacacaatcctgcccaatccggccctgaagatcaatgtgttgttgggaccgttcgttagagtatatatcggcaataaagaaatttatataaattatatgtcgatttttttattgatattgagataaagaacaaacaatcagaaaaagccaaaaaggcaatagtgtgtgtgtgtgtgtcatcagtgacaatcgagattaaatctttgaaactgcgtccaccaatttgtccattttgacctcgtcgccccattgtttttccaaatgtgcaaaaagcattttatcgccattcaccaggtaaacacctgacaaatgaacgtaattactttatatcttttataaataaattttatcatgaggggccggattaactttttcatatgtttatttagaatagagttgggtaaaagaaattccggaagcgggaaaatgaaaaaaagcgggacgggattcccgaacgggattcccttttttcccgttcccgttaaaaccttgtcaagataaaaagagaaacgggaacgggattcccgttttctcggagcagttttcgatttagaacaacttttagcatgtaaaaaggtatttaaagttttggattcaacgccaaatgtttttttttagttggtgtctaaaaatttgttaagaattacgcattaaaatgaccgtatttgatgttcattttgagcactacttttcgtcatcaattcgtaaaagctaagaatttggctaaatggatgccaaattcatactttagcaaccccgaaaagtcctaaattagttaatgttgtttttgaaaatacaaaaaaattcagaaaaaatggtagataccataggcaatgttctaattttctaccgcggtttcatctaggcttcttagtttttaaaccaattttaatttaataaattattatttttccaaccccctaacagtcggccttctccctcggtgttgccggcaaagccagccttccacgctttgtaatagttcacataggtggacagacgcaaaaagcccatccaaagcggaagccaacgctgtgaagggccgaaaaagcgtttctaaaacaaatttcaaaaagtaataaaaaattattaaaacttctttaatagtcaatatttccaccctattgctttgctatttcgtataaagataaagaaagaaaacaaaattattagaaaagataacttttcacccaaagaaaattgttttttagtttttccagaagttcatatctccctagtggttttcatttattgtttcgtgactcagacgtccaaaaatatccatttctaagcaattaaaccaatgacacttatttaactttttacaattttgatggtaattgtgcagttttgtgatttctacgaagaaacacattttttgtgagagaaaatgcgttgatcccgaatctgagctcggattttatatatattaagtttttcgtttatatttttttttattatcaaatattactttttaacacattatccaatgtcacatttttactggtgatagatctaacaaacaacaactaaaatagtgaggaaaaagtgccaaaatagtgacataattttcagccaaaactgagcaaaaataatttttattcattggttgcagttgcaagtgcgtaggactgggatttttatgagcaaaaaacccaaaataattacttaaaaaaatttttaaaattaaaatttcatttcataggagtatattttgaaaaattttagctcgattcttaggggtgtattttttgaaatttttttaggtccatttttaggggtatattttttgggtttattgcatttttgttagggaattttccaaaaaaatgtcgaaaaagagtgaaaaaagtaaaaaaagtgaattttcactattataagtgacaaaacgccaaaatagtgatttctagtgacgaaaaatgacgtgcaaatgaaaaaattttaccgcagaaatgcgttttttgagctcctttcttcaaaacaattgagcaaaaaaagaagttttttcacta

SEQ ID NO: 6554 - DNA, 3492 bp, Heterodera glycines
tcatttttctattagtcaattttgattacctatcttgatgtgtggttataggtcataaacatagcatacaaaggtcaatttggtagagaattttgtcctctttcagataggcttactcaaattttccagaaaaaatttcctaacccccataggaatttttttctaaaattttcccgatttcaagccatttttgtcttttcagatcaccgtgaagaagtgatctaatcaagttggtgtaatagacttttttgatcagcatcaaaagttaatctaacagagattttttcagaattttatcataataaaaaattgagttttggtcgattaaacattttgaggcattacttttgcaccgtcagaatggggggttgtttgggtcatgaccaattttctcgtcagcaaagggagctatcggggcagtttttggctatttattagcgctgtaattagtgtttcttttggtgtaaataagactttttttcaccattcatttttgagaaaaccagttttaaaaaaaaaaaaattttttttgaggcaatactttacacgatcaaatgaatgttcattcggctcgcgagcacattgagcgctaatttgtggcgaaaaatgacgaatattttggagtgtgtgaaaacttttccaattattaaattatttatttttaaaattggaaacaatcattataaatgggaattagcattttaagcaaaacacttcccaagcgaaagcaaaaggacgtcggaaattcctttccacgacggatgacccgaacaataacatcgatttgatcgatgcgaatgcatacggacacaaaacggagattggcggatgggaatcggacgaagtgaggcacaaagacagaactcgaattattttctcagcattctccgatgattgataatgcataatgactagggctgtgaattttaggttttaactaaattttttgctcgattgatttgaaggagttcaaaaaacacatttctgcgttgaaatttttcgattatgttgtcactagggatgggatttttaagggtgaaaaagtccaaaataaggccgtaaataagggcgaaaaagtcaaatttagggtataatttttaaaattgctgttttttacatgaaataatttcagactaaggcaaacaattttattcactgattgcagttacaaataagctatattttagaaaatttttttcatttcttagggtctatttttgaaaaatttagtgtcgattcataggggtatattttttcgaaatttttttggtcgattcttaggggtatattttttcgaaatttttttgggtcgattcttaggggtgtatttttcgttttttattgcatttttgttaataaattttggacaaaacgccaaaataagggcaaaaacttattttaagggcgaacatccaaaataaggatttttaagggcgaacatcaaaaataaggatttctaaggtcgaataagggcgtgaaaacgcaaaattttcagacaaaaaatgtgtttttcgtgtatttctcgttgagttaaagccgcagaaaaaataagtaaaaacttagaaatcccatccctacaaataactaaacgcaaattaaatctcaaaattttttgaggcactcttttaattaagaaaacccaaaggggagggaacttttatttcctaacaaaaaattatccaaaaaattgtgagtaaggaattatttgagtttttagatcgatagccaggatttttaatatccatttttaatttcctgacttttatccaaatactgatcaaaaccctgaaatttattatatttttttggttagccgacatttgcggaccgacatttgcggaccgacatttgcggaccgacatttgcggaccgacatttgcggaccgacatttgcggaccgacatttgcggaccgacatttgcggaccgacatttgcggaccgacatttgcggaccgacttttgcggaccgacatttgcggaccgacatttgcggaccgacatttgcggaccgacatttgcggaccgacatttgcggaccgacttttgcggaccgacatttgcggaccgacttttgcggaccgacatttgcggaccgacttttgcggaccgacatttgcggaccgacttttgcggaccgacatttgcggaccgacttttgcggaccgacatttgcggaccgacttttgcggaccgacttttgcggaccgacttttgcggaccgacatttgcggaccgacttttgtggaccactatttctcggttgaactgtctaaataaagaaaaaaataataagaaattttaataaatttaatattcccaaattgaaattagtgaaggtaagctgatgcaaagcgatctgtctcaattggagagaagtcttatttgacataactatttctttcttttttatagaatttctaacttataattaaactgtgaaattggcgaaaaaattagctaaattaaatataaaagtcagttcaagaattttataccaagaaaattttttatcttgtttcacttccacgctttagttaaccgagagcttaattttttccggcatgtcaaaccaattaaattaacaaacaaaaactaaaatagtttatctttttatcaaaaattgtccgtaatttgatgttattaaaactatgggcccaaaattaaaaatgagcaactacatactatatttatctatggaaactaaacttctttaaaaaatgggttctttcgatgttgattgcaaaaagttgatcgattactcttgaagggcgatgttcaacttggtaaaaatcacaaataaaactacttagtcactcaatttttgaaaaattatttttttttgttttttgttttttttttgacagttcaacccagaaatagtggtccgcaaaagtcccgcaaatgtcggtccgcaaatgtcggtccgaaaatgtcgcactacgtttttttgtcctttccccgaatttgttcttttcaaggtccatcttcgcctcattcttccggcggggcctgccccctctccctacgacctcaaattgtcccgtgtcgatgtcgcagtgtctccgtcaaccacttcgatgagctgttcaggcactgctttctgttcgttgcttacaattaaatccgttggcttttctccttagatttaccggtggatgagtcggcgagtaattcggtgcaatttccgtcttttcggaatggaattttactaaaagacgaagggaacgacagtcctcgtcatcgcagccaaattcaaacccagcaacagcaggaaatgcagggcatggaaacggcagaaatcgaaggaggactgaatgtgcaggtggggaatgggggttaacaagggaacattccgagctgtcagtcgtaaaatgcctataaacgatataccttggataaaggagggtcgacttctattgtgaatttttttattttaacggtgcattttgctccttcgagagttacatggcctcaaaaatcggaaatttggc

SEQ ID NO: 6555 - DNA, 929 bp, Heterodera glycines
cggcccattattccgcaaaaagtgttggtgttgattttggtggtggtcgacggacgcaaatccgccggaggactgtcgggaagggaccttacggagatggcgtcctaaacggcatttggagagtgagtaaacccggaaaatttggacacaacattaccgccgatttcggtgtcctcaaaatggaacactacacggaccaccaaatattcggacaataacaaggggaaggattgcgataaatgccggcggttgaacaacaccgacttggccctgtctccactcaaattgtgcgtttcgtctggcaaatcgatgcgaatgtttcctatccattcaccgacctaaaggggaacaattggaggaccaaccacttattgtcagatttatggaaaagtgagttgccttcatcttaaaagtggccgcaatgtttcgcatcgacgaaaggcgcccattgcactcgtaaacgaggaaacattggacggtcgccattctctggcctaaaaacgaaagtgattattatgacactttaaaacacaaaaaagtaacggaccaaagaaaaagtggttgcagatgaatgagggacgaatggtggtgggaattttgttggaaatgcgcgaattggcacgacgagtcaaatccatcggcggaagccgacaaagggcagaaggatggtggcgaaaatggggagagtttgatgtgttgggccgacggacaaaaccagcgacggaatggccgtcggaggatttggcatgctgaaaaacggaaaaatgtgccaaaatggaagttgaaactcattgtcagagagattagagaaattaatatgaataattttagtcatatttccaaaaatttcctatatttgtgccaaattttgaataggtaaattgaaatttcccagtttgagaaactatgtcatttttcacattaatttg

SEQ ID NO: 6556 - DNA, 2212 bp, Heterodera glycines
atcgcgtcgtccgcaaaacatttgtggattggaaaattaaattttccctcggcggttgcttgcttatatagtacaaatttcggtgcataaacgagcgcaaaacggggctgaagtcgccgagaaaacggtacaaaatgaacgcctctgcaattattatgaacagttatccggaaacaattttaattttcatatatatttcgtcaattcccaaaacaaagcccagcccaataactcaaaaaatgaaaatcatttttgaatatagccaaaaaaagagcaaagtcccaacattccatggtccataggaggaataaccttgcattttgcgctggtacgggtccatgtcttcggttggtcctgtttcgtatgggtttgagcagtcgaattccccagccaatggcttcagagggcgcctttgcagttccgtccagtacgactttttctgcaatgcaagcggtaacatcagcgcaaatttctacgaaataataagagaatgggcctaaaaaacttaaaaacatgcgtttataatttgattggaaacggagtttctgggcgaaattccctttcgaatgcgccgtcgtctgtcccgcttattatttttttattgagtttaattttttcatttacattcattccaaaccttcctccggcgccgagacaaaggcgccgaaaactgaggcaaatgcgacggcatttggtgccgttgttggcttaggggaacggggggagacaacatgctcaagctgttcccgcgcggccactctgtttcatcgtcgctgctaattgcgctgctggaggacggagacgaacaaagtgataattcatccgctgttgatggtgggtttaattgccgggaaggactgtcccctctttcgttgtcctctttttctgacaccgatgattctccggacgagttcatcgtctgattgtgcccctcttgcgtcgttctgctgctgcctcttccgacatgtcccccaactcggcgctgtctcccgccccctcctcttcttcctctgcttcgctgttggcgtcgtactgctcgccctcccttcccttccatttgctcagtttcagaggtcacatcgtttcccatcgccactgtttccaaagtgatgggtccgcctctgctccgtcttgccatgcctcctccccctctcctgcggctcccaattgttgttgctctgccggtggtgctcaatctcagcgccggtgcgtcgttgtcatcattgattttgtcggcagatgccgttgtttggagtgatgaaagacgccctccgccaccacgcggatgacccgccctccgccctctacgaacaggcgaaaaaagcactcttcttccactgctggcccctggtgggtcatccgccgcctctgccagtccaattgcggacgacagggatgacaattcagaagatgatgagccaatgctgctgttgctgtcgtctctcgctggccttctcgccgttcgttttgctgtggtggttgtgttgcagttactcgtcggccttcccgttgtcctttcttcaatgaccgacgaatgctttcttccgttcagaaactcattttgtgttgttgcagtgcttttcggcaacagcgatttcttccttgtgcttttcctcaattggagctgttgagttgtgtcaacggatcgtcgaatgccgacgagtcgtcgcgggcgttccattccattcggcacgggccgtttccgttcgccggaaggcggcttgaactcgtcgagctcatcactcacagtctctgctgatgagtcagtgcttatgaagtcgttggaattgtccagtgtttccacttaatttcattaattttttatttttgtaaacaagttttgtagaccttaaaaattagcgataatttgaagaaaaaacactttgccaaaattttgtttttttgagcaaaaaatttatttgaatttttttgttcttttttcgctgctggtggtggtttacctatatacgactgctcgccctggacctggatccaaaactgggttttcctggatccagcaggtccaagccatttttggcaacctggatttcctggaatatatttagaattggtttttcaagcgaccattgttttatttcaagttatcaaaaaatgattaaataaataaaaacacattattattgtaaattagatatttttagatgttcatataataagaaattaatgatcttttcagttttgtttgtttttt

SEQ ID NO: 6557 - DNA, 1643 bp, Heterodera glycines
gggggataggtccggcggtgccgataggcgccgtcgggaaatttttttttgaaaatttgaagcaatttgttaacagattttgcccaaaaattctccaaattttgtgattttttagcaaaaaatatttcagaaaattataaaattgtgactgtctttaaggaattttgggcaattaaactatttgttaacagattttcaaccaaaaaatgaacaatttttacgattatgagccaattttttaaggaaaaaaaagttttggtgggccggcggtgccgataggcgccgccgggaaaattttttgaaaattagtaattttagtagcatttgtatcagcgaaataaatcattaagcacaaaaatttgaaaagtttgggaaagcccgaaaataaggacaatcttacaaataaggacacttggcagccctgtgtagaaatgatatacataatcatagaggagaaaatgtagtatttggattagcagcagaataatatcaatgaaagcaaagggagagaatgacaaatgggagagtgaaagagtgaagcgagaggcggaatgaaattttgcacttttacaatttacaaatagccccagaggaggaggaaagaaggcgagagagagagagggggtggggggagagagaaagagagacaagagagagtgaacagagagagaaggggatagagagagcaaaaggctgggaaaagtcacttctttaatttgtcgactaattggccaattttggccaactcgtaaaatcgtaccatattgcggaaaggttgcgttaaaattgaattaaatttcaatgcgtctttttgctcgttctttcccagtgtaattggtaagactgctcgaaagttgattctgagactcagaccgagaccgggaattgccccgccggagagtcgagaccgacactatgggtcaagcccagtgttagacaaaattgctcataacgccaaatagcgcatttggtgtaaatttttgcgcgttaattcaaaatttacactggaaaatgcctttttgtattttttattttgatctgccataactcgcttcattcccaactaaactgaacaaatttggtatctaaaaaagtttttgaaaaggagaatctttttctaagcgaatgctaagcaatttgacatctcagaaaaaagttgtgatactttcaaatttttatcacgttataactcaagtcctaaactgctgttttcaccaaaaatgctaaaactattaatttctctattgattctaagtgtccaaagtgattttgtatccttataaccaaaattgttagcatttacgaatttgatgttttttgtgtgttagagatgtgaaaatagtacgccaaaaagagagaaaaagtaatgcattttcatgttttatatatatcttttgaaaaagtgtataaaacataaaatggctgtattacattatgcagaatttttttctctattagtatgtaaaatttggtgtggatttaacaagtagaaaaaaagttaaacagaatgaagtaaatgttgttttttacataattaaaatgaagagatagtacgccaaagagagagaaattacaaagaaaaagagaaacgacgagatagtactaggcttttctctgcacagtggagttgacccatagtgaga

SEQ ID NO: 6558 - DNA, 1487 bp, Heterodera glycines
  misc_feature (1025)..(1025): n is a, c, g, or t
gtgaattctgtgcaaaaataaatgttcaaatttgtgttagaatccggttggtgtttgaaatggtcaatgtgtcagaatcggttttccgaccctgaaatccaagatttggactacatttttcaaaccaataaaaacattttgaaaaatataagaaaattatttttgtttttaatcctacagtatgtcggaaacaaagaaaaacgaataaaagttttaatattggacagaagaaaaacagaggttgttttaatgggcttgccttacaataaaaattttatctaattttgcgacttttggaaactcggctctaaaactaaggaatttacgctgatcgaataatcgcaagtggccagcctttttcacaacgaatctggcatcctttcgaaccccgaacaaaaagtcgaaatcgcaatttcaaaattcacatttacatataactccaaataattgaataagatacacgaaatgaacattcaaatgcgttctttgattaaaagtctgttcgccttggcctttgtccatatttgtgtttttagtcccatttactattaattcatcatatgtaaatttaatcgaataattttaattaaaacaaataaaagccaaatgcgagctttttctttattttgtggctttttcgaggtatccatgagtatttttttaggcttttcccctacctttgttactaatgcaaatacataaactttatacataaattattgctttttctcattatctttcataaagtgctgctcattttgtcattcggcagatattatttcattcattgtgcacagcgccacacacattcagaaaaaagaagaaaaagaataaataaataaatgcttttcattcagtttttgttcgatgtttttacagcattgccggcagaagaaggcttttgctgctgtgggaatgtgaataagaaaagtaagaaaagggaggaaagggagggagtagccgcaccaaacggcggccggccaaagcgatgggaggcatttgcttcgaaagaatgaatgaatggngtggatgtaacgcatttgattgggacgacatcgaaggctttttttttgaattatatttatccttttcgtcctgcgtttttgaatttgattttatccttcccaccccctacggctcacccaattttaaatgccattcttttaaaaattaagcagttcggtcagtaatttttccgttatgattcctcgtccattaaaaaagaatatgaacaaaacacgcttggtattaacatactcatttggaggctgaaagcaacaatttctgccaaatgggaaaaaactgttttaacagcttttggaaattcatttttgctatcgagcactctgttgattctatttttaactcgacaattgttggccaagatttatgtcagatttatgtctagcaccccggcggaaaacccactgtaccaattttcaacccaaaatgaaaaaagttaaattagaaacccacattcctgagta

SEQ ID NO: 6559 - DNA, 2151 bp, Heterodera glycines
tgacaatgccaattgtcacgccgggacacattgaacaaaatgccgctttcaatgtgaaccgatcaaccgcaacaatcattcggcgagaaatgcaaaacggtgccatttaaagggaaataaactaattagtgaattaaaaagtggtgtcatcattaattgaatatttttagcaattaaaattgtacgaaattggccaaatctgagcatttcattgaatgaaaaatggaaaagcttaataaaggctaaacagttcaatgaaaaggtgatcatcaataatagttatttaaattggttatcaaatttcaaaattttcccacagttttcccatttcattcgcattatttgcaaagccttcgcattggccgacttttacgacttttgtggctacgtggagacgcgaatccgtctccaattgattattaatgtcgtgccattcgatcgcgttcgattggcacatgcgaaaaaagttgcggaaaaggagcaagaaaattttggcgaaaggaataacaaaaagtgatgcgtttgctttttggcaatttaataattagtcactccaatttcggggaaaggtcctaatttgataattaagaaacaaattaccttgtaggaaactatcacaactagggcttatatttttagttttttcactatttttttcctgtgcttcctatggtctgaaacgcatgaaaaactttttttgggtttttgttaagctagtttttattttttcacctaaaaataaaaaatttcacccctaagaattggacccgaaaatttttcaaaaatgcagaaatgaaaatttctcaaaaattcagctccaaaatttatttatttattattgaaaagaatttttgattttaaaaatatttatctcaatactgatttggcataaattactttttggataaattttaatattttacacccctaaatttgaaagattttaacaactattttcccattttagaaactatttttggggttttttagaaactaaaaactaattattttggcagtttttaataactataaatataagccctattcacaacacattcttttggctcatttataaataatttctaatgaatttccaatatttcctctgccgtccccaatttcctcctaattttgctaaatttgctgtttaggacggatttcttcaaaatttggttggttggcctcgaattggacgagaaaatcgcttcagaaaatgagtcggaaagaacaacaaaatggaataattggaaaaaagcattgaattcgatgctttccgaccaatttaatgccgacattctgaaggcttatcggataaagaatggttttggtagtccatttcctcacattaaattgacggcacaatatgaggaaaaatagcagattatatttttagacatttcatcattattttttttcggaaacaattttattcacatttacgcattaaaaaccaagtttgaatcttcaaaatttaatccatatatccaggttgctaaaaaactgaaaaacgccaaaatagctgctaaaaaagttgccaaattggaaaaatatgtcaataaatgtgtgaattttccaaaattgactcatatttatccatttcggttgattatttgtaaatcaaacatattttaagatttaaagacgtaaaaatttttcattgtccgccaaaatcatggccaagatttttgcttttttaaaaaatcgattcttagggatgcattttttgaaaaaaaattaacgtcgattcttagaggtgcatttaatagttgctaaaaagtcgctttaaatcgaaaattgattaagaaaatgtgttttttgcgcttatctcagcatatgataggctaaaaataaatggttgaatatggatttatttccgaaaaccaccaaaatatggatttatatggactaaaaaccttcaccaaatcaaaaaattttaacgtagaaatgctatttttgagcccttttctgcatagcatatgtgccaaaaaatgttaatccaaacaatttataaccctaataataattaaaccaacaaaataatgtgtgtaatattaacccgaaattccataatttttcaggatggatttaaaattttggggaccttttcgccaactcaaaattattaatttttttttttttgggaacagttga

SEQ ID NO: 6560 - DNA, 2925 bp, Heterodera glycines
  misc_feature (102)..(102): n is a, c, g, or t
aaaatagcagattatattcttagacatatcatcattattttttcgggaaacaattttagttcacatttacgcattaaaaaccaagtttgaatcttcaaaatntaatccatatatccaggttgctaaaaaactgaaaaacgccaaaatagctgctaaaaaagttgccaaattggaaaaatatgtcaataaatgtgtgaattttccaaaattgactcatatttatccatttcggttgattatttgtaaatcaaacatattttaagatttaaagacgtaaaaatttttcattgtccgccaaaatcatgccaagatttttgcttttttaaaaaatcgattcttagggatgcattttttgaaaaaaaattaacgtcgattcttagaggtgcatttttgtttttgttgtttattgcatttttcataataatttttttgttgaaagcagaaatagttgaaaaaatagtttttaaaaattttttgcaagcaaaaataattgttaaaaagtttcataagcaaaaatagttgaaaatagttgctaaaaagtcgctttaaatcgaaaattgattgaagaaaatgtgttttttgcgcttatctcagcatatgataggctaaaataaatggttgaatatggatttatttccgaaaacccaccaaaatatggatttatatggactaaaaaccttcaccaaatcaaaaaattttaacgtagaaatgctatttttgagcccttttctgcatagcatatgtgcaaaaaaatgttaatccaaacaatttataaccctaataataattaaaccaacaaaatattgtgtaaatattaaccagaattccataattttcaggatggatttaaaatttgggtaactttcgccaactcaaaattattaatttttttattttgtgaacagttgaagagatctttttcaacaaaattgtatttacattgtgcttcagtccaaaaatttctcttgtcgattgcatattttggccttggatatttttgtgcgattttacagagttggcaaattggagaaagtagcgactttctcttctttttgctgtacttccgtgtccaattgaagaatctgttaattgaccaattaattaggccaattgttccctcggcggattgacaaaatgtaattaaaaaattcactgcatgtatcggtcagtgtcatgtcggagtgtcaacaaatgttgtgccaattcttgcgcactgcaaaagtcgtcggctgcgatgtaagcgtcgtccggcacgcccattccgcggagcaccgcccggcgcagcaccaccggcacagtcagtgcgcggaaagcgttccaaaacttctcagtcacatattgagggcacaccgaattttcaaatgccaaatagaagaaatgcgatgctaaaagatgatttaaatgggtaattattagttttttcaatatttgttaattgtcgttaattggggtagtaaccaattgcttaattacccatttcctgcctgtagcactgttcatcacactccttcccactgcacgcaccaaacacatcgacgggcaccagttggcccaattgcgctgtgagaatgtccctggctgaggaggcgccgcatttggacacaatttgcaagactaatttgctcttctggcgaacgcgcgtttcgatcttgaattggacaccaattaccactcttttgctaatcacttctgtgtccccctccgatcagtcggtggctggtaaattcgacactgagtattttcgacactaagtaatttcgacactacgttttcgacatagagaaatttcgacactgaactatttcaaaaactctcactgttttccagcattttcgacactggaccatttcgacagtgagtaaattcgacactattgagaatttttaaaaattaataagaaattttggtgttagtattaggtatgataaattttcctatttcattttctaattcgtactttttaaaaggttaggttggtataactagagttggtcgggaccgggaaatttgacaaaaaccgggaccgggacttaccgggaccagaaaagtcgggaccgggaccaacttttttgaccgggaccgggatcgggaccgcgagaaaagccgggaccaaccgggaattttttcaagagaaaattttttttgaaaaattttgaaaatttgagtgcactttgttacgaaaattgccaatattcaaaaatgttcccataaatattgtagtttcgttttgggggacgaattcgaagaaaatttttaaaaattttcatttcggggggggggggggaatcttggattttctgagtcccaaaattctggatttttataaattaattaaaaaattttgcgaaaatggccctcacgcgaaaacgaccccgaccgtggaatgggtcgaagcgggtcagttccgtctggcagttccgtcttcaaaagtcatgaaaacatgttttagggtgattttcggttttcgggccctagaagccctacaaagcgctttgacaaccaatgcaaaaaattgcaatgatcagtgatcactgactgatcaggtttttttgaattatcgccccaaaatatcgctatttggcattatgagtcattgtctaacactgacactgggtttgacgttttactcagttataccaacctaaccttttaaaaagtacgaattagaaaatgaaataggaaaatttatcatacctaatactaacaccaaaatttcttattaattttaaaaaattctcaatagtgtcgaatttactcactgtcgaaatggtccagtgtcgaaaatgctggaaaacagtgaaagtttttgaaatagttcagtgtcgaaatttctctatgtcgaaaacgtattgtcgaaattacttagtgtcgaaaatactcagtgtcgaatttacccagtgtcgaaattacatagcgccgctaaaa

SEQ ID NO: 6561 - DNA, 2201 bp, Heterodera glycines
  misc_feature (2154)..(2154): n is a, c, g, or t
aaagtcggggaccgggaccaacttttttgaccgggaccgggatcgggaccgcgagaaaaaccgggaccaaccgggaattttttcaagagaaaattttttttgaaaaattttgaaaatttgagtgcactttacgaaaattgccaatattcaaaaatgttcccataaatattgtagtttcgttttgggggacgaattcgaagaaaatttttaaaaattttcatttcggggggggggggggggggaatcttggattttctgagtcccaaaattctggatttttataaattaattaattttgcgaaaatggccctcacgcgaaaatggccacgcgaaaacggccctcacgcgaaaacggccacgcgaaaacgaccccgaccgtggaatgggtcgaagcgggtcagttccgtctggccagttccgtcttcaaaagtcatgaaaacatgttttagggtgattttcggttttcgggccctagaagccctacaaagcgctttgaaatcaattaaaaattgcaatgatcagtgatcactgactgatcaggtttttttgaattatcgccccaaaatatcgctatttggcattatgagtcattgtctaacactgacactgggtttgacgttttactcagttataccaacctaaccttttaaaaagtacgaattagaaaatgaaataggaaaatttatcatacctaatactaacaccaaaatttcttattaatttttaaaaattctcaatagtgtcgaatttacccagtgtcgaaattacatagcgccgatcagtcgctccgtttcgcgctcagttggacatcgtccgttggctcttactcgctcagttgggtcccggcacgtttgggaccagaatgtttttggctataaccttttttctttgtcatctaaatccaacattgattgtggtatcattcgatagctctatgtgttctctattagcctgtgaaattgcaaaaaatttcgtcaatttttgacaaacttatggccaaaagtacattagaaaccaggttttcagtcatttttggccataaatttgtttgaaattgacgaaattttgtactaaaaacattttggggtccaaacgtgccggcgcccaactgaggtaaatccccgttggctttatctctctcagcgccgctcatttctgccccccccctcccccactcacttcgtccacgtgccacaattcgaattcgtcttcccccgccagcaacaactcatcgtattttgtggctattgtactgtcagcatggtaagtcatggacaaattgaaccaatcgttagacaatttgttgaaggcacttcccgcgtaatatggcgactcttgagtgaaaaaggcgtatctaaatggactaattaattaattaattatcgcttaaatttgggttttagcatttaaaacttatttaaaacatatgcataacgaaatgttacaattgttcttcactgcgatgctggggccagctccaaaaaggccaaaatccgatcggattcgaccagaaaacgtggaacagcaacactgaggccgaagcctcgctaaaattaaatatttaatttcttttaattattaaaattgaatttttaaaataaaaaaaaattacgccgttcgttccgttgtgtaaatgcattggtagggacaattcgaattggggtcctcgtcataagataaagccgacggccaaaagtcccattggtggggaaagaaaaattgcttattccatgctaatataatgggcaatccacggtatttctgaattaatattttaggtaaattttaataaatgtaattatgcaattccattccgtaaaatcccatttaaattacatggaattttatgacttttcgtagttttttttcatttaaacggatttgttcgagtgcaacaaattcaacaaaatgatttggaactttgtcaaaattcgtttctggcaattcgatttgttgcagaattacagccgaattgcgtcgtttgaatgttaaatatccgacaaaagaatctgaaaaagcaatttattaaattgcttttgagattaattggaataaaaaccttcgcttttcaagaaaaagcatttccgacgagaaaatttggtagcgacgaaaaaggcaatagcattatcagtgccattcactgattttgaccangaaatataagctgtgaaaataacgagggtggtcaaattgagtaaggg

SEQ ID NO: 6562 - DNA, 1934 bp, Heterodera glycines
tcagggcaaaggtccacaagtgattgccaaccgtccacccaaccatcgcaccgttgcgcaagtcaccgttgcagcaaaaactgttacaatgaccgtggaagccttcctgacgctcatgccatatttgtaacttcaaaaaattagaaatacttatttcaacaaaattttggtggctaatttagggttttccatgaaaaaacaatatgtgatatataaattttaatagagaattttagtgttaaattaattatgggccagcagcaattaaactaattgaaaaggcttgactgataactaactaattattagttgcacaaaatttgctttggtgcattttttagtatggtaatgacaactggtaaagtttccgtaaatatattttctattttaaaacttgagtcaactgtataattaatatatgtgatgggacttggcaccaaataaagccagtgtgaaacgacaaccttgcggatttgtgtaagcgtcaaaaagtctccaaccacaaaagcgaaaactgtgcaggttcaagcccgcaccacggcaatgaacattcttaaaaattttatttgaagcaattgaacattcttggtatcatcaaagtctcttggtgaggagaaaccttttcaatgtaaatgttaagcatcttgaagcaccagaaaaaaagttgcgagtctttgaaaatttgcatttgcttaagaaagggtctgggggagttcatgaaaatatagactaaaacatgaaaattggaacaagatttataaaatcctttttaaaaagagacaaattccttaaaatttgtcgctaatcctttgaaaaattccgcaaatagcgcattttcattctaaattttgaatttatttaattataattgaatgttaattagtcccacacattttcaatgatcatcagttttgaattgataattcatatccttttttgtcccattctcctttaatttaaacattttctccaagttttcgtcaattaaacaattttaatttaaaaaatgaaaatttcaattgttggattgcggtggagagtaaaaactgattttgaaataacaatatgccaaatgaatagaataaattttctataaggggaatttatttttattagtcatttttaatggggatgggattgttaggggcgaaaaagtgcaaaatagggacctaaataggggcaaaaaattcgcgaaattaggacgaaaataggggcgaaaaaatttcaaatgtaggggagaaatttattaaaatttcttttttctctatgtaaaattttattcactgattgcagttagaaatgaagtaaattttgaaattttcaggatttaaggttcgattcttaggggtgtattttccgaaattttttgggtcgattcttaggggtctattttcttttgaaaatttttaggtagattcttagggatgtatttttccgaattttttttggtcgattcttagggggtgtatttttcgttttttattgcatttttgttaataaatttcccaaaaatcgcgaaataatattccttaaaaaactgccaaaaatggcttttaaccctcaaaaaatgccaaaaattttgtatttttttctctgctttgcattctccatttgttggcaccagggctggacgtaactgattttcaaatccgtaattacggcaattttttcagttacggccatccgtaatccgtcattacggaggtccaaaaagtccgtaatttggcgtaatccgtaatacgtaatccgtaattttcaaaaaaaatttttaaatttaaaaaatttttaaatttaaaaatccaatctaaaaattgttaagattaatttatgatcagaatatctgcttgtttttttgaggtgaaaatcccaaaatagtttttttcacggtgtgctttttccaaaaaactggggaatgtgggggggaaggggggtca

SEQ ID NO: 6563 - DNA, 2552 bp, Heterodera glycines
  misc_feature (2499)..(2500): n is a, c, g, or t
aaaaaagccttgttttgggatttataaggctcaaatttttccggattttcttttaaaaaggataaaaatccaatttaaaaaaaaaattaaagaatccattttttttcgataggaaagcccatgattatatataaaaagaaatttcaaacctttttcatttctgtagagggatcgaaccaggggaaagaagaagggaaagtgaaggagactagccactaggccatttgcacagtgggtcttgctactttatgaatatatataattattatttctaaattttttcctttaactccaattttctcactaatttttgcactcagacccccattcttaccagtgcttgtttttcccggttcccggttgccctaccgggaccgggaccgggacctgagcttttcaaaatccgggaccgggaaccgggaccgggaccctcggatgaccgggaattcccggcccggtcccggtctccccccttctttactttttataatagaaaaaaaattcattttataaaaaataatcttgcaagaaatcgtcttgaaaaataatctaaaaagccagttacggatcaaaattacggaaaaatcccaaaaatccgtaacccgcaatccgtaactccaaaaaggccgtaatttccgtaatccgtaattacgtccagccctgattggcacacatctcgttttttgaaacggtgtgtttatgagtagggatgcaacttttagtgatttaacaatttttttgctcgatttttttgaagaaaggagctcaaaaaacgcatttctgctttggaatttttcgatttggatctcactatcggtcactagaaatcactattttggcgcttcgtaactaaaatagtgaaaattcactattttggcattttgtcactattttttcattatttcgacattttttggaaaatatccgcaagaaaaatgcaataaaaacgaaaaatgcacaagaatcgacctaaaattttttttcaaaaatatacccctaagaatcgacctaaaaattttttagaaaaatttctcaaaaattcatcaaccaaattttttttcttgataaaatttttggtttaaaatcagggctcggatcgaaaaattttcaaaatcagaacatcgggcctaaaaaatcagattttggggtcgaaaatcagaacattttgcaaaattgcttcaaatctgttatttttacatttttgtttcacttattatatttttcccctcctattatcgaatttaacaattttgagtggaaataagcatattttaaatcagtgtatttaggatcaaaaaatcagattttaaaaattttttgcggcgcattttccaaaaaattgtaaaatagtgacattatgccataaaatttctaaattatgaggatttaggaaatcagaacaaaataagaacaatagcccaaaatcagaacatttctgataaatcagaacagatccgagccctgtttaaaatgtcaatatttgccaagaattattagaaagtaaatttacttcagttgcaactgccaggaaaaaaatttttttttttacttatttttggctgaaaattatgtcactattttgtcacttttttggcacttttcgtcactattttagtaactattttggaattttcgtcactaaaagttgcatccatatttatgagatatttgaatattttaaagtggtgcaagacttatttgtcactctgtaaaagcatcgtgtgtgagaatttccccactatttataggcaattctataacaacaaataaaggggaggtgctctgatttggtaaaaatggatttggtacaaatgttgaaatgatgagtagtataaaaggaagttggttcatcctttccggccattctattccaaataggcattaattaattcctgcgtattattgcggctgctgttctctgtccgtgccatcatcaaatcaaatcaacgaaagctgagccatcggaagtgtgcacaaatcgactaccaaacgaaactgggcaccacaaaacaacaaaatcatcatcagcagtaaaagtggtgcagaaggaaacgcatggaccaaatgtgagaaaagcggaaatttttttttgtttttgaaaatttaatttgttttgttttagcggcggcactttcagcgaccaaatttggctcgacacattggcgtggattggacgtggcgaggtcggatggcacttggcgctggtcaacgcccgcttcgccgccctggtgaacatgcagctgcagcagaggcggtggtgtttggaggagtttcacatcagtgagcggaagccgaaacggactggcgccgaagtgttgagcttggcaaacaacggctcctacttctcgttgccattggccacctcaccgttgccggacagtgtcatcggattcaacggcacattcaacatttggtcgccattcaatttttgaatttccaattgcattttgttcttccccattttgcaggtatttggacgcagaagtgatcaatttcctnngcacgattcggcgcctctttcacacgtacatctcgctgaaagtcaccattcc

SEQ ID NO: 6564 - DNA, 1637 bp, Heterodera glycines
tctcagtgtcaataaaatatttaaatttaattattttaaagcaatttttttaattgaatattaaataatattaaaaattttaaaataaaacaataatgtaatttcaaggttcaactttcttcaatatgttttttcttcaaagattctgctaaaaaaaatctttctttcgtaccagggatggcattccgaggccccaaaaattttcggaaatcggaattccgaggcccaaaaatttttcggaagtcggaaatcggaattccgtgccatccctggtatacactagcaggattagggctcgtttcggcgccaagccaaaaacttgaaaaatcaaacgaaccagaaatgttcgtatctgatttacctcacagttcgaccgacacgatttagccttcacgtttgggccccgcatgtttttttagctacaacttttttctttgccaaccaaatccaacactgttggtatcattcgatagcccttcagatgctctattagcctgcaaaatttcaataaatttcgtcagttttgaacaaatttatggccagaaaggttagaaaatttggttttttgaattcttctggccataacgtttttgaacttaaacaaaattttgaaaaatttttaggctaattgatgacaatcaggtctatcgaatgataccaacaaaatgctgatttggttgacaaataaaaaagttacagtaaaaaaaacccggagataactcatattaaatttaacagtcaaaattatgagtttcgtcagtttcttaattcttcacattaaaatttgtatccaaaatgttctcccactgtcagcaattgaatggtcatctttcgaagtgacaaatgagtggtcaacaagtacgaattggtctcaatttgcttgccattctccaaatagtcgtccattgtttttgcattgaaatgaccttccaaaaggccctggagagtgaaaaagtgccaacaatcaaaaactaattgctcaattaattaattaattaattaccctgatgaacaaaagaatgatcactgattgtgagccgaacacgagaaatgctcgatagataacacaaaagttgaccatcccatgggctgctccgtcgttgctagtcgacttcttcaacagactgaacttcttgccgagttcggcgtgcctttcccggtccccaaattgtgcccggccttggcccactttctcccccaattctctcagcaatttgatttcttggtcctcattttgctcctcctccgatcatcttggtcaaaagcttttctgatcagcatcaaaagttagcctagcaggaatttttttcagaattttatctcaataaaaaaattgagtttttagtgcataaatattttttgctccattactttttgttctactaaatagggagggggtcgtttgggtcatgaccgattttcacgtcaacaaagagggggttttgagaaaagaaaactggatttttcaaaaaaaaaaatttgctccaatatttttttgactgactgtatatttaagaaatcagagcaattttcgtcttataaaacaaatgaaagccctggtttaaaggccaactttgactcactcttactggctaacgaaatcagatgggtcggggaccccgatcgggtagtgatca

SEQ ID NO: 6565 - DNA, 882 bp, Heterodera glycines
aggaattagaatttttgtgaagggatggggcaaaatgggacaaaggggcaacccaactggcagaaatgggatttttaacaaaggacggcagacagacgcgggcctattatcaatttgaaattgcccgccggggaaaaggagaattacggggggagggggtgctcaaagaagggatcagaaatcaaaatacattaattatgggaaataaaaattcaataatcataattggtcgtctagttcacattatgttgtccgatgggctattctactaaaattgtattacatccatttttaccctagggaactcgttctatttatcgggtttatttcgttttcgtacagaacttattctccataataaacttgatgggtgattctctaactttcttgatcatagcggctcctatgcagtcactacatctttgctaccttgataatggtactgtcattctcgtatctatggcaaacatgatgtatattttttcgaaacataactatgaaggaacatgtttatccggatcataatgacatcattactctcgcttcagcccaacactcgatttcaccaattcagatagtgaagaattgtaagattctccaataagcaacaatcttctccccgcgcgttcccctatctcattaaaacatctgaccctacacgtttccctacccgacaacatgacatccccccccccccccaccagggctgggcgaaactcggcttagcactcgaagcgaagctcgaatcgaaacccaatttttttcgaaacacgaaactcgaaatttttgaaaaaaattttttcatcgcaaaatatattcaacacaaaaatttcgattaaatattaaatttaaagtcataaaaatgtaaattctgttaaaaag

SEQ ID NO: 6566 - DNA, 5762 bp, Heterodera glycines
  misc_feature (5651)..(5651): n is a, c, g, or t
tacctaatcgtagacatataaccaattacagttgccattttttccggataagatagccctgcaccggggagcatgcctataaaatttggcacgattttattgcttattgcaagagctacagccgaagaaaatttttttaatttaagcctaaactttttggcatgctgaaaaagcaattaaaaattttattcactccctttttgatagtaaaagcatcagagagccttatttaacttgtacataaaatttggtgcgtttaagagcactttctgaaaaaatatttatgaattaattttgcaagttaataataaacagtgaaaaactcagaatttctaaaaaaatttaaaaccaattacaattgtcattttttcaggttaagttagtcctataccggggagtatgcctataaaatttggtacgattttattgcttattgaaagagctagagccgaagaaaatttttttaatttaagcctaaactttttggcatgtttaaaaagcaaattaaaaattttattcatctccctttttgatagtaaaagcatcagagagccttatttaacttgtaaataacttggttgcgtttaagagcactttctgaaaaaatatttatgaattaattttgcaaaaaataaataaacagttaaaaactcatgtcgccaaagcgaccaaaaattgattaaccgatcaattttgttttgaaataatatttatttgtgatgattcatcccctctcccgcctcctccggggttcgcttataaaaggcagccctaacattcattcaaaaaatgtaaatgaataagcagttaatcgatattgttaagcaaaatttgtcccttttttcccattgcatttttatgttttaaatttaattttcaaataaatttggattagaatttccctttttgtaagggaattaaggaaagattctttttccttaaaaagcctttttggtttggtcgaacttctgtcttttctggacagaaattcttaaaacttccccagtcgttgggaagagcaaatttttgcggcctatttgccgacaaaattggagccccgtaggggtcggcttccagttgtaagcctaccctccaacccttaagccaaaagcaaatccaaagcgcagccgtagcgcttggatcaaacgcaacccaaaggggtatattgcgttttcctcaaacgtaagagcaatgagtgagctcctacgtatttccattgcaccaatggtggtgcgtctcaaaatgtatattgagacagcccaagaaaacttgggcaaagagctgacggaccaaagtgtccgtgcagacttaattgcagagagacaaaatctctgcaaaaccatttctcttttggagaaatacaatggaaaatgggaagccattttcttgagaataaagggaccagctcttcaggaggaagagcaaaactatagggactttaagccagaaggcaaagccttcatgcattgggtcgaccaagcccgagggcttgtcgacaccattgaaggggccttaggcctctcagagctgggggatgcaattccccagccaaaccagccagcacaattgtgcagcagcaacaacttgtgcatcagcgtcatgatgtgacgcttccgccaataacattgcccaagttctcgggggaaccccgagagtggcctttgttttggaagctctttgagacttccgttgaaagtcttcagattgaagactttaaaaagcatatttatttgctgggatgcctcccagagaagtcaattgctcggagagcaattgacttgtatccaccatcagatgaaaattatccaagggtagttgaaattctgaaaaagcggtctggggatgaaaaaacgatggtagagtccatccaagcggagttactccaccttcccaaaccagcagaatcagttcagtctctgagacaattctcagagtccattgaacggatttgccatcagttgttggactatggagaaaatgaacaaaataagttcatggcctccactattaagtccaaactgccttatcaccttctcacccaagtggtggagagggaaatgagggcaggaggtgcctttaattgcacagagctccgaagagctatcacctcaatcgttgaagtgaaagaagaagtacagagatgtactcaggttttccgtggagaggaaaaacctcgcaattttccccctcatccaatggggggaagagcccaccaagggagaggaacaccgttccgtttctcccagccgttcagacaagaacggcagtggaggccaatggaacgaaacgaaccggtgaggaggatgtctcctcaaccgaatcgttccttctcggccatcaacaaaccacagacccctatctcagatagggggtcaaaacgcttatgttccctttgtgaaacaaaggggcatgcaccgagcagatgcacaaaatacaccactccgggggcgcgaaggaagcgccttacggatcaagacaggtgtattaattgcctgatgatggggcataacaccaagaactgcacctcaccccgcaggtgcagtcattgtggtgaaagacaccactttatggtgtgttttggagaaaagtctcgagagggaacctctcgggtccaaccaaataatcagatgaaaagagaggcgagaaaatcctctcaaagtcatctgactatgagcgagcacgctcataaaagcgtgcccagttcggaatgctcacccatcactacaaatgtgatgacaagcgtgatggcgaaaaagcctcacgcatttctaatgaccagaaaaatactggtcagatccaaaaataatagaagagtttggatggaagttccattcctcttcgacccaggaagtcaaacttcctacgcctccgaccctctcatcgagaggctcaagccaccgaaagtgacttccgaagaaatggaagtctatggctttggaggagaaaggaatggaccaatgaggttccattctcccgtgtattccatccaaatcagaagaacggatggaaagtgggaagaaatcctcctaaataggacggagagaatttccacgccattcaaaatggcagaatggaattctgaggaattcccactcaaaggaatggacatggccgacgctatgagtttttctcgggaagagcccgaaatactcataggtgccagacatttctggcaattcttccaagggaaggaagaagtttctccagggttgtttgtaattcaaacaaccttgggccctttggttaacggagagtccgactttgggccggaacttccgaacccaggactatcaatgatggccattgatgagtccaatcaagggcaaatgccaacagttaaagaaattgaatatttctttaatttggagtcattggggattaaagacgatccaaatgaaaatgacgaccaaacagcaatgagcctatttaacaagtccatccgtcgagaaaaagacggaaggtactctgttaagtggccatggaaggaggaggtgcctgacctcccttccaattaccgcatgccttttcaaggctaatgtctacttttggtaagctttgtaattctccagacttaatggagcaatacgatgctaccattagagaccaattgcaaaaggggataatcgaagaggccaggaaagcccctggcactcttgagcattatatccctcatcagggagtccttgccaaaggcaagaaattgcgcgtcgtttacgacgccagtgctcacaccagaggaacaaacagtctcaatgcctgtttgtatagaggcccggtaatactgccggatctcataggaatgcttatgcgattccgatgtccaagattccctctcctctccgacatccaagcagcatttttgcaaattgctttggaaccggaggatagggaagtcaccaaattcctctgggtgaaggatgtcagtaaaccactgacaccagcaaatctgatcacttaccgattttgccgagtggcattcggagtgatcagttctcccttcattttggctgcgactttgcagcaccatttgaagggataccattctccagtggccaacgaattggcccaatcattgtatgtggataacactcttcttgagtgtgaatccacagaagaggctctgcataaatatgcagagtctaaagccattcttaaagaaggacacttcaacctaagggaatttgttacaaattccccagaggtaatgaaggcgattcctgaggaggatcgcttgaacaagcccaaggtaaaagtccttgggctcatttgggacacagacaaagacgaaattgtctttgagttcccaactcatggcttagaaaagctggcaacacgccgtcttgttctaagcttcctcgcctcattatttgaccctcttggtctaatggggccgtgcattcagcccttaaagcttttcttccaaaactctttgggaagaaaagaaaggctgggatgatgttctttctgagaaagaacaaattcaatgggcctccttccaagaaaattggaaggatcagaccctcaaaatcccacgcagagcaatgctacaagggaatccatcccttgaattgcatgcttttgtggatgcttccatacacacatttgcagctgctatttatctaagagcagtaaaagataaccaaatatcagtttggcttatcttctccaaaaataggctcaagcctaaaaatgcttcaaaagcattaacaatccctagaatggaactcatggccattctaatagggattcgcggtcttaaatttgtcgccgatcaaattcggcgacccatttctgaactccatctttggggcgattcacaaatcgctctaagttggattgcttcaaaggaagcacagctcattgagagacgagttaaggaaattcgtactctcaatgaatgcgcctttcactttgtccgaacagccgaaaatccggcggacattgcaaccagaggcgcaaaaccaggagaacttaaggataagtctctctggtggaatggtccttcctggcttaaggaagaccatgaccaatggcctaaagaaatggaatttcaaataaaagatcctccagaaaatctggaggaagggtctctggataacgaagagaaagttttcttcgttaataccagaacagaggaactgattgatagtcctctgattgaccccaaaagattcagctcttggacaaagattgtccaagtgactctttttgtgttaagatttctccgtctgaaattaattcagaggggaaatcctcatcaacttttcgagagtcatcgaaaagaaatcgccaaagtgtccgaaaaaggaccattttcagcagaagatgttctcctagcagagaaccttctgatccgcatggatcagatgaaaaaggctgaagattccctcagctatccttctcttaaggatagcgaggggattttgaggcttaaaaccaggttgggacggtgtgaccaaccttttggttttagccatccaatcattctcggaggacaatcctccatccgagacttgatcatcttaaaatgccaccagaaaaggcatcattttggggtggaaggcacactcactgagttcttactcgggtattggacacctcgagcaagaactaaggtcaaaaaagcactgaaaggatgccttcggtgcaanaggatgcaggcataccagtttgcattgccaaaaatgcctcctttacctgacgagcgagtatgccgtcaggctcctttcaagcatcggcatggactttctcggtcaccgaaa

SEQ ID NO: 6567 - DNA, 997 bp, Heterodera glycines
attgtatatattatgaaaaattttaaaagtttttaaatactatgaatatctgaagaaaaaaaaacactaaacattggtggggcatgaaagcgtttggcaattggcaatttgatttcgagatttcgaattattaaatttcccaaaaaatcaatgaaaatatgaaattctcttccattcttgggcctgatcagttgggctagttttgtaggcacaaaaagcacgaaattggcacctaaaaggaaagaaaaaactgtaaataaataaaaagtgtccgtaagaaagtggccaaatcgaattcaaatagtccaaagttggccaaaaaaatgcgtaaataggttttatttaattaattttttctaattagaaaacttttatgagcacgtcaataataattggacattgcaatttttttaaaatcaaattcacaactcaatggaaaaagctaaaaattctttggacacttttttggataaaaagtcttaagccttgacttttttatttttaaaaattttctttgtaagtgtttatttgctgctacttttcttggatgcaaatgatttcgtcgtcagcagccaaagaaaattcaaaatattctttcttcttcgcagataaatgagtataaattaaatttttgtgccaaaaactcaaaatctttgtaaagagaaacttaaatatttacaataaaattaatttttttttcttttggtttttagtcaacaaccaaaatgctacaaattttcacaaataaatcattcaaattgagcataggaattttatgcttgaaaatttctcttcctcttttctctcaattttccactctcttctccaccttctgccctcccccgccccccggggccagtcccaaagccatttgtctatttcagtcccgggtctgtatctcttcagggattggtttccgcaaaaaaattctttcggattcctccattaccgaccgagagatatcgattggtatatatattttgaccattttcggctc

SEQ ID NO: 6568 - DNA, 6005 bp, Heterodera glycines
  misc_feature (5983)..(5983): n is a, c, g, or t
taaagcagggctcggatctgttcttatttctaagaaatgttctgattttgggctattgttcttattttgttcttatttcttaaaattattcaaaaagcttgaaattttatggcagaatttcaatattttatcaagaaaatataagatttgaggcaaaatttggtcatttttggacaaaatctgttaacaaatcgaataaaaatttaaaaaattttcccggcggcgcatatcggcaccgccggaccccctcccctcgcccattcaccaaaagttttttggaaaatgcgccgcaaaaaaagagtttaaaaatctgattttttgattccgaatgcactgaaatttacgatttgcttaatttctcaccaaaattgttaaaagcgattaatgggaggtgaaaatataatatttaatacatttttgatcgaataaattgtaaaaataactgatttgaagcattttacgaaatttatattgtttaaagtttaaaaataagtgattttaaaatgaaataagaagacaaaaaataaaaaaattttctacattaaccattttgttaaatatttctcagttacaaaacgatagtgcttaaatgatcggtcatcaaatcttcgagctaaaaaaagttttgaaataaaatttaaaaaagtttttctttcttatcgaacctgaaattatgaataaaaattatatctctgaattggtttatttttaattactaattaaaaaaattaaaatttagtagcgaaaaaaataaaaatgaacttctaatttttcttacatgtattaaacaatcagcatagcctggaattttgataaaaatgggtaacggaatttatgcttggaaatagattttgccgagacgtaatttcgccaccgaaatttctttaaaaaatttttcaaatttagaaactttcaagaaaaaacttagaagctttttttaatgtaaaattatttaaaaaactaataaaattatttatttttttaatatttgtacttctttctttgtctgctggtcattattttcattctccacgtcactgtttcttccatcacttttgatggcaactcgtcgccttttttggtattttctggcgatttatttcctttggcaccagcggattcggaataatttgttgcaaaaataaaatcaaaataaaatatgtatatggaaaacatttctgcgattttccttaatttaataaattttcataaaatatgactaaattattgtttgaaattgaaatattttatatgcagatttatgacaattttgttcacatgcaacccaatgattgaaaatgtatattttgctgccatcaataaggaaattgtcatatttttctattttccattcgaattttatcaatctgattttacagtataatacaattggtaccgtatctgtacaaattggtacttttacagcttcaactttggcatcgtatgcttcatttttggttcttttttgatctctgccgaacgattataaaatgttgtaattccgctcaattaaattatctgaatatttatttttgaatgaactggattaaagaacagacaactttttagctagcttaaatttaacttaatttgaagaaattttgtgaaattttaccctcaattggaaaaaaaattgcatattttcaacttttataacgttttttttgaagtttttttttgttttggaattttatgcgattttagttgtgtaatggtgaatatctttaaaatgaaaattaattttatcatttatttataaattaaaaattactttaaatgtgccgcaattaattttccaaaaaaaatactttctccgcttttataaaatttaatttccattatattccgccaggcaaaagtttttggttccaattacttaatttttatccaaaacgacataattttgagattttgagccaatttttaaacagttagtttttaattttccttttattcttttaatggtttacaacacttatcatattaaaaagttcaaaaagaaagttttttcttgaatttgacaattttctatttaattaggttaagcgctatattaagaggaaattggaatataaccaatagcataatttagaattgccttttcatacgaaattttttttcaaattattttaaatatttatttaatattttaataaaattttggagaaaaatatttgttttgtttttttgtttcttctattcaaacatggcttgacatttggatccaacatttgagaaccggacatttggaggtcacgcttggaaaagaattgccaattcaaaaggcacctcataaaaattatcaaatataatattaaaaaaagacaaaaatttttcaaacaagcgaaaggaaacctgagtgataaaatgcattattttatattttagtactaaaaaattattttattacccaaacattttgacgcatttctaaatttataaaaaattatttaattcacgaaattccttaaaaaatgatttttataacaattaaaaaactgtgaaaaaaggaagatctaagaaaaaacacacaaacattggcgtgggagtgaaagcgtttggcaattggcaaaatgccgaggctgggcttgtaatgaattaaaatatcaattttatgggatagagatggctaaaaaagagtaatcacttttataatattttgtaaagaaaatgaaaatgcaaatgaaatgtagcaaaagaaaaaaagccaaatggaaaattgattatgtccaaattgagggaaaattaacaaaaaaaaaagaatttaatgttattaaaaaatctttattgtatatattttctataaatttctatatattcttaataatattataccgttatagactatatttggtctatcaattcttataattgtttttcgtttctccattttgcagtatatttatgatttcagagcgcaaattttgaaaatgatttggcgccgagaactttatacttcagcagaaggaattttataaattttaaaattactttaaaatttcatttagacttgctagaagctatctgtctcaagtgtagaaaagtctaatttgtcatactttttttaaattattttcttagagggaaaaaataccctcaactagattaaaattttatgatctacatataattaaaatattcaaaaataaattttgtgtaaaatcaaaaagcattgaaattattattaattttttgatattcgagttgatagggactgggccgagtcgggaattcctcgggcttcctaagtaaaaaaaaatatatatgtattttagggagaaatttttgggaatattttcagatttttttttgctgtcgattcttacaattagtggtttatgcagaaaaccagaatgtcgcccttcaattattatataatttcttatttttaaataaaatgttaaatttttagttatattatacattaatttttgtggctccataacttttttatttttcgtctcacaccgctaatattaaaaaatcagaatagaagtcgatcctgttctatccaacaataccaaattcattcccaatttttgactaacaattcgcgaggtacccttgtaagtcgatattcggacttttaaatctgttaaatccattgcgttttaaattttaacggaaaataaaattttggtgcaaaatttatataacattctaagtattaatagaacactccataatactaaaatatgaaaaaatattttttgttttttaaattatgacctttcctacagcaagaaagttaaatttttaaaattttttcgttaattttttttacatcgaaatgaataacaatatttttaagtatattttttaatatatagaatatgactaatttttaaatcatttttaaaattattagtgtaggcatttttctgaaatgctttgttgcatttaattataatttttctactttattttttcacacaaaaatagattttattttaactctttctcttttgctgctgatgttatgagaaaaatttgttaaaattttttggtattactaaaatattgttaaaaatttaaataacttaattttacattcttaaatttgtgatgtattatttgaaattgatttccttgtttgttagtcttttcttataatgtaaaatattttattttgatttggtttatttttcaaagaaaatctttttaaaaattagtgaaaaaattttgatgatatgtgttttttatcattttttatttatatttttacgctaatttttttctatttgatttgcagacttttgaatttattctttacaagaatatttaaatcttctttttaatattatattgaacatcatttaaaccagggcttcgatctcaaaattttgaaaattttcatttcagccataaaaaatcctcatttgccactaaaatacctcaaaaaaatcctaatttggcatgaaaaatcctcatttctataaacatcaaaaattacgaaaaaaagtcagttaactgtcatatttttcgtttgaaacaatcacggcgcctatcagcgccgccggacatattttttcttaaaaaaattggcataaaatcgcaaaattggtaatttttggtaaaatcaaaactaatcttatttaaaaactccaaaaaaaaaataattcgattttttttgatttaataaattgacaatctgttgaatttgtttgcttttaaattgctctttttgtggcgcagtttttccaaaaaaatttttggtgacattgtggagagggggtccggcagcgccggaaaaaatttgggattttgagtgcgttttgttaacagattttgtcaaaaaaaatgattttgaccccctctatcgaattcctctttattttttttgaacaaaattatctaaaggaaattaattaaaatttattgaaaaatgaggatttttcgaaaaaaaaagtttaagatttgaagaaaaagttcgaacattttgccaaatatgcctaatttttcaaaaaatcatgcttttttgtcattttttttatcaaaagaccacaaaaatcctcaaatttctcaaaagaccacaaaaataaaatcctcgtttttcaaaaaaatcctccttgaccttctaaaagaccacaaaatgaggaaaaatcctcacatgtcgaagccctgatttaaacattgtattactaaattaatttttcgaacaaaaaatttttcaaaagaaaattcaatttatcaatctgtttgccattttttgtttcataaaaactttaagattaatgtagaactgcattttttctccagtataatattttccaataaatattttaaaagaaactttattaacttttttcatttttaactaatacatttatttaattttgacagtcatttttttattgaacattatttatttctctcgtaatttaaattattaaaaatttgaaagatacttttacttttctttaattttatataactttgatcaggtttatttatattttcatttttttaatgataattagtttgaaattgtcttgtccagtgagacagacacatctttaatttcggataccagaaaataaatattaaatgtaataacgattaaattatttcgctattaattcacaataagcgttttcatattttattgaaacattaataattaaattaatttaaattacaacgtttattgctttgaaatttactttttttacagaataataaatatataaattaattctgaattttataaatatttttcaagttaactttttcgagattgaatattgtataagcggcgcaagtgtcccggcgcaaaagtcggcttaccacaaccgcattagaaactgctttaatatgtaaattcagggttacgattaatccttgaatggcaagaacgtcctggaaattaggccctctcacttgaaaatttgaaaatattcttgaatttaaggtgtccttgaaaaggaacagtcgaaagaaaataaattcaaaagtttacaaaggaagaaaacttttataccanaattttaaattaaattatgaca

SEQ ID NO: 6569 - DNA, 2709 bp, Heterodera glycines
  misc_feature (2580)..(2580): n is a, c, g, or t
  misc_feature (2593)..(2593): n is a, c, g, or t
  misc_feature (2624)..(2624): n is a, c, g, or t
  misc_feature (2641)..(2642): n is a, c, g, or t
  misc_feature (2653)..(2653): n is a, c, g, or t
  misc_feature (2669)..(2669): n is a, c, g, or t
  misc_feature (2671)..(2671): n is a, c, g, or t
  misc_feature (2673)..(2673): n is a, c, g, or t
  misc_feature (2675)..(2675): n is a, c, g, or t
tctgcgagaaattttatgaaatttaatcaatttgttaacagattttgtctaaagttgaccaaatgacgcagtttttgactcaatttctacaggattattaagtaaaagcctattcggcggtgccgataggcgccgcaggaaaatttcacaaattttgaatgaaatttgcgatgaaaaatgagttaactttaattaaatttattatttaatttatttaaaaatatttggcattctgtcttagaaaaattttcaaaaaaatcaataaaatcccgcataatcccgcacaaaaaatcaaatttgcggatcccgctgcgggattgtaattcaaaattattttcgggacgggattccgctggattaatcccgcaaatcccgcattttccaaaaaatgcgggattgcgcactgggattccgcaaaatcccgcgcgggatcccgtcccgcgccggtctctactaaaaactgccaagatagttagtttttaggttctaaaaacctccaaaataggtgctaaaatgggtaataagtgccaaaaagttccaaatttagggcgtgtaaaatcgtaaaattttatacaaaaaggcaaaaaaattaacaatttagtattgagacacataatctttattattctagtataaaaaaataaaaaataaattttggagctaaatgccgaagtattgaccaaaatattgaatcgtccaaaatatttagcaaatttattcattaattacagttgaaaatagttaatcgggattttgaatgcagttttccaaaataatgaattaaaaaatcaaaaattttgatcaacgaaaaaaaaatttagggcggaacccgtcagctggcccctcacgcttgggccccaccatgcttttccactatagctttcttctttgtatccaaatccaacattggtggtatcattcgaaagctcttctcatgttctattagccttacaaaaagcgaaaagttttcaagtttggaaaaaatttgttaagaaaatttcaatatttcgacttttacgcaattttcatgtataacttttttgatatttgtctaatcgcgaagcaatactttagaaaaagcctctaaacatgataagtagagcccggaattttgaaatggccgggaccggggccgggacttggaaaattgacccgggcgagaccccgggaccgggactcccgtttttccgggactcctggtcccaatttagggcccggggccccgctgggaccgggactttttcaaaatttttaaaattttgattaaaaattcgaaaattttttttataattttatattttagcttagaattatatcaagcctataaatcggcctcttctgcttttcaattatcatccaacaaaattaaatcagtatttgtagtccaacattgggatggccttgttcaaaaatatcaacatttctgcggttttcggctttaatctcgaacgtcgataatcataaacaggctaaattcatatttggactttccattttctttacattctcggcactccgccattttgccatcctttgatttttcaaatagacctatttcgagattgatgcattcatttctaaaaaattttattgattaaattttctaaattctttgggaaataaaggttcgggccataaagaattttcgaggttttacaaaatctaggtatgttgaattaaattctacaaattttcaaaaatctaaagtcatatcttgaaattttgaattaaagacatttcgccaaatgttattaaatttttcaaattttgggcagtttcgctggtgaaatttaagcccgttttagcccggtcaaaatgaccgggcccgggctcgggccgggcccccgggcccgtccggtctctaacagattcacaccaaaaaatgacaaagttttgccatttaaaaaaatatatgacgccaaaaatgtgttcgcgtcaaaaaactttcatttttaatttaattctcatctcaacttattagttttctttttaatgaatttgaaaatttggtagtgggatttctttattttctagctaatgagaaaatccctgaacctgctccagaaatcccgtttatttttataaatgttataaataattaaaacttttaagtaaatttagataacggaaaatgaaacagaatttgtcagtattaagcctattattatttgttcaaatatttgcatcaaatctctctgataaaggtattttatatggctattagcatacgtttatattattttcttattctgcacttatcgtttaggcacatttgtgaatggaaaaaatggaggtgagaaaatatttctgaaattaaaacgtaattaatctggtcattgatttaatttccattcagcaggcgttgattatttccaagtcaaatacgaagaaattgaacaaaaaattgcccaactgcaaaagcacaatgtaaggattaaatatgaatgtttaaattatttttgtgtaaaatcaatgcgctaatatttgaacaaacaaaaataattttattcaccatttagaacgaatcggacgccaaattaaacaaaatcgaaaatgaattggtaattaattatagcttanaatggattattanaacaatagaatatttttcagcgacaacttanacaagcgataattcttnncaacgctgctntaaatctgctccaccnantngntgattttttttcgcacagtggcttttccctgaat

SEQ ID NO: 6570 - DNA, 1903 bp, Heterodera glycines
atcccaaccttccccctccccctttggtcccccctatgcaaaggctggttgaggttgaccacatcctatggattggggctttgcagtgtttgctttgctccagaggaaatgaaaattttattaaaattccgaggaaaattgaattttttataaatttactttcattctaaaaaattcctttctaatatgtagagaggagagtaggaatctaagaaattgtggacaaacttaaaaagctgaaagtcggcctttggtattggaagccgatgctgatttgaatttgatatcattaggcatttacagtaccatttcgattggaatttggacaaaatccgacgacaccttttacaaatattcaaacaatggcttcattttcggacacagtgccactggcttgggcggatatccatcttttgcagagggcgacacaatcggatgcggcgccaatttaacatcgatggaaatcatttacaccaaaaatggacaaaaattgagtgagcaaatattaatttatcatgaaattaagcagatgaagactatttttagacacctcaaatttattcgtttttgacaacgaattgcttccatttgtacaagttaatacgcttggtgatgtgattgaagcggatttcggacctgtctttgagtacaagaatgtttcggatttgttcgctacacaaattacctaatttactaaaaaggaaaggaaacagagaagagaaaacttacaaaattaatttttgcttttgtttttaattgtatatacatttaatttactttatttcacacgcattttaaaatttatatattgtttctgcataaaataaatacatatttttcgaaaagataaaaaatgaatcaattatgaaattcaggaaatataattttctgaaaaatttacatttttactttttttatctcgggggaggaggggatgcggtgcttttttgtctttactgcatttttgaaaaaagccaaaattggcattaagaacaaaatagccgaaataggcaaaaaaaacaggcattacaactcaaaagtcagccaaatgatctgctgaagctgaaaacttggataatcagtatccgttacaaaaatagttgaacattcaacactacaaaaatagttggcgttgtcgtgccaattgcctgtgccatctccgaagctttcgtgtccgctaccgaccgagtttttaagctggcggtgctgagtgactaattttctttttataagcaattagtcaacgtgaaattcatttgcaaatttaaaattagttaatttcggtgtgtgatgatctgatgatgatggccaatttttcggtaaatttctaaatcagctaattcctttccaaagggttcaaaattttggtatttgcagctgttcggcatcacgcgagttgctttgaacaaacagaaatcgccattaataaaaattcattaatttattgtgcaaacaaaattcaaaaaatgtccatttatgggataaattggttcttttataaatgggagattaaattatgtcatttaatttcattatttcactgatttgcccattacttttcttaatgaactcctcatttgtcatctgctgctgcttccacaactttgtgttgttccttcttttgagttgtgttgtgccacatgcttttgcttgttgtcctcatggaaatctcagagtgaaaggcaagaaatgacaagtcaataatttttttaaaatatttcccgggcagatcccaattagctctttggagattcattgtttaacttttcacaattctcgaaattgaaaagccaatcgaatttgtcaaataaaactcaataattaccaaaattatgtttttcgctttttgagctgttatttcatatataatttgtttaattacctcaaaaggtgcatagttttt

SEQ ID NO: 6571 - DNA, 3446 bp, Heterodera glycines
aagaagggaaagtcaaggagactagccactaggacatttgcacaatgtcattgtcacctttaaagaatatatattaatatattttttaactttttccctttaactctaatttttcacaaggaccccccattcttaccagtgcttgtttttcccggttgccctaccgggaccgggacctgagcttttcaaaatccgggaccgggaccttggatgaccgggaattcccggcccggttccggtcccattttccatattcctatggcgttaaatttaagcaaaaaatagtcgaaattttaataaaatcgaatcgaatgtccgtccatcaaatggcgaatcaattaatcaattttcagtgttttcttcggttagccgacttttgcgccgcgccatttgtgccgcgacacttgcgccgcctaacaaaaacgacatttgcgccgtacagcgaaaaaagacatttgcgctctgattaaaataaatttatgtgctttatagaataagaattgatagatattcattattaattcctttttcgaagcctttcatgtcaattccatattgaagtgcacgtaatgattgatcaaatcttgatcattttggttttcattgggaccatatgcgataacaagccttcgtattgcctgatcattaagcggcggattttaagcgaaaaaaaaggtaaataaatgagggcataaaaattgcgaaataatgcgaaaaatggtaaaataggagcgaaaatttgaaaatcagtacgttttttcaatgaaattaaattaaaatcgatgaaaataacttattgagaaaattaattacaaaggaattgaatttcattcctttttcgaagcaaaaaaataattggggtttctacagaaaattctttttttcagttttttgttagtttgtattcttaatcattttttcatatctttgatgaacctattcaatgttaagattttaatggttaaaaaattgaatgtcaatctttgtgactagtaattttttcgaattttcaattagttatttttgtcgatggcttatagttttagtaaaacttattgataatagtggaatttttatgaatataatatttttgacagcgcggcgcaaaagtccatttttgctgggcggcgcaaatgtcgcggcgcaaatggcgcggcgcaagtgtcgactttgctgagcggcgcaagtgtccacttttgctgtgcggcgcaaatggcgcggcgcaaatgtctcatcacggttgtttaatactcaccagaagacaccacgaggggtgttcagccaatgacgaaaattataattcatccgcctcattttaatccaatcttatgaaaagttaccaaattcggtccctagcattttctggcactccccacggcgaatataaaaaaaagtgttaaatctctgtccccaaaaggtccgtgctccgttagctgtggaccagggcggctatttgtcaaatccagaacaggttttgtccactgatcacgttgacagaaaataaagagccaattttcaaggagtatgcgaaggtgaagagcgtagtccaagcagcaatcgacaaatgcatgtgagaattaaggggggcgagaaatccatttaacgagaaacgagaccgagaaatggagagagagagcaagagagagagagagagttaaagagagagagaccgagaaatgaccctgaaaagtgccaaaaatcacaataacaaaaatataagcgagaccacgaaaatcccgagaaactctcggagaattaattctctcccccatccacctgtgttatgctgaagagcaatctctttaaacgaatttttacaattttgaattgggacaaaccctcaagatatgtgctgattgattggcattacacgagcagtgagaaatatacggacaaagcgaaggagttcttcggcagaattagcactctgtgcgctggcaaatgcaactgtttgtacgaaacatggaacgaacccatacaaaacgattggtcctcgcagttgaagccgtaccacgaggagctggttaaagtgagattttaaaatagccatttaatgggtgttggcggaaaagtgattgatcaggaccatgttttggaggttctcatttttaggtagcaccgtaataattagatctaagccattgagacagtatattttttatcattggaaatcaacgtttttccctcaggtgattcggcagaatgacaagaacggagtgataatcgctggaacgccaaattatgaccaggatgtgaaggcggtagtcaatgacccaatcaaagagcacaatataatgtaataaataccgaataaatgatagtgggggagggggggggatggtgggccaatatttatccgaatacgaggatttgatatcctacacctcttccccgccgcacaaaaggtacacattgcatttgtacgcggcatcgcataagcaagaactgcgcaacacggcacaacaggcaatcgacgcgggagtgccgttgtttgtcacggagtatggcacaagttcgtacacaggcgatggcgggccagaccttgtcgaaacacagaattggtaattttccagggaccctatttcgaaaagtataaatgtttacaaattagagagggctttgaacgaattggaatatcgaccttttgtttcaaaggtacgactttttcaacaaaaactccctctcgtacatcaactgggccatcgacgataagcaggaagcgtcggcagcgctgcagaacacacagcccccagtcgggccggccgacgtgtgcagcaccgatcggctgaccaaatcgggcaaatttgtgcacgaccacctcatcggtgtaaaccagaagccggatggctgttaaacatcagacaaatggcaaatgatcggaatcgcgcgctcttttttttacttttctgggtcatttcatctttagcattaaaccaaaacaaaggcgttgagatagagaatagaagcctgtctaccttgctgatgagagcaacatacattttagtgatgctcgagagtatcgactcggcccattaatttagattttggctctaattcgcgcgagtttcggtctcgatttccgagcaaatcccttactataacatggtgacaactgacattccaaaattcatactggcacgactcacgtcaaaaatttttttttttggggggggggtattataattcagaggagagttcaaattctgtaaatacggtattcaaatttaattacgataattctgaatataatatatttattatataattaatatttaaaatatcgaataaaaaggaatactataaaaatattgcgtcttcgaccgaaaagcgaatcacgtctaaacgaaaatttcggtttcgaatcttgaacccgactaaattgattcgagttcccggtcccggcttctcgggtcccggcgagtcccggtcccggttttgcccaaaat

SEQ ID NO: 6572 - DNA, 2487 bp, Heterodera glycines
attgatttgtcattactacattagataattatgctatttttcttacgatgattttatttattttaattaaaactcattttattacaattcatattaatcttttatttatttaatcattttatttaattttattgtttgaatggtcgttcatgatcaaattttagtaacccattattttatatagactgtcttaaagtggtatttcattcaacggtttagaacattattatttttttttgcaaaaatatagacgaattttggtcataagatttttgcacaatttggtatctttttccaaaattttactattttagaggcgtattttccaaaaatttcaaaattttccatccttaagcgtgcttttttcgggtttttgtgaaaatacagaaatatagatgtaacatatggaaaatggacaaatatataaaatatgaataaatatggaaataaaaaggaaccatagatgcaccaaaccaagctaaaaataattcttacttgattgattttgaggccgaaataagtaaagcaaaaaatatgaaaatccatacaaatctggcccaattataagaatgcacaatgaacaagcattcattcaattatttgtgtctaatattcgataagtaaacgttcaattatttgtgtctaatattcgataagtaaacattcaattatttgtgtctaatattcgataagtaaacattcaattatttgtgtctaatattcgataagtaaacgttcaattatttgtgtctaatattcgataaataaacattcaattatttgtgtctaatattcgataaataaacattcaattatttgtgtctaatattcgataaataaacgttcaattatttgtgtctaatattcgataagtaaacattcaattatttgtgtctaatattcgataagtaacattcaattatttgtgtctaatattcgataagtaaacgttcaattatttgtgtctaatattcgataaataaacattcaattatttgtgtctaatattcgataagtaaaaattgtttttcttaaggacattttcaatttttgatttttcattttaatttcggatcgtggtaaagtggtacttctgctattaatattaaaatgtatatttttattaaatacaacatatttcttaaaataaagggtcgtctaagaagtggggagatctcctaaaaaacttttctgttgatttttttatttggaatacataaaatacaacaaaatgctgaaaaaaaaaattaattttcacttgttttcggctaatttagagtcagttttcgtgggtttaatcggtttataatgacgtcggattttgtgttataaaaacacaacttgattttttctacttaaatggtttaacttaatttcttttctcttttttgtaaaaggctttctaagaatttttggaagcaaaatcaatttttacctatgtgcctccatgcctctgtaaccggggggggggggggggcaaggggggcaactgccgcctccccctgagatgaaaatcgatatttttttaaatttacctaattttattaacaatttgagccaaaattttctaagttttccccagcggcgcctaacggcaccgccgagtctcaatttccttatagccaaaatttagtctcaaagtggccaaaatttggctaaatttcctgttaaaaaaacactggcaaaaattttgtgccggaaaagcaaaaaaataaataaattgttccattatcgcctaatcctttcccttcctttccttaagtcgaaaaatatgatgttatcaaattggggtggacagtgcacaaaaatatttataatttgtatgagtacttgggcaatagttgggtaattataaatcaatcaaatgttttttttttattattttagattgcagcgccctaaacgcctttgaacaaacttttatcagtcccaggtccataactcggtccaaagtagtttccgccaataaattctctttgattcatgcattacagaccgagaggcgtggaatgatatatcatttgtgagatttggtttggtacaagttttctagactttttcccataacctaaaagtaccccatctatgaaccttcccaacttaaaatcagtcggttatttttttaatttttaaaaaatactgaaatgtaaaaatcccttttcaagatggggttccattctgctggtgaagactgtgctcgggttggcatggaactccttccccgacttgtacaaaaacctaatggaattgaaagtcttccaaacggctgccatttttgaagtgagttttctcagtgaaagtgtgaggtttggtggaactggtccgcttttgggagttctgtccgcttttcacagtgattttggccaccaatatttcatttgttcaaagattgttcacaatattgtcggtttggtccgttcgctggtgttcaacaccattgtccaggttagcttagcagcacttacctataaatgccaagatttgatt

SEQ ID NO: 6573 - DNA, 2200 bp, Heterodera glycines
taattctgcacatcatcaagccaaatcaaggcatatttgcaaaatcttgaagccaaatcaaggcataattctgcaagcctaattttggcacttcaaaagcctgggcggctttcatcggacatcgacaaaaactgatcacctgggtggtgtaagttccgctgggtgcggtttctcatcaacaaaaactgatcacctggggggtgtaaagttccgctgggtgcggtttaatcaacaatcaaaatggacgcacaacaacttcagcaaattttggacgcggctctaaaaaaatcagcagaagtttttgccgccgcactcaacattcaaaatcaaaacccaaacccagggtcatccacaacggcatcacttgcggcatcaatcaatgcccgcctcgaaaaattcaattataatccggaggttggacagacatacgatgcttggttgaatcgatacggaaaaatcgttcaacaagacggcgcttcgctcccagagcagtccaaagtccaacttttggtcggaaaattagacgaggaggaatacaaacggtacgttgacagcattgcccctaaagccaccgaacaattcaactggctcgaaaccgtggcaaatctgaaaaagatttttggtgagacgaggtcgctcttcctccgccgtttcgactgttttcaaattcgccaaagccaaaaccaagacctttcgagtcttttggcacaaatcaattcatcgtgtgaaaacgccgaattagatttgaagaaagaagagctaaagtgcatgattctcatcatctctttacgcgacgaattttcggatttgaaacagcgatgtcttcagcgaatggaagaagcccgaaccaatgggaaaagcatcaccctgcaggaattgggcgaagaatgcaaaaagtaccaaattttgaaggaaagcacattggcactcagcacaaaacagtacaatgccaatgccattcgtgccaagccacaacaagtaaaggacaaggcagacgcaacaaagcaatatgccaaaccaaaagcggttccaaaaccgtatgagagcaagcacaaattgccaaaccgtccatgccaatcatgcggaagcacaaatcattggcgctccgattgtgggcacagagatgccaaatgcccaaaatgtggtaaaatcggacatctcggcaaagtttgtcgaagcaattcttcaattcgccacatccaaacggtgaatacaactgaaaggcatgcacaaatcaacacagtcatcatcgacttaaattgcatggaaatcaacgcagaccatccaaaatggtggaaaataccaatcaaagtgaatggcgcagattatccaatgcatgtcgattccggtgcacaaatcacattgttcacaatccaaacatggattcaaatgggcaaaccgcctttgacgtcagcaaatattcgcgtcaaaaattgcaatgaccaaacatttgcaattaatggacaattcatgtgcaaagtgcaatacatggatcgtccaccaatgaaattgttggcatatgtgagccccgaaatcagtcataatttattgggcatgccatggatagaagctttggaggtgatcccaaaagagattatgcatccaaatcttcatccaaaaatcaatacaatttcaacgaaaaccaacgaaatcaaagacacggagacattaatttcggcgctcaaatcaacccactccgatgtcttcagcccagaattaggtcattgcaccaaattcaaggccaatctcattctgaaaaacggtgcaaagcctatctattgcaaggcaagaccagttccacatggcgctttggacgacgtaaatgccgaaattgaccgtctattgaaaatggaggcaataaaacccattgaatttagccattgggccgcgccaattctggcagttaaaaaaaggaatggcagaacacgcgtgtgtatcgatttttccacgggattaaacgacgcacttgagctacaccgccatccgctgccacgtccagaggacatttacaatgcaatcgcaggctctaaatatttctcacgcctcgatttgcgcgacgcttatctgcaattggaattgtctgatgagtctaaaaagctgtgtacaatcaacacacaccgcggactcttccatgtcagcgttaccgttcggcgtaaatcagcgcccgcatttttcaaagtttgatgaacaaatcattaca

SEQ ID NO: 6574 - DNA, 2037 bp, Heterodera glycines
attaaaaattaattagtttattcaaattttacgttatgtgcacagtgtgtgttccggcagtggctgggttgaaagtgaccagaaatttggcggttccgctttcgatttggctgacatgtgatgggattataatgccgtcgtggtcctggcaaaaaaaaataaattaattaatattttagagttaaataaatagaaagtggtgtatttgttaattaataatttttattatcgttaagattggttgccacaaaaacatattatttttattttttaaagtttttacaacttcaaaataatttcattttttggtgtattgtaaaaatggtttatcaattaattaattatttttaataataaatgtgtaaagtctattcaaatttgttttaaattatgaaatttctaattaatatattggaaatagaattattttttgtgcaaaatatttgaaatatttctcaacaattcctccacctttatggccatctccaagtttccaaatccggccctgccagcgtccacagtaaattccaccgtatcattgacagtcgcttcggtgacaatgtcttccaccacaatttggccagcatcataaacccgaattgggaacggagtttggggatggggctaaacattttaaaaatttattaaatttaatctaaaaattatttccaaaatgccaccatgttgttcacgaacaccaacactttgtgcgttccgacctgaaaatgacacatttgttcagaaaccttttaaattttttgaaataaaaattcgtcatttaaatagtttcttggtataattcggtgtttaaatgttctataacaattttgaaaaacaacaaataaattttttctttggttttaccagtacaaaaacacttctggcggaatttaaatgacctaaaaccaattctttccaaataatgaaatattaaatgtcttaaatatggcacatttttatggttccatttttaaaatttgtgtttaagttccaattgacaaatgcccattttcacctccgttggtttgaagctgatctcccacgttttgctgcccgtcttgcggagtcggtgaacaatctcaacggcttgcggttgtgctgcagttggttctgccacgcgttgttcgcctgcaatttgagcgctggcggcactcgtggcgggaggagttacaagcaaaaatggcaaatttattaattaaatttttaaattaattatttgtttaaattaccactcgcaaaacgtcttctttgcccaacttgagcccgtccagcttcacctccacctctttaccacgacggacgacctgagaaaaagagacaaaatattttccaatttttattccaattaaataattgttcaaattaattgttattataattaaataattattccttttaaatgaaaattatttcgcttttctcaccgaatgtttgctgctcagtttcgattttccccactcaaaaacgccgtccgttttgtctttgccccggaatttcaagctcagtcgcggcgttgtcgcttttgaagaatgccttgaactaaaaattgaatattatgattaattgctatatttttaaaatttttccgctaacctcgaatgtttcataaacattgtaattaatgaaattattatttattattttttaatttctccacttgcctcggtgtttccgactcagcctcgtgatccgttgttgtggctgagcctcgtccttcgactggtgaaggtaacgtttcctgaattttggtgtgattgaggggggaggggagcagttcacgcgatacaaccatttccccaattgagaaagttttcacaaaaaattaatacaataattataaagataaaaagtgaaaaaaaaaagtatttgaacattaagtcaaatggattgggctttccttttgagacaaacggtgaaaagttattatggtcatacatgaaaaaggggaaaaagggggggggggtcaaccgaaatttttgcgaaggggtccagccatgcaatttgacgacctttttgtttttttttgccttttaaaat

SEQ ID NO: 6575 - DNA, 1428 bp, Heterodera glycines
tttcttgtacaatttctcttgtgaaaattttaagggttaagtgaatggataccatgcataattagtaggtaattaattaattaattaattgctttttgttgtttttggctgtgtgtggttgaactttttctgctgtgacgacggatttggaaaggaaacacaaaagtgaatatgaaatgaatgtgacaaagatgatacagtatgacaaccatatgatgacaaataaatacgcggtggtgcgcaaagcaaaaataaatttaaatgacgacgacgataatgatgatgatgatgaaattaaaataggatttgtgttgcagggatgggaaagccaatgcgaaaaaaaattcggaaattggaatttctgggcttcaaaaacgagcaaaattgttggtgtgccgactccaaaaatgccggaaattttattggtccctaagaatttgatgggtttccgtgtgaaatttttcaataaattggcaaaatttggaaactttttggaaatttaaacaaacaattttagcacctttttttgaaaatttgcccccaaaaaggcagaaatagtcgtttaaaaaatgtttttgactactgacgacacattggttcaaaaccaaatccatcaagaattatttcaaaaaatataataatccatctccaattatgaataaaaatgaatgctctattttaactgctctctttttgaattgaattaaaatttaaaaaatttttgtctaaaaatccctctctttccacgcatttagccttgctggcccgtccgtggtgcggacccgaaaagccgaaatgcgtgccgaacgggtggtgacgatggcggcggcaccgaaccaccattaccaacccaataatgccacggacgatgatgaagcggtggatgccgacccggatgttgccggctcactgagccaacgcgcggcggagattgagaagcggcgcgagtggcgccatgcccgcctgcgctccatggacgtggaatcgaagcggaccgatgagctggtgcgcatgattaccgccgcagcagcggccgccggtgcagcgggcaccgcttccggcggcaacggtgccgcgacggacagtaacaagaacaacaacaatggcaccggaagtgccacagcaacaacaacaacaacgagggcattggcaaatggaggcggaggaggagcagtgaactttggcaccaccgcgccaacgtcgacaccgacagtaaacccatcctcaaacaacagcaacagtacaccgtccccgattccaattgcaccctaatttgatcactaaatgcctattaatgctcgtcccgcaaccgggcgaccatgttgcagtgcaagtcgaacagctccaggctgacgagacagtccatttttgggcggctgcaaaaaaataaacgctttttttcaatggaaaattccgggaaaaataata

SEQ ID NO: 6576 - DNA, 2615 bp, Heterodera glycines
  misc_feature (51)..(51): n is a, c, g, or t
  misc_feature (2512)..(2512): n is a, c, g, or t
ccataaattcactgaaaattatatgtgcgatggatttacatataaaaaatngatagacctaattattaatttaagctatcaaaatttttggttgccttttaaatatttatttttatatttttaaatttaaaaaaatgaaattacagtgcagcaaattgggtcacttcacgaaaagcacagtttccattcatttggatagttatactgataactttttcgtcaacaacaaaaaattcgtcaaagatttccatgctttaaatgtatttctgcagaaaaaatcgaaactatttttattaaatccaaagacaaacaggtgaccgagacgaacgagtaacaagaacagcaacaatggcaccggaagtgccacagcaacaacaacaacaacgagggcattggcaaatggaggcggaggaggagcagtgactttggcaccaccgcgccaacgtcgacaccgacagtaaacccatcctcaaacaacagcaacagtacaccgtccccgattccaattgcaccctaatttgatcattaaatgcctattaatgctcgtccggcaaccgggcgaccatgttgcagtgcaagtcgaacagctccaggctgacgagacagtccattttgggcggctgcaaaaaataaacgcttttttcaatggaaaattcgggaaaaataatatgaaaaaaaattaaattaaattcgaacatcgagaaactgtaaaaaaaaaagattggaattccagggaaattttttgaaaattttgttgcaaaaatttcgagtttttccctttaagagggagaagatgggtgaaagaccatcgacaagaattttttgataatgtttagggttaataagtgccatgccacgccgagggaatattcccttaaattcgggatattgcccaacaattttatgcaaaaaaatgtaaaattaagcaatttttaatgcgggaaaagtttttttttcaattttaaccgttaaaagaattgtatgaaattcaaaaatttgcccgttttttgggtttcattggcgctgtacaacattcttccccatgaactgctccctctctatgacaacagcaatttatcattttatagcgtcttctccttagctcaatgtgatgatgaaaattcatgaattgacaattttgaaagattttttggaccaaatatcgaaacccttttccacctaacggtaagcaatttggtgggtttagggcattagaaaaaataaatatttttcgtgcccacttttttgccaattcaatcggcaccaatgccaatgccatcgtcggcgttgttcaacaatgacatcaattcgggcgttgaaaggtgcgccgtttgagcaccgaacggagtggccgactctcctctaccggtggcacagtgccagtaataccgccaggggcggtgccagaaatagtggcatttgccggtgattggctggatagcgtaaagccagcagtttttccggaataggtgccaactacgtgcgggcattttttaaattttttcggaatgatctaactctgtccttcgtaaccaacttattcctcgaataaaaaattttttagcaatttcccaaatataccgtaatacaaatattttttaaaaataatagcgtaatacaaatattttttaaaaataataccgtaacctctatattacattataccaaacggtaccggagtgatggatttttggtccaattttttaatgatttttgttcgagaaacccgctccggatgtgtaattcccgagttcgaatgatcctgatccagattttggctcaaaatcattttattcataattggagatggattattatattttttgaagggcagttaaaatagagcattcattttattcataattggagatggattattatattttttgaaataattcttgatggatttggttttgaaccaatgtgtcgtcagtagtcaaaaacattttttaaacgactatttctgcctttttgggggcaaattttcaaaaaaaaatgataagcaaagggtccgatgatgccgttaagctcccatgaaattcttttaaaataattttaatgcaatttgttaagaaaattgtttgtttaaatttccaaaaaagtttccaaattttgccaatttattgaaaaatttcacacggaaacccatcaaattcttagggaccaataaaaaatctttcaatttaaatttaaattttgccaatgctggaaggaatttccataaaaataaatataattttataaagtaaaacttaaatgtttaaaataagtacaagaaaatgcgatggaaaaaattttaaaaaattagacgtgcgttcgcgcggactcgaactttcatatatttaattgactgctaaagcgctaccgactgcgctattttgcacgacagaaaaagtgaatttaatatcccttttcaatgatacttaatagtgtaacgaaaacaaaaataattgtatttaattaattgtttcttgtacaattttttctgttaaaattttaagggtcaaaattntattatttaagtttttcgttttaatttcaatattttgaggaaagacatcaaaaaaaaaagaagtgaaaatgcaaaaagaattaatatttttttacgagaaaaa

SEQ ID NO: 6577 - DNA, 2266 bp, Heterodera glycines
  misc_feature (2236)..(2236): n is a, c, g, or t
agggcacatttttaattcgtactttaaaatggtgaaagtaaacatttaaaggtaaacatatgctttggaattgcagcaaatttaatgaaaaaaaaattgaacatttgattaaaagtgattggagaagaataggagcaatttttgatcgaaaaaatgggggggggggtaagaaattacaacacaaaacattaattaataagtgaatgaatgcatgcataattagtaggtaattaattaattgctttatgaatgtgacgatgatttaaaataagtacaagaaaatgcgatggaaaaaatttaaaaaaatttgccgtgcgtccgagcggactcgaacttctatgtaatttcctggcagaggctatgcgctaccgactgcgctattttgcacgacagaaaaagtgaatttaatatcccttttcaatgatacttaatagtgtaacgaaaacaaaaataattgtatttaattaattgtttcttgtacaatttttcttgttaaaattttaagggtcaaaattttattatttaggtttttcgttttaatttcaatattttgaggaagacaatcaaaaaaaaaagagttgaaaatgcaaaaagaaattaatatttttttacgagaaaaacaaattggtaaaaactagaaaaaaaaactaaaaaaagattttaatttaaaattcgttggaggggaaatatttcggcttttcgggtccgcaccacggacgggccagcaaggctaaatgcgtggaaagagagggatttttagacaaaaattttttaaattttaattcaattcaaaaagagagcagttaaaatagagcattcattttattcataattggagatggattattatattttttgaaataattcttgatggatttggttttgaaccaatgtgtcgtcagtagtcaaaaacattttttaaacgactatttctgcctttttgggggcaaattttcaaaaaaaggtgctaagccgagagtccgatgatgccgttaagctcccatgaaattcttttaaaataattttaatgcaatttgttaagaaaattgtttgtttaaatttccaaaaaagtttccaaattttgccaatttattgcaaaaatttcacacggaaacccatcaaattcttagggaccaataaaaaatctttcaatttaaatttaaattttgccaatgctggaaggaatttccataaaaataaatataattttataaagtaaaacttaaatgtttaaaataagtacaagaaaatgcgatggaaaaaatttaaaaaaattcgcgtgcgttcgcgcggactcgaactttcatatatttaattgactgctaaagcgctaccgactgcgctaatttgcacgacagattaagctaatttaatatcccttttcaatgatatttaatagtgtaacgaaaaaaaaaattgtatttaattaattgtttcttgtacaatttttatgctggaaggaatttccataaaaataaatataattttataaagaaaaacttaaatgtttaaaataagtacaagaaaatgcgatggaaaaaatttaaaaaatttgccatgcgttcgagcggactcgaacttactgagttggtaatggtggttcggtgccgccgccgtcgtcaccaccagttcggcacgcatttcggcttttcgggtccgcaccacggacgggccagcaaggctaaatgcgtggaaagagagggatttttagacaaaattttttttaattttaattcaattcaaaaagagagcagttaaaatagagcattcatttttattcataattggagatggattattatattttttgaaataattcttgatggatttggttttgaaccaatgtgtcgtcagtagttaaaaacattttttaaacgactatttctgcctttttgggggcaaattttcaaaaaaaaggtgctaagccgagagtccgatgatgccgttaagctcccatgaaattcttttaaaataattttaatgtaatttgttaagaaaattgtttgtttaaatttccaaaaaagtttccaaatgttgccaatttattgcaaaaatttcacacggaaacccatcaaattcttaaggaccaataaaaaatctttaaatttaaatttaaattttgccaatgctggaaggaatttccataaaaataaatataattttataaagaaaaacttaaatgtttaaaataagtacaagaaaatgcgatgaaaaaatttaaaaaatttgccgtgcngtcgagcggactcgaacttccatgtaattt

SEQ ID NO: 6578 - DNA, 1231 bp, Heterodera glycines
ggaagcgctgaatttggcatatcgcgaatcatacgtattcaaggtgaaccaatgggggcataaaacggggtaagagatgagccagggataaagccgaataaattaatgggacactcagccaaaagggattaacgaattaacgggattccgaggggacaaagccgggcttggcaattgcactaatttgtaagttataatggttgatccccaaaagttccgcgatcgcgtcggagtgcgcttctcctgcgaaattaaactttgcatgaaggcggaggacggatgtgctgacattaccgtaaccaaagaagcacaaagctacagtgtgttctaatacagtaaatcccctgcacagcctccgaactgccaggaaagcagcagcaaaagttacccggcagaacattacaaacactcgcgagacgacccattggggggaggggccaatcggacgaaaggaacggcacagaaaagggttagcggaattggcatcgaacagcgattggactgatccctcccctccccggacagagccgccgatcgatcaggacggtcgatgcagatttgatttctcaatatgtgttcgttctggacgaacccgttgagggtgaagaagacgacgacgacggagagcgcaacggcgccgttgcggcagcaaaagcgggcgttggcacagcgcctgggaaattgcgtggtgagtgttttgtcggagcattctttggtctctttttgtcgaaaacttcgcaaatactttttgttttatgcacgattcttttaatacatcccccaattctcaggtcgaacaacaaacaatgagttgacttcctccatttgcatcaacttcgccctgttcgtcgccgttctgttcgttgtgctcgtctctttcggcttggccattgcagtcgttggccattcgttgttccaacgctccaagtctgtctctgtccatttgtctgtctgtctctgtccatttgtctgtctgtctctgtccatttgtctgtctgtctctgtccatttgtcggtactaattcagtttgtatcccgggtttgggtcaaattttttcaaagtgtagccagacaggcagacagagcactatttccttcttttcttcaacatagctacaggggagaaagaagaaacagtgaactgtctgaccaaaactgggatactaactgaattaatacccatttgtctgcatgtctctgtccatttgtctgtctgtgtctgggcatttgt

SEQ ID NO: 6579 - DNA, 3580 bp, Heterodera glycines
cgatggttcgtcttccccaatcgcttttgttcaacgtacgatgaaaagcatttaatgcaaaacaattttcattcttttcgctccatcggctgccttttttcgggtgccccccccccaaaaaaaattcattcacttttctttcgctttttccaaattgacgaatctctccctgaattgctttactcatttttgttaattgttcgcaagtgctttaactcttttcgatgctttcagtcatttaaaatttatacaataattttaatttcgtaatttaaatataacaatttcttttgttttttttttgcataataaataatctatttttgttcatcataatcataattatcatctttgggttgtattttgttggatttgatttctttgcttctgtggtttcaatgctggcgaatgttcactgccctccccctctccccctcaatccttccccttggccagtctcttccatccgagtgatcattcgtccctttctctcccttccccttggctcttcaactctcccctctcctcctcattggcattcgtccggcacacagctcactgttgtccgtccgtccgccaatgtccgccttcccaatgagcacccgcgcaccattccctttgccgtttcaattgggcaacactttttcgtctcgtcgcacttttccgccgccgttttggcgctgtgcccatcttctgaatgggatcaacttttgcagtttacttttctctgatcaatcggtgccttcgctgctccgttctgtgcgttctgtggcgcggtggggcgttccgaagaaagtgatcgctttcttctgttgatggtcataatcccgctgctcgccactaaatgataaaattccaaaaccatttgcaaggccttttatcggctgattatcctaagcttttgcctgtcttcctccgatgccatcgctgggccgttaaagcgtttggccacttcgaaattgggcgcgactgccatggccacgtcctccgttgggtgtggtgcctttttttgcccgtcgtccccgtccccgcgttttcccttccccgcttcgtctttgccgcataactctctctcaatctccacacactcttccccgtccccttcatcctcttccgctccattttccgtgcagtttttcttcctccaccgctctccgccgatgcattgactccacgccaaaacattgggcgactccgtcggcacgtcgtgaagccgaacgcgagctgaggagcacaaaacgatgcaaaattggaagaggaacactaattacccggcagttggaagcacggcggcatttccatataatcgaccatttcgcgcctctccgccgcgtacaaattcggacgagagaggcgcgtgaagcgactcagaaaacagttttgggaagtccagtcgaagaagaagctggccgaagcgcagttaaagcccagttcgttctgttgattacgtatacatataattgtattttttagtttgagtaccgtagaagaattatctggtacagtacccacttttacctttgcccttatgcatttcctcacacattccagctgactgttcgccgtttgtaccgtgccgccgtcagttgcccggcgcgggtccaaatggtgttgagggatacggtggatgacgtcatcacagcccagggccaattcattgcctaattaattaattaattaggtttgagtttgatgaacaaaaaaacacttacgaggaatgcaaattttctcgaagtaaagcgaatccggattgggcacgtattgaagggcgccgtttggagagatggagtccgagagaaattcacagcgaccgttttgacgatggaaagtggcggaacggcacggggacggaagacgacgcccatccaaaaactaaaaagggggcgaagggggaataatggcaaaattaatttaaaaaagaaaaataataatttaaatgacaaaaaaagaaaagggaatttcatttaaaattatcaaattattaaaaaatcaccgcattttgttgacaaatgtgcagacaaacatctgccgagtcgactttcgctcttccgcttggcctttgtccgttcactgcgattccgtcgatcagttgcacgcgcgcacgcgcgccgtccgcgggacagtccgagttttgatcagttgcaattccaatggcgccggcgggggacaactgaattggctaattaattggtcaaaggaccctgctaattggtcaattttgccaattaccgttgtttccctttcggccattccgtttcccaccgttttctctcctcggctgctaccgtagttgccttttccaccgtgcttatggcccgacgacaatactgtagaggagtggaagggctccaatgattcgcccgaccattttcgggtgggcgtcggcgcagtgagcggaggcggcggaggcggaagcggcgccggcaattggttgtcctccgcagcagaagccgaagttgggtcggctgtctcctcactttggtcatcggccgacaaaaacggatcggacgaaggcgacgaagaagcggccgaagaaaaagcgcaagcggagtcaaagccaacgaaaacagagccggaaaagggctcaagggatggcacgcaagcggaggcaaaaacgggcgaatggggtgccattctgagcacaaaacataaacgggagaagtgaggggggcatactgtgccaacgtgttgacgccagcggccattgtctgactttggtggtccaaagggacgccgctctgcaaaaagaaacgcttgcggcgtcggcgttggcttttgcctttcgctgcgcttttcccccgccgttttgccactttttggttccattgctctgctgttaaattggatttgtttacgccaaaagtcaattcataacagaaccttccgcgtaattttggcctctgtttggactcaacgaatgttcgaataaatcgcaaacactgccagtcgagtcgaattggaagctgcgacagcgcggcctcgcatttgaacagtgcctaaaccgactttggcattttcacttttttcttttaatcgccttgcctttggcattcgctttcgtcgcttggcgttctccgctcaaaaggaaatgcgcaactgaggcgtgtgtctgcgtagcgcctcgtgcaggacgagtccgaattggcggaagcagctgtatgggtggcggacgaggccatggccattgagcgcgccttcgccgcgtaagggacggcgggttgggcagggtaagaggggtaaacgtaggcaggggaagaaggtggggcaaagggtacggcaccgccgccatcgccacaacctccgggcatgcagcagccgccgccgccacaacccccgccgggggacattagcggaaagcagccttacaaattaggggagggtgagggggaaagcatgcttaatagcagcaaaaagtggaacggaatggcacctttgacgacggaagcaaaaagcaatgccaacgcggcaaaaagcgactgaatgccaaagagggcgttcaaggaatggaatgccattcagaaaaatgaaaaggcaaatgaatggtggacaaaacgaaaaagcctaaaaggcatttaaaatt

SEQ ID NO: 6580 - DNA, 475 bp, Heterodera glycines
tttttggccgatctcagtacaaaaatgaaaattaaaattcgatttgtcggtaactttcacagaagttcaataaatattattttgtactaatctttgtcctcatttcacttcgtttctgctcgaaattcgctgttccttccgcgccgttttttccgcgtgttgcatttccctgtgggcacgcaacgcttctcgcggtggtgaagccggcgtcgcagtcgacgcaaacgtgcggacgggccaactgcgccacgtgctgctgcagccaatgggtctgaacggccgggggagcggtgggaggcaattcgaaagcgaagcgaaagccgcgctttggcatttggaaatttaatcattgatcgactgacttggagagcttggacatccgccaactgagcaccgcaaaattggcaattcagaagagaagggacggacgaagaagacaaagtgttagcggaaggaggggacactttgtcagcag

SEQ ID NO: 6581 - DNA, 1124 bp, Heterodera glycines
gtttcagcgacagggccaacggcgaaatggtcgagaaaagcgttggcggtggcatttgtggtcggagtgggcggcaaaatggttggacttggcatcgccgcgggataatcagtcgccgtagggtgggaggagacactcgccgcggatgaacaaccgctgatggacgttgttgtcgacactgtgccagcagtggccgtctcaagtccaagctgttcacgcatttttgccagcaattctgcaactagctaggtgggattggtttccacaatttcctaattatccttcctatttgcttttattgatttcgttggcttttcctctgattcccccattgattttgccattacgctttgtggagtgcagcgctttctcacagtccccggcatcgatgctgcccaatgctttggagtgctccttggccaacagatggtttgcctcctccggcaatttgccaaggctgaccagtgttttgacgtggttttttgagcgcaaatgtttggccaaaacgccgtgcgatcggaagcccaaattgcaatcggtgcacagaaagttgcggtggtgggcgtgcgcaggcgcggaaccgccaggggcggcagtggcgacggaaggagggagcataagcgaagcggaaggggacgcggtggagcaaagtaacagtgagggatccgccgtttgtgagttggccacggatggggccacatggggctgaaggggcggcacacggcacggcactgcgctcactgtaaagcataatgtcaataatgttgtcctgcaccggcagcactcgccttcgtccgatgcgacagcctttaccccgtggacactctccgaatgccgtgccaaaagtgccttcgatcgcacgacggcagagcaatcgccgcattgaaaggcgccgcccgcgcccttttgacgcgccaccgccgcattttgttcgataaaatgcgtttgcttgtgcagagacagttccgactctttgcggaatttacgaccgcacaaagaacacaaaaattgttgcgcatcagtggccaaaaaagcgctgagggtcgactgaccgcgaagcaacgaatctttgggaatgaattggttaattaggcaattaacgagcaaattgcttaaccgtaatt

SEQ ID NO: 6582 - DNA, 1288 bp, Heterodera glycines
agtggacaaaatgttgattgctttaatttgtaaagagaaaaatttggcgaatccaaattatggtgatcaattataattaacgagaaatatattgcttaatcatttgccatcattttgtaaaccttaatttggaataaacaaaaaatgcaatatgatgaataatttttatattcgaaaattatatttttgaacacttcagcttttcggttgattaattatgcttgtaattaataaatgcttttttataacataaaaaaaagtgtaattataaatttatattcgcataaaattattttttagtttttgattttttcagcttggaatttatgttaaaattttgacaaattcgtattatagaaaatacgctttaaataaaattccatgaaatgaattcttatttcgcaacaatttataccgtaatataagtgaaaattttatagtaaaaacatgaaattttatagttttttgcttgttttatgaatccaatcaaaaacatgtgtcggttcgaattaattatctctccaatcaaattcattcaatgctcattcttcacattcacttagcattcacttttcttttttttcttttccgctcttcttcattaatttagtcgtgcgatcatctaagttatttgaagtcaataaatagcaaatttaatttattttggcttaattttacaacaaaaaagcttttcggatttttgctgatcgaaacaaaatttattaaaaagattcgatttctaattttaaatcgttcggtgacagaagaattatataatattttgagtttaaaacggctttaaaattttattttgcgagttttattcgaaaacagaaaaacaatttttgtaaattcatattttcaatttttttaatgcgtttgttctaacattaaaaatagctttttatggttggcttcaagtgctgctcgagcattttttggtctcgagtcgtcactcgagaaaagactcggactttttgaatctcgataccgaatgtccgggttgattctcgaaacaaagtcttagtgattgattatcatgatgctcttattttaaataaagctttagtcattatcatggtactcagtagttagtctcggtctcgagagttagtctcagtttgagtctgggtaagtctcggtctcgaagagcacttgttggctgatacctttttttgctttgttgcttttcgttcggctcatcgtttttgttgattttccatcattactattcccatctgattctccataatatgttttcgtatctgagtcaactttgggttttgcc

SEQ ID NO: 6583 - DNA, 2162 bp, Heterodera glycines
gagagtttgggcagtgatttggatgataattaattctgaccgtggccataaaggaaaagtttcccacggaaatcaaagttaaactctatgataagaaatgaaggaagggggccttggacgtccaaacaatggtgggaacggttagcccgggtggtaaaacttaaagaggcggtcatgcgccctgggaaaacattcccattcccaccccacactcgcctcccaaaccaccaccacgtccttctgagccagtcagacgagcttttccggtggtgggtgaggtaaaaaggaaaaacaccgacaaagaatgctcactttgtctcggggagggtcaccaaccctcgaattgtgtggtttaccggacggtggagcagagaaaagctcgacttttttatgtacgtcaggtccatggataaccccgccgacttgggcacccgggggctctctcccagtgaattgagtcactgtgatttgtggcattatggtccagaatggcttaaacgctctgaaagggaatggccaaacaagtaccgggaaataattctgccacccgaggtgaccaaggaccaggagaccgaacttgtccaaattgccgtcctcattttagagccacccatgtgtccttcagttcttaatccccgggactttgggagttggtcaaagtttttagcgtccacaacttttgtcttatttctcttgtttaaatttgttggtaaaagtgaagcagttaagcaaaaattttccttttttttctaaacttgagggggccgagccgtcgtcattggcggccagaacagtggcgaaaaattggatcataaaaagggaacaggcgttcatgtcccctgggggtgacacttatgtgggatatgacggactaatccgcctccgcacccgtctcacttatgcccataaatcggcacttccctaacacttttaccagtaggccaaagagtggaattagtgtttcatactccccacacactgcccatgggtagcttcgtgtcatccatcctccgttgtccggcagcaggctcttgtacgggctccttttgctcagaattggaaccccatcattcggtccccgaactcggcgcaaaatttcccggcttaaatttttgtcgcgaagcctccgggtttattcgtagagactgttttcacccgaatatgcctgccttttctacagggtgttcgctgaaccaatttccccatttgcctatgagttatttcaatgcccaatttggaaatttcacctattcggccagcagtctccccccactccccttcctcggaggcacatttattgccaatcagactcatgctgctttagtccctgaatggcactcacaccttagttgtccctcggcattgtcggccgaacgcttgagttgagctctctcccatgaagtgtgccattcgtgtcacacttatcatgaggcagcggttgtcaaatgcaggtgccaggaccacgacgtagaaagtgcccttagggacccattattaagactgcccaatcaatttggccaactccaggttttccacagggacgcaaaaatatgggtctccttcccatactccccgataaatttggttgtaaaaatggaccggatccacttggccattaaacattcacccacaaaatgtacagtgtcaccaggtcggcttttaggatgccacagttgtaggacaggcgggagatttagctattcatgtgcctcatctaatggagaatcatttgccagtattgtgtgtgtggatggtactatgtgggtaacacggtgtacacccaagggcctccctcactcagtggtcatttcctgggaccaccccgaagtcaaaaccaattgtcaagtcgattgcctcggggagaagacagcattcaaattagaagggactttaatgttttttttgataaaaggcgaagagtactcccccatcagtacggccaagggagggaagggcatttacaccggaggggtgaccttccctcagattcagttagcccttttccgatccgtgggatcgcttccacagatcctatttgacatcgtaatctacttggcatggcgcattctcctttttctcgccattcgatattgccccatagcagcattgacggtctgctgttgtccccaggcgtccttaggggctatttatggacagtgcag

SEQ ID NO: 6584 - DNA, 1291 bp, Heterodera glycines
tccccaggcgtccttaggggctattatggacagtgcagttagaaggcgctcaacgagggcgcgaaatagacgacaccatgcgggcacgatttgaaaaataccgctttccctctttcccctccccctccccttttttccctttttaagaattttcgataaattcgtacgcatattttagtctttgtcatttttagcaaacgagcaaattcgccccaattgacaccatgaacaacaacaacatcgcttcttaccctaatcaatcctttcctcttcccaacactcaaaccaacaatactttttagttgcgcaacaccctcttcctaacacggtcctttaggagtgaccgatcaacagccgcctatcaatgcccacttggccccaccccaaccgccaacccatcatgggcatgtgctggcacctccccaactgccagcacacaatggccagccgccattccatggccccgttttggggccccagcaattcgcccgaaacgcccttccggcgccccctaatcttaaccacccccataacagctaattgcctctgcagttccgcggggatgctctgccaccacaatcccgaagtgcccttccacccgttccgccggttttcactgctgacccagctaatcgccgtcagtggggatgcatgaatgaagctctctctgagctggtggcagagtcaaaacgtcagcgagcactgttggagagattggtttcggtcgttaccgccaaccaaataactaatcaggtcacggggcgttttaagcatgggaatgataagcgtcagcgtaagcgtcctcgtcgtcaccagggtccggccccaattcctcttagagacattaaaggtgtggccgttgggaacccccaagcaagttttgtgccaccaattggggttgtgaacaacccaatactggctgatgctacggtggctgctgctcctccggtggttcctccggtggttgagattgcgcctattcaaggatcgaaggacatggccagcacagcggtggagtcgcgccccgcgtctgtttaagctccccctcccccttttctttttggcggggaggccggggaggcttgtctccgacaaactatttaaaaattaaaataataaaaatcacaaaaaaaatattattaatgttaatccgtaaaatttggggagaaatttcaccataaacatttcgtgctaatcttcgggcttggcccacttcccctcccttttttccccagtaatcccccaagaaattcgccatctcaatgctatcacacaatctcggacggatttg

SEQ ID NO: 6585 - DNA, 2363 bp, Heterodera glycines
  misc_feature (2208)..(2208): n is a, c, g, or t
  misc_feature (2217)..(2217): n is a, c, g, or t
tctacgatgacttttataatgcctatttttgcctatttcggggtttttgtgcctaaagtgcctattttaggctttttgaaaaaagccataagaaaaatgcaataaaaacgaaaaacacacccctaagaaatgacgcaaaaaaaattttcagaaaatacacccttaagaattgaaaaaatttttcaaaaaattgttcccaaaattaaatattttttcttaataaaaattttttggtttaaaaatttgttcatattcgaaaaaaactttaaaatattttataatttcatttacaattgaaatatttaagttttaacgtgttttgttacctaaaaacgttaataaaaaattttatttgcctattttagcgcctatttgaggatttttgtgcctatttcgcgcatattttgtgcctaaaaaaggaagcctttttaggtgcctatttcgtgattttttgtgcctaaaaaaggaagccctactaataataagccttggttgatttttagtgataaatttaaaaataccattttttaagacaaattttaccttaaataaaatatgttttttttattggcgaatttatggaatgccaatgatggctgaatttcgaaacgactcagcaccgtaataacagcatatatcgtaataatcatatcactaattaacctgttgctccgcattaccccagccaaataaattactgttccagtcatttaccgtcctctgactgttttgctttttttgttgcagtttcttccatgctttgaccacttttgctacttttttttcactttgaagtattaattgtgcgtttaaaagtgcttcatcataattatctgaattcattccaccaaaaatatctttttcaaaatcatccaattcgcttccattctctgattcgtcctcagcatcggtttgcttaatatgaaaaatattaataatgttattttatagcataatcagcacaggcatattgctcatctggcttctggtatctcgctttctcgccttttttggggggttctcgttctcgcattttagcgcgaaatgcaacaattttatgtacttttatgaattgggactttgttctcgttctcgaattctcgttctcataatttatgcgtcttgcgagaattttatgatgtacaattatgaattgtgatcggaatgaaaaattaatgctagcctttttttttggggggcgggggttctcgttttcgcattttaccgcgaaaaacgagagttttatccactcttgagtcataatgaaaaattattttataaattgaaaaaaagtaaaaattttatgggtccttggaaaacaagcctattgttctgttgtgttttcagaaaaaaacttaaaaaaccaccaaattcttgagtattttaagtacaagcaattctcgctttttgctttcttgcatttccacctttttgtgcttctcgctttcggttttttgttgtgccgccgcagctcttgcacgctgctccgccgatttgctgctctccgccctgtctaggtgcggtctaccatatacggtaccactgtgtcctgctgggctaccaagagcgggaataccgtaacctgccgaactaccgctaccaacaataccaccaccaattttccatgcttgaaatcgttctttcacttttgctctactttcctcatcaagatcgtgcatcgcctgatgtttcagcccatacatacaaagttggagcgcagccgattcctcttcattgagaccacgaaactaataaaaatggattttaaatttgaaaaaaatactgcgaaaatttttcattaagagccaaaacatttttaaaaataaataaattcccatatgctaggcgggatcgattcgtaaaaagtgccaatattacagatttttgagaaattctcgccataactcagccaaattcaataatttggttctagtcggttttacgcttcctaagacattttacgcgtcccataacattttacgcgtcccaaaaacagtttgttttttgaaatggctactcgtacaattaaaaaaaatttaaaaattaagcctatgcttaggcctaagtctaaagcttagcctagtctaagtaagccattgtataagttgcttgtgtacgagttgtgataacatcttaggtttaacaatccgaaatttttagtaaaaactgagtaccgggcaataaaacatgtttcttcttagttattgngacggctanaatacgatggacatagaaaatgcacggaactagaatcaataattttggtatcattatgataattcttggattactctattagtgtaaaatttcagtaatttctttcattttcagaaatgcaaaaatgccataactttcaaaaaact

SEQ ID NO: 6586 - DNA, 704 bp, Heterodera glycines
cagggttgccagatgaaaattttaaaaagcctcattttgggtcaaaaagcctcatttttacaaaatttattcaaaacacgcttaaaattcaaaagtgttatatttttgattgtccatgatcaatttgatcattttgttgttagaaataagcattttgtgagattctgagcatgaaaaatcgaagttgatttttttgcggcgcttttccaaaaaacttggggaattgaggggccggtggcgccgataggcgccgtcgggaaaatttttgtaattttcaatgcgatttgttaacagatttgtccacaaaatggccaaattttgcaattttgagtaaaattgaaaaaaaaagaaaaaggatttttagggtacggcggtgtcaaaatggtctgacgtattcgaacacgacctgctcgctagcaatctttaacaaactttttttattcaggggccgccgaaaaacggtcttccctttgctaccttgtccccagtattcctagccttatttgccattcatagtcatgttgaacacctctttctctcctgttgttcgtgcctatgtgagcgaggctattcacaaaaaattatggtgcgtaaaaatccggactcaggtagttacagaaaaaacatctttaccaatataagtaatcataatcccaagattgacgataagctgtctctccactctctaaaagttgaaattccaa

SEQ ID NO: 6587 - DNA, 6134 bp, Heterodera glycines
cctttcatttttgctcttctttccttgttcctcatcctctcataattttgtcctccaatctgcttccctcctcatcctcctctccctcattctattttctcccactccccaaccattttgcccatgcccatacacccaaagtttaggctccaaactacaaatcactccccactaattacctaattaccctccacacccatgtacctcctacctataccgatgtacataaataattttgcctaattaccaaaatgtcatcatgacaggacacaaaacagcgccgccgccaacaaacagttagttaggaccccgcgggtcatccgtctccgtcaacatcaaccggtggctcactccgttacattcattaacctgttcctcctccacctcctcccctcctcttcctcctcctgccccctttcgtcatcatcaacatgtccccccatcggcaccacctccatggccccgcttcaaattcgtcctcccccgctgttgctgctgcgggtgcccatgttgaagttgttgtcgcccccggtcgtcttcggcccgccggcggtggcgttcctcacactgatccctttgtacgtcttcctccacctcctcttcctcctccctctgttcgtcttcctcccactccccctcctcctcctcctgctccctctgttcgtcttcgtcgtcttccgcgctctcttctgctgctgttcgtcttccttttccaccgtcctcgtcctcctcactcttcttctccgtcctcttcgtcttcgtcctccatcttttcacggtttgtcctcccctcctctctctttctcttccctcccctccccattcaccccactctctcttcgtttgtgttgtccccttgtgtatttctcgcacttgtctggtgtccgtccttgcccttttttgtacaaatttttaggtgcaacacttaattccccgcctcctcccccgcccatttcatcccccgaagggtttttcaaagaccgtaacttttttgtaggaatttcctccccgacccaaagcggggaatttgcgaatttttgtttgttgcattccaaatcagatgaaagggtctttttaaatggtttctaaaacttttttgcggaatttcttcctcaatccccgacttttttctccccgagggtcggagaggaaccctattttttggcgaacaaaatttgttaaagaaataggccagcgtcggggaaactttaaaaaaaaaaaattttttatcgagttttgtttaaaccagtgattgaattctgcactaaaatgccaaatttatttttaaacttcaaaattgtgataaaatatttatgtaaaggcttaatgatattttagccatttttgtacgtacaaaattggagaaatgagaataaaagaaactaaaagatggatgataggctgaaaagggcacattttttggatatggtaaagactaaagagcacaattttgcaaaacccggacacagaggacccgccgccggatttccgagacgaaccctgacagggtccctgatgaaaactcctgttttaacacgactccgggtcccgccgttccatttttcaaaaacacacaagggccccggacccggcggaccaggccattttcgcgccgcccgtttttgcgcgggtcaagttgttgaatgaactataactttttttttcattgtcaaccaaatccaatccaataatcttggtatcattcgaaagcactaagtgtcctctactgcaaaatttcgaaaaatttcgttaaggttcaaaaaagctatggccagaaaacttcaaaaactctggttttctaaacatttctggctataactttgttcaaacttgacaaaaatttttttgaaactttgcaggctagtagaggacatttaggactatcgaatgatgccaagaatgttggatttgggcgcccttagctcagtcggttagagagcactccacggtatggaaagggcatgggttcgaatcccaccgggcgaggtcacctttttacgttctacagtactcaatttgtccttatatttaatttgtcctttaatttgtactcagtttgtccctttcttcgctaaatttgtgctctttgtgccttgtgtcctttctctctccccacttttgtcgtcccgcccaaaaagtttgaaacagttaattcatttctcatttcatcaatttacaaatttccgccctcccccgcggcgttattttttttttttgggggaggacaaaaactacgacgttacgttttgttaaatcaatgcacctaccgtccaattcattataaaaattactcatttattctccattttttgccgggggttaaccaaattttcttttcttcctccacccacccaatggaatttcaaacatttaaaaattttaaaacggtaaattttttttaaaatttagtaataaattttgtctgggccacgaaaaatatgtatgtgatgccttcaatagggcaactcaactcgtacaaaaaaagaccaaaaaatattttaaaattttttgaatcttttaagaaaaaaaattaaaaatttttataaaattttataatccggttgtttttcaaaaaatcttttagtgttttttgatacatacaaattgccatggactcaaaaaatcgaattttagttcatggcccttgtgggcatacgggggataaaacttagaaatggattttggggattatgacaccgaattgacctaaatcatggctaaaaactaatgataaaaccaagaaatactgaaatggtttcgaaaaattttgaaaaatgggtaaaacttcttagaacaatgccttgctttttcgttcagaatgttcgactcgaccaatgcccgttggggccttttcattgcgtgccacccaatccggcacattctgatcagtttgctgtttgtcctcgccctgtccattcatctgatcaatttgcgaattggtaattttgccaatgggaccaatttgaatggcatttttagtgcaaaattttaaaacaaaaatttctttttccaccatagaatacgacattcgggcttcgttttcgcccaaaaattccaaggcaatgcggtacgtttttgattaggtattttttgcggatcaccgggaaaaattctcggcattttttgagtgctcgaaagtcttggccatgtgtgttttggcccgagaattttttcaggaaaatttgggttaacgaatttttggaaattttatgtattttaaacaagtttttttcgagaatcggtcaaaaaaaagtgtgcttttgtggccaaattctcgtgctccaaattcttagtctcgagtcacgcctcaaaaatggccactaattaatgataatttcccctgctttagtgaagaaagaatctatcaacaattctacaacctgagcaattcgccgctgcgctcgtaaattctctttttttattatcactgcatgatagaagaatgacaaatctctaatggatcattcattattgattgatcattacactgaggaatcagtgatcactgatcacttttgctcatagttcattgatcactatgttaggtcgttatcaaagacacggtcatttttcaaaagtctggtgatagatcattattaccaactgagggatcattatcaattattatcgatagaacatccattatgatagagaatattaatcaaaaatcactattggaacattattgatcactgcactgagggatcaaagatcacttaatatcaatcgatcatcgtttcctatttgatcatcaataaaagacatgatcattgatcgctgtactgagggagcagtgacaacttttttatcgacagatctttttggagtttgaaatgccataattgcctgtcgcaaatgccacacaaatgtttttttatttttgccagttttgtgcttttctcggcaaaggacggcggttccatgctgcgcccggcacatctgcgcgaggtgctttcattggatgccgaagtgaatggccaagtattgcgcagggacagcaacacggggtacaaactagcaaaatttgcacagattccgagtcgaaattttgaactcgagatctcgttatttcatttctgaaacgggttttttccagcatgcattagttttttgaaaatctaggtgttggtgttgaatttcacgaaaaatttgaagccccccccctcgctcgcaaagggcccagagagggggggggggagtggaaattttcttaacaaattcattaaaaagtccaaaaaattttcccggcgacgcctatcggcgtcacccaaccccaaaaatctcaatttttcttaaaaaaattgactcaaaatcgtaaaaattggccatttttggtgaagatctgttaacaaatcacaaaagcgtttttttaaaggttcgggaatacagactcgagaatctcggccgtattaggagattcctctcacccttccaaaagcaaaacttttttgtaaaaaaaaaaaaatcgaccctaaaacccgaaaatattcttacgcctgattttaattcaaccgtcatcgagactctcgagtttaattgattcattataatggctattacaataaataagcatcatattaatcataattgaattcatccctccacagaatgcgtgtctgtgacccgttgtgctcgctgaatgggccatttcatcttgttgcggtaagttaattacacatgcctgggcattttcatttatacaacaattattttcgtgattttgtccatttaattgtgattaatgccaaaaatgtgctaaaacccaaaaaattgccaaaaatgtgctaaaaatgcatgaaattgttcgggattataccgaattgttcgggatttcgaataccgaattgttcgggactcccaatcccgaaagttttctgatcacccttttggctttgaagccgactgatcagtcagagtgattggtcccttccagaaagcactgctcccttccaaccgatcactccaattggccgccaatttgtcatcgtcgtcgtcggcgccactgctgctcgactatccgatcgcttctttccatggcagtgatctgttcctgggtggccatattctgggcgttcaaactgccagtaggttccgtccgatcacttatcacgtgattttttcaacaatcagatttcgagcagtaaggcatacctaatcatttcttacagagctgatcgttcaccccgaaaattttagaaattcaattttattgcaatctagaaaattcagatgacgttttgaaaactctttgtaaaaatacaaaaaatttctcaatgataattgaaatccttaataaaaattaaataaaattctacataaaattttttaggaaatttttgaaatttaaataaatctttaaaaaattacaaaatttttcctagggaagaatgtaaagaagtgaggacagggggcttcttattttttgttttcctaccacatggcggtttttaggaaacgacctagcacctcttacagagctggtcgttcaccccgaaaattttagaaattcaaaattttcaacgattttttgagacctagaaaatttagattagtgaaaatatttcactgaaatctcttcctaaaaatacaaaaatttttcagagaaaattcaaattttcattataaaaaataaattaaattttacataattttattaggaaattttgaaattttcttttaaaaaaaatctttaaaaaatttataaaattttttcctagggaagaatgtaaaggagggaggacaggggcatgatcattctgcttccgttttctgatcacttcgatctgatcagcctttattacccttttttaaactctccgtttgttcgtctttttgatcacgtttgaattttcccacccttaacagatcacacttttgccaacaacaattcacgcattgtttccgctcaaaaggtatattcattcattattttgatgatctctgcttcaaattggcacacatccaattccccatttcacagatcattttgtggtatttcaatcgggcagacactgcggagaccaaaaagcgaatgcgagaggtgagagagagagaattaagagaaagagtgagagtaacggagagaatgagagaaaaggcgaatgcgagaggtgagagagaagagagagagagag

SEQ ID NO: 6588 - DNA, 6497 bp, Heterodera glycines
caatgaaaaatttaaggaaattttaaaagctaagaaaagaaaagcagtgcaatattaaaaagaaaagcaaacaaaaagccaagaaaaaataaatagaaattttaaagtcagaaaagaaaagctgcgcaatatttaaaaaaagcggaaagccaagaaaaaaataaatagaaatttttttaaagttaagaaaagaaaagcagcgcgatattaaaaagaaatgcaaacgaaaagccaagaaaaataaacagaaatttttctaaagttaagaaaagaaagctacgcaatattaaaaaaaaacaaattttctattttttttttacagcgaaaaattcaattgtcctttattttatggctcagcagctaccaaccgttttcggccaaatgccgccctttggccaagtcataatttaaaaatataaaaaaaactaataatttattattttaaaggttgcgcagttggtgcaacccatcctcgtcaacgcgtcccaccagcaaatggcggtgcttacttgtttttttttgtcttttttttaaattttgccttttcaggagcctttctgtgcggacggcacgaacaaccttcaatttttgaatggctgcgtttctgcattgggtcagccattgccgtaagtttaagtttcaaatctagaattaaattgtgcgcgagtattttttagtccgctgtgcctgatcgtcgtgtcgattgaccaccgtccagcgcagccgacgccagctggcccacttgccgtgaccaactgtgtgcttcgcacgggtgacggccaccgcgttgaggcctcgggatggcaggcgcacgcaggcgcgttggcagcattgtgtgttggcaccgcctactggttcaccaactgcgtgacccgtgccaaataccagcgactggactgctggtaccgcattggggttggaggccccaatgcgcttgtggtgccgcacgtggccccagaggtaagttttttttttaatttttaaattgatatttttttatgaaacttgtgtttaagtctccggcaaacattccaccaatggtgcccgttcaagttggcgcagggcgcgatgcggtccgtgtgccaacaaacgtgaccaatgccgttgatgaacgcgcggatctggacaacaataacaatgtgaggaaatgatcttttaattacgatttgtgtaatttgttgctttatgaagaataaacttttggtctcaggaaaatgttggtcttgagccacgtccgagtcgttgtgcgagtcgtactgctggtgcgcgatcaacacaaagacgtgctgctgaaccggttcgtttgagggtccgattcgatttgtcccctgatgtcgaagaaattaggggggtggaaagacaaaaaccatatcccgcccataaaattcgtttgctgcccaattttgacatttcacccattcatattgaaaaattccttgactgcccaatttgcatgtgctcctttgtgattggggagggggccacttctctccattgttttcacattttccatacttcttgtattgtcccctggctgagaatcagccgtagctgccccgtttgtaaatttgatttgccttgaataaatttttttcattgtaatgcttttcaaggctggccgccaaattggcgagtgcttcgtcattgagcgctcaacagccatgcggaacgtgccacgcaacacacgtggagagatttgtgaactacgcttcctgccgctggaggaagcgcagcggcccgatcttttgatggaggccatcatccagcaactcctcgaccgtgtgctggctggtcacccgcgcccatcgatggtcggactgcagctccacccgccgggatttgatcgcccatatgtcatcgggcttcgtccgccagagcaaaacaacgcagcggcattggcggcagctatcgagcggctcaatgagcagtcggcagccggcattgacttgcttgccggaacaacggtcaccaaagtcttggcggtctggccccttgactccattcgtgctgatccacaaaggggaggtgagatgccattcttatttcattaacatattttggttaaaaaaataggagcctgtgaccgtgacgtggagcatcatgtttccaacaacgtgcagtcacttgtccggattcacaaccccaacgaccggctctgccttgcgcgtgccattattttggggatgcatgaccgcgagacgcgaatggctggcggtggcggcaaagcggcattcaacctgttcgccagtcgtcaagaccaacacggtccggcagcagcgcagatgctgactcgtgccggcattgctgccaacagtgacatgtacacgctggacgatgtccaacgtctccagcagtggctcaacaatcagcatggtgtgggccaaattcgcctggcggtgtttgaaaaggagcaggaataccgcattgtattcaaaggagatgggtgagttttttatttcttttcttgttttgggtaaattagttaattgaagattggcggcgagattcaacctttgccttgtgttggagcgtggccacttcaactacattggaagagttgagcagctgtttgatgtgcccaactactgcatcgactgcgagcggagggctgacgcgcgttaccacgcgttcggatgcaaagttgtgtgccgcctttgtttgcggtacgggcctggttatccatggcaaactgaacaggtagattaagctccaaaaactacaaaaacaatagcaaaaaaaacccaattaagctaccgaatggtggaagtagtgctcgaaagtgcgctgaatgtctgttcatcttcccaaatggtgggtgctatgactaccatctcagcaaccactctccagctccgatggacggccgtggtcagcgacaacgtcggcccatctgtcaatggcgccgggtgtgtcgtgcgtgtggacgtatcgcctacgtggccacacatcagtgccacatgaccagccagccgacgatggaatctgtcggcgctgcaatgggccccacaccgtcgatgagccttgctacatccagcccattgacgacggctcagttcgacaacgtgcatcgattgctgttgacaacgacgattctgatgacgacgacgacgatgaagaattgccgcttcgtctgtgcttctttgacgctgagacgtcacaggatacgccattacagctgaacaaccgcaccgtccagaagcacgtgccgctgctcatcgtcgccgaagtcatctgcgaacgttgtctgcaggctggcatcagcgtgagcgatggccttggaagacgggctcctggctgcgtctgcatgacaggaatggtgagaggtcaactgtttcgccagtggtcttcgccaccctttgccaatgccccgggagacaacagcgcttcgccagttggagcaccagcgttcaatcagcgccgcttcttcttccattcgtttgacaacgacggcaacgacccagtggaccaatttttggattttttgctgcagcatggcccaaagaaggcacacacggtgtgcatcgcccacaacggtggaaagtacgatttccatctcgtacttgaggcactacaccgccgaaaccgtccacccaagcatctgtgcaccaccggattgaagatctactcgatgcgtctgtccgggcgtaaccaacgacgaatcacgttcaaggattccatcaactactttttttgtgccttggacgcgttggtgaagagcttccaagtgccggaccatctggcgacggtgaagcccttctttccgtatctctacatacgacgacaacatctgtcacagcgcctcaacggtctaccggctcaagagttctacgcaccggacacgatgaaggcagagaaacgggcgcaatttctccgttggcacgccgacaacaacggcaatggattccagctacgcgagcagctcataatgtactgcgtcaacgacgtggccattttgagggagtcggtcatccgattccgccaactcatcgccgacaatactcaaggcctcgacccattcctccacgcgtaaacagctgctggtcttgcgctggcaacttttcgccgctgtttcctgcccgccaattgtctggttcactcacccgagggcggctacttgcgcggacgccgtgcttcggcagaatcgcagcgctacatcctcttcttcgagctggagcacccggaggcgcaagtgcagtgcgccagctggtcggtcggagaggcgcacattgaggacagtggctaccgcgtggacggactttggcgacgagaagcgcctctccgtcccctggccattgaatggcttggatgctattatcacggtaaaggcttttttccgtttccaaaatatcttaaaattgaggctgtcccgcgtgctttcccgaccggcagcaacaattggcggcggggcgaacagcggaagatttgtacgaacggacggagcggcgcctctttgagctggagcacgaccacggctgcgaaatccacaaagtgtgggcctgccagtggacggagcggctccgtcatgacccagacctgaaacgccgttacgatgctgtgttcgtcccgtgcccgctggacccgcgcaacgacgcactgcggggagggcgcactgaaccgttcaagctccaccacgtgtgcagtgacgacgaggagataatgtgcattgacattgtcagcctctacccatacgtgatggtcggtttttgttttaaaatattcgcatattcatgatgaaaagcagaaggccaaccgcttccccgtgggcaacccacgggtcctgacgcgcgaggtgttgctccgtccgccaacggcaccgctcccgtggactgcgcccgaaaacaacatcttccgtgggttgctgctcgtccgggtgcttgccccacacaacatccgggtgccgttgctcggctaccgcacaaaggacgggcgattcactttccctttgtgtgcgtggtgcgccgaccgtcggcagcagcggccgtgccgacatgaagacgacaagcgctcgtgggtgaccgcctacacccacgtggagcttaacaaggcactgcagctaggctacgtggtcaccgatctttttgaggttgtccactcattaaaattttgagttcaagaacacaaattaggtctgggactatgacgaatgggacggcacgctgttcagcagctacgtcaacaccttcgttgggctcaaagtgcaggcgacgggctggccagaaggatgtgtgacggatgagcagcaaaaggcatttgtagacgattttgagcggacggaaggcatccgcctggactcgaccaaaatggagttcaaccccggcctgcgcctcatcgccaaaacattggccaactcgttgtggtaaatattttagggggtgaaaatttaaaaaaaaaaattgcatccacagggggaagctagcgcagcgcgtgggccagactgagattcgctacacgcggactccggctgaattccacgcgctcctcgacgacccaacggtggacaagttggactttgtccacgtgtcagaacacatggaccgctgcgtcgtgcggaagcgaccggaattcgccaaagccccgctgaccaactgccttccggtcgctgcgtttgtcacctcatacggccggcttcatctttacgactacatggagcaggtgtcagccatcgtcggtgcggagctgctctactgtggtatgtttatttgtcacgaatggttttttttggacagccctttgttttagacaccgactccatctactacgtcagcaagatgggtggtccgtgtgtagcagagggcgaggctctgtggcagatgaagcgcgaacacaccgaccgacggatcgtcgagttcgttgcgggtggccccaagaactacggcatccgccacactgcgcgggacggcaccgacgagcgcgccaacctcaaaatccgcagcttccgcctgtcctatactgcgcagcagctgctcacctttgaggcgatgaaagacctgacgctggccacttacaacattgacggcccaatgtgagtttttaacatatcattcttttacataatattaaaaaaattgaattttagcgatgatgctttagacaatgacgacctttacgtgtacgggggcggcgaacatcgtgccatacgcgtcaacttcccgcaaattgatcgcaatgtgtacgccgatctctacacgcatgaggcccacaaagactacaggcccttctatgccaaggggcgcgttcggcctgggatgcagacgcgtccctttggctatctggaggatgatggacagccgaacgaaggacaacggacgcatcgacgaaagagaaattttgtggagcaagatcccacacagcccggacactctgggtggttctgatgttgtgattttttgttagtttactattttgtttatttaaatttgtacaaatgaaaataaattatttacgaaaatcacttagatgtaatattagacaaattggtaaatgactggtgcaaaata

SEQ ID NO: 6589 - DNA, 1131 bp, Heterodera glycines
atctaattgtcagccaactttccgaattcgccccccccccccccccttccctccctttatactcgcttatgccggattacagattatccgataccccgcctatatcgcacgttacaaaatggtcgaacatgaacatgagggagtggaacccgtccaatgagtgagttgtttggattgaactccgctgcatgccaaattcggaattggcacactttgcagttgccgttgggaattgctcgacaagaccagagagcgatggcgccaggacggactgtccaacttgaactacactatgttggccaccacttttcatcggatgtacacaaactttgtggtcgatctgttggaggacgactcgcgcttcacaccgagagcatgccgatcagtgatgccaccgggtgacatgccgatgacgaaactgatcattgccatcatttgcaacggtgtgctgctgctgacaatgctcggccatcacaatggcggtaaaaataatgccaaaaaacatggcaattgtgcaaaattcagtgaacaatggggacacttttaacttaaaaattttaaatataacaattaaaaataattttctataaattctaaaaatttggaacttcaacattttaagcaagattatatgttttttttttactttttgttgtgttcttgccaatgaacacacaaagaataaacaaatttttattgatcggtcggtggacaatgcaaaaatataataaaaacgaatgaatgagggaagagacaaaaaggaggggaatggtctccttataaacacaaagaggagggttggggcgtggagaacaaagtacagatatgaaaataattaaaaaggtcaaaacgccaatttaacatctccaacacctcccttctcaagcttctaattccttcagcggccggaaggcgagaagcgaatcaccggcttcggcttacgctgcgatcgtcgaagagccaatgtcggcgggtcatttgcggcttgttgatcagtccgttgatcgaccggatcagcaatttgatgcgccaaattttgagtttgtccgttggctggtggaattggctgctgaccggcaccaggattatgtttcgaattctcttcgaaaacataatttcgacgaagttggt

SEQ ID NO: 6590 - DNA, 4800 bp, Heterodera glycines
  misc_feature (20)..(20): n is a, c, g, or t
  misc_feature (65)..(65): n is a, c, g, or t
tgccgtccatcgaatgtttngccatgtgtttcgagtagtccttccttcttttgttaagctgaatnttgtcaatgttctctgaattgtttttgtgctcttgcgggaggactaatgccaatttcgttcggagttttcgtccgaagaataattgatcgggagaataaccatcaatggcattatttggcgtcgtcctgtaagcgagcagcaccttttcagtccaatttttatcgtccgtcgatggattatggaacgaagtgtgaaaactgtggacttggccgtaattgaagacatttgatagacttccggccatttggaaaagtatacatactggcgtgccaaggccttcattcgcacaattcccggatgtgcaaaatgcaatgactttaaaattcggccacgcagttggcttggaacgataacacgacttttgtagagaaggcagcccccaatttccaaaatttcatttcttttcggatgaaatggtgcaatttcgggttccctgcacttcgttggccaaccagaaataacaaaattaacaattttctggagtgtctcatctttggttgtcgattccgcaatttcttgtgccgtgactgtaagatgaacggtttgcgattgtaaaatggtgttaatataacagtccgtttcgacgcaaatgttggcaatcaacacatcttcctcaggctttggataattggctagccttgagaggacatctgcttgtccaaatgatgctgtattcgtgtatttgatgtcgaaatcataatttgccatgatcaacgcccaccgttgtaatcggctggcggaataaaccggaattccctttttggaaccgaaaatggcaagcaaaggcttgtgatcagtaaataaggtgaatttcctgccgaatagcattcggtggaatttctgtactgcaaacactagagccaatgcttctttttcgatctggctgtaattttgctgggaatttgacaaaacacatgatgcgtgttcgatcactttctcggatttgtcaggaaaaacgtggccaatcgttgcgccaatacgttttttggatgcgtcagcggccacgattattggaagagccggattataatgagttaacagcagatcagaagtcatgatcttcttcgccttttcaaaagccttctgttgctcttcgctccaattccaattttcgtcctttattaggagctgatcaagcggtgtgagtatttcacgcatttttttcacgaatcgcccataataattaagcgctcccaaaaacgatagaagtgacgttttatcgtgtggcgcgggcattttgctgatcgcttcagaacgtgccggatcgggacgaatgccttttgatgacacaatatgaccaagaaaaagcaattctttttggaagaatttgcacttttctaactgaatacgcaggccaaattccttaattttcgtgaaaagctggtaaagtgccgaaatatgtccttccaacgtcttagaagcgatgagcccatcgtcgagataggcaaacacgccgggtattccagcacatatttggtccataagatgttgaaaaatggacggtgccgactttactccaaaaggtaaacgttggcattggaataggccgcgatgcgtattgataacacaaaggtccttggactcctcgtccaactccatttgcaaataggcatccctaaagtccaaatttgaggaatatgacgctccattcagtgcggcataaatatcatccggtctcggcaaagggtgtcggttcaattcgagggcattgtttaaccctgttgaaaagtcgatgcaaacccttgttttgccattcttctttttcacggcgagaattggtgcagcccaatggctgaaatcaattggcttaatggcaccgatttccaaaagtcggtccaattcagcgtttacggcttcagttgcaccgtgtgggattggccgtgccttgcagaaaattggcttggcatcctgtttcaggataagatgtgccttgattttcgaacattcgccaagtcctggttcaaaaacttccgaaaaatccgttttcaaagcctcaatcagtgatgcttcgtccttgatgtttgcctttggcattggtgccaatgtggcatggatgctgattggctcgcacatctttttttgctgaaccttaggaaacatgacttcccttgggatcagatcaaaagccataatccatggcaatccaaagagattgtaattgacagcactgctaacatatgcagttagcctttttggcggcttgtcaaagcaactgacgacacattgaaacattccttcggtgggaaatggttcctcattacaattatgcatttcaatgtccgacagttccaattttggtcttcccaatttaatccatgtttggattgtgatgattgttgcttgggctccggtgtccccattcatctcacaatcattgtcatttatcttcacttgaagcttccaccaatgaccgcgattcagtccgacattcaagcaatggcttgtcactttgactgtgtgcacagcccgattttgacgtcttgaatttgatgtcgaagctgatctttggggacacatctttgctatgtgtccctgtttttggcatttatgacaaattgcactgaaaaatctgcaatcagatcgccaatgatcagaatttccacaagcgccacatgggtaggtcggctttctttgatttgctttgcctcccgttgtgtgctggtttgctgtcgttttcccagaattgtaattgcctttctttgatttgggctctctccattgttgtggacgaagttggatggcatttgttgagattggcggtgaaagaagagccaatgcactgtccttaataagctgcatggctttcaactcttcttcaatttgtccgagagaaatccgtgtgccacttttctctgcctcctccacattttcaaacatttttgtctcatgtcatggtggtcatcgctcaatgcgattaccaaaatcatgcattttaactgctcttttgtcaatgacaaattagcattctcgcatgatgcattgatgtgagcaattaatgtcgacacgtcttggtttggctgctgacgaatccggaaacattcataccggcggacaaataatgaccgggtttctgaaaacaaacccttcaatttgtcaatggaatctttccaattgactgtgtccggttgagttggactaatgctgtccctatatttggcgtactcgccgtcagccaattttccgagcaaaagtctaacttttgctgactccggtaaatcctttccgtcctcttctatcaggattccaaaccttttaaaccattgctcaaaggtatttcccgactcagagtcgtaatgaaattttgaaattcgtccatcgattgagctcgccaaatttgcatggcttaggctctcagaaggtccaacattttgctgcgcattcatcatttgttgaatccgcttttcggattttgccaaaactgcatcgagaatttgcttcagttggtccgcccgcgtccattgccaaattgttgaaatccaaataaccacacctggtggctccctacacttgctgagtgttaaggatttttaaagatttgaagataaaaccgcgtattgcggaacctcaccacaattgcgtcttttggtttttagttgaattgaactgctatattagcagacctcacaccacctgggtgctattggttttcgatgaattgcagtgtcttcagtagagaagatggctgctgactgcgccaatttgttgtgttcttgccaatgaacacacaaagaataaacaaatatttattgatcggtcggtggacaaatgcaaataataataaaaacgaatgaatgagggaagagtccaaaaaggaggggaatggtctccttataaacacaatgagaaggggggaaaaggcgtggagaacaaagtacaaatatgaaaataattaaaaaggtcaaaacgccaatttaacatttccaacacctcccttctcaagcttctaactccttcagcggccggaaggcgagaagcgaatctccggcttcgtcttacgatgcgatcgtcgaagagccattgtcgccgggtcatttgcgcattgttgatcagtccgttgatcgcctggatcagcaatatgatgtggtaaattaagaatttgatattaatatgttggacatgagtattggtgaggtgctaggggtgtgcttgatgttctgctacgtcactcagtggttgagtcgtgaaaacagtagatatatttcctatcatttaagtgaggcattttaactctggccaaagcagacaaattttttttctttttcattggggcgcaaatgtggaggcgcaaatgtggaggcgcaaatgtggaggcgcaaatgtggcacaaccagtattatgtataattttttcaaattaaaaactaatgggatattgacatgtcgacgaataaacaagaacaaattgatcaaacattccaaaacttaaataatattaataaattttatttcttaataggttataattcttaaaatgatttaaagatagaaaatctcttaacatgaatcaaacagtcttcctaattaagaacatttatttttaattacctaaaattaatatcaattataaaactatgaaattaataatttctaatgtcagtagcgggtgagagctttggttgccccgttcgaccagttcaaaaaatttctattttttgtgaataggaatacaacgatgaaaaagcattttaatttaaatttgctttaatatcattaaatttaaagatcaagaaaatag

SEQ ID NO: 6591 - DNA, 2892 bp, Heterodera glycines
  misc_feature (27)..(27): n is a, c, g, or t
cgtccctacatatgagcagttcatctntttgcaaaaaaactttaattttttagtagattacaccttaatttgggattttggaaaacttccatattaaaaaaatatttttttaaatttgaacattttataaaaaggaaataaaactatcgtaaatacaattttgtgtttaaatccttacattcggaaaaatatttgaatccggaaaaatattattagggaaacaaaactatcgaaaaatttaattgattcgatactttttttaaatattttaatccaagtttttcataaaaatttcaaattaatttttttaagaaaaaactaacctattaatttttttctaaaataattcaaagttattgagaaaatcgcgattttttttgtaaattaaaaaaaatatatatatattgtatgaaatgtccattgtacgactttccttgaccttggtattggatttcctcatagacaattgaagtgttaggggttctcctattgctgagtctcggaactcaaatttatcccaaaaatttagaaaactgcatttttggaagttgattataaaaaatcataaaattttataaatttataataaatctatgtgaaataaggcttattaaaaaaccaatgtttttctttcaaattgccaacagttcggtgatttatccaacaaattctaaatccgatcattcatccattcactttgctttctctcctttctgttgtccgatcgtttgtccgtcgattgatcagatcagcgaccgatcaaattccactggctcaatttgactgtttccattgctgtccatgtggccaaaccattcactgttctttgccaaatggtcagccgaagtgccattctttgtctccaccaaatatgcaatggcttccttcatcgaaatggcaccgcttttgtccgcatcaacctaattaattaatattcaaaaataaaaattagttttaggggcaaatacaataattaccgtatcaaaatgttttcgcgcagtttccaccttcttcaatgaatgtacaaatggagagttttcagtgagactaaagatatatagaaaatgaaaaaaaagagagacgcaaagtaaaaataatttttgtcattttattttcaaatgtccaatagagtacacttttgttcaaattgttttactacccaaatgtccgcttttcaaattgtacactgttgcgaatatccggtaatcgcccgtccccttaatgggacagtacccaatctcgctactgtagttgctgcttgcgagccgagccatcggcgtgtggttctccggacatccgccctcctcataaaaaccgtcattgatgcaatttttgcatccttgtggacaatgcgcggcgtactttttgtcgcaacagtagtaacaactgcagcgtgttgcagaaagaaagcactgtttgcttttgtctttgccgatttcgacctggcagatcacacagtttctgtggaaaatgttgcaagctgggtcgggaagatcgacttcacatctaaacaagattttgcattttcgggcccaacatttagttatccgacatttagggaactgacagttggcgaaataacatttcaagatattttggaaagcgaaatagcatttttgaatctggatattctttgttgctccatgttgttttctatgatgcttagggttctcggcatagatgaaaaaagtctcgattgggctttttgaatgtctcagagaactctctacatatttaagcctctgggcccgatcgctggtcaattgggacatttgcgaattaaccctcctggataattattttaaaaatcaaaaattttacacaagactaaatatgatgttatgacaacatcctattgtaaaataaacatcatgttggcatggaaaaccctgaaaaataaaggaatacgatgaaaagataattaataaataattggcttacttgtgggacaaaattggcgagaaaaataactccgatggacagaaaatttgtgaaaaatgccatcttgacaaaataattaaaatatattttaattaccagtaaatatttgaaataagaattctgtgattttatgaaatttgtagttatgtgctcagtttttacagctaaccaaattataatttgtttttcaaagaattaaaatagagttgcacgggaccggaccgggacttttaaacatttatgaatattgggaaataatcgtaaaaaagtgcactcaaattttcaaattttttttcaaaaaactttctcttgggaaaatttccggttggtcccggtcccggtttttgtcaaaattcccggtccgtgcaactctaatttcaagtgaaaaagaaaatttttaaaattttatagaattttataaaaactttggtgaacgtggctaaaagagctaattgcatgttggcttatttctttaccacatttatacataaatggaagtgtggatcagaataatttattaatgcttcttaatttattcacaataatattaaatttattcaaaataaagcatctgaaaaaactgttttgattaagaaaaagtgcgacagaaagtaaaaagaaaaaattaattcagagcagaaaaaagaaaaaataaattaaataataaaaataataaaattatgttttaataaaatatattcattaattgcgctagtttataacttttaacctaaattcatacatatttgttgaaataaaaaagtgcatttcatttagacatccacataatttattgttaattagtttaaaaatttgcttcagaattcaattaataataatttggtattcatttttatgaatcgtttatagaaaatccgctcaaacctctgggcacttcacaaacaatcaggtcgctttcaaagccgttggtgttttaaatccgctcaaagc

SEQ ID NO: 6592 - DNA, 3113 bp, Heterodera glycines
  misc_feature (3093)..(3094): n is a, c, g, or t
acttaacgctgtctcgcttttttctgtttctatatttactacataatagtacgagttgggtttcgtccgttttatgtcagcatttggacaatcacaattatgcacttgttttattattaaatcgggcttcatttatgaatttataaactataaaatagaatgaaattatttgattatattttttaaatattaagaatttataaatataaatcacaattataatattgaattgggcttcatttatgattttataaaataaaaatcacaatgatcaatcttttgggtaggggtatcataaatttcaaatcacaaaaattgcatataaaaaggctggatagagccttaaaaatcataattttccaacaacttcaatcattctggacacttaaaatatttcgaaaaccaaattcattaatccattcataaattttgtttcgatttgtccctaattttcttccgatttttctttcaattttattccgttcttttggtgagtattttctttctttttgcttgattttctcctttattttataatatttttcaatatttctcttttttcattcaaattttcttcttccttttgttcccatttttctccaaatattcatcaaatgaattttgtttaatttttttatttgctggttctgtttattaaacacaaaaaaaactgccacataaacaaagtttccaattaaaacaaattacaacacattaaaaatactcgtctgagctctcggaaaaaaacatttaaagaatttttttttttttgcgatttttcattttttaattaattctaatccgaatgccatttagaatttgatcatttaaaatttttaaaaatttaaaaattctctatgcaaggatcggatttttggcacttttttctcccttttaccagaatgcctagaattccggcccatattgggtagaagagattaaaaagacaaaatttatgtatggcataacagaaaaagaaaaataagaatttttctgttaaaatgctgtgggagcaaaagcaacaggggccaaatgaaggaaagatggtttcaaaataacatccatccctcaagtggtggatttggtctagtggttattacaacggatccaagtaagcggccccgagtgggggttcaaacccggtcttccacccccaatttttcgcctaaataatagggacttttgagctaaaactctcaaaatcctcattgcaaaaaagcctcttttacccctccaaaaaactccttaaatgtgagaaaagctttgatcaaaacgataaatccaatcctgcgattaaattggaatgcgaactcttcatccacaaatagtttgtattttattttattattgttcatttggcactctaataaacacaaaaaaacatcgcagaagaacggagggacaatcaaaattcaaacatttgaatgcgatctaataactagggctccaatttttaggcactaaaaaccgccaaaataggtaggctttaggctctaaaaaacacccaaaacaggctctaaaaaatggaaaataggcactaaaaatcctcaaatttaggggtgtaaaatgaaaaaaaatttattcaaatggtaaaaaaataagtcaaatcagtattgagataaataatttttaaatcacaaattcttgtcaagaaaataaataaataaatttatgagatgaatttttgaaaatttttcatttctcttttctctggggttttgttcaatgttcgcatgcaaatgctttttgtggtaacatttgatcagtgaaagtgttcacttttttttattatgctattttggcatgccaacattgacaaattgtaaaaatgggccgactttggcaattgacattcagacatacacctgcccaatttgccgcattgttctatcattatttttcccatttctgtttgccttttctttctttctttctttttcatttctttgagataaaagcattttaaattttgtcgtttttaatttgttgaattttttatattgtcttttggtcgattcaaatgactgcgactcgattggacgtcgtttaaatttgggggtcagccgttatcggatctccgggattttcatccccgtttttgctaagcgcagaaacggggacccccgcaccgcaacccccgaggacggagataaaaatacaccccttagaagaagaatggactcaacaacaaaaatcgtcaaactagccgtcagtcaatccaacataggactgttttgaatttagcatttattaattagccaaacaaaaattgctgcattaatttgtttcgcatttatttatcggcggaaacaaattttatgcaaaaattgcatataattttttcatctcattttccactattactgagtgtgactttttcatcattgctaaaacaaataaaagggatccgatattttcaaatccaaaatttgttggccaaaattctaaaatttttatatgcattatatgacccaacaagtgtcagtgaggtatcttaattaaattctgggccttattcaattactatagcctgtacaggaaagggtcatgtacggaattttcgccaggtccgaatccaagaaatggtataggaattcaagagtcagtcctgttcgagcaggactgttgtcctgtcttggtacgtatgggaatcttggtccaagtccattttatttttaaaatcgggggctctattgatattgcattgtgataagcgtgctcctaccagatgcctcgtaggcattggtttctaattgccctcaacagtctgcaaatatacctaaatgctttatccgcttacaaatttgcaaacattaaaaataccattgtcggaaataacaatagcaaaaaatgtgccgaaaaaagcaaaagtggacggagagtaaagcatcgagcttctcgcattgattgaggcgacattgactgtacacaccatcccaaaaaacgagaagtgtaccaataaatagagagtgccagagaaaaacaatatcttttttctctaattttttgtctccttttggcgtactatctaatattttcattattaggaaaaacaacattcacttcatcctgtttaacttttttcctgcttgnntaatccataccaaatattg

SEQ ID NO: 6593 - DNA, 1454 bp, Heterodera glycines
tcatcggcggtgacagtgccaacagtaaagtagagtaacaaccaaccctcagtttactacggtatttaacacgcactaccgtaccctgcgattttagcctttcttggcacagttctgctcggtggcatgttaacccgggttaaaaattttgaagaagcacggtgctctaattaaaaattgtgattaacataacggttcgaacagcttcgacacattaagcgattttatcatttttaaattttccgctgcttattatttgctgctctcttcttcatcataaagcaagctgccggacaatcaatggcagtgttgtgaagcatattgcaaacaattgcaatttttgcaaatttttctttatttcaaaatgaaaaaagccaagaataaatttagaccgggttggagcctacaaacttatttattaaacatttccgtcagttttaatacattgagtatgaaaatgaaagtcttaaagcgaacaaataaaatacaattaattttaatataaatataagcactttttcctttttattgaaattaattaaattttaaactcacgagaagtgatttttaattaagttttttatctgaatatcatctcaaaagaaaaaaatagtaaattttgtagttagatacaataaggaaaatattgattttataattttatttttcatatttaaaaataaaaatgttaataaattatcaaaaaaatttttaataaaaattcatttgttagttttgaagaaaatgaaattgggcctagctagtattattattatggctttcaattttaagcaagaaaattgacccaaaaaatgggacaaattgaaattaagtctaaagcttgaccaacaaaaaaatcataaacaaaaatgatgaacataaacttgaattgccttattcaaatactttttctaagtaaatgcaaattttcaaagactcgtaacttttttctggtgcttcaaaatgcttaacatttctccataaggagcatttgaatgatttttgagaaaaacattcaaaacagtttttcaaaaacaaccagtttttaattttcttgaaataactaattaaaaatattggtgtcgtggagcgcactcgatcctgacccattttacttttactgtctacaaaatccacttaaccacaaatgaaaaagtttttttaggtaaaagaaccggtaatactgacttttactggtcccataaaaaaaggaaataaaaagacggccttttacgattattcgttctattcgagggttatcgaggccgctgatcacgaatatgatatcataattgtcatatgacatcatctaatctttgatttttttgtcaagtctgattttcttcaagtatttttttcattttttagaattatagtcataaaatatgttttgtggagttatcggggtcgctaatcacgaatatgtcatctatttcgaccaactcccaaactct

SEQ ID NO: 6594 - DNA, 2737 bp, Heterodera glycines
gtaattttgtagtagaaaagttgaaattcccaatgacgctgtgaaatcctggatttttgcccaggagatccaggtacagaacaaaaaaaaacccaggtccaggctaaacacgaaaaagctaaatttccagacaaaattttagagtttattatttcaactgaccgaccgatctttttcacaaggtttaaaaaagggattagataaatttaaaaacacaattttattgtcaattagatatttttcttttgatggcggatttactaaacgactcaaaatcaatacgattttaacgttgaaaataagagcattaattaaaggggcggtggtttgcccataacttactatctgacaacaattggttgagtgttagtattattccaattaattgatcggtctttgatcaatttacaaatgacaacgtttaaagtgaacttttatgccgaaaaaaaagaaagaagaaaagtcgaacaaaaattgaaaataatcaaatacataataaaataagggatagaattaaacttgaaagtgtcggtcggcattgggtgaacataataacaaataataaatttaaaagaaatgtttgatttcctttaactgttgatatacttaatttcttatttctctttttctctctcttatcctctgatcattgttcgcccatcaatgtcatcccgggggcggaccttcttttcactaatcgagaccctttataagtgttcatccgcctcttctctcaatgattggccggatgaagtgtgacaaattgatgctgtttaccgttaaatcaatgtccccacccccttatccattcaaattcactctttttgaacaaatatttaaattttcatttccttctcaccccgccccgacttcttttcaaattcacaaaaatagttaattctccgaacacatctgttcatcttttaattgctccgatcgcagaagtggcgagcaaaggccgaaaagcggctgacggcaaacgataaaggcgcctattgttggccgaaggggctgcttggataaaccaatgacaaaaatgttgatgtttaatgttgaaataaaagaaaatcacgagaaattccgatggaaaattgagctcaatgaataaataattaatggccaaaagtaattaacgaaaaattaaaggaacagaagcgaaaaagcaatggccaattgtttaacaaaaataaagataatgagaattggcaaatgttgccaaaaataagatgatcgggaataaattaattggcaattacgagagtcagcagttgatggaagaaaagagtcatttggcaaatcctaggcattttgcttaaaacaatcgcgatcggacgcatcttcacttttttttcttatcaaaagggatttttccatttaagccaaataattttaaaactactaaaccaaaacaccgaagttgtcaaatcatcaatttttgatcgaacggaacatcacacagtcgaaagtgggcgagatcggtactgatcagtgatcacagcggaacatttgcggtgcggacgtgacttttcgaagaaggcaattacggacggcgtgttcaactacgaagtggaccaaattgaagcagtcgctcgaacggacaaaaaggtgaattcagtttttgaaaaaagggttttaaataaagggccattcgtttaaaatacaaaaattgcctgtaatttggaaagagtgaaaattaataaaattgaggagtaatttgaaggagtgtaaattaacgacagtaaggtgaaggatttgaaatactgtcgaattgtgcgatttgtgcaaaatgaccaaaagtgattaaaaagtaaagtttgaatcttgaacgacggcagaaaaaaacaaattattaaaaacgaaatcctctgaagtgcctgattatttacagaggggataaatttgccgtcgggcgtcaaaatacccaaatatagcgccatgggcgattttcacaaatttttaaaagaatttaatattttggctacggcgtccaactggcaccccagcgactgtgttcgcatgttacccttattttttagagggggaggcaaaagaaatttttatgaatatacccgcggataaaaagaaaacttggcgggaattaacggaagcattggcggaccatactaaaaaggtggatggaccgatgtgggcaaagaaagtgttagcaaaaataaagatgggccaagaaaccgtgactgagtatgcaataaaataagagagcttgtggaacagtcttctccagaccccgcgtataccaaggatgccagagagaatgagtcaattcattactttttaaatggcttaccaacttccctaaagcgaaagttattttttatggataagccgaaaagtctaatagaagcaatttctcaagcaaaaaaggtccttcagttgaaggaagagcttgaaaatgacgagaaaggtgatgaatttagacaccaaattgccgagttaaaggaacaaattaatgcaatttccataaaaagtaaaacaaatgaagaaggaataaatagggaatttgtaaattcaaattacaacagagggagtgattaccgtaggccaataagaggaaattggcagcaaaaccgaattatacgagaggtggatataacggtggattcgtaccaagaaatccaaattttatcccgcttggtcaaaagcgaatggaaataattcaaattctaacagatttaacaataatgagccaaggggaagaggattcgataacaggggcaat

SEQ ID NO: 6595 - DNA, 2254 bp, Heterodera glycines
aaaggtccttcagttaaaggaagaacttgaaaatgacttctaaggtgatgaatttagacatcaaattgctgagctaaacgaacaaattaatgcaatttccataaaaagtaaaacaaatgaagaaggaataaacagagaatttgtaaattcaaattacaacagagggagtgattaccgtaggccaatcagaggaaattggcaacaaaaccgaaattatgcgagaggtggatataatggtggattcgcaccaagaaatcctaactttatcccgcttggtcaaaggagaatgtggaatggaaataattcaaattctaacagatttaacaataatgagccaaggggaagaggattcggtaacaggggcaattttcagaataatcgtggtaatttccgaggaaatggtaatgaaaaacagagataccgaataaatatggtgggagatgaacaaacacagtcaagttcatcgagacgttctccgactccgacttttacatttttaacaatttcgatggttttgtctattttgtttggtacttttagtctgtcaaatgcacaatatcaaatttgttctgaacgagttcagactaccgcaattctgttaccaaatatcacgaaatgctctataccaaaataccaaaaggtggctgaaaacaaaataaccttgtttttaccagtgcgtttacctaaacaatttgccgtttataaatgctatcaaaaattaaccaaaatatgcaccggaaactttttgtttttatggaaaggagtaaaaagtcaggagacaacggtgaggggagtgtctcacgaaacttgtcaaaaatttaaacataaaatgggcggctcaatgaatcgacttagtgagaatctttgggccacggaaaatcctgaaaagttgacatatgcctggactggcgaaaaatgcgagacaacagtaaatgactttttagaggaaggaaaagggggaattttggactttttcctggtcacttcttttgggcataatttaaacccgtataaaaactgggaagaactgccaagaaagacattcatttgggaaatccctgagccaaatgagaaatattgggctacacatttttcggttggcgaattcaaggccgaaataactgaaaatgcagtggtaattgaaagtgagcaaagtgtattttatttcgaaaaagaggctaatgacgaaagggagggcataatcggtgtccctgaaaacgcctacaaaatgtcaaatgatgcttttattgtcttaagcaaaactgaaatacgggaaaaacgagaaacacctaaaattgagccgaaaagaaaggaaagcccggtaaaacagtaagttcaactgaaaagtgaaatcaataaaaaggaaaatgttttgaaaactaaggaacaaaatgctacagtatctgttttaccgaaaagcactgtaaagctggtcaaggacagccaacaaaaaatatcaaatccaattaaaattttacctcaaagtacacaaagtacagtgatcacaacttctaaacctcaagtcaaactctccacaacagtaatgcctgttacgacaagcaccactccgaagccaattactgttcaaagggttataacatcaaccagttctccaaatgttaattatgatggacattttgagacaatttcagtgaaaaggcctcagaatgagcgaatttatcaggcaaagggaagagagtttaaaaatttgggaagtcgttctgaaagcactaccacaaaaaagcctattactgtcacaaaagttgggacgaatatttcaaaaaaatttgaccgtgtctaaacctgttaaaattcacaaaattgaaaggccgttggtgtcaactgcgacaccaacaaaaaatctaacaattacacaaaaacccaaaaatggagtcaaaaaatctcatctcgtgccggagttcaaaaaattgttaccacaaccataaccacttcaacggtaaagcccatggtaacaagtacttctgtcactacgatttctacaaaagtcacgcaaaatgcgagtgaaataacagtgttgccaactgacaaaacaaatacaagtttaatgattggctcaccaattaattcaaatattttctcgggattggagaatgtcaccgaagttattaagtcagaaatgggtgagaacattgagactgaatatgaaactgaaaaagagattgagatacgtacagaaaatagttctgaaaataggagacttgaggaaatggaaattaattttataaatgaggaa

SEQ ID NO: 6596 - DNA, 3235 bp, Heterodera glycines
gcaagagagtgttggaaaataagagaaaggagggtaacatctcagcgacaattaggagatcaacgagcgattaattcaaccagtaattaatggtaataataattttaagaattttcatgtttatgggcatttgtaaaatatttgggtgcgaaaaattaatttttcgcactcgaaaacttttgacgtacaatgtgaagagaagaaaattttaaaataaaagaaatataaaataaaaaattatttggatatgatatttttaagaaaacaatataaaagaaagaacctaatacttaattctataagcttttaaaaatattcagcgaagcaggttttttaaaataataatgctatgaagctggagcttttcaaaaaataactggtagacaaatgttctacaaacagaagatttactaaaatatttttttaaatcagtcaaaaaatttaaaaattatcatatatttttcaagtaaattctaataaataaaaaataatcaataaatatcactccattattggaattaacataaaagtaaaataaaatttatgagttgaaccacagataattaaatcaaataattaaacaataaaacgaaataattaagtaataaaatagcaaaaatacataacttaagcgaatttaaaagcaatcaaaaaatataaaaaaggtggagccagtcttgaagttgcttctctattcatagcattcaaacttctgttccgcgagaaaatcgagatagaggaagaaacaaatacctaaactaagctaaaaaacgagtaaaaaagaaaaaataaaataaaaataagaataaataattgtcaacgacaatttttaatcccataaataattttctaccttattaaaaattggttcataaaaatagcaaaaaatatcaattaaatccaaaatcttagcgtaatgttaaaaacaaaagtaataatagtatcagccgtaattaaaatagaatttagtaaaattctgataagtaattaaacaattttttcaaattttgaaatatctttatataattaaattatcctaaaaaaagttgtgaatttatttgatttttttgccgttggaaaaatttcttcaattgtccgattttcttaaaattttgcatagtcttagcccattcatcgaattctcctttgttttttgaaaatttcttttctaactcgagatcggctcttgcctttaacacgcgaaaatctcaaattttttttaaattttgcaaatttgactttctgatttaaaaaattaaaaatgaaaagcttcaataatcggcgaggcgttaattaatctgctaatttataagaacagccaccagcagcaggcatttcaatcattttaaaagatttgacgaaaaagagaattgtaatacccgacaccaacattggagagcggatttttgaagttaacgggtaaaaaggttacgagttgtgtacccaaaaacccgtaaaaagccacatacgggtccggctcctattcaatttttaattttcacctaaattttgaaccgaacccggttttactaattcggaaatagccacaccaaaaattggaaccggactcggcttttatccggacttcaacttgtaagcggacccgaactaaaatcaactattaaatttaaactcttagtaatataaaagcataagaaaaagagcaaaaatttaaataaagtaatttaataaaaaattaatatttttataagaaacaattttaaaaatgttcaactattcttaatgaatgagaatatacactatataatcttttttgttttatttacaaacagtaaaatataattttcattcagaaaatttataaataaagaaaaaatatataaaaaaatcatttataaattcttaaaataaaaaaattcggttgggtaagataaaaaattaaccaaattgctaaaacttgtgattgaaaaccctgccattagaacattcaacctcatcatatgtgcacgatgccataaacgagattaaaaaatggaatgaagagagaaaaattaaaattaaaataatatttggcaaataataaatagcaatttttgaatagtctaaaataatataaagaattgaaaaataatattttggctaaatatacacaaattatttttacgacaatttaaagaaaataattatagtctgaaaaaagcaatgtttttcatttactgttatttttgcacatctgaaattggaagatgagaccataatattctcattatgttggagttatcagagataattaaatttacaaatcattcataactgtcacccatttcgacactaatggcagaacgtactcgaattttaaaaaagtaaagcgatattctcattatgttggagttatcagagataattaaatttacaaatcattcataactgtcacccatttcgacactaatggcagaacgtactcgaattttaaaaaagtaaagcgaatgaggatttgaaaatttgaggaatatttaataaaaataacaaaaataaataaatagaataaaacctatttaaaacaaaagaattaacataatatgataatgaaattagattcaaaaaggggtaatttaatagaaaaattaaaaaatattttcaaaataacaaaaacaatgataaattacccaaaggagaaataaacattcttaaagcattctgaaaaagcacatctcagaagcaaggtaattttcgttcggttcgtggacagatatacttttgctaaaactatttactgcttgaaaataataaaaatgaaaattcaaaaattttaaatttattaatcattcccacctaaaaaataaaaaataaaaatttattgagagaaatcttaattttaataaaattaaataacctaaaatgccttttctaaaatgttttaatagataataaacaaataaaaaaatatttatattcagttgaaaaattattaataattattaataaaaaacgctttagaaaaacttaaaccatttaattattttaatataattaaagaatatatgattaagcaacattcttataagggataattacatttttatgtcattatgagaaaagtattgaagaaaaatgctttattaaaaaacaaaaattcaaatagttcaaatatctgcatgaacatagcaaaatgaaataaatatgtaaaatgttatataaatcattaaaaatttttaacaacttgtgtttaaaaaattatatttccttaaaattaaaaaatttgtatatggaaact

SEQ ID NO: 6597 - DNA, 4115 bp, Heterodera glycines
tttatagacaataaaaaatatttttattttttaaatcctttatttggtgcgctaacttcctaaagattaagtcgcgaattttagggaggaaaacccaaaaataggtgcagaaatttttaaaaatttcgattaagggtcgaactgaaattatactgttgtttataaaagataaataaaaggtttttcaagagcttaaaaatgccgattaataaaatttcttttatgttcaaataacaaagttaattagattttaatttcgcccctatttcggcattttggtgcatttcttccctattttcgcccacattcgcctctgttttggtattttcgactctgtttaggcctctaaattggaatttttcgcccttaaaaatccgtgtcttaatattgtttattgtttattcataaaaataaaattcatcacaagggcgaaaaccacttactctgacgactattcagataaatgtgtcgtagagtaagtgacaaaaatatatggatgatcacaggaaattaaaaagacaaaatagtgaaataaataaaataaattgaggtcaaaagtcaaatgaggtcgaagcataaaaattacaccaaaaagtcccaccataacaatttttccgtgattttcctcacgcaaaacctgttcgataaatcaatgcgggtgccaaggtcgaacgcccattacatcttcctgatgcgggctcccaacgacatgcttagcattcgtaatttggccagccagatgttccctcgcgagcagggattcctgatggatgcctaccgacaggcatgtgccctaccgtacggctacctgttggtgactctccacgcgaacagagacaacattatacgcctaaggacaaacattttcccagacgacgaggagagaatcatttttgcccccaaaaatggttaagcgggaacagaagatcggtgagcgggttgtgcacaactacgactatttgaagaagttgggaaagacaacgtcggagaagaagcgccgtcatttgttgaacagtgccggttgtgaggaactgttaacgctggtcgagatttgtctcaacgttttgaacgggagtttctgtctgagcaggaaacaaaagcagagacttgagccatttgccaaagacatcagacagttggcacgtgtgcgaagcgagaggggtgcgcgaaaactagtgcagcagtcaggcggatcactttttgcccctttgttggcccccattctgattgaggctgcccgatacctgctttcgcgcagcaataatggccaataaacttattctgctgccatacgagcactacaaggggctggttgcagcgagggagacaaagaatgacgacgacattgctgagcggacaaacttgggctttgtcaaacgacaggtgaccgctgcagtacagaagcggaagggaaacgtcagcgagcggaacgcaatgtacaaccagcagctgcgccggtacctgaagatgcgcaaggaacataaggagcggcccgtccgagtacagctcagcaacggtgctcaactgctaaataaaacagtggagacgggtgtgcaggtacggcctggtccggacgaaccgaaggacaagtccgtgatggttaccgacgaagatgaagaggaagaaattgaagtgccaaagtttttaaccccaacaagccagacgcagggaagcagacgatcacccaggaccaataagaaagcagcaaaacagcaaaaattgatcgagaagaaggaccacctgttggccatcattatgtctgatccgcagagattcggcgcaacagaccgtggaaaaatcattaacccaaagacaggccgagagttcattgactcggacctggcctggtcaattgaacgcctggtggaccctcgcccggagaatgccccttcgccaagcggaaccaaagagttgaagaggaaactcgcacagaatccgcttgccagtagcctactcaatcgactgtttgttgggtctgggttcgtcggacaagtcaaacaaagcgggcgttttattccctcaaaatggacaagaaaataaacaaaatatacaccgacccggccaatccgggcgggtatgcgggggcgagtgctctgtacgcggcggtgaaggagaagcacccgaagttgaagcgtaccgagtttgaagactttttgcaaaggaacaccacctacacgctgttcaagccaaagagggagaagttccgacgcctacgcactgtgcctacggggttcatgaccggtaagttgtaccggggcttattgcgcacaattcagggttcagatgttcaggcggacttggccgatttccaagccctttcgcgcaagaacagcggctaccggtacctgctgttggcggtggatgttctatcgaggcgaatgttcggcgcccccgtaaagagtaagcgcccagtggacatgaaaagggcgtttgaggagctatttgagcaaatgccaagggtgccggacacactgtacaccgattgcgggttagaatttgtggcaaaaccgttgaaggagttttacgcggagaagggcattcaaaagtttgagaccagttcaaagaagaaggccgccgttgcggagcgtgccatacgcaccctaaagactcggctgtacaaatatttttcctccaacaacacatcggtgtgggtggatgtgctgccaaagtttttgagtgccataaataactcggtgtgccgcgcgaccggtcttagaccgagagaaatcagcgacaccaatgcgagggaggtctggaagagggtgtacggcgaagggcttgtacaatcgaacaagacaccaaaaatcagagcaggggaaacggtcaggattcccgagcctaagcacattttcgagaagggtactgtatttcacacattttttcggtcaatttattttaattttaggttatatacccaattactctgatcacgtttacacagtagacgaggcccgctcaaccaacccccagcactatttgctcaaagactattatggcacaaagttgaagagaaaattttatttgccagaattaacaaaagtacaagtggatgaaagcacaatgtatcgaattgaaaagaaatacaaagaacaagtgagagatggtaaaagagaaatgttggtgaaattcattggatttccggaaaaatattgggtcacaaatgaagaaataaatgaataaaaatattacaaatttaatgaaaattaaaaaataaaaacaattatggcataatgtcggggtcatcagctcctcttctgtgaacatgttcacattgaggtctgggttgaacagacaggtacaagcgccagggcagttccacttacaccactcttcgtcgctgtacccaaagggcaccaccttcaacccgtgatccctgaccacccccttattcacggtcgggttgaactgcttgaccaaggggacggtgaaaatctctcccttcttggtgatccgaaagttcttcgttgggtagttgaagcggacgttgttgtccggctgtcccagcttgttcttcaccatgtccttcatcttctcgaaagttatgcgctcgcaggcatccgagtcgagcgtgatgccgcgcaccttgagcttgtactcgtcctcccccgttgcgttgttgcgcagccacagtccgtacgccttgggtccggctaaacaaagtttccatttattttggtcaaattttaactaatcttaccacaaataaactccatgatcgtatgattcgggtactcgtccgcgagttccccgagctgctcaccacccggaagtgggtcccccagccgcgtcaggtagtcgtaaaagatgctgtccgtgtcctgattttaaaaaattacttcacattttcattttattttctgaattttaccatgtagagaatgcgggtgtcgaagcgctctacacctggtgcagggccatacacctttttcagcgattccagcaagtggattcgcgcagcagaggtggtccatagggcaatggccacctgagaaaatttcaattgtcttttttaatattttaaaactttcttacattgcttgtgctgtgctccaccacatgctcatctttggccttgtagcagaccattcagaaccttttccgtcagctgatcaatg

SEQ ID NO: 6598 - DNA, 6008 bp, Heterodera glycines
  misc_feature (56)..(56): n is a, c, g, or t
aaaaaaatttggcaacaggaaaccgaaattctgagctttcctgtgcggaaatcggnactcgaacccaaaaatgtcggacttcggctttcacgaaaccaaaaataccgaaatcggcatttcgaacccaaaaatgtcgaaatcgtcatttcgaactctgaaaatcggcattccgacatattgctgatagtcatcatttttctttgttacttccaatttttttttgtgttttgtgacttttgaaattttcaaaacacaattgcccacagtcactcattaattagttcataataactaacagacttccctctcattatcattattatcctcatcatcattaggcaattatcgctttgtctaatctctgatctttttttggaatgccaattaaacattttgtcaaattaattgcctgtcgtcttcccatgatcatcatttctatcaactccatctgttcgtattttgttgcgattgggtcagactcggagacatggaatttttaatttttaactttgtttaatttcttgccctttcaaggcttgggttttgactttcgggatcgaaaatttcccgaatattcgagacggagtgccaaaaaaagttccgatactttttcgaggcgagaccgagactctcgaacagcacggggactattagaatggcaccacaattagcccgactcgttatatttaattgtttttttaatttttaactttttttaattccttgcccttcaaggcttgggttttgactttcgggaccgaaaatttctcgaatattcgagacggagtgccaaaaaaaagtctcgataattttctcgagtccgagactctcgaatagcatgggactattaaaatggcagcacaattagccggactcgccatatttaattgttttttaaattttttaatttaataccaaggtcaccataaatttcatgaaaattccacaattttatcccccgtctaaatttttaaattttgtagatttaaaaatattgccctttttcatcatcacaaaatttgccaacttttttttcttctacattttgcttcttcaacagctttgacacatcttccaaaaacatcatcatcatcacctcattagcaaccagtaaatgatgccaatgccattcctcccgtcatcatcatcattctcggcatttttgacgacaattaacgacaacgacgacaccgccaagttcaccaacaaaaactgttgtcgccattgttgttgctgttgttgaaccatcgtttttgtatacccaaaaccatggttgagtcgacattggacacattgttggacggctcatttttcggcacggcattggactgcttgaaaccgttggatgaacgcgaattgccgccaaagtccgctttggaagccgtgccgccgtcatgctgctcgtcattgttgtgtccgttatctttggcatgttgccgcacaattggcaacaatgacaacaccggcagcaggggacagaaaaggcaccggcacaatcaccacctccaacatcaccagcatcatcagcagaagcagcaacagctgcaacaacaacagttggagttggacgcggacacaattgtgatcggtaggtaataaattgaacgcggcattttcaaaatgatggcattgtgtatttgtcgggaatggctgggaatacagcgccaatttcgaacggtattttgatggcaacaattagaactcattagctgattactagggatcggatttttagtgataaaaaatcccaaaataattaactaaatagtgagaaaaaaattccaaaatagtggcaaaaatagtggcgaaaaagttccaaatttaggggtgtaattttttaaatagctgttttttaatttgaaaataatttaaaattaaggaaaaagattttattcactgattgcagttacaaaatattttcttagaaaatattgaacaagaaaaaaaaatttgggggaagaatttttgtgaaatttttccaattcttagggatgtatttttgaaaatttttaggtcgattcttaggggtgtatttttgaaaatttttaggtcgattcttggggtgtatttttcgtttttattgcattttttgggaaattttccaaaaaatgcaaaaatagtagcaaaaatagtgacgaaacgccaaaatagtggaaaaaaatgattttagtggccaacttccaaaataattttttttagtggcaaaacaacaaaatagtgattcctggtgatgaatagtggcgttaaaacgaagaatttccgagctaaaaatgtgttgttcgtgcatttctcgtcgaaataaatccgcagaaaaaatagttaaaaaactaagaatccgatccctactgattaccagtgttggttttatgccaatatatatggccaaatttggcaaaaacatttctttttttgaaaattcaaatttttaatggacgctgaaatggtattttcaaaaacggcattttgaaggcatagtaattaggaacgcattgctatttgctctcctcactgtccctattttgataataggaaacggcccggcgggcattgcgctgtccgcgctgctctccggctggcgccccttctacaacaaacgcgtgccgcacccggacccgcatctgcacgcgcaactcacgcgcatggcgagcagcagcagcgacgacaattgtgacctgtcactgcttgaccaggtgggtggtgtgttgctgttgtggaggagtggggtgccccagcaagtgggagcagtcagcaggacaaaacatctccgggacataacgtctcaccgggataaaacgtcgccacaaaaaaaaaaaaatttttttttttaaactttagaaaaaattcaagaaaattataaatttttagttgcctagcctatcccggcgacgtttgcgcttctgatcacttttcgaaaaattatgagggattaaatttttactaaaaatatgccttacaataatggtgtaattaaaaattcaaaaaaaaaaaaatttaaaattaagaatttcgagaaaattttaaaaccaaaaagcgttgaaatattttcatgttaattttattagctatagaaagggttaattaagttcaataaaactttaatttaaccttaaggaatacggcttcaaaaatgtgacgaaatatttttttgtttacgtaatttaatttttaaaaatttgatcatccacaactaatttgtaattgtgatcagaagttcaccaaattttgcagagatacataatggaaacagtacaaatgtttacaaattttcctataaatttttcacccgaggaaaatttgtttttaatattttttttaattgacccatgggaatgttttcaggaaatgggataaattattttaaaatagaggttgattcccttccttttagtatccccctaatttttttttttgttgccaaattcaaatttttggcattttgccacagcaggaccttgacgcgttggcggaccaacattttgagcgcgcgcaaaacgccggcggcgccggagggcacacgccgttctccgtgctctacgattgcctcgcgcggccccatttaagcgcctcattcgcctcctccgcttcccataccgctgctggccatcatgcggcggcaaacggcgacgacgacgtcgatgccgagcagttcgtcgtcgatggcaccagcgctggtggcgacgattgcggggtaaaaatgtgcctgctgccatccgaaaccggaatttcacgggacgcaagatttagcgttgtgcctccctgggatatatgtaatccacttatcatcccctccccatccactctcaattactcgagacttggttcgagacccgccccctcccccctcccaaaaaaagagctcggtcttggcgagattttattccgtccccccgatttttacggtatcgaggtattgaaaacagtttgcggttttaattgtataaactaattgatgtgtgccattctcccccccccccgcttccagcaacggcatcggtcgccctcccccgccgcttcttccccggtcccctcctcctcctgcctttgctggagacgacgcgagcgcgatgccatttcacacattgtgctcggcgatcagcagattggcggcagttggaccgaatatgacgaccatgtgagagaacaagagtggggcgcagattgaatttgagaccagtcagggctgaaatggcgggactcaatttcccccatttattttttctaaatattttccccaccgtccgatatgttccgtttctgttcatcatcaacatatcaatcatatcatccccgatcagatgctcactgtgagtgcggtcgagtggatggatttgcccggcttttccctggccgcggattttgtcggcgacgctcagctcgcgcagcagcgcccgcgggccggcctctacaaggcgtacttgaatgcctacgtggacgcaatgggactgcggcacaacttcaagctgttcacacgggtcacccacattgaggtgtgatgattagggcttcgatttttaggtgctaaaaactgccaaaataagtaggttttaggttctaaaaaacccccaaaataggtgctaaaaatgggaaaataggtgccaaaaagttccgaatttaggggtgtaaaatcgaaaattttcatcaaaaagcaaaaatattttgccaagtcattaaggatatacataattttcaaaatcaaaaattatcgtcaagaaaataaaataaataaattttggagataaatttttgagaaatttttcatttcttaggggcgcatttttgaaaattttctggtcgattcttagggatgtattttttgaaaaaatttttgggtcggttcttaggggtgtatttttcttttttattgcatttttgttaacaaattttgggcaaaacgccaaaataggtgaaaataagtttttttaaatttttttaggttttttaggtgctaaaaataaaaacctagaaaataggtgctaataactcgaaaagtagcttaacaacagcccaaaaaaacatgtttttcgtgcgtttcaggccacggggagctcaggaaaaaaatatgtaaaaacctaaaaatcgaagccctagtgatgatattgatattgtcgtttgtccgatattttggggatcggaaatacagaatttttgaaaattttcgattctatgctcagaatttcattatgtaacccgattttttggtattttcttccgtccctcttactctctctctctctctctctctctctctctctctcactctctctctctctctcttatctctctctctgcctgccttaaactatctctatgccttcccttccaacattaagatttcttcgttgttatttctctcccattcctacactatttctgcttttgtctctgctttctctggccataacattcctccatcgagtgcatgcactatttcgttccctcttgcatttgctctcccatctctgccagttttatctcatcgctgccattcacacctcccgaaaaagatttgtggcaagaaaaatgactttgaagatggcattagaaagagtgctttttgtgatggaccaaatgccaaatttactctaaaactgtgattttttaattacaaactataaaaaaagaagcagaaaattttttttttattttttgaattttttttcgattttttaaagttttcgcttttaaaaacagagattcacaatgaatgcccaatagagagtcacagaaaacactaatggcattggcaggctaattgtaagctctagaatccttttcccgggagtaaatcccaaacagctaaaaaagcaatcgcaattttttttttgaatttttctcgaggctctcgggttctttcgagtaatgattttcacccagcagtgccaattcgttcattatcccccactcacttcggcacaactacctcccagcctcttttggacttggtttctactgtttcaaacacacatccctccccccccccccccgggggaaggggggagggcaaatcg

SEQ ID NO: 6599 - DNA, 1472 bp, Heterodera glycines
ctcggattcgggctcattcgcattctccctctcattctccctcctctccattccccccttttctcttccactcctcgcacactctctctccttctccctcccctcctacttttgtcttcccctgctatttctctccctttttctcttccgctcctctttcactctctacccttccctcctctttttgtcatttcctactttttctcttccgctcctctcacacactctctctccctttctgtcctcccctacctctttttgtcttccctattctctctctcttctcctctcactctctctctctctctttctttttctcttccctcaccaatcagactttctttccttatcctttccaccctctctttttctcttcatcagctcctctcacacacactccctttctccctccctccctccctcaccccgcccattctctactgtcccaatgtctttcacagtttttccacgatttttacaccaacacaccaacccacaccacagggttaattatgtaattaaccccagttaattacacatataattaactccttttatcgtgcattcctccgccgttctttcgtcctttccctttccctttttttctctctttttcactgtctcttccgctgtccctttcccttccccaatcattcaattgcctgccattcttctcacattcattcattgttttttgactgatgaaggtcatcttttcgtcacacagtagaagtgggaaagtaaagaaaaatgaaaaattcaaatggaaaaaaaatatatttaaaaagagggaaaatgggggggggccaattaaaacgataaaagactaattaggactaattaggccacagcaaaatgaatgcatggcaaacaaatacaatattatacacatatgaagggtatattacattcacaaaaaaaatgcaattgagattaaagtgatcatcggcttcgagtcaactttccatcaattgctaattttatgaatttttggaaaaattgaaattttttgtaaaattgggtcagggaggccttggagggggtaccaataaggaaaatcgaaacttttctgcatacaacactatttttccattaaagaattgttttcatttgtttctcacttgcaaaaatgaaaatttggcaaaatttcagaaaatttgccacccctcctttgtcggcacatgccattggctgctgcacggcaccgaaacggtgccaaagacggcggagcagcgcacctttacactccgttgtaggcacgtcgtgttggcatgcggacgacaacagcccaaactgttaggggtacgtttttcaaaaaatcgcttcccgctgtctcagtggtctgtgctcttggcacggcgcattttccgggtcgccggttcgaatcccgtccgggtgaaaacaatttttcctgtattttttggatcagaattttttaaattttttttggcaccatttgtgcaggtgcccgg

SEQ ID NO: 6600 - DNA, 679 bp, Heterodera glycines
cagtctcagctcgtggaagcagcgattggaggagacagagggcggcgattcgggcgcgacagagacggcaacgacaatgggcaccgcggaccgaagcgacggcgaccacaatggcccgagcgactattgccgccactgcggagacggaagaagtgtccggcgactgtcccgtggtggtggtcggcgacggcatttccgccgcggacgcggtgctgcactgtctgagcattgaacagcccgtgctgcacattgtccgtcgtacagagcgcgagctgagaagtgagtgtttcgatgaataaccgtggagataaataataatgattcatgggttgatctttgatcgtttccaagagaattttgagtttcgagaaagatctcgaggtttcctgggggaaggtcagtctcgaaagtacaagtctccagtctatatcgggataatgcttccgctctctctctctctctctatctctctctctctatctctctctcatgctctctctctcatgctctctctcctttccccctctggggagagggtcgtttcggcgccgccgtttcggcgcgatcccaagtttttggactacaaatttttttgtaaaagcctgctccgtccgtcttgttcttcttcggcccccctaaaaagggtggatcaaattcaaataatcattatccaaacaaa

SEQ ID NO: 6601 - DNA, 1243 bp, Heterodera glycines
atccgaaagcgaaatttgctttttgtttattttaataatttattcagggtttcgagaaaatttactaaaatgatttttcggaaattttcctgactttagggtcaaaaacgccattggggccattgttgcacataaaatatggccataatgccaaaatatgggataaatatggaaatatggacataaatcgcgaaatatgaaaaatataaaaaaaacgggtatagaaatccatcctagaggcttcataccaagctaaaaacatatctttcgtgagtttcaggcctaccacagtccaggaaaaaaatatagatttccataaattgggaaccctattgatcagtgtcagcttctccctaaaatgggcaaaattaattatattaatttgatcgaattttccatatttatttaatctaaaatgcaaaaatgtatcattttaaaacagatcgctgcttcttctttatctccgcgaaccatcgctgaatttgcattttttaaaattattttttcccatcgtttgtccgccatttctcccgtcccatttccctcttttttgctcctccattaattttttgttggccttcgtaactttgcaatatttcttttaaatgattttatgtcccaacttttaatgtcctccgtccgcttacgtttatcagtttaaatccaacaattcaagcaaatcatttgttgaatgaaatgactgaattacattttttggaaatttgcaatttgctgccatcgaaggggacgtgctgattcataattattttttaattgactgaccaataaaaaaggttcccaaaatttaactctgtatgacaagccggctaacatttcattatcacatatttcgaagtcaaaaaattttacaacttttttaatgctttaaattatagtgaaaataatggggtacggtaacccttcgctgttccttttactttggctcccggtaaattggacaccagaaaattggacaccgaaaattggacactgttgtaaataaaaattaaaataaacaaaatatattaataaacaaaaattttggcttggcctaaaagatctttatcttaatctgcacatatgttgtttataagcgtaaataatatggaaatgaatttgatattatttttgtaacatcagcacgagaagaaaaacatcatatcattcctaaagaaaaagttttattacccatttttcgtgcattatttggcacattgatcaatcaccccccatttttggtgca

SEQ ID NO: 6602 - DNA, 1401 bp, Heterodera glycines
aatttaagaacgaaactgcacttgaaaacatccgtgatgaactgagcgacctcggcttggaccacatttcgtacgcatttgttaagggcgtcgagtgagtgaaaaagggaaaacgtgaaatattttaaattaattttattttaatttctctattaaaaattgactaaaattgggttttcaacacgttcagagtggacatggtctgcaacaaatgtgccaccaaattggagaaactcgacgacctttgttattgtgtggatgccaaagagagatgccaccaccgcaaatggtaggagaaaaagcacattttgattggggaatttatgtgcattaatggagtttctcaattgatcaattttaaatggattttaaatgggtttgaaatgtgttcgatcgcctctaaagccgaattgtaattaaaaatattgtgaaaatttgaaaaattattaagggtaatcaatttaattaataataatattttatatatttttgcttttcagctgttctgtccgcaacaatctcgctttgaattttcactgattttgttgatgcaaaaaagaaaatgaattatttttcattttatttattgagttctaattaattggaagaaatttattgcgtaaatttatgaaaaattcttttcggattttcccaatttacgaattttaatacttttcatattgagaatttaatttaaatgttttttccattttctcactttgttcaaattgaaaacaaaaaattatcatgccctttgatagctgctggtggacgccttcaaataaaagcaacattttcagtggaaacagtgaaaatgtattaatcccttaaaaatttaaatattttaatttaaaagcattattaattaattttcattttcattttaatttagttgcgtcctcatgagtggctttgcgtgcgtcaaaatgccacacccgaggagatcaacaaaaattacaagaagctttcgcttgccacacacccggaccaaaacaatcaatgcagcgacaaattgtttatggtaggactaatcgctgggattactgtacaacgaaattttaaaaaataatcaataagaaattcctttttattatcttaagctgatcaagaatgccaaagatgtgctccttggtcaccccggaaacagctgcatggcgatggtcagttattttttactaattcatttttatgtgtccccaatattccatttcaataagtggtggtatttaacgagaatttttaaaaatttattttatttttttccctcttcaattctttcaaaaattaagtaaaccttgccaaaattttcggtagtgtcaattggcaggttttccaaactaaaaaatgggtgctgtgtcaagggacaaaaagagtgcaaaaatttgcgtaaatttctgacga

SEQ ID NO: 6603 - DNA, 1418 bp, Heterodera glycines
aagggctatcgtagataccaagattgtgcaatttggttgcgtctgagaaaagttatgagttgatttagtcaaaaatttagcaaattttgcactttttgtccatcggccaaccacgaaaaaatgtactactgttttggtgttactgtacagcaggactatgaccagcaaatggaaatggtgctcgtgcctttcaccacggtgctcaacaagcccaagtatcaagcgattgttgcccagctgaacacaatgccaaaaagtgctgctgattgtgcgacttttggatacggtaggacaaaaactaaaatcaaaattttgtgaaaaaatactttaaatttacagatgttttcttggtggaccctttgatcgaatatgctaagcatttcgcattggaaggaatgtttaaggcctacaaaaaagtacagtttaatttttgtcaattttctaagagaaatgaggcaaaatattagagaccggacaagagggtcggtcggtcggtttcggtataaaaaccgaaaaaaaccgaaaccgaaaaactcaaaaatttctcggtcggttttttcggttaaaaaccgaaaccgaaaaataccgaaaaaaccgaaaaaaaaaccgaccggtccgatctctacaaaatatggtctcggctttcccacgcctcccttcacattttctcattaactaattcttccacttatttattaaaattatgataaaaaactcaaattggcatttttgggtaatactgaagaatggcggtttcccttttttgggataaaaaattcatatatgggggtttaacgaggtgctcaacaataaaatcacatcaatcaatttggaccaattcctcctaatcccgaacacgagctcgaacaaaattccctcgaaaattgaatttttgacacctttatttgattgagttcgggttagggattaggaattggtcaaaatttatgtcagattcatgatcagggaccaccaaaaccccttggacacgacttttaaattagcgcaaaatcatggattaaatgatgtcatacgatacattttacccccatctaccaatttttcggtgccaggtcgtttcgtaaaaactgccaaattatagattttcgcgaaaaatccacataacttttcttaaatacatcctaaaaaaataatcttggtatcataagatagctacttcattatcatgaaaatttcagaatatttcattaagtttacagagttatgtctatttttttaacatttttggtcagaactttctggaaacccaatgaaattttctgaaactttttaggctaatagagcaagccaagagctatcgcaggataccaagattattttttaggatgtatttaagaaaagttatgacagatttttctcgaaaaatctgctaaatttggcagatttacgaaacgacc

SEQ ID NO: 6604 - DNA, 2730 bp, Heterodera glycines
  misc_feature (27)..(27): n is a, c, g, or t
tagttaaatgcaataattattaacaanaatccaatgttagtaaaattattcggaaagcattttggaccaaattacggacccggaaatgagatgttcaaatatcttaaagacgcattggctgattgcatcgcatattaaactcgaggagaaaaaagtacggcaccgaaagtgagcgaagcaaaaacatatgaaacccagcaaaagtgccaaattctgtcgcttaatgaacatttgtaatttaatgcacaaactcatttatgctacatttatttattcaaaatatgagggatgctaaaacaaaaataatcacggaagagtatcacagaactcagaattccatgcaaaagtccagcgcaatttggcgtccaatgtcattgaccggcgaaaccgtggtggtcgtaggggctgtcggtggcgcgggtgttgcggtgccatttgcctaaaccattgaaaatggcacgctgagaatggtgagtcgagaaattggacgccaacaaattgggaaaatggaaattggcatcaaagacaatcggaaggcacaaatggaggaaaataaaatgaaatgatcaattcatatgatttagcgaagccagctggaaaggaatctgaaaagcttcacaaccctcgggtttttctcgacagctttcaactctcgtaaaactattttcttgggacaattttcgattcctataggtaggtactcacaatcagcttttttcacatttccgaactttgtcatattaacagtctaattatctttttttacaatttttttacctacggtaactcacctcttttaaaagagcaagagatacgcgatactttaattcgtatcattttggctctcatttagccgttttgccattttgatttgttccgtttcaattttttggcttctggccttttgcccatcaccctcccctcccactttttccgttttattttacgttttgtgcgccttgcggcttctgctgttgtatctgttggctttgttgggccaacatttgacgtgcaaattcgtccagctgtgccttttccttctccgtcaattcgcgcgcaaattttcccgaaatgtaaactttgtgattttggacggtacaaccggccaaaatgtacagtgtcgtctgaaattgggggagagggggcggagggatgagtcaatttacttttttagataaggatggtttatcagcccaagaaatgaacaaaaaaaattaaaatttttagagcaattggatattttaaagtcgggcatcattcaaatttcacaaattttttagggtttcatggttatgaacctgaatttctctaatacttttggtttgttcaaatgctttcgataaaaatgactcatagccaaactaatccggatttattcattttgtttttcttggctcttgaacggattccctagttaatagcatttcgatatttcgtgattcctcattttaaaaattgattcatttataaacaaaaatccttgaacttaaagtcccaagaatcgggacctgatttgatgtacagaaagtcggaagttgcggacgaggcggaattgttggcaaagtggtggagtttcgttgcacagcttgctccaaactggcatatgcatcatcaaccttctgaataattttttaaattaatttgggcacaacggagattggccaaaattggaaaatgccattttgtgttcttttgtaacatatttagaatattttcggagttgttaattgctgtaaatttgctcattaattctccacctgcttccattcaaccaattcacgtttgtacttctccatctccgccaactctttggcactcagttcacggataaaattctgccaaaatttaaatgaataaaatgtttccataagcgcataaaacatggtcgtttggggggggtattgttttcgtagggttattttggcgagatttaaacgtagggatttaaactgacaaaggcaatcgtaacgcctgacaaattaggcactaattcgagaggggcgaagagcaacaaatttattttttccgtttggtttaaaatccgatgaatcatcaaaaaaaggaatgaatgattcggctgctgggcttaccccatgtgagtacagcttgttgccggtggccacgcagcccgagccggtcatcatcggcgggctgtagtactgggcattgccagcgctgggcaaaaggagcagcgacgggagcaagaaaaagaggccaacgcggatgccaatttttggtgccattctcccttatttttggtaatgcccacagaaatttacaagtctactgaagatgaagcagaattgagaattggattaaggaatggccaaactctcgagagattaatgggtattggtggtccttttattttgatttgtctgactaatccccccgcccatttaattgtgctagcacttaacagttaatttgtaccaacaaaacaacaatgcgtctttaaaagattatttagcagtcaaaaatttgcgggcctcagaaattgggcggttgtagaaacaaagaatttgaattaaaagtgaatgcttggatgaatgcatttaaggatggccgaccaattgaaagcgtcacaaaatgagtggccggtcgactgaagtggggctataagcagcagaagaagcagcagaatgaggaggaggaggagcagagattagcaaatgaccacccattattcaccgatctccgagaaaagcaaacattggcagcccaacagag

SEQ ID NO: 6605 - DNA, 2482 bp, Heterodera glycines
cggcggtaggaaaatggcggtatgaaacggccagtatgaaaatgggtcgatcccaaaatagtgattactagtgatgaatagtggcgttaaaacgaagaatttccgagctaaaaatgttttcgtgcatttcagtggaaacaaagccgcagaaaaaataattaaaaaactaaaaatccgttccctactaatcacactgtaaggccgcgaatggaaagactgattcttgagaccgttttgttttcatgactttcgaacaaaacttttctcccaaaaaagtggggagcataggcagtatttttcgacttcagggtttgaaattggtgcaaatgaatgtcaattcgtgatcagcagctatcctgaaaacccttgagggtaatactatcgatggtgccccccccccaatttttggaagaattttttttttttgttctgaaatgtcgtggaaacatatttacggggggttttcagggtcgatcgatgatcgcgaatctgacatccattttgccctatttcaaagaaaattcaaaattttgaaaattcacttttagttcaccctctaaatccactccctagttcactaagttattgctcacgaactgtacataaatgttgaagaattttttaagtcattgaattcacagcctttcttccatctctcttttattatttcgcgaatttttgtgtgaaatggactctacaaaaccgatcgtgtttttgaaggtcagcctaaaaggaaagccggcaacagttgtagggcgagtcggtgagttgtaagctcttctgtatgaatgattaaaaatggcttatcaaaaattctgggtgattgtttgtattttttcagatacgaagacgtccgttttgtcaaaagcttttgcctctaaaattggtgacattgattcgaacctgcgtggccatgtgacgctcccaactgccgatgtgcccgttgtaggatggtaggaaatgttcgtacttgtcaaaaaaaaatttaatttgttagggtggatgacgtgtcagtcgctttgctcaatgccgaaccatatgtctttgcacaacgttttggcgtcgtggcggatcatcacatgatcgcgtaagtttttgaattaagttaattttctgtgcgacatactgtaaatttaagcttttgcgaacgcaaggtcgatggcgtctttggagccgacttactcaaacgcatgggcattttgaacgaggaacagattgacgccattccgctcgcttctggagatgttcctgaggaataaatgatcgtttttgaccgccaaaaaagttgtgaagttttcagttagggtggtcaaaaatcgaaatttcttttggtggttttgcctgtgtacacgttgcatgacacgtgtacacatcataagttacatattgtacatgcataaaacatgtacaatatgtaacttatgatatgtacatgtgtcatgcaaagtgtacatgggtaggttgctaaaaacattttttaaatttattcttgaccactttaactgaaaagtgccatttgttttcgttatacaatttctccgcagttatattcaggccaattttatgccctttatttatgtgtacacccaaattataagtgataaatcctttgcagggctttttgttttccgatttttcttttgttgatagctcacgtgtaaatttgcacaaaaagtttattttaaaaatgacatgtcaaaaaattttgttgcccggcctctttattagctcttctgcattttgtcggacgtaccgacgctgagcacgacgaatcagcaatacccgtacaaagaacagactccgaagggtattttcgagaagatgggcttgcagaaaacgccggacggcgcttcgctcggcgaatttgcagtgatgcgtatggacgacatgatgaacttgatcgggcgcggctctctttggttagcaaacatttttttaattcgatgcattaaacgtatgttttgtagccattgataaccaaattcagatgcatttcgccgctcctcgttatgacatgacgcggtttggcgatgtgtttcgtgcaactccttgtcaggtttgtgaatttaatacacaaatgattatgtttttgaaaccgggtgaacgcagagccgagattttttatggcaattcgtaaataccagagattggaggccctaccaaaaaaaaatttgtcccttttccatgacaggtcaaagagccaccgattgacgtcgcgccgaccacgccgtactcggagcaccgcgaaccgatggccatttgcatgtcgccccagacacaaatgccgcccgcccaccagcaacagcagccgatggttggccaagtgccgtccccggcacagttttattgtgagaaagaaccgctgatgatggtcatgatagaggagggggagatgttcaattaaaattgtaatttgtgtgtcgtcggcacagaccacccattttttggtccgttaaattctttgttcttttttcatgatttt

SEQ ID NO: 6606 - DNA, 2597 bp, Heterodera glycines
gagtcaaaatggtcaccatggacggtaaaaaagaaaaaaaagcgacaataaatctttttatggataattatgggaaaaaattggcgttctgtcacatttactttttatctttatttctctcacttttacgtactatctcttcattttaattatgtaaaaaacaacatttacttctctccatataacttttttcctatgcatacaatttgcaccaaattttgcaaacctatagagaaaagaattctgcatctttctatagtgaatttaattttgtctatggtcaaactcaaaagttaagaagttcctaataaaatgtatttcttttcctctccttttggcgtactattttcatgtctctaacacattaaaaatcatgaaattcgcaaattctaataattttggttataagggtacaaaatcactttgaacatttagaatcaatagaaaaaagaataaatttagcattttggttagaaagagctggctaggacttgagttataacatgataaaagtttgaaattccgacaacttttttctgagatgtcaaattgcttagcattcacttagaaaaagattctccttttcaaaatctttttttagataccaaatttgttcatttttgttgggaatgaagcgtattatggctgatcaaaataaaaaatacaaaaaaggcatttaccagtgtaagtgcatatactttgtttttgcgtgtgttggcgttttgttttacgccaattattttttggcaatttttttcgttttttaccgtccatggaataaaccggtcgataattccaatataaatttttggaaatttgtaaacattttcacttccgacatccaacattttcgggctcggaaatagtgttcataactaaactaatttaataatctgcatatttaagaagcaattataattttaaaaatgtctacaaattcacagaaatacggtaagggttgaagtgatggttttgaattttgagtgagtaaaacaattgtttctttagtgtttttaattggtaattttgtggacaagggatggcgtagccaccgatccttggcttcgggcggggagctaaaacccctccacctactccaacgataacgaccttataattttgcatttttcccaaccaaagtatttgaaaactagagagttttatcgaatcttacccaacatatttaggataattaagttgtcttagagtcaattatctattttttacaccatctttaagtttccgtcgaacaatttcaaaatggtcagaaggcacttttggaacgaatcggtgaattggagaaacaattgaaagaacggccgcacaaacaggaagaggaaacggagccaatggcaaagaagggtaaggttttcagagagcgcggtgcgccacgtaatccgcgggtgggattgggactttgagggacttccaaaattgcgggaataatcccgcgggaatcagtcccgcaaaaattaagagttctaatctcgcaatggaattcgaaaagttacaatttctgggtttagtgattaataaacaaaaaaaacattaattggttcggctcgcgccgtaaaacggtttttttgttaatcaatctttggctttttgtgaattctttgattgtttaagcattggtcgacgaacaattcgcgcagttgcaaaatggtcagaaggcaattttggaacggatcggtgaattggagaaacaattgaaagatcggccgcacaaacaggaagaggaaacggagccaatggcaaagaagggtaaggttttcagagagcgcggtgcgccacgtaatctgcgggtgggattgggactttgagggacttccaaaattgcgggaataatcccgcgggaatcagtcccgcaaaaattaagagttctaatctcgcaatggaattcgaaaagttacaatttctgggtttagtgattaataaacaaaaaaaacattaattggttcggctcgcgccgtaaaacggtttttttgttaatcaatctttggctttttgtgaattctttgattgtttaagcattggtcgacgaacaattcgcgcagttgcaaaatggtcagaaggcaattttggaacggatcggtgaattagagaaaaggggacagccggacaattacggtaggtttacgcattttgaattttgaagaaacaaagtttacgcaatttcaattttcgaataagcttttccaataacatttaacgaggtcagaagttgttccgatttaaatgtgtacatttatttaaatttgtgccgtccattctggattctttgatcaccacaggcaacgcaaaagaaaattttacattttttcaattttttagtttctgtcgatcaattcaaacgccgaatagaagcaatcgaaaccttcttttatgcatcgatttgttggggttgttgtttgaatttaaaaaataaaaatacttaaattttttgttgttcattatcaggcgaaattccaccaaaggaggacgagaagggaaaatacggtaaggaaaaaagagatataatcgaaaataaatcctaatctctaaaaaacttttaaagtatcggctgagcaattcacacaattgcaaaatgatcaaaa

SEQ ID NO: 6607 - DNA, 1972 bp, Heterodera glycines
atttttaaaacgaaacagtgcacaaaaagagagggagggttagacgaaaagaggaatttttaggaagggacgcaccccatctgataattctccttttctgttccataagaggccagaggcgactgtgttcgttgacaagtaattgtccaattaaggtacttggactttccacagtaaaatgtggtacaaattttggaactgtccctcctcacggtgggacttaaaaacatggttaagccaagttcgaaacttcagaggagaattttaagttttgaatttttacaatttaatttcttagagtcaaaaaatttcggaaccaattttttaaacgaaacagtgcacaaaaagagagggagggtagaagacgagagtaattttttgtaaggatcgcaccccatcgaatatttccttatttctttttcataactgtccaaaggtgactgctgccattgactcttttgtagtccttaaggtacttggactttccacagtaaaatgtggtacaaattttggaactgtccctcctcacggtgggacttaaaaacatggttaagccaagttcgaaacttcagaggagaattttaagttttgaatttttacaatttaatttcttagagtcaaaaaatttcggaaccaattttttaaacgaaacagtgcacaaaaagagagggagggtagaagacgagagtaattttttgtaaggatcgcaccccatcgaatatttccttatttctttttcataactgtccaaaggtgactgctgccattgactcttttgtagtccttaaggtacttggactttccacagtaaaatgtggtacaaattttggaactgtccctcctcacggtgggacttaaaagcagggtaaagccaagttcaaaacttcagaggagaatttaagttttgaatttttacaatttaatttcttagagtcaaaaaatttcggaacagaagtattatttaaaatcaaaaataattttagtaaattttttacattttagtttcaaaaaaacaaacaaaaaaatgttcccaattttgaaaatgaaatagtgcacaaaaagggagggatggttagacgaaaagagaaatttttaggaagggacgcaccccatctgatattcacccttttctgttccataagaggccagaggcgactgtgttcgttgacaagtaattgtccaattaaggtacttgtactttccacagtaaaatgtggtacaaattttggaactgtcccgcctcacggtgggacttaaaagcaggatagagccaagttcaaaacttcagaggagaatttaagttttgaatttttacaatttaatttcttagagtcaaaaaatttcggaaccaattttttaaacgaaacagtgcacaaaaagagagggagggtagaagacgagagtaatttttaggaagggacgcaccccatctgataattccccttttctgttccataagaggccagaggcgactgtgttcgttgacaagtaattgtccaattaaggtacttggactttccacagtaaaatgtggtacaaattttggaactgtccctcctcacggtgggacttaaaaacatggttaagccaagttcgaaacttcagaggagaattttaagttttgaatttttacaatttaatttcttagagtcaaaaaatttcggaaccaattttttaaacgaaacagtgcacaaaaagagagggagggtagaagacgagagtaattttttgtaaggatcgcaccccatcgaatatttccttatttctttttcataactgtccaaaggtgactgctgccattgactcttttgtagtccttaaggtacttggactttccacagtaaaatgtggtacaaattttggaactgtccctcctcacggtgggacttaaaagcagggtaaagccaagttcaaaacttcagaggagaatttaagttttgaatttttacaatttaatttctttagagtcaaa

SEQ ID NO: 6608 - DNA, 2542 bp, Heterodera glycines
tccctttttgtgggacgataagagtaaatattttcaaaataaattaatttgtaaaataaataatggctcaagaaagggactaagtgaattaacggagagagtgaaagagagaattatttgttaattaggcaattagagagagaaagcgaatgcaatttgttgaaagttggtatagtcttggtttgtgtttttgcgttgtttggtatactttgaaattgttaagactgacgtcgtaccggttttccctttggtgttttgcctatacatataaaatttatggggcgaaaaatcccaaaataagggcctaaacaagggaaaaattgcgaaaattgggccgaaaaatggcaaaaaagaggtgaacaattttgaaaactatgcttttttctatgaaaatatgtatattaaaatatgtgcaaagaattttattcattttttatgaaatttacttggtttattttagcattttaatgcatttttataaatttttaatttaatagaaactattggtattgcggtttctccgagtcctatagtttttgcagagtatgtcaggaggaccaggaattttatgaaaaccaggaacagaaaagtcgggagcttgaccaagaaaaaaatatactcaaaatttatgtaaactaataaataaaatcagtttttcacaattgaccaaatatttcatgaaattctgaatcaggggagaccaaagttgcattatgtatgatcattgatcaaagatgcagttccgccccaaaaaactttgaaattcggaagctgtaagttttttcaaccaaaaattttgttggtaatttgggaccgatatttcctttaattttaaagttttcctaaaacctttaattttggtggtacctacgaatatattttactgcccaatattttcccaaaattttttggtggatagagagggccggcgctgctggagaaaacttgaaaaattcggctttattagttaatagattttgcgctcaaatatgttcatttttgggtttttggcagaaaaattttataacaaaattataataaaacaacgttttcttagtaatttcattaaaaataagaagttccattgatcacttccgaaaacctgtttgaactttaaacagaaaaaatatttttcacctttcaatccaaatctccattaacatcattcatcatcacttcactttttttgattcactcaacgcaaaaacattaaaactccccgagaaattggccgaaattttcaccccctcaaaaattggataaacattaagagggaattctcgttcccgccaaaattacgaaaattaatttggcaattattgccgtgggaaagaaaaccgataaatatttttgtgtatataaatagagttgttatcatgagaaaagtaataaaagatacaaaattttgtatacttagtcaagcgattaatggaaaatgcaatttttatttatttttaataaaaaaatttgatgattttttttttgttttttcatatatagaattaaaataaaaatatattttactcgtttataaaatggcaaataaattgcaattttctttgtttgttgttttggtcctttgctacggttccacggcttttccgcgtctcaaccaacaacaacagcataagcaaaagcaaaagcatggaggtgaaatgttcatattttaaatttaaaattaaatccacttaaaaataaagctcattaagttaattgtcgttagggatggttccggaatttctgggataaaaccctaaatttagacattgccttaggagttccctaaactcggtggtataaacaaacaaacagaatattagtcttaaagatactgtatttgcagtaaaaaataacaaaaactgttttgtcaacttaattttatttagaaaatgatgggaaacagcagcaaatggcgcgtcgtgtgccatttcctcacccgggtcaagcgccggaatattttcaggaagccagcgacaaagcccaaatggaatacaagcaaatttttgaggatgaaaaaggccaaatgccaaaaggggagctgaaggaaaaactgaagaaatgggctgaaaacaatggcataaaggtgaaaaatatgtaaaaattaacataattcaaaaacggataaaaattaaaaaaaattttaaattactttttaaaaactttaaggatgaatacgaaatgtcccaggaagaaaatgaacaaaagaaggagtcattccataaaataatgtcagcaaatcttggcggagacgcactgaaagtatttaagaagatttgggtatgttattgtcaaataatggcacatcgcagattttgtcttcctccctcattattattggtttttcatattttatttaattttttttttcacgacatatcattaatatttcaggaaatcacgcacacagatgaactgtcacgtcaatgatgaatgccaacaattgcaggcattccaacatagagttaaataatactgacaagaagattataaaatttaaagggtggagggccacaaatttatttcactttttcattgagataat

SEQ ID NO: 6609 - DNA, 4142 bp, Heterodera glycines
  misc_feature (4067)..(4067): n is a, c, g, or t
tttaattagttttttataggggctggattttagttcctcctggattgtcattaagattactcaaaaaaaccctaaataccaaaatttttatcaaatatagacaaaaaattaaaaatattttataattatttatttatgaaagccgaaaatttttgtgtttatatttacgttaaaataaaacatttacgatttgaaaaaatggtgttttcgtgtatttcttctcaaaataaaggtgcaataaatagccttaattattagcacatttaaatgcaaaaaactttgccactaaatcatcaaaagtacggcagaagcaactaaagctaaaggcattttcggcacatttaaagcggcgttgccatcggcatcaaattccgtggaaaggtccaccggtgaaggcggtgaactgcttggagatattggcgttgatctgcttggggatgttgaagtgggtgactctttgtacaaagcatcgcattgttccttccccccgttgcagcaactctcgtcacaggcaaagggttccgagaatttgcactgtttgtacattttggtcaagtcgttttcttcgtctctgctgcatcctttgattgtgtacaatggcactcggtttttgaacatttcgtcgttatcgattctggcatagaacgactcattgaagcagttcatggtgaagcaccactctccctcctcacacactcgcgcagtcagtccaatggcacttcatttgcacaggcgatcgctggaagaaaacgcatggtcaataaatacaatttgagtgagggtgataccaaatgttatttaattaggaggtaattgcacagaaccgttaactcgagtcaacaataaaagagtaacgggataaaccgaaatacacatttggccttaattttgttagtggtcaattaaatgtaattaatgtaaggtattttcgaagattaaattctgtttgcctaatatgcggcttgaaaagtttgttcattgtcaaattgcctccgtctcagtttttccaatttatttttacttggtctgattccatatgattgcatggaatatccctttggccacggcattttccgcatttcgacggttttcctccgtcttcaatgcactgcttggtcagctcgtcacagtccatgtcgctgttcatctcctgctggcatcctctgaccaaacttagcgtcagcccatcgttgcttgttccaaccgtaatgattaatttttccaattttaatttgtgtcttttctcaccgatggaacatttaaactcaatgcgagtagggttgagctcaattaggaaataaaacaattttaattgaaaaattcattaaaactcactggcgacacaaaatgcaattccgccaaacaacaaatggaaaaggaaaagaaattccatagcaataataaattatctgaaaaaaataagtcgggacaggaactctggtccagatttttaaaatgaatgaaataatttagattcaaaaggacaaatcgttcactatcatttctgattgaatattcattaatattttctgggaaaaaaagaattgatgatcataaaatttatttgttattaattttttcattaattaaaaaaaattaaccgtttaattaaaaaagaattttatatgaaccgaccataaaatttctcttcgagctgttgtgctggttaaaatattataaattaagttgtctttggtcggcatttgcgacgtggataagcataaatatttttcttttttttggccaattcatttttatgtcgacttttttatgactaatcctttttagtagctaatacgtcttttggctttaattgtgaaaccgagattaaagtgataaaattttaactatttttgatctgtttcaactcaaatttttatatatagattttactatttaatatttagtatacaaaatagaatttttgaattttctcaaacgcatttttaacgaaatttctattgattccggggagctttcaaggtcgctagtcgcaaatatcacattcgttttaaccaattaaagaggaaggacaatttttttttatctttgagtttccaaattctcattaaacatccaataatagcaaaatgttttctgctaattgagagatgaattttcaggaaaaataaaataattgtgcattgaatgagttcgataatttaaatatccaacaaattttatttagcgaaaactttttcaaaataatgttaattttctcgagttaagagaaggatttaaactcgttgtcacacatacagtcatggtcatcatatctttagcaccacttaaaacttatatcaaatttgttttaaattgattataaaataccaatttgatatacatgtgtatatatgttttacatttcttgtagcattttttgtgttgcaaattgctcgtttatgcctacttaattattctaatacatttttgttgctcgaacctcatttctgcttattaaatgatgaatatcgggaaaaataaaataattttgatgttattaaattttacttagtgaaaactttttcaaatttatgttaattttctcaattaacgaaggagtgaaactgtttgtctggttcaattttattaaactaaaattttcgaacaaaaagcttcccagagaggtcaactgtgtattttaactaagcatcaataatttatagaaattcattgtgtaaaaattaagtattttgtgcaaaaatgacaaagttttttgagccaatttttaagaaaaatttaggagttttcgggcccagaggtgtcagtggacaattgcctgcggaatttgccccgatttttaacatattttaaccaaaatttgccattttaacgatttggttcaacttttagtgaaattttggggccgaggtgccgatttgcgccgtcgggcaaaatttctgaatttttaataatttttttacatctaaattttcctcattcacccccaccccttcgcatttttaaaacagacatagttcataattcttcttacataaatatgaatttttttttcaaaaaaatagtttgctctcgaatcggagtgaacttttcattggaataattgtaaaaaatttttttcaaaattaaatattattaaatacccattttatccggtgcctgatctcggttaaaaaaagttgtgtccaaaattcggcttttctttacccgggcaaattcgagttcgactttgcccaaagcccttacgcgtgttgttatccattcattcatttattacatccatccgccaattcttttggcgttttctccgccgaccaaaaacaaaacaatgatcacaaattacataagcttactgcattatttacataaacaaacatatgatcaaatagcagagaagcggtctctttcgacaacaatttctccccttgctgaagtgccttttccataaatatttttgcatcgttttgccatcggcgattccattctcttccaaagtccgcccacagcccttaggccttagtgctttaaaaagcctaaacatatggccctcttttcatacattggcacattttaaatttcatcccgatttgtgctgggtccgtcccgtgcatccgtcttttttttaacggggcggaagggcttgccagcgggtgccggttcgttctgacccggggtactaattatcctgtcgcgataatttgttccccagtccgtgcgagagtcggtctttacaaagcagaaacgaaacagaattgcggttcccgaaaattttgggctttctcggaattcctttccttggtgtacttaaacaaatacccagttggtgcttttccattcaattatttctgacgcgcaaaaaatgggcaacggtttttcgtcatcttcggacaacggcttttcatcatcatcgggatcatcttcgggccatggttggtacgagatgatgcgcgactttggtgacaacgacttgccgatggacgactattttcaggagcgttactgggactatctcgagcgtcgtcgccatgactaattacgcggtgcgcaagaatttcttgattataaaatactaaggcatgtggtcaaagatttagtgtatttatggntggcttagttacctgcttattaattacttttgaccacccttttttggcaattatcgcactccaatgggctaatga

SEQ ID NO: 6610 - DNA, 3484 bp, Heterodera glycines
ttgttgcgcgccgcctcagagttgttgcgcgctgcctgggcgtacatatgtcccgtctcaattagcatggacttaaaaatgtgaatgtaataataaatcaagtaaaagtaataaattataattttattccttaaatcgtgaaatattttttatttaagtctgatatgttagatcaacctgttcgtatctggccaacctatccgaacaaaaaaaaccaggctcatccgggaactcaatttttttgacacaagtcatgttttaggatttcaagaaaatgtttatgcaaaaatttccaattttattatttattaatttggcgttgtattttttttcaaattgcacgaaaaactagtataaaatgggaaaaacattcatttcgttttcgcaacgactcgtttttttattccaattgtttttttggaaagaaatgtaaaaaaaactaggtatacccgatgaaattttatagatgtttttaccttatcaataaatttttaaaattttatggattattgttcaaaattaaaatgcactaacccgttcctggcttatcgtcggcatggtctaagaaggaacacaacatttataagaacagggcaaattttgttgtataaatatgtttgatacataaaacgacaaaaggaaaattgtaaaattcaattggaataaaacaaatttattatcaactagtataaaaacataggtaatttaggcaaaaattttcaattattttgaaaagggtagaacttaagacatggcacttttgttgaccgaaatttcgtcaggcacttcgcccacctgcagttcttttccgtccgaatcgctgatgcccggccacagagtgtcaaagcgctcgatcagccgaaccggcattttgttgggctccgcacgaccgttgaccaccagcatcacctgttgaaacaagaaaaaggattcaaatgagaaaacgccatgtttaattgttgtaatttattggagtctgtccaattttaaaataaaaatttgggagcagatcgttacctccaccccctccgaaaaaaatttttttttcaacctagaaattttcattaaaaaatctcctaaaaatttcaagaaaaatttttatgaaaaattttcagcgtttttttgaaaaaaacatagtggttcatcataaaatctcgaaaaaaccgctgaaaaaattttcaaaaaaattttttaactaagaaatttttttctgaaaaatttctaggtttgaaaaaaaaattttcgggggggaatgaagtgcaccaaaaaattcggatccggtatttgacatcggtaaaataaatgttatcacgatcagtgaatgggcgtaaccagagagaggctaaccgatgagggcttatagtcttattggctaggcctttaaatcattgaaatacacaaaatgaaaaaacggttttaaaaatttgttgaaaattaaccccttcgaagcacatgttcaattgcggattggtggcaaacgcaattggaccgactgctgacatcaacgcatgcaaaaccagtgacgaaccgaaattctaaacaccaaagttaattgaaagttgaaaaaacgagttttaacccatttgttggaaccggcaaaaacatgacgacaatttgcgacgagaccgagacggtcaatcacctaaaaataaagaaaaattcaatgccaccgcctaacccatccttcacctccttggcacgactgtgcttcgtctgttggctgtgtgtgtcgtcgtcgtccatctgaaggcactcgagtgccatggcacggttgtccgccgtgggcagagtgcccagaaacaaatcgtccggttccaagtgatgctgaaatggaatccaaattgagggcgaattttcaaaaaccattgaattgcagtggttaacccaaactcactccgccaaactgagcgaccaaacggcgaaggaatgaaattgcgtcgaccggcagcaccgcggtttcgcccgactcattcgttttgcgcacaaatgcgacgagttggcgaccgtcgacacttccgaagtcctgtagaaaaaaatgcatcatttttatgtaaaactatataaaatggtttgccctcgcggatggcttaaagaaagccgggaaacgcgtggatttaacaatgcttttgctttacctgagcaatttgcggtggtggagacaatggttgtttcagtcgcgtcggtagagccaaggcattgttcgactgaacaacggcactcatcctcaaatatcagacggtaacggtggtcagcaaagaatatgaactcttaagtttgggaaaacgaaaacaatttataaaaacaacaaaaaagtttaaatgtcgaattcgacagcggctcggccgttaacggaccaaaaaaatttgttttctccctaacttttgcacagtttaccaaaaacaacaaaaatggtactcacagtcgaaatctgtgtttaattagaaagttttctttaagctgtgcattcttaatagggatgggatttttatgtttttacatattttttttgcggcttagttatggcgagagaagcccaaaaatagcattatctccgaacaatttttgatttagagcgacttataaaaacataaaaacacatattttgacattttggcacataaaaacatatggcacatatttcggggttttggcacatattttgcacatattttggcatttctgagaaaaatttgcaataaaaatacaagaaaattgaaaaatacaaccctaaaaatcaacttttttcacaattcttatagaattttcaaattttttaaattttttttcgaatgtagaaagtaacaaaatcgaattcattaattcgtcattggatttcagttctctgctggaactttcaatttataaaatgattaatcaaaaaaagatcaattttaccccaaacactttgaaatgtatttgatttgcgttgtatgggcgaaaaatgataaagaatgagatttttgggaatttttatgcaaaaagacacttgatttttccaatttttaacacatattttagcacatattttggcatttttggggtttttagcacatatttaagcattttttagcacatattttattacatatttcaggatttttagcacataaaaatcccatccctaattattaatgatggcactaacgcaaaaaccttttgtttgctggtccgctaatgacagtggaccagacaaacacttagtttctcaagttaaatggctctaagaacaaatgtgcgcatgttaattaccaaccagctttttcgccattagttctaggtcaaatccaaatttattaacatgcaaaagaatgaatgggtttttctaaattttccgtcctttcgacttttgtcagatcctttttttaatattcatattcaaataaaaacatttatatttttttggcgttttgttactttcctttcagttagccattctttccacgataatcgaaatgtgtcaaagctaaaaaataggatccgagat

SEQ ID NO: 6611 - DNA, 895 bp, Heterodera glycines
taaaatttcgaactcctaaccccgaattcaaatatttttcgatttttttttgcaaaaaaaaaaaaaatttgttttcgccgtcgccttcagtgaaattccaatgaattttgttaaatttcgctttttcagatgaatgagttgttatctcttacatatttcattaccatattcatgatcagcacccttctcaaatcgctgtatattcattggaatttcactggcgacggcgaaaaaaaaattcgaaaaatgttagaattcgtggttaggggttcgaaattttattaatctgagtcagattctgtcccagcagaaagaaggacattcaagaaaatgccgctacttcaatttgacttttcaaaattaaaagttcaaaacttattcaaacgaaaaaaattagaaaaatcatgccagtatgtctttcgaagttgatcaaaaaaaacactttcaccaccgtgatcagtttaatccttcacggtgatcgggaatgatcaaacgggaaataggtggcggaaaatttcttgaagttgcaatttgaaaagaagcattatgactttttcttcctcatcagaaaataaaatatcaaaacgattgcctttatcgtattattagctgaaagaaagggagagaaacagactgcttgctcttcgtcttttccctttgcctaatgcgtcgcaatttgcgatttcttctttctcttttcccttttgcgcgcagtttaattgatttgtgatgtggaaaggcaggcaaagaacgcacatttttgttcagtcagtcgcagacggacaacaaattcaaagagagaaaccgagggaatgtgagggaaaaagggacggaggggagggagcacttttttggtgggtttgtcgtcgctgtgactgacactgacacgatgatt

SEQ ID NO: 6612 - DNA, 1712 bp, Heterodera glycines
  misc_feature (1573)..(1573): n is a, c, g, or t
  misc_feature (1662)..(1662): n is a, c, g, or t
cataacttttcaaaaagcatcaaaattagacattcttagtatcatttgatagccctaagaatgctctattagccttcaaaaaatttcgttgagtttcaaaaaagttatggccagaaagtttcaaaaggttggttttctaaacatttttagccataaattttttaaaacccaacgaaattttttgaaattttgcaggctaatagagaattcttagggctatcgaataatactaagaatgtttaatttggatgcttcttgaaaaagttatgatccattaaaatttcaaaaaaataaaaataatttttatggccgtgtcttttttttatggttgtgtgaactgcaatagagccgtaattgtttttgtttttcttccattttccgtccctctgttcatttgccactcactcattgcctttgaaggactgatttttgtcgtggacagcaacgaccgcgagcgtgtgggcgaggcgcgtgaggaactgatgcgaatgctggcggaagacgaactgcgcgacgcggtgctgttggtatttgcgaacaaacaggtgaaaaggggggggggacattataggcacatggcatttagcgggaaggacacttccgtgttggttgcgattgagaatcatttaattattattttgcaaattttaggatttaccaaatgctatgaacgccgcagaagtgacggacagactcggactgcacactgtaagcgttggctgaatgggattttgttaggtttgagttaacgctatggcaaaacaaaacttgttgttacgtatgagtttctcttccttttgttccgtttagaaccttcgggcaaatgggtgctttctgacttccacaattaatcactgaaaaaggaacattgtttcgccattgcaatgttttggtgtttcagcttcggaaccgcaactggtacatccaggccacctgtgccacgtcgggcgacggactctacgaaggattggactggctgagcaatcagctcaagaacagaggatgaacagcgagcggaccatgcgaattggaagatgacggaagggaatttgtttttgcgcgcagctctgttttggggatggccgtttaatttcgataactatttaatgttttttgtgacaatccatcaaaatgacttctgacacattcgacaaaacctttgtgaaaagatttttaaacatttggactcactcccaaaatcagctaaagtgccgtaggagtcattgtctatttgttaatcagatgggtagtgtggccaaactacacactgattgtgagcatcggattcgtgtttttatatcaacattttccccaccccattttcgctcatttcttgacgttatgtcgcaccttcaccaatacaacacgttaatgtcattgtctaccttcgggaatatatttgtttgcgtatgatgaaaattcaaaactaatcaaaaaagctaaattttgtttgtgtgttctttctgcgcttattttattaagaaatagactcaaaatcacatgaatctttttatgggtagcaaaagtggccaatttctgaaaaattttccaatactcaaaatattgcacgtgngaaacccgcatttttataattcaaattttgcaaaaaaaacaaaattaacaacaacaacaattgatcaaatggcgttttgatcaaccaanaggatgtgtattctggcgggatggtatattttgacgttgtgtttctcacc

SEQ ID NO: 6613 - DNA, 1372 bp, Heterodera glycines
tcaaatggaaacggcacaaacggttgcgcaaattgactaactgaaaagggacgctgaaaaggtacaatttgacgctgtcaaatcattttcttgttattcccacctcaatttgtgcttctgttccttttttgccttcttccccaatttgttggtcgcccttttccatctgtttgatttttgctggcgaaacgatggaaatttgcggcacttttgccatttcggccaccaattgtcgctcaattgacggatggacccaaaggaggagacggctgaattttgaaattgctttgaaaacttaaattgtggttaataatatatgcgtttgaatttttcaagttaaaaaatcgacgaattctgacccgtcctccgtccacatggctcggccgggccccaaaaatccgtgtgggtatttgccgggcgaaaaaagcatcaccggcacttccaaatgacccgaaagggcgccaaaatgggcaaaagtcggcgaaaccttctgaaaaaattaaattgaatattttaaattttagagtggaggattaatttttactttttcgcaaaattgggccaaaacttcggaaataattttcattttacaatcagacgaaatttgggcggacacaacaaattggagacagcataggtaactttggtcaagagagctgaaagcacttttggaattttaaaatttaatgtaaaaattacacggccgaacggacggcgcaacggtaatttgggcgaaaaccacgctgacagcttttcattggcaatttgtagccccaaagttccctttaaaattctggggaagagtttttaggagaaacatttggggttacgtcatgtgaaagcgtttggcgtgccaaatgtgcgtttccaaccaaacgtttttcctttgttcgcgcacccatcgctaaaatgtggaaaataatcatttattgactagggtcaatttaggtcataaaatggattttaaagactgatgaaagtgtagaatgcaaagtatttattcgcctcccccaatagaatttctatttccacccaatttcccatttttttgccctttttcacttaatttgagcattcgcgtcggcctccgtcgccattttcggctcggtgccttttttcggtgtgccgttcgctgtgtgtgccgagcggcgatcgggcgcaatgcgcggggcaatcgcttcacattgtgcgacatcgcacgtcgacgcatgtgcctaaaagctgatttaagaataaatgagagagggcaattcgaattgacctcggaagtcgctgaaaaaccgtccttggcccggaagtgacttcgccgagaccaagcgaaggattgtccaccacctggggggaaaattggggacggagatagacaaagcag

SEQ ID NO: 6614 - DNA, 2362 bp, Heterodera glycines
  misc_feature (2351)..(2351): n is a, c, g, or t
atttggatgattgtattatcggttcgatgacagaggactaacacttaaaagacatcgaaacatttctgaaaacgatggctgaggttggctttcgattaaagccagagaagtgccgatttgcacttggagaaatacgatatttgggacatttaatttcggaaaaaggtgtgcgaattgaccccaaggatttggagccgatacaaaaaatcaaaaaaccaaaaaatataactgaattacgatcgctgattggtgtcttatcatactttcgaaaatttatttacggattcgctgaaatactgcaacccatttatgaactaacaaaaaatgaaagtacgacggaatggggacaattacacgagcaagccctggaagagttaaaagaaagattgatgacagcgccagtgttagctccgccaagatttggacatccattcgtagttgaaactgacgccagcaccaaagcaatcgccggatgtcttctacagaagaacaaaaaggaggaaatccaccccatttgctactttagcagagttctaactaaacatgaaaaacgatattcagtagtggaattagaagcacttgccatttgcgcttcattaaagaatttccgcccatatttggagggagctggaaggtcaacggtggttacagacaattcagcattaacatcactattccgaagaaaggacttagaaggacgattaagcagatatcagctggcaattatggcattcgatgtagatattattcacagaccgggaaaacgaaatcaattctgtgactatttatctcgttatctgcacgacaaaactgagcaagaagttaattctttaaaattggaccagaaaataaaacgagaagaaatgatcacagcacaaaaacaggacaaagaatcacagagaatttgcgaattaataaaaaatgcggacgaaaaagggaattctgaggggacattcggaagatggaagctttttgagggccttttatgcattacagacaggggagagtggaaggtttatgtcccagagtgtatgcgacaacgattaatgagtgaatatcattctgaccctttccaaggaggacatttgggggagaaacgaacgaaagaaaaaattagacgaagtttattttgggaaggaatggacaaagatatccaaaaccaggtgaaaaactgtgacccatgccaaagaaggaaaataattggcgtcaataagagcgttgaaccaatttgcccaatagaaccggcagcgcgaccatttgaaagacttcatctcgacttaatgggacccctaagaatgacaaagggaggattccaatatgttcttatgattattgactcattttccaaattaatggctgctattccattgagagaacaaacagcaacaatcattaattcagcatttgtagataaattcttatgtctatttgggttaccaaaaattgttgtaaccgactgcggcacacaatttttgagtgcgacttttgagtcactcgctgaaaattggggatttaaacaccaaactacggtaccgtaccatcagtccgctaatggacaagtcgaacggtacaaccgaacattggtggacatgctcgttacaacaacagggggaaaagattgggcttccgcccttccaatgctttgttttgcgtataattcttcaattaattcgcaaattggacattcaccgttctatgtaatccatgggtttgacccaagaataccaagcgaagctatttttgacaaaaaagaggaacaattctcagacatggctatttacgtccaggaactgacaaaaagaatgggtgaagtaagaaaggtagtacaggaaaggctaaacaaatgcgcaggacgaatgattaatcagcaaaaatggacaaaagaaataaattggatggagggaatgttggtcctgaagacaaaaaatgacaaaaaacataaattggaggcgaattatgaaggaccttttcgcatcataaagatcgaaaaaccaaatttaattctgagggctttgaatccggatgatgagagttttgctgcacatatgaatcagtgtaaaccatattatactgaaccggaagaagcaacggaaaagggagtagggcctatcccgaagggaccacggaaaattggggaccgaaatatagaagaatcagatgaggaaagtgagaaaaacgagaccagaattgcatttttgaataccagaggagacggggctacgaatgaagaagaggaaatatttgccgagcctttgtacttaatggaaattcaatttgaaaacaatactattctgtcctacatcgatttttcggacgattttgaactttcccataatccgctacaaatcgantgtcccaggac

SEQ ID NO: 6615 - DNA, 1934 bp, Heterodera glycines
aaaaaatgatttgagcaaaacgtcggaaagagagaaagagcaaaatgtaataaaaggaattgtgagaaggaaaatgaccgaggaggaaaaggaagaaaaaacaaaaagagaagaagcgcaggaagcagcaagaaaagaacgagaggaagttggcaagaaggccaatcaaaagggaccgttaattggcgctgacgccaaaaaattattcatgacaaccgtcgagcagccctatgatcacggaagagtgattggacaagtctttgaccccagagcggaagtggaagcgccctgggatatgactaaagccctcgcaaatcgggaaaaggaggatgaaataagagtaaaaagaaaggatgaaagggaggaaggttggaggaatttcgttggcggggaaagaagaccggaaacgggaaatgaaagttggaaagaaaggcaaagaaatgagggaaatagtggggaaaggtggagagagagaccgagggttgtcgatgcttttgcgcggaacacaatttggtcagcggagaatgatgtatccacaaaccccggcattccgccggagggatttcggggaagaagaccgacgcctaatccctgttggaaccgtttccgcaagagaagatacatgagtccgattcgatacaatactgagcagcatggtgtggggacccaaacaccgacatggccgacaacagaaagttccgtcgaacaacttcgatcaatccgcttgatgttggatgtggcaattgcgggactggtgcaaagaaacggcaaaaaggagggtgaagaaacagaaaatggggaagacagcaagggaccaaaatgaaatcgccggcaagataggtccttctcagcacgaggtattgcgtcttattttatgtattaaagatatccaagtattgtaatgaaaattctttctgaaactatatttaaaaaatgaactttaactaaataaaacgacaaataattaaattttaaataaataaataattaaatatgaattttttccggtatttggtaagaaaattgcacgatatataattgccaaaatagaaaataatgtacgtaatcaatcgagaagaagtaattatatttgtatgttgggaattttataaaatttttattttattaaagcaaaataataactaaatcgttataatataattaaagaatttgaaacataaccaatcgagttcagaaaaattcacacttttaaaaattcaacaaggatattgttttaaaacactaactttcgaataataatttactgtaaaaaacacaaaaataatacttcgaaatgaaactaaattttagtactgatgaaggaagtattacaaaaatagaagtaaggaaattaattcgtttggtgaagaataatgtaatatcaaaaattaaagtaagaataatatctaaattcgataaatccttgcagaatctttgtatgttaatgaataatttaaaaaagttcttcaaatcacccgattgcagtcaattttctatttaattctgaaaaaaaaaatcaaaattccgtaatctcttataagctctcgaacgataccaaattttccattgtttgactttggtccaaatgatacatatttaccatttattttagtttttatatattttcatttttattatattaaattaagttttaatatattgaatattaattgttataaaaaaatacaaattctaaaatcactaatttaatgatgaggaattggtttgattctctgctaaaaatactgggactcaccatgaaaatttttaaaaaagatcattctatatatttttgagttcttcatacaagaaacaaaattattaaaacttggggtaaagaaatttaaataaaatcataataaatgaataattaccaataaaccaaatttaagtaccgtacctagcacaaaaaattaacagcctataatgataga

SEQ ID NO: 6616 - DNA, 6040 bp, Heterodera glycines
  misc_feature (5948)..(5949): n is a, c, g, or t
aagcaaaaagatttctaattaattatttaaaatattcatgctcaaatgatatcttttgatatttatcgtaacattaatgagtattttttaattaatctttttgatttaaggcttttaatataaataagttttttttatttttcttaaataagatttcatagaaacatttttagaatttctaattgtgaaataacaattatatattttttgattcagagttttacagaaatatattgttttggtggtaatgatgattctttttcaaagtgcagcttcatcaagttcattagctgcaataatatttggtcctaatttttacaaaatcaaaaaattaataccacacagcagggttaaaaaaaaatttttttgaagcgattgtatgaatattcaaaatttctggaaacttggactatttttctcaaataattcctttcagaattccaatttttcccgccagtgctgacaatctttgaatttctttaaaaaaattaggctttaaatcacaaaataggtaattttttaacaaaattccttaaaaaatttacatcgatttctatccaaaatggagccaaaaattataaaaatggcaagatagagtttggttaaaaaaattccgtaaaagggaaaaatattgaaaaaattaaatacaaaaacaaaaaaaaaacaataaacaaagtagtaaattatttttattaaataataaaaacgagtttcgaatttatgttattataggttttttttacttcgtagtatactacttaatacaatattttacaatttataatgttatacaaaaaatataaattgagcgttggacagaaataccgaacagcggatatcagcatgataaaaaaagaataataaaaatttaaaaattcaattatgatagaaactttgacagaggaaaatatgaattttaatattaattctaattttagtttacatgaagccgtttaaaataccaatgtattttcaatcgcatcaattaaaataaaaacaaaagttaaaaagataataaataaggtaattttatatattaaatataatttgtaataagtaccatttatgaatttaactaattattttaaagaataacagatgaatacttgaaaacgaaaattgtcctaaaataattcagctgagaaaaataccaattcaaaagaaatggtcatatttttgaaaatttaaatttttttaaatcacataaaataaaacatatgaaatgttattaagaaacataggacataattcattgatgaaatacttgaaaaaattcttaacaacaagtctacgtgaagtaatcttgattaattatataatcatattagattattgatcggagaaaggattgtacaactaattagtcaatgtcatcacattaactactaatctttgctgctgtgtatatttcatttatttatattctaattttattaggcactttatttaaaaagcgtcgacacccacatattttgatttggtgaattctattttccatgctattaatgctatttattattcatcaattttttatagatgatcattgtttcaaattcgaatttgttagttttttaaatattttttcgtattcaattctttcattaatttgaataattatataaaataataaacgtttttttgtttcctcattttttaaacaagcgaggtaattaaattgtaaccatgaatatattttaaaaattattattaataaggaaataaacaaattttattctatcagtaattaaaaaaagtcccaatataggtttttcattaatttgggtttttatcataaactgtgtttaccttgaccttgtaatgtaatttgtcatttggagcaaagtggtttgggattgtgcggcagcttcagatgtagtccaataggcacgggtttgtgagcgggcggcaccttcaaaagaaaacacccctcccgtaggtttgggtttgtgcgcgaaactcccgcaaccttttggagccatatactacttgcaattttatttgtgcacttctaattgatcccttttgtccttttattttccaaggtattccttggatgttattcatcttcgattaaaataatttcaccttcttttggctctctttttttgtgttttaggtcctttgtggtgccatggctccgatctcttagtatggtcaaatatacttttggccatctgttccaaaagtattctaaaattttgttcgttttattcctttgaacttttaatttgtttcccaatttttcttgctctaaattaaattcttcgttatttttatcatcatcagcgttttgtaagttattcctaattctaatcctggtttataaaatctatcgggcggatggctctttcgccttacggttcaattgatgcatgagtgatcggtcggatattcattatccattcgacttctgttataaatgtgtgcaactcatccaaataggtaccatttttccaagagatgctttaaacgcgtctttacaaacttttataattgttctgctctaaaattagcccacggtgctagggctggtataaatctccaaataattttgtttttaattaaatatttttctgattcattttttccttttattcctcttgcgtcatataatgaacacgcacaatggattaagttaaatatttaattttttttattatgtattattctaaatttcaaaataatgatttccgaggtaaaaatactgatcataaattttccctattgtactgcctacgagttctggacagggagcggtgtggacaatttctttgtgaattaacttaaaaattaaaatcgataaaaaccttttaattcgtgagagtttactagaagtataatgaaattttgaagaattagttaaaccaaaaataaataattataaatataataagttaaataattaaatgattaaatatcgatttccaaaatagtttgatgaattaatattgataaaaatatgtatctatttcttaaagttcaaaattaagaaaaatttatgaattattttaaaaatcaaagatgttattgcgtaaaaagtaacagaataaaatgattttaaatcttcaaaattcaataaaaatacaataaataaagtacaaagccttagtagaaattcatagcttaaattttttttgtcaattaaatcataaccgatcatattattattaacataaataatcagactaatttttacacatattcttacaagcatttatataccttataaagtattaaatattaaataaataagttaacttttaaaacgaataatctttaaagcattctactggcttgcagaaattaagggatatctcgctcgttataagttatgcaatctctcaattttaaaacctcacgtaaatgaacatgggaacctctcaaacttgctgtttagaaatgtatcttaagacaaaactatttatagaataagaaaaatgtattaaattaacttatttgtcaaactcgatttattgaaaatcgtgttagtagtaagagataaaaacaaaaatgagctataagtaatagctaacaacaaaacaacttacgcagctctcgaattagcgcacataataaagtaattaaaaggaatattaaatgatgaagtcaaacccaaacttagaataaaaaaactttaaaaatcaaatactaaaatttcaattcattttaaatattgtaatacttaaacttttctaatgaaaatccgtagaagaattttaggtgcattcagtaaagaaacaattgatatatttattaaaaatggaataaaaccgaaacttacatcgagccatcgcaataaaatttcaaatgatatataaagacaaccagtttaaatgtattattacgtaaacatacaaagttaaaattatctatcatattatttaaactaaagataacaaaaaatacagttgactaaaaaagaagtaaataaaatatgcttacaaataattatttaattaacttatttttaagaaaaagttaaataagacaattaaattaaatattaccaaaagaatttcgaaaatacaataaataattagtttataaaaagaaatattttaatttaattctaataataaaataaatattttaatttaattctaataataaaataaaggattcaattacctaatcaaaaatttgtgagttcttgcggtcgagcgcagttcgaaaacagctaagaccaaactaatggaaatgtgcatgggaaccgattcatatcgatttagaagtaaaatcataaaaatatttgaaaatgaaaatgacataaaaactgaattaaaaaaggggaaaatatttaaaaatatactttaaaaacgcatcctttgacttttaatcatgcctagacaaaaaaaatcaaacaacagttgataagcgtggtaatgcaaagaatttactccttaaaattttaaaacggatatattaaaatgataaaaaaatgcattatttaaataataaattatgaaactttttaacacacaaatcgcttaagtgaaattacccattaaagtaaatttatgtataataaaaaccaaattaaaatgggtaaatcagtaattttcaatgtaatttaataaacaaaccaccataaaatgatgctttcttagaatattaatttattaaaataagattaaattttaaacattaataataagctgaaattattgatatcatttacaaaagtaattaattataaacatctgtctaaagtaaatgaaagaattagcatgaataaaaaataattagtaaaaaaatatgtttgctctcacttataaaatatttaatacgttaaaaactaaaatatttaatactttaaaataactcatattaatttaaaaaacattacatttcttgttttccaaatgattttttttcagaacaatttggattttgtatttattttgtcaaaatactaagatgggcaaaagtcggccttttggttattttgctacacatcattttagtttttattttcagcaaacaagcgagttcagattaaaatcaaataaactaaattattattttttattcaaaatgattaaatatctataaaatcaattaaaaatatttatttatcgattaaatgatagaaataaaacaataaatttgtctaagaaaaatatttaattaatttaattttttaaagctattaagctagactttgttgaaataatctttaaaacatactcaataaatgaattaaaatgaaaaccataaagcagtcattcaataatcaaattttaccagctttttaacaatcaagaaaatatgaataatcaaaaatagagcccgttttttattaattcgatctattttgaaataaattatactaagcaagattttgcacgattttaaaaatgtctggtgtttagcggttggttgaaaatttatgcaaaaaaatatacagaaaatattatgctttaaattatcaaagacaagaaaaatcgtgatacatttttgggcccatctttgcaagaaaagaaattattaaatgaacattcttaattttaaattatataatatagaaaattaatttattcttaaaaaacggaaataaaaaacctaacaatcaataaaaaaatgaaattaaacaaacttataataatttcgattaaaaaaaaattaaataacttaaaactcatttgatgtaaattgataataaatagaatcaattaagcaataaaatcaatacagtggcgttcttaaaataattcaattgttattgttcaaaatttataaatgcactcatttgtcagaagagcaaaaatttaaattaaatttttataaacattggactattgcgcacacgaagtaggtcatgttgccgtgaatgcaagaaaattaaattctcgacattcttaattacaaataacagttaaacacgcgaaataacaaactacatcttaaaaacactaactacatgattcgccataaaaaatgtaattttnngtaaaatcaattaattctgtctaaagttccaaaagcatttattcatttatatttttatgctatttttataattaatagtatatgtttttaa

SEQ ID NO: 6617 - DNA, 1723 bp, Heterodera glycines
  misc_feature (871)..(871): n is a, c, g, or t
aaatccaaaaactcaaaaatctgtcggtcggttttttcggtcaaaaaccgaaaccgaaaatcgaaaaataccgaaaaaaccgaccggtccgatctctaattattacttagtaataaaaaaactgtttatacaataaaaacattgaatataaaaatgtttgttgacttttattccaagattatgatacctaatggcttgtgttcaaaaattgaaaaatgatacaatcaaacatatgttatttaattttttatttttacattcaggcatttttattttttttaattggcgtatcttcattgttttctttatgaattgttaatgatagtaagtataattttatatttattttttgttcgtagtagaaaatattattagaatgagttttattaaatttatgttattataaaatgtatttttgtttagagtcctcgtacgttattatatggttaatatttttttatgaataatcaagaattttaattattactattaaaaattaaagaaatgtggcgaacgcattttttgagtcagtagatagaagatacctttattattttgggcgaagtaaattcaatactattaagaattttaaaacaacgagtactttatgcaattaataaaacattattgaaaaggatggcaaagattaaaatttaatttatattaaaaaatcttttgacaaaaatattcaacatgtttatattcttcttattagaaattaattaaatatcctattttgcgagccattcgaaaactttgaataatatgaagttataaaattttaaattaacttagaaattacgatttttcaaattttcaaaaaatttaaatctctaaaattttctttcatacaataaaaattctcaaaaangtaagatacaggtaaaaaagatatagcccattgccataccctgacatttgctaattgtcattgcgctaatggtaattaattaaaagccaaaaactaggcactctctagactgatcggttggcacataaacacgaaacacctcaaaaacacatgaaacgcgaatttttttaccgaaaaattctaaaatatttcgagtcatttaactaaggtgtaatccttacaaatttttcattttttgcagaattttttccccaaatttttgtggatgaggcggtgcccataggcgccgccaggaaaaatattccataattatatgatttttcttgtcaattttcttcattattttttcaactaaaaattcattcaccggcggtgggaacaaataaggcaaaaaagtgctcaaagttcaaacgaaaacaattttatcttcgaataccttttacatttaaagtaatgacgaaagccgcttcaaaattaataaatattaacgtatgactatgaaataataaaataataatattaaaaggtgtaaagattttaatattttattaatattactttcaacttaaaaatattgaatgcacccaattccaatatataacttattaaaattccaaattccttggaaaccccatcaaggtctccactcgacataattataaataaagcatctcttccattttcgacttactcataaacacctctatatagatgcaagtgaataaaattaaattacaaggattaatgtaatattttatgcatatattgaataaaaacttactgaaaagtactcaacattgaaatcaaaaattaaaaatatacaatataaatataatattataataactagta

SEQ ID NO: 6618 - DNA, 2958 bp, Heterodera glycines
tgattttaataaaatccaaaataattttcactttttaacttacgttaattaatgttttaagtttttagaaaaatttcccaattttttgttcaatttagcatttcaggaaaaaattgtatttatcaaaaaattttccgggttgggagagagtttaaatcagaatcacaaattaaacattttaaactaaaacttaaattgaattcttcaaaagtgatttttttataatagcatcgattccgtattttctcaaatcacacaagttgacaaaataaaattttcgtcaaaataactttcatttttaatgccatttcgctttcttctaatcctgacccaaaaatgtcaaaaatattcagggcggaaaaaagaaaggaattttcatgggtttcgaaataacccgaaacaaatgcattaaaattaataatttattgaaaatattatgaaaaataagtaacctattctcaacacttcgggaaactcttcttcgaagcgaatgaaatggaggccaccgaccaaaatgagcaatttgttttttgcaatttcaatttcgctcattcctccgatgaattcaatttgcttcgactcattaatttcttcaaaacgtcccttctcttcggttggcattttcaaattgcaaaaatggccccgcaattgctgcgacatttttagcgactcgcgaaatgcgaaagcggtgaactcggccacttttgcacggtttgagcacagtcgggacacaacatgaacagaagccgcatcggaagcacacttttgctgcagccattgcgaaagatcaatccgatccatcgaaaagatttgatcgtcctgtgaagtgatggaactgttgcttagatcttgttatataaaatctgagcctcggactttagcgagggttcatttccatccgagttacccatttattaatgtatttttggtaaaattctgaaactgcatttaaaaaagcagattttcttacaaaaaattagggatggtacggaattccgatttccgaaatttttgataaaaagcttttgaatttttttttcaaaaaattatcaatttttgtacatttctgttaataaattgcactgaattttcaaaactttctcggcggcgcctttcggcaccgccggaccctaaaaatctttatttttcttgagaaatttgctcaaaatcggtaaaaatttttgaccctcggaattccgatttccgaaaatttttggggcctcggaatgtcatcctggcccttatattaaagtatttatctgcaaaatttcaagtcatttaacaacttaaattgaataagaaaatctgcttttcaaacttccaagctcacgacttaaattcccagcctagttatcaattcccatcttaaacaattatatttttcaatatttttaagatgcctcgtctatgataaattcttcgtagagcaaagattgccgccattggtccaatgttttggcctcacttttcactgtgtattctatcagatggtacgccacacaaatttggacacttttgctttgatttgtgaaccctttttccatttccttttccatttgctgtagaaaattggttaaagcccataaaattgtgctcaattcaatggaaaagcattgtccaattttgttcataataatttgggcgtcgtcgttttccacttggaaaaattcaatgaaatccgacgccaaactttgatctgcttaagttaaaatgacaaattaatgaaaatcgaaaataaaataaatgctattttaactttaaacaaaaagttgtatacctttcagaatgaaattttcttcattaaagggagacaattcgcttggtgtttttctgtcggggcagccaaaattttgattcttaaataaatatttattatttttacattttatgtactttaataattttatattaaaatttttctattgtcctatatttctcattactttttccttttgtcgtccctttgaattgtttgattttgcgattttttcctcctcaatttccttttccgattcgcttttttccgtttttccaatttttccaattttcccagttttatttctttttgcattctttttatgttcatccattccataaagtgtttcccattcgttaataaattcagaaatctttacgaaaagcgaaaatctcgaaaagatttcttctgtgtaaactaaaagaaaggaattgttaagacaattattttttttctgcaaaaattaattgtgatatcttttgttttttagcttattttgtggaaagcggtgtaaaacgaaaaactttctagagaccggacaacttgggtcgggagggatcccgactctgagatcccgatgaaatcacgatcccgatcattgccgatgaatttaaaaaaagattcgggatggatcccgaggtcggatcccgaatttaatcccacggaatcccgatcccatccgttctctaattctttcattcagttttgaaacgaacattctctgaatttgtccattatgtgctcatgacgtcccatcagtccaaagatttccgcttggtgaattttgttcaaaaatttgttccatccctccattttcgtcgccttttcccctcctttttcgtcacctttttggccaattgctttttcccatttgctcttcaacatttcctgttcataatttgaactttgtcctagttttttgcccaatatttcgtcgtccataaattgttccgtcttcgtgaaaattctgcccaattttaaaattgtttccatcgcgtcccaattttgctcctccaagcagacaaacagtgcgtcgtgttccaaatcaaacaatttgttcattcgatcccatagaatttgcatgtttcgttcaccaaccaattgtcggtgaagccaacgacaaaaagtaattacatcggcctgcattttgcttcgcagtcccaaggccgacttatccaaaaatgtcgtctcgtaatgttccc

SEQ ID NO: 6619 - DNA, 1542 bp, Heterodera glycines
agagaatgtgccggaggcattccaaaatggtcgactggcccatcagatcttacatgaagagtgaattcaattttggaatagatttttacattcatattttaattattaatatcaatcccaaagcattcgattttaaaagtttcattttaaattattaacttttagtttaaagaaatttattgaatttatttttttatataccaattcgcaagtgttccgggaattgctcctcaagtcgcatcaattccaaagtgcccaccaatttttcaattcttggctttacaattatctgcaaatcatccatgtctttgctgcagagaaagtgccgaaattgttccgattttcggatggcccttgccaaattttcggcatggattatgcttaatttttgctcagaactgctcaattcttcaacagttttttcgtattcgtcctttgaattacaaattatgtccaaccattttattgtcggtacttcaaaagtatcaaatgaattgacctaacaaataaaatgaaaaacaaaataataataataataatttaaaaaaatataattattaattaggaggattatttatgtatcttttataaacgtggaatttgtcttaagcttttaaatgccttgccttgaccaattgtccaatgcgttttttctccacaaaatctttccacacagttttgtccttcgccaatttgtatccattcgcaacaatttcttccacaaaattgtaatgatagcacagtgcctttttcgtgccgtctatgcctttcattttgccatttttggctacaatttttttgtgttcttcatccaatttcgcaatgtttaaatttggaagtgcttcttccacaatttccatagccaatgcttgaaagtgccaattcactgcttgaatttcaaaaattttatggctgtcatcttcggcataaaataaaagtttctcgacatggacgaccaccattccctgtattattggtttgctcagatactttttgtaatcagtgataattgaatcttctttctctaaattgtcactttaaaatatattaattgatattatgtattttttgataaacagatttaagtgccaagcctcgaagataagtatttttaggtgtaattattttgtttttttaagaaaatgctcataaagctattctattcaatgtttttgcatttctcttgctaattatgagtcttaataaagtcaaggggtatgaaaaaatgtaacacataacttggctcagtttaaaccaaattaaaatttatggtatcattcaatagctttaagtgttgtctaacagaatattagatttttttacaaaattataaaaagttttgatcacaaaatttcaatgtcttaagtcaaaattttttacccataaatttttgaaaatgaatgatttttttggaattaaaaagttaaaaaagaattcgaatataagaattagtttagctcaatttcaatttaaatcaattaaaattattaaacggttataataaatttgcataaccatggcaaaaagcattgcatatttaat

SEQ ID NO: 6620 - DNA, 1398 bp, Heterodera glycines
  misc_feature (1376)..(1376): n is a, c, g, or t
ttcattcgcttaaatttttaatccgttcaacttttttgctctccgatttaaaaaaatactatttgtcattttcgtatttacgcaccgtaataaatatttgtcaccgggacattatttgaaggttacggtagaggaaaatttggtactaaaaaacgtttcactgggaaacgggaaattggtccagttttgagtttgggaaatatgagaaatacctatttatccaatttttaagaaaaatagggttcttgatggaaaatttttgaaagtttgttgggctttaattaattttgcccaaaataactttatttcgatcgagttttttaaaaaaaatttaatgagtttttctttaaatggggtcatccttgaaaagctgctttttacttgtttttcgcacaatataggtagttgactttgttcaaaaaagtttcaggaataggggaggtgtgataatattgtgatttaaaatatgtttggcgttttgttgttctattttgtgttattttgtttgtgattttgtgtgatagtgagttgagttagtttatgcacagtcgtcagttctattgattgtcgtcgactatttaatttggaattaaacgataattgttcttcagcattgtgttttgtatttgctgtttgctttgggcagttgtcttttgctgtgtgcaacaacaacaatcttaaagcccctgatgacacaccttctttcatttttacgactgaggaggccggcggtgccgataggcgccgccggggaaatttttggaaattttgctctgtttcttagcaactttgcccaaaaaatgaccaaatttttcactgaataaccgtgaattagcaccgtgaaacgtgaccgtgacagtgagtgaaaaaacccgtgaaattcacggtaaccgtaaccgtgaccgtgaatcacggcacccctctactatatatcagggttgccgcgggtcgagaaaaatatcaggtcggcagaaaattatcgggtcgtgtttcgggtcgagaaaaatgtcgggtttcggcatcgggtttcgggtcaattgacaaatttttataatatattcaaactcgataagaatttttttatcgaatgaaaaatcaataaaatttttttttcaaaatttctccttgtccaccgatttccttatctacctagtttttcacccagacccctttcttaccagtgcttattttgacccgaaacccgaacaaaatcatcgggccgggtttcgggtaacccgcggcaaccctgctatatattacttattacgaataatatatacaatatattttttatgaattgacgtgattgtatatgcaaagtaaaatgtcaattaaatcgatactgttgttttatttcttcaaaaaaatatttcaanttaattttaatgcaatgaaaaa

SEQ ID NO: 6621 - DNA, 1160 bp, Heterodera glycines
aaaatagatgttgaatcattttgcccccgcaatgatttgggactggaaagtgccaatgttgcggtagtgacgacggcaccttcttctactatcactgtcataatcacatcaccaccaacaacaacaacaactacaacaacaacaaaaccgacaacaacatcaacaacaacaataatgccaattaatgtagtagaagtaaacaaaacaacagaaaaggatgtgcctaataatgaaaagcccaaggatttgtgtatgaattcaagaaaacaatgctcataattcttatgagactcataattatttttaaatatctcaattaatctttccattcccaaagcatgtgccgttgcgccgccctccgtcgtccgtccgtctccgttggacgtcgtcctccttttggatggttccggctcgatttcctcttccattttctatggccaaattctgcactttgccaacgaattggcacaaaatttgaacctttccgccgagggaacgcatttggccattgtccaattttcgaatcggccacaattggagtttggcctaagcagcggaaatgacgcgcaaacggtgggacggggggtgaactaattacggcataatttttgcttattttattaaattattccataaattggtatttagaaatcccataaagtaaaataacccataaaatgtaaaaatatacaatttaaaattgtttataaaatccgaggggagggaactctgatgaaattccattaaaattctaaatatttgaaatttggtttgtttagattaaatcttatattgacaacatttcctacctcgacggaggaacaaatatcggagaagcattgcttttcacacttttccacgtgttagcgaacggcgacgcacgtgccaattcggaccgaatcgttgtggtggtcaccgacggcgcttcatcggacgatgtcgttgagccgggtgctttttgttctttcgaattaaattcagtaatttccattttggtaatttagccgataatttgcgcaaaagtgcaaatgtcgaactgatcgcaattggaattggagaaaacattgaccaacaacagctgaatttgggcattttattacgccaaaattaattaatttaagaaaaaatattaattttattgacagatcactgacaatcca

SEQ ID NO: 6622 - DNA, 4110 bp, Heterodera glycines
  misc_feature (4098)..(4098): n is a, c, g, or t
attttcgttgtgccgcaaaactttaagcgtcgtttaacaaaaatgggaatgacgcgggagggcattattggcaccagagaaagttaatcacagctcaaaaaaagtggtgggccggcagaattatatgctggcactggagatatgaaaatgattggctttttctaatgaacataaactttgcacccgtggtccgtccattcccttgacgatgtcccatcattaacaattccaacgttccattattatcaccattatcattatcatgatcatcatcatcatagatgctttcggctaatcatctcttcacttcattacttggtcaaaaacaacaaaaagcatcagcttccgctctgttccggtgaggaattagtgctgctgctgctcgaactgccgctcccggcggtgaaaaaagccgttccgccgtcgcccgtggtcgcatcggttggccgttgctgctcctcctcctcaatggcgatgctggtcgaagtgacaattttctgaaaaacatacgtttaaaatgatgaacccaaaaacaaaaagagagagagagagagaaagagaggaggggggaggcggagagggggagagagggagggagggagagagaaaattcattctattgcatttgtcaacaaaaagctgttcaccaccggtctacgtcagttgtgcgccggcgcgtttgggcgccagcatgtttttgcactataacttttttctttgtcaaccaaatctatcaatcttggtatgattcgagagcccttcagatgctctattagctgcaaaattccaaaaaatttcgtattgtttaaaaaatgttagagccaaaaagcttggaaaatctggttttttaaattcttctggccataacctttttgaacctcaacaaaatttatcaaaattttgcagactaatagaagacatttagggatttgaatgataccaataatgttggatttgattgacaaagaaaaaaagttatagctgaaaacgtgctggcgcccaactgacgggttccggttcaccacacctttggcggagttcgcttgtcctttccgcaacaggtcacgtcgccgttctccagcattgcgcaattgttcggaagacaggcgaaggcgcactccaattcagacacactgcctgaggtgtccatctaaaaagagaaaccaaagtgaaattatacaatgaaaaaaaacagtcaaaagggcctttgattgctctatttattcgaatagagttcatcggaacgggtgggaaatggaactctaaagcgatgagcaatcccatcaatgtaaggggatgttggaatgtgtgtgacccattaataattacgcataattccttaatggatattcccagtcggctcccccccccccccctccacgggtcccacttcggcaaattctggctgaatggtggtcgagtggatgtgattgtcgtgaaacaatgaacggatttgctccgccgccagcacatagtggcgcagcgtgcggaaacggatgtgcaccgtggcgatgatgcgctcgccgacgaggcgccacacgtggaactcgtggaccgccacaatgccgtcgatgtgcaacagtttggactgcaacgagtcgatgttcacgaagctgggcgtagtctgcagcagaatcaacgcagtctcatgcactgaacagcagaaaatgacgcaccaaaagattaatttgtgatttgtattttatggagaaaaaaagccctatatttctggataaagcccagaaaaattcaagcgatgaaatccccgaacaaagcctatgccaaggcccattacaattagtattgtattacatcgttatttttttcttaatttacatactagtaatattttcttaccaagtggcaaagttgtacaaaccatcagacaaaccaaaacgatgctgaaaatcaagaaaaatagtgataaacaattcataaaataggagactgatcaaaaaacagcacgcataaaaatgtaagaaaataatccctttctaattttttaaaaaaaatgcatacctatataattataataattcatctaactttaaatgttgaatatgagtttttcgttcctcaaaattaacacctgagcatcgggtccatgtacagcttgagccactcgaccccttccactttccatgccaccaatgcggttgcgatgacaatcactgagccgaccgcgtcactgagcacgtgcaaaaagacggcatgcatgttcaggtggccagcactctgcgacttggctaaatggaaaacaaaaatttagctttttttcccattttcataaccttttcccatctttacgtgtttttctattttcgccgaaaattttgcgatgtcccgacccccgtatgattacgaacaggttggatttttatttgaaaattaagaattgagttgtttggattcccccacattagcggggggaggaggcaaactctgcccgatacaatcaccatccatccgatcttacaatgtttgtgccgcggaacgcgggacatcagcgactcctccactgcctccaagtcggacatggaaatggccctgttctgttcctcctcgtccacttcgttgtgtccgcctcgctgctgcgcccgctttgtcccgtcccgacagcagcggtggttccggcgccgtccgtccgcattcccagcgccgaacagcggctcgtccgccttcgcggcggctgcagccgccgctgcttcggccgccacttcgagcacttccgagcggacgtcctcaacgccgtgagcggcgtgggtgtgccctaaggagggacaaataattttaattaaaacaagttttttgcaagttggttccctaattggtggtgcaagaccgattcagtgacagtcactcaccaacatggccacgaaacatgatcatcccaatcagattgataaagaatccgatcagtccgactaccaacacatgaagcggatttttgatcggctccgggttcagcagccgctggatggactgaaaatgaaaaataaagaaaatcttaattttttttgaaggatttgcctcgatgaaaatagtgaaacaaagagccaaaaggaaaacgccgttgaccaacgcgccgagcacttccgcgcgaacccaaccaaaagtattttttgagcttttccttcgctcggcaatctgtggaaaaaagtgatcagaaattttctttgaatgcaaaaaaatcgcagctaaatccatcactttgcgagaaacccaaattaaagcgacttaaaaacagttttggccattttgacccaatcaagaatattctttttttctcatttgtttcaaaaaggttaatatcttttaatacagatgtcatatgggaggagttttaaaataagaaaaaagagattcttctagccaaacttttaaagattttttcattttcaataaaaagcactttaaaacatttacattcagttaatgatacaaaaacagaccttaagacatccaaacgcaatgcacaaagcaatcacatcgctgagcatatggaaagaatccgcaataagtgccattgagtgggaaatataaccgaaaacgagctgaaacaaagcaatttggcgttaattaaagtgcaatttttaattaaacaattaatttttttgtgcttacttcaatgaaaaagaaggcaaacgtcagaaagatcatcaccaaaaggcgacagccgcgcgaaaggtaacacattcgccgacgacaacagccaacggaagagacactgctcatggacagtttgggctgaaagtgggggggggacaggatgaattagaggaaaatgaattcgaatttaccgcaaaaatccggcactatttaaaaagaggggtcttttgaaaagtggcttttatgttagaatctgagcaaaatggtcatttttgatgttttaatgattcatgactacttttagcttttttaaataaattttatggcaatagtgagaattttcataaattcgactttttgttcgaatttggtttaaggggttctatagaatgacctgcagtctattacttaaaataaataaaatgacctgcagtcgattagcagccgcctgttgctcagcgcgatggccggcgcccatggcacacgganatttgtgggttg

SEQ ID NO: 6623 - DNA, 947 bp, Heterodera glycines
aaaagggctcattaaaagcacaaatttaaaattgaaaaatagaaattattgcagagaaaataagcaattcgaattgaagtgaaaacaaatgctaataaaacaaattcacaattaatccaaataaaaaatgcaacgaaataatgaatccgaacttagtttaagattttgcggtaaatttgcaacaatttttgtctcttttcagaaaagctaatcggtcaggattatctctcccattaaaatgtttagttttgtcgtcagtgttcgctttcgtctttgagtttgtgcacagtgtcttcttcggcccgtttaaatgctgaagcccgaacgtcggttttgttttttccgcgaatgagaattttttgatgctaaccgaaattcttcggagcgttttttcctgtaattaaaatagaatacatgcaaaataaggcatacttatgttaatagtaagtttggtgtgaaagaaaagtactagcgatatcgacggttaggcccaccgtttttcgatttatgagaaaatgccccgttccgataaattcagattttcccaacgacgcctaatgacagtagaaagttgtttgttttagatgaaatgatacgataaattaaaatagtaatgaaaagaattttttgaaaaagcatcgaaacagggttccccgatgccaacttttggaaattgggtcggagcaaaaaaatgaaattgtgatggagtcgccgcctctacataaattaaagatctggctaaataaataattcaaaaaactaacaataaggcaattaaaaaccgagtttagaaataaaaagctttctatgtttgtccatggaaaattttcgtcggtgcctaatagggcatttttgacattgaaaatccatcccaccgttcttccattaggctgatgtgttgtggtgaaacgtgcgttcggtgctcttccttgaccaactcctcggag

SEQ ID NO: 6624 - DNA, 1111 bp, Heterodera glycines
ctagaaataggtaaaaacctaaaaatccaactcctaactctttataatcatacacaataggcgatagataatgcattcattaaatttaaaaaatataactacataattaaatttttctctttaaatttcatcaatattttttttaattaatttattattttttatattcattttattatatttaatttgatattttaaattttggcgatatgatatagtcgtaaatggtcattgtcgaaaaggtattgtcgaaacggtcattgtcgaaatgtccagccaccctcgaaataaggataattttaaaaaatcaaagtcatcccaaaattgtggttttcaaaagcacattgaaaaaggttttgagccattcaaggagggagccaatttaaataaactgtcgttgcgttggtcataaagtgcagaaagcaaagccaaattcctctcaaaatgccaaatcggttcttccaaacccccccccccccactaaaatgccaaaatcggctctccataaatcctccacctgcgtttgtcggcgcggccgacgtgtcgttcgctgtgccgttgctgttcatcacccgcttcattatcacatttcccacccgttttgtggtgaacgtcgtttgatagacgcgtgggtccaccggagaatgagcggtggacgcggaaacgatgtccgactgggaggaggcggtggacgagccggcgtcgtccctttgcggtgccgcgcggcggtgggaggcgcggagccaaccgacgcggtaggaacctgagcaaaaagtggaaaataacatcagtgaaaggaataaatttgccataattacaaatcatttaaaatcatcaccctccgattgattgtcctcgcgcagctcggccgcgtaatggaaattttcgccgctcaccgatttgtgcgcattgtgcagaaacgaggaatgtgaagatggtccggcagcggagacggaaggcgcggccattttggaagtgccgaggaaagagtcggtggccaaaacattgggcatggacatgcacatctgtgacagggaagaacgatgaccaaaatggaaatgatttaaaagggacatgagccgaaagaagtttaaggccgaagaaatgccgg

SEQ ID NO: 6625 - DNA, 4236 bp, Heterodera glycines
actaagttcgattgattcactagcaaatgcttttttctcaccccgttgtttggttcattttttaaatttgtgaaatttacttattgcgtaaagtaaaaagtttacaatgaaatgcttaatttctgattggctaatttcgatgaattcccttagcaaatgctcttttctcattaattttgtttgtttcacttttttgcttaatgatgtgtacctatgaaagagatcaagatcaaaaattcacgcatgcccagtcacattaaattaatgagcaattcaaaacgaataataaacctctgcatttggtcttatattggcgacacaaggcgatattaaattattatttatctcttgtttaaattttttcggtaaattttatggatttgttaaaaattaatataattaagaaattttcgaatccaggcatcatcatgctactcttgctgggtgagttaacgaaaacttcctaaaggcataaaaaatttaagacagaaaattctcattaaataacttaaatctcgggaagtagaccatttgaccaaatggtctacgactcagtcacaacaaaaagggaacttcaagatttttctcaaacacagagcactcagtcacaaacgaatgcacacagaaaatacgcctcacccgtttaatggtagggatattggctcgacttttcagtgccagtgctggacgactttgcacctacttcctcccctatatacacacactacggtgctttttcggccaataagactattgccgtggcggcctaatggagttttaaatattaatccacactagagaccggaaatttcaaatttgcggatcccgctgcgggattggaatccaaaattttttgcaagacgggatcccgcgggattaatcccgcaaaccccgcaaatcccgcatttaaaatttgcgggatcccgcgcgggattgcgggattttggaaattttgaaaaaatttcaaatttcaaaaaatttccaaaaaggaaaaaatacctgacattttgaaaaagaaatttttaggggctggcgggatgcattggcgactaaaattttccgaatggatcagacggtaaaaagagatcgggcgggaatcatatctgttaatggtcaataaatttgacatttttgcttttcaaaaccgcttttttcggcacaattttttcaaaaaactaggaacaaagggcccggcggtgccgataggcgccgccggaaatttttttgaaaattttgtcaattcctaactgattttgtccaaaaaatgaccaaaggttgcactttttgactcatttttacaggattaataggtaaaagccgatccagcggtgcagataggcgccgccggaaaatttttgcaaattctagataaaattttgagatgaaaaaatggatttaatttgattgaatttattataatttataaatttattcaaaaattttggcattctattctttaaaattttcaaaaaatcaatgaaatcccgcagaatcccgcacaaagtcaaatttgcggatcccgctgcgggattggaactcaaaattctttgcgggaccggatcccgcgggattatcccgcaaaatcccgcgcgggatcccgtcccgcgccggtctctagtttaaaccacacgaagagattgggtgagaagctaacgccaccgcattggaggtcgtgggaccgaggccaactccggacaacattttgccaaaaccttacttctccgccaaagaaaatggtcgttatattcttaatttccctccccctcaaaattcgggtctttgtccgaccgggtccatgtgttggtggaacagtgccatcgcttcatcattcagtgagttcgatgcaccgatttgccccgtaccattgcgcaactgttaacaatgccatgatattttcgccatttgtgcctttgtcttgcctcgtgctgttgtgccaccccagcatggtacgaattgtgcatgtcaatttgcctttgctgcttctgaggttgcattttgttgccgtccttttgcccccttttgtctcccgccgcaacgatggcactctgtttttattttaaatgaatttaaattaattaaattttatttaaattattttcattttcccacctttggtcgtccttttctgctgtcccttccgttttgttgctgcgtttgtttctgttggcacagtgagggaaaagtgcacacgaaattgccgccattgtccgtccgtttccgtccgttcggttggccattgccctcaagcaattgttttgtatttttgaataaattcgaattttaattttcatttttaaaccattactcctcccgccctttcgttgttcgttcggtcggacaccaaaaattgggcacggcccaaagaatttgtgcctccgcccggcacggcattcccacgtcgtaagggcctgaaattacacaaagcaatggcaaaattggaagaagcgatgggagagagagagcggataattgaaaaagggtagttattcatccaaagaattaattagagacaatttgggggaggggggaggaggaattgagacggggaaacgttttcacgagaaactgagtcagacagagttgtggcctcccgagtatcgagtccgaaacaatacccaagtttcgcgagagccccgccggagagtcgagaccgcgacttggccccgatcagagttggtttgccgtttttggtatcccgcttttccctaattgccccccgtcttccgtctttcatttttggcatcgcttttcccacctctgaaagggctctctcctctttcggtgctctctcacgtaatcgatcagctgtttctgagttcgtcccctgtattggaagttggatcccctcgtgaacagattatgctgttggtggtgttgctgctgctgcgtgcccttccgtcctccccccgttccattttcctccgtccgtttggcactgccggcgaccgaatcggcacatccaaaataaaaaggaatttaaaatgccaggagattattttgctaattgaagctggcaatggagagataaacaccacctgaagaatgagtgatgttccacacatttcttccaaaagtttttgcagtcgtctcgattttcgaacgaaaattcgattgtttctttgtagaattggaagctgtcgggatgaacctcaattcggataaaaataaataattaaattaccccaaagattacattaatgcaattttttcctttttaaaatttaattattgttcttccgcctcactttgatcatcatccgtttccgtttgaagctcaatttccgcacctttgcccatgaaaatgtggtgacacaattcatttggtggaacactttaatccccatatgcgccacagccaaagcgacttcagtgcctaaacaggcgaaaaactgctgatcaaatataaatacattagccatttttaatcaaataaataatgcaaatatcacgtaaaaaatagttcaaataaattgggtggatattttaaatccccccccccccaccttcgatatctctcgccgggtgcagccgaagtccgtagaaatcgcagcgccgtgccgtctccagcagaacaaagtccgcctcggccggctccatgccaatcagtcgccggtgctgctccaacacggcctaagaagaagggcaaatgaactgaggaaaaatcctcggattatgtaagttcacatggtattatttcaaaaagtgaatgaagggcaccgggctatcaagtttaacggagtgatcagttggaaattgatgatcgataagcctgggatattttttgattagtacggcttaagcagtgaatcctctactggtcaatttgacacatcaattttggcattttctgatcatcaaatcgttcttctgactctgatcagtcaacttcaattgtcgatgggtccgacctgtgcaaaagtgggcgtttggtgcggcacgaaatgagtgccggccaaataggcgccggcgtccggatagtccaacggagagaagtcgccgcactccgactgcacaatcagtgccaccaacagtgcagcggtgttctcgttggtacagattagctcaccacaggacaaatcgcgacggatctgtgccggaaatttatttaatttccatcgaattttaataatagagccattcttgtatgaaattgaccttgggagagaaatggaactgatcacttcgggaactcctcataaaataaatagattttctgaagggtttgatcctcaaatt

SEQ ID NO: 6626 - DNA, 1933 bp, Heterodera glycines
ttaagtcttttttgatggaattttccaattcattcacttgaagagcaaaaaggtagcgcgtgtactcctcctccaactcggccgggttcggcgtgtaaaatttcaccacaaagaaaaagcgggcgtccgattgggcgaccataatttgacgcaaaatgcttttgtccttgtcgagccaacactgcgaaagtgatagccgtttcaatgatcattttatagcataagaatgggaccgccggggggggcaaagaaaaggcgtttaaaaaggaaaaggcgtttaatgttaggtaattaagcggggaccgggtcgtgatccagtcttatttctgcctggttaagttaaggaacgggcgggcatttttttgaaacggatttcaacccagaaaatcaacccaggccattctaaaattcagaatttttgaaatttcttgctttataatgaattcccattagtccctcttgctaattactctgttcccatagctgtcgatgaactccaagccgaaatagtcactttccaacagattcaaataccgacaaacttcctcaaacagtgcttggcccgccgctttatgctgtattatcaacataattgattttatttatattttactgcttttgaataaccaaccccgaggtgaaaaacgcccaccgaatcgtccaacatacgaacctaacaaaattaacaacttattattggaaatatttaataaatatatttttattttatttaaaaataaatagtatttgtgtttaatgttctgaaaatgccgttccaaatggcactgcttgccttgatacacatcaatttgcctttgccttttcgcgggtccatccccggcggaggtgggcacccctgaaaatgccaatgaagacatatatatgattaattatttatcaatttcctttttaccactcctcgcggaatattcgaagtcaccgccttttgcattcacttcaatttaaaaaaaatgcgaataaagcaactttttacgataaatgaaaaatattaaaattaaatacatttaaattcaattaaatcataaaatggcaaaaaaaacaatataaaaaagtgttaagcggaatttgcgcctaatgaaaggcttttgaatggtgccccgggggagggggaaggagagaaggtgatgatgatcagtgccagaggcaatggagatcaatcaggccgccgcaggcacaatgtttatttttatcccatttggcacagctgttccaatagaaaagggaaaaagagaatgaatagagtggagagaagaagagagaaggagagcaaaagggagagagaaagagagaaaaaaagacaaaaaatggaaattaattcgaaaatagctcattttaaaattagcaaataattcaaaagttgaatgaaacagtccgtcttctgtcgcaaatgtcagtttcggtggtgtcaattggacgagggtcaaccaaaaaaaggccccgggggaatttaaaagttggcaaaaactgaggaaagaaagataaatgggaaggatttgacatgggacacaaagggagatttagtgggggggggagggaatgggacggatgggccgatgattgacagacaaaccacaaacagtgcaactttggggagacaaaaacaaaaaaatgtcaaacttttggatggagttaaaaggcgcacaattttaaacaaacccattttaaacattaaaagcattgaaagttttcttctaccaaaatgcccccgtcccttggcaaatttgccaagccaagacaaacacttcaccagagtccatttgtccgcttttggcagcagaagtgccgcctgccgtccggtggtcactcgtcgccggcaattccgtgccaccaattcatccgtccgtccctttcccgacggacgtcgtcccgggagttgcctcaatgcttattaagaagctggaggggggggggg

SEQ ID NO: 6627 - DNA, 1268 bp, Heterodera glycines
  misc_feature (1171)..(1171): n is a, c, g, or t
  misc_feature (1240)..(1240): n is a, c, g, or t
aaatagcaaatttttggtccatcccaaaaatttggcgctgaattccccgggggatcgccgccccgggcattatttggttaacgcagcagaagaagcaggcggcggagaagagaattaatgcgagaaatggtgggtggccaaattggagaatgtattgagttgttgttggcgagtgaataaacagcggaggattaggaaaagcaaattgggaaaattcggcacaattttacaacggcagaagagccgggcacagcacaccccggcaaatgggagggagtaaaagaaccggattttaaggctttttgagttattttaaaaaacttttttagaccaattacctacttcagcagagggatgttagaattttggtccgaatgatttggcattttcgggataaatgctaattaaatgccaattgcataaatctcaaggcgtctgaatatgccgtccggcgggtgggggaaggaatatgacaacattatgtattatttattcacctaaattggatgtgacacggaaagttatcggatgaccgcaacggcccctctttccaaggtcgaggagagagagaaaaggtccaatgatgggattttgcacgatatcataataaaaataataattattattaattatggattgaatgcaatcaattaaactttctttttcttttgtctataaaaatgactcattttaatggccaaaaaatttttggcaaaatttgagaattatttttggaatttgaacagagttcaatcaggagcaaagataatattttatctttaatttacaatttgatgcctcaaattttgcgctaaaaataaaattataaatttgcacaggcgcaaaacattttaaacataattaaaaataatagcaaaaattcgaaattgctaaaaaggccaataaataaataaagtaaagtgggagaattttgttgaaaaattaaaaaagcgatttggtcatttgaaatggtttttgttttcagaatgggccacccctttccaagttcaaaatttcttcggcacttttgtgtcttttgcccgccgggggcaaagggtgccgccgctcgccgccgccgtcgcattgaatggccacggcatcgccacggggcatacaaagggctaacaaaacggggacacctaatttgccgaagggcaaaatgactgctgancgcgagagtcactctcgagacaaacaaagagagagagggagagagacagcgggagcgagacagacagancgagaaaagacatgggcagcaaacgaag

SEQ ID NO: 6628 - DNA, 6230 bp, Heterodera glycines
  misc_feature (31)..(31): n is a, c, g, or t
  misc_feature (108)..(108): n is a, c, g, or t
  misc_feature (114)..(114): n is a, c, g, or t
attccttgtttcttaacccgatcacagaatncgtccctacaatggtaacaataaagtatttttacaggaggcggtgcctttagcaagctgtagtgttttaaaagtttnaatagncattgagtttttccacttcccgtagcgccggataaaattaatgtaaacggtgcgttgaacattttttttataaaatttctttgtgtttttttttgcttacaaatatccctttatataggcaaaacggagaatgtcgcctgcatccccctctcccgtccatttttgactcttgcgacactttttttactacataattgacaaatatcctttttcggatgactatgtcctcggtcaattggttgtgcggtggatttgacctcttgggttcgaatccccctcctgttggtgaattatttaatcgattttaaattatattatatataattgctaattatcctttttcggataactgtatcgctggcccagtggtagtggtttggattagacctcttggattcgagtccctctgcctctggatcaattaatttaattaattctctcatggatttggaccccggcacctgggacaaaatcatgatgaacaaaaatgggtgtttttttaagcaggggcaggggtctggaccccggcccctgggaccttatactactagcatatcatcttcggtttttcatgcttagaatttcacaaaatgctcaaattgatcatggacaatcaaaaatataacatttgaacattttaagcctgttttgaataatttttgtaaaaatgaggcttttttacctacaaaatgaggcttttgaaaattttgatctgggaaccatgatttaaacctattaaaaataaaataaaacaatagccattttcccttcctagcaaaaagctatcctctcaatttccatttccataattacttacaattagactggttttaagcttttttaacaagatttctcattttaaatttcggagtttggttttcaaaaatgtcatcgtcctcaaagcaggggaatccgattgaacggatgaagcatttgttgagctcgggagaagacgcggacatccaatttttggtgggggacggagacaaaaaagaggcgagttttttttaatatttcaatttgaaatataatttatgtcaacttttaaatttttcagcttctgtcggcgcataaactgattttgaagcacgcttccgaagtttttgaagcaatgttccgttttgactcacagaaagaaaaaacagaaaatggtgagaaaataaaaatttgttgattattttttttgaaattaacccctgctaattgccataattagggatggcattcttagttttttaactattttttctgcggctttaactcgacgagaaatgcacgaaaaacacattctttttcgaaaatttttcatttttagtgccaatattcatcactaggaatcactattttggagctttgccactaaaaaaagctatttcggaagttggccactaaaataattttttgcaactattttggcattttttggaaaatttcccaaaaaatgcaataaaaacgaaaaatacacccctaagaatcaacctaaaaattttcaaaaatacacccctaagaattggaaaaatttcacaaaaattcttccccaaatttttttttcttgttcaatatttgctaagaaaatattttgtaactgcaatcagtgaacaaaattgtttgccttaattttaaattatttcaaattaaaaatagctatttaaaaaattacacccctaaatttggacctttttcgccactatttttgccactattttggcattttttggtcactatttagttaattattttgagattttttatcactaaaaatcccatccctagccataattacttttcaattagcctctgttgaaagtgccattgtggaagtgcccgacgttgagccaacggcgttcagagtgatgctcagcttcatttactcggacgatttgagtgaattggacggagacaacgcgatggcagtgctttatgccggtgaaaattggcacaaattaatttagggggcggttgtaaaggagggggggggggggtagcttcttatggaaaacgcaattgcagtgctttacgcgggtcaaaaaatttggagcaaattaattttaattgggtgattaatttataatagttatatcttatatatataaatagtaagaggaagagaattttcctatttgaggctgtgaaatttttggaaaaaaggaatagcgccattcaaaaaagcatttttcagccaaaaatacggcattgatcggttggtcagtccatgtttgcaaattccaattccgaagctgtccaatgttttcttggcctttgcccaggctcgtctttttgacttggaggtaacaaaatataatattatattttgttttttatggtttatacatttttaggatttttcccaccaatgtttgcgtttcatttgtcaaaatgcggtccaattgttcggatcagaggaatttttacaaattgatcagaatttgctctgtgatttattcgagcatgatcaattgatgatcaatgatgaatttgatctttggaatgcggtaaaataaatatttaaaatttaaattacatttgtttattttccaaggcacttaattgggccgatgaaaagtgccgtcaaaatgccatcgaatgttccgatgagaaccgtcgtgctgcgcttggcccggcacttttcaaaattcgtttccctctcatcccaccatatgcatttgtgaaggcaatcggtagaaattcaactgtcatttatcaacattacccccttttttacagttccttctggcatttttacaaacgatgaattcgtcggcgtttatcaattcaatttctaccctaattttcgtggtgtgcccgagctttacccattaaaattgccatggcatggacgaatttccgattggaacacagccaaaggcaacagagggaccctggcgatggaaattgagaaattttctgaatttgcacgagaggaagtggggagtttccgaaaaagtgaaaccgaagtgtcaataaatggactttcttggaaaatatcggcacaaatatatgagaaaagaaataaaaaatggtttggattttatctttggtgcaccgatcctacaacagaaagtgggcaaagaatattaatttggattaaaatttaagtggcattaattaaggtggaaaatggagctgcaaatattcggcgacctatcgaattgtttcgcaaaaaagcgggacgaaggatttaattggcaaaataaatgatcacattattagcaatgaaactcctgcttggggatttaactttttcattacattttcggttagaagacaattaaaatattttttcgcaattaaatgagcaaaattaaggaattgatggacccgtgcaaaggcttttacgacaaagacggggacaaagtgactttggtcatcgatgccgttgtggaggaagaaaataatgagaaattcataaattgaactttgagcaagactatttggattcggcgtatttccctgtcaatgagcaattattttcgtccgaattctttatggaaattctacagtatttatgctttggaaaatacaacaaaaatttggctccaaacgacattttaattcatacgacaaataatgatgttgtaaggaagagagataaatattattttgaaattgaatttttaagtgcgctgcggtctcgaaattatgtgggcgggtgattgagtacgtcgttgggtcatccaacccattcagcgtccgcaaacgcatcagcttgggcacaatgcagccaaccgatctacccgcatgtctgaagcagccggcgagagtgatggtgcgcggaggaatccatcctcaaatccgttcagatgaaaacgaagtctaccacctctacaattcaaatctcatgaagaaagttggatacatttcgatgttctaccatgtacgaattggtgattgtgtttggctcagtatagacttggtattgtattattaaaagacaaatctctttcaatttatttccgattttattttattttgtcgcataataaatttggtttccgatttatgtgcaattataataatttttgtcaccaaataaattctgtttgattacataacgaattggatgatttggtatttcttccactccttccgcctttgtatgaacagtaattttaaacaaaaagttatctacttatattatctaatatgttaatccaataaaagcggcaaatttatttgatgcataagtccgccggccaaatgaccttgttttccgattctcctcccattcaccaccaaataaatatgcataaaaagcacctatcgtcttactccattcatttccgtttgccaaaatagtaaataatttggggttaatatttagaaatgaaaattaatcgccgcttcaccagtaagccgagtcgcgcggaaacgagaccccttttccaaattaaaataaaaaataagaccaacaaagggttggtggcctcaaaaataatgaaggcaaaagaaaaacaacaacaacagcaacacaaccagccaaaaattgatgatctgctcaaggacttggcccgactccagctcaaccaatcacagcaatcggccggagttttgatgaccgtgccaagcccgcaaactacaatgtcttgctggcccaaattcaactcaatcgaatttgatggagttgtcacggtcgacagcggctcttctacccgccaacattgcggagggtagaggtcccgttgactttggtaaaattaatttgaaagagatagaaatgaaaataaaaaatattttaaattatattaaaaatggtttctcaaattcgttaataatttatttaatatccaaattaattttttgtgtcttttcaacatgtgttttccagcaaccgccttcgccgaggagcaacttgtgaaaaaaaaaacgcgttgctcgattgcattgctctggcggaggagtccgcaaagttgctgagcgcggatgcgcgaattcgctgtctcctggatcttggagaagagctggaggctgggtttcagcgaatacttagtgggtttttaaagaaggaaaaatgatcgggggaaaatcgggaacgatccaaatgaactgtttacagttagttaaacacattgataaaaacaccttttaagcttcatttattttatattgagtatttttagggctttattaatttattttaacttagaaaatgattttaaaaatattattctaaacatgaaaatgaaaatttaaaaccaaaaataattaaatttaatattttaaattcatcatattaaatatgcgcactccgtgcgcatggtctaacactctttctcattgccttcgagaatgactgaaataatagtaagtaaaaaacgataaatttataatgccattttcactcaccctccaattcctgctcggagatttccttttttgccccgtcctcgtcattgtcacgattcgccatcggactccccaattcgatcaccacgtcctcctgtaaatgacaaaaaatatttataaacaaataatttaaaaattttgactcatagaacaaaaaaaatgtaatttggaaagaaagcaattaagtttaatttacgttttttgaaaacatttttcaccttcccacgacgataactgcgcaagattggctctgagcattgaggacgacgacgtgggcggcgaacgcaaagaatggccgcgagaacagcacactaaaatttttgatggataatttcgtgattgggataagagtgaactttaaggataataatgaggatgaaaagcagaaggagaaacgggaaaacatcaaatcccccgtttccggtgctcatcggaggcgagaggaggtgagcagtgacatttgagagcgagcgggggtgaatgcactcaattggcttagtgtatggcaatggtctcgcacatacagtaagcccaggacaaccagagcaattttggacaataatccattcgggacgggtggggaagataggggtagagacagacattcattactttcgaatttcggtaaagtttccgcggaatttaaattaggaattaataaaacataagttcttattatttatttatttattataactatttttattattaaatgcttaatatctgccgattttgtggtgatttggcagtatgaatgtcattggcgctgcgtc

SEQ ID NO: 6629 - DNA, 2230 bp, Heterodera glycines
  misc_feature (1878)..(1878): n is a, c, g, or t
tgtcttcctttcttataaattaatggttgaaaatgaaaataaattgtcaaaatagaaataattgcttgattgattgattgaataatgattgagaatttcaaattgatagcaattcagcgtccccggctagccgaactccctaagcacaggagtccgggttagctatcctttcaggataggccgcaataaaaagccatcaaaagaaatgagagtttagaaatgatgagcaaatcatcgtcctaggccaaccggactccataagcacaggagtccggctagctatcctttcaggataggccgcaatgaaaagccatcaaaagaaatgcaagagttaagaaatgatgagcaaatcagcgtcccaggccaaccgaacgccataagcacaggagtccggctagctatcctttgaggataggccgcggtgaattaagccaccaatgcaagaaatgagagtttagaaatgatgagcaaatcatcgtcctaggccaaccggactccataagcacaggagtccggctagctatcctttcaggataggccgcaatgaataagccacatgaatgcatgagatatgaaagtgttaagaaaatgcaaaaacatgagcaattcagcgtcccgggccaaccggactccataagcacaggagtccggctagctatcctttgaggataggccgcggtgaattaagccacatgaatgcatgagatatgaaaatgttgagaaaatgcaaaaacatatgacaattcagcgtcccgggccaaccgaactccataggcacaggagtccggctagctatcctttgaggataggccgcggtgaattaagccatatgattgcatgatttgagaaattggtcgagaattaagaataatataataataataataaattgattcaataaaatgagaaattacgaggcaaaaacgccccatcgtccgctgtcgacagaggcggattaatttgccttcggaaaattatataaaaaagaaggaattcatatatatataaataaagaattcattcaattattatctaaataaataaattcaattataataataatttagcattatggctgtttgtaaatgcaaagtgtgcgacgagtgccgtcgaaagcaacggctgcatgaaattagcgaacggaaaaaaattattgaaagctgcggtggggaccaccactatataaaaatgattgaattacggatgcgcgacttaaaattatataaacgagcttataggcgaataaaatctgtgatcgaccaagtggtggaaggttggtaatataaggagggtgaaattttaaaaaaatttagggccattccatgtaaaatgcacttcaaagtgcaaagaagaatttacatattatttgattaaatgggaatgttgcactgaggattatggatggggagtgggctgcacatatgcagaaattagtgatatagtaagaaaaaaaataataattaaaataatatttaactgttagcgccaaaatgagttgttggcatattacgatcaggaacgggtgctcggcgatataattgtaggccgtcagggcagagatgcgcctagttaataaagcgggcgcgacgcaaaatacaaaaagaggggcggtaagtaaggtaaataaaggggatagatagaggaggaggatagaagaagaagcagaagatgagggggaggaggaagaagtggcagaagaggagggggaggaggaagatagcaaatgacagtgtgcaggggagcagtatatggtccgggtcaattgactcggccattactggcttctccacaatgtcggcaacgcagcgaaaaaaagtgctagggaggagccgacaatggttgtttaatataaacggtatacattcgggtgtcaaaaantaacatatattttaaaattttaatacataaaaacataaaacggcataattgattaatttagttaattcattattcacaaaaacaaaaaaaaacgatttttccgtgcctgtggtcagttagtgttccctcaatttttccttttgcctctgctcaataaccccccccccagtccatttttccgttgcctctctctgagaatgcgtcggattaattgggtcaaattcaaattatatgatggctcccctccccacattgtacttttttttgaaaatttatttaaattaaattgtaaaattgattttttgaaacccgcaaacaaattttttacacctactaattggccatttaatta

SEQ ID NO: 6630 - DNA, 1360 bp, Heterodera glycines
ctcctcctcctcctcctcctcctcctcctcctcctcctcctcctcctcctcctttctctccttttcttcgtcctctttttattttatggcctttttgctgcctgctgctatcgttaaaaaaaggagaagaaaatgcgggtgacgatgagaattgaaatgattctgatgatgatgagtcactttttggcagaatttccccgccggggtgggcggggacggggcgcggcgaggcgaggcggggtctccgtcttttgattaaagttcgatgggccagcagcaagcctagcctgaattttctcggggctcatgtgcaaaattgtgttagttgcgtcggcgcgatttccctaagaatccgatttgtatcggcccgtcccattatatatttccagttaatttgttttaaaatttcttccttttttttgttaacctaaaatttaatacaattcaatttaaaaatctaagaatctatcttttttctttaacaagtactgagttttttattgcacaacaatctttgccgtttgtatttgttggtcctgccgatttggcaaacattaaaatttaggccaccgcgcgacgcatggaaaaggacgacaatttttataggttgaaattgctgggcggattcatgaatggggggatacacaattaaatgcaaaattgggaattccaaagtcagaaattgtaataattttcttcttttaaatttaaatttttattttcttcgcaattttttcgaatattcatattcacatttttgaaaaattaatcttagaattccttgaaaatcttacaaacaaattatcgcatatattctttttaacaattttcctgaaaaatatgacttttaacctgtttttgctagcaattttcgatgttttaaaaaggagggttgttttttcattccaaataaggcttttttatgactatgattgaggatttgaaaatttgagatcgaagcttggttctatataattatatgaatatgtataaaaaattgttggacatataaaatgccaatgtttgcgttggtgtagcatgcatttgttgctacaaaattgctggccacgccaactaacaagcagaagcagctgcagcagtacaagcaagcattacataggccaagtgcttcattccccccaacatccttctcataatcatcatcatcgtcttcttctcttcttcgtcttcgtccattgcttgttggacaatttgtacaaatattgtcccaacactgactgactgactgttggcccatggcgcggccggcggtgcataatgacggcttttgctttcccttccccctctcctccccctttgcttcaaatggcttctcaaaatgttttggacccccgccccc

SEQ ID NO: 6631 - DNA, 3923 bp, Heterodera glycines
aaattggtaaaaaaccaatttaaaatcacataatataaaaatggacaaaaatattttgatttaaattgattactttttcaatatcgcacgcataaacaacattaaagttaagaaaagcagctcttgaaatattagggttcattattcataatttgaaatgtaataattgggttttcgaattaaaaaacgaaagaaaaaatgagacaggactattgaaatataatcacatcattaacacacttatagagttttgttaatattattgtgatagaaaacatagaatttaatttaacgaattcaaataaaaaaattttacactaaattattgacaaaatagaaaatctgagtttaattaattttgcaaattaagatccctggttcctgggccttttacacgctgttttttgcgctaattgccgtgctcatccttctctcagtgctcatcataatcaatttaatcataaaaattcaatcattttacggcacaatgcgcgggggctcgtcaagtaaaagccatttaactattttaaaattataaacattaacttatttaggagcgtcgacgccgcttcaatcgctggttcaatccgagtcaaagcagccgcttcacacgcaacaaattccggccatttatcacgggcacattccaacagaagcaacaagcagattgaggtgggtgttttgaatggctcaactgatgcagttcacgcgaccaaacaatgagtattccacagtttcttatgcatattttttcttacttttcataaaccattcatttttggtataacgaagacttgaaacctattcatatttcaaattttgggcttaggacaatagattaaaaaatgctgttgaatacactcgaaaagatattattttggatgcaaacagataaaaatttgataaacctttttgtagaataaacaatcaaaaaatctaatgcgttctgtaattctgcaaaattccaaaaaatcagacccataaactaaacaaaaaatgtcaagtcgagttttcgcacctttttgtcataactgttttttaaatggaccataattttttaatttggaggcttacagaagacattttactatgcgaaaaggagccagacccacaaatttgtaataaaaaatgttattaaataaattgtaattttggccaaatattttcctttaaaggcaccatctcgcggtcgaaatggaggctgaaccaagaagatacggacttggcatgccgacctgtaatattttaaaatgtgattaacagaaaccatctgactgttattacggtcagcaagtgcaaccactacagtataccatccggggccgacggtcactgcacggccaatggagtaccacggacgtcgaaatggtggtggaggaggaggcggagagggcgggcacagtccaaattcggagttgaggggccgaagccacgggggcagctgcagtccacgcacacaatgacaaaaaaaatgggagagaagcgggtgctgaatttattaaatgaaaaaaacaaaagtgctctggaaaatatttaaaaatgggtggagagtaaataattagcatttacaattatgtacagagaaaaaattaacaaagcataaaagttagttctatgtatgtatatttctaataaatttcgccaaattactatgttattaaatgtattattttgaattatatatttgattaatgacagtttcgcctatgccctaaataatcttcaaaatcatatgttttttttcaatctcagatagttaaaaggcatttaatttattagaattacatcaaaattttgaacattattttgaaacgcattttgggcatatgagtaaatttttgcacacattctcttttaggtcttctaaaattattatgcttttacattgcaatactttgaaaaacgaaatgtttaataaaatagcatttaattgtagaagcataattttatatgttttctttttccttgagttactgtgctttgaaaataatatacatcgtaaatatatcgtatcaatgtttctttcttacgggtttgacaatgctttctttctttctttctcttggtctatttcattttatgcaatatttgaagttgataatatttaattgtcattttaactaatgcctaaactaataaatttattgtacatttatttatcttttttttattttatctacattgaatattttggctaaaagtattctttttttttaatctttttgcagttaaacaaatgaaaaatttctctttatatgtcgacgtacaaattcaaagtctatgaatttttaatgacactgttcacctgtttaccatttaaagtttttgatatccaaaaataataattttagatccattttatcagcaactgactattaattctatatgccaatgaatgcaatttcaagcaataattagataaattacttttcaattcgatcaacttctttgaaagttaattaattttttaatttttcaaccgacttgcgatttggaaataattttgttaaaaaaattccaaatttttcgctgattcattaaaaactaataaatttttctctttcaattctaaataccttatcaattattgttctgggttaaattaatcaaaaagaaaaatggattataaaaagactatttaattgttttcaattagatccctttcgcttacgaccataccacgttgaaagcacgccatcccgtccgatctggcaagttaagcaacgttgggccttcttagtacttggaacggagacgtcctgggaatcgaaggtgttgtaagcttttttcttcttttttcatttttataataaaaattttataattattttatattttacagactttttttatttaatattttcatatgatagaaatatgtatttttagttttaattaatttttacagttgggtaaagggtttgagaaaaacgttttaaattgtaacacaatgggacataaatgaggggaaagaaaaaaagagattttttgagtaatttaatattttaaaaatttctttaagtttttaatctcttcaggttcaagagtttcttcctgttccattttttccatcaaatttttacatgaaaaaatgaagacaaacaaaaagaacagtaaaatttatttgttaacaaatacgcatgataaataatataaaaaactgaaaataaatgtgaaaaaaataaagtgaaaaatggataatgaattaattaattaaatgagtaatcgccctttccgttgtttcttcagctttcttcaaagagtggccaaattgaatttgaaacttggcccaaagttcgcctcaattttgtcgccagtccacagagaaacgcatggaaacagagaattgatgggagttgtagtgaaaaaagaggagtcatctgacaaattgaaattgaaattatttgcttttttcgttttgtgtttggcccaccgattcgtcggccattcttcgtcaaaaagatctgtcgagtggccaaacaaacgccgcatccgaccacatctccggtggaaaatgctggcgattggaatgccaatgcgccgtccgatggcattggcacgggcacaaattccaatggaaatggccaattggcactcccaacgtagcggcggtccctctgttgtccaatcgccgcgttgaatggcattggcatggtgccaaatcccattttatcagtcggccttttgggctcggcagatcgaagagatccgatcatccatttttgcccaattcgaatccattaactcaataccaaaaaaatctagaacttttatttgtattcgaactcgaagtaaaaggtaaatacgcaacacgaaccaaccctaacttacaacaataatactggcaatctttcggaatggcggtcccgaaaaaaaaatttcttttaattcgtaccactttttctaggcctaaaaatacgaag

SEQ ID NO: 6632 - DNA, 2755 bp, Heterodera glycines
  misc_feature (53)..(53): n is a, c, g, or t
  misc_feature (111)..(111): n is a, c, g, or t
  misc_feature (150)..(150): n is a, c, g, or t
  misc_feature (158)..(158): n is a, c, g, or t
  misc_feature (181)..(181): n is a, c, g, or t
aaatcatatgtttttttcaatctcagatagtaaaagcattaaatttattagantacatcaaattttgaccattatttgaaacgcattttgggcatatgagtaaattttgcnacacattctcttttaggtcttctaaaattattatgcttntacatgcnaatacttgaaaaaacgaaatgtntaataaaatagcatttaattgtagaagcataattttatatgttttctttttccttgagttactgtgctttgaaaataatatacatcgtaaatatatcgtatcaatgtttctttcttacgggtttgacaatgctttctttctttctttctcttggtctatttcattttatgcaatatttgaagttgataatatttaattgtcattttaactaatgcctaaactaataaatttattgtacatttatttatcttttttttattttatctacattgaatattttggctaaaagtattctttttttttaatctttttgcagttaaacaaatgaaaaatttctctttatgtgtcgacgtacaaattcaaagtctatgaatttttaatgacactgttcacctgtttaccatttaaagtttttgatatccaaaaataataattctagatccattttatcagcaactgactattaattctatatgccaatgaatgcaatttcaagcaataattagataaattacttttcaattcgatcaacttctttgaaaattaattaatttttcaatttttctaaagacttgcgaatttggaaataattttgttaaaaaaaattccaaatttttcgctgattcattaaaaactaataaatttttctctttcaattctaaataccttatcaattattgttctgggttaaattaatcaaaaaagaaaaatggattataaaaaagactatttaattgctttcaattggatccctttcgcttacgaccataccacgttgaaagcacgccatcccgtccgatctggcaagttaagcaacgttgggccttcttagtacttggaacggagacgtcctgggaatcgaaggtgttgtaagcttttttcttctttttccgtttttattttttgttttgtaagaaaatgaattattttttgtttgtttttgttaaattattcatttgcttgaaattacttcttcctataactttgtggcttgttaaaaatctcttcttatttttaataatatttatttgttgcctatggaagtcaaaaatttaataaaaatttaaatcgctttgagaaagaaaaatagaatttgctgaacaaaaaatgtgaaatgaaaagtgaacaaattttaaaagaattttcttttaccctaagggccaaaagaatctttttaaattcgaaagaacagctataaaagtcaggctaaacatttgaatttttttttaattcattaaattttccaatttaggcccatcatttttaaatgtcattcgctttatgttttttatcgtcataagcttgaaaaaacatttttagtttggttttgaactattaggatgaatttttcgtcccaattttgactatttgtgcattttgtgccgaaattgtttttttttttggttttttatcggaataaaaaaaatggcaccttaaaaaagagtgacttaaaccactaagaacggaggatacttgtcttaaaaattgacaattagaattaatttttcttaacctattttctgattctctagcttttttagtcatttgaaaattcaaattttcgaaaaattacgtataggaaaaggcttttgtataggttttaaagagaatttgtgaagaaagtcaaaaaatgttatcaattttcaatttttctaaagacttgcgaatttggaaataattttgttaaaaaaattccaaatttttcgctgattcattaaaaactaataaatttttctctttcaattctaaataccttatcaattattgttctgggttaaattaatcaaaaaagaaaaatggattataaaaagactatttaattgctttcaattggatccctttcgcttacgaccataccacgttgaaagcacgccatcccgtccgatctggcaagttaagcaacgttgggccttcttagtacttggaacggagacgtcctgggaatcgaaggtgttgtaagcttttttcttcttttttcatttttaaatgtaaagaaaaagaattgtttttttgttgaatttatctgctcaacattacatgtttttatgacattttgtataggaatctatacaattttcacttttttataattatactatttttatatttaaaaacattttttataatgttttaattttagaaattattttttttacaattggacaaattaaattgaatgtaactcggataatatgattattcaaaaaatttatttctcgcagtttttataaaatttataaaatatttcatttgtttcttttctaacaaatgatagtaaattttaattatcatttcatgagaataccaagaaaaatttgaagaaaaaaagcataacagacaaaaaaaaatataatggaaatatttttatgataaacatcgaaggtcagttgctcaaaatgatgcatatttctttttccaccttctcagactttcttttccaatttttaatttcttaacaataaattcgtcactaatttttggatatttttctaagcattttgtaatatttctgcaatattcttaatttttggtcaacggaatatttattttttgctaaacaattctcattttaat

SEQ ID NO: 6633 - DNA, 580 bp, Heterodera glycines
tttttattcagaattgtagtcataaatatttgtgttcatccacatacagtttgccattcgcctctctccatcaatctttagtttgcccaagcgtcagttccatttgattttaatattattgggtgagacgatgggagctgagcaaaattgaaatttgaagtgtaaaaaaagcagcaattcagcgaatttcgaaatctttttaatttcaataatttttattccataatcatttaatttgtttgttttacgagacgttcagccatttttcgaccaaaaattcctaaaactaattttcgaaaattttagactgaaaatgagcgatcgctataatttataactagggttataaattgtatgattttgcatattttttctgcgcatatgctatgaagtagagtgccacgggaccgggaattttgggcaaacccgggaccgggaccttttcgggttgaaaaatcgggaatttttggctgggaaaaccgggaaaaaaccgggactagtcccggtcccggtcaaaaccgggaccttggtactcagttgtgctcagttgtccgctaccaggtcccggtcccgtggcact

SEQ ID NO: 6634 - DNA, 1949 bp, Heterodera glycines
ttcgaaagagaaaaaattgagctttttgtactttattttagatttttattttggttttcgaattttttgaattttgcaaattatatatgcaaaaaattaaaagtttaaaaattttttgaatcaattatatttccgagattccagtttaaaaaaacgaaaaaaaatttccaacttcaaaatcaacaaaaatttatcattcttggtataattagatagcatattcttcatatttttaaacaattttttttattgcctttttagtggaaccaatgtgcggtggtgacggatcagcagatgatcaatctcaagccaattcactacaaaatgatcccaaattctaccatcggctgattgaggcacaaaaatttgcatacgctcaacgcgccaatttgggcgatcaagcatttgtgccagaagcgaaaaaattggccaagcacatgacaagcaatacatttttgcataatgtgcacaaaaaaatgttggacaaagcaatgccggacgagcattacactgatgatcggcccatcaaggctgatgtgcgtttaatttaatttttttttttaaatttattttcatggcatttattttaatggattttcatattttcacgaaacttcttttgtgctaacaattttcaaaatttcattttctaggttataagcctcttcaaaattagccttttatatttagtaattaaaattttttaattttgttttacgaattattacttttttaattttgtgaaaaattaaactatttttatgtaaacagttcatccatattttttgagttatatgaggccatagtacagtaaattaaacaaaatttgttttttttttaaaatttttagaaagatcatactggaacatctcacacatccatattagacgctgatggaaatgccgtttcagtgacaagctcaatcaatcaatggtcataatttatgggatttaaaaatttatctaaatggacaaaacttattccgttattttataggtttggggctgtgattcaatccgaaaatttgggcattatatggaatgatgaaatggtaaaaaaaattatttaatggttttttaatattttattttatttgcaggaagatttctcatttcccgatgtgaaaaattggttcggatatgccatttcaccaaccaattttgttgcacccggaaaacgtccaatgagctcatttagtcctatggtcatctacaacaagcacacggggaaagtgagttgcaaacgaattttccatttttttaaatttttggggcaaaaatgaagaatacttgaacggaaacctaatttggggaaatcgtctttaaaaagtttcaaagacttttttgaattttagaaaatttcctgtaaacttttctctactttttatgaaaattttgtcgctgactaagatgttactcgtcgatagttttgaaatttcccatgccacttcatgacaaattttgtcgaagaatttccttccctaaccccgacttttctctccttgatggccgtggtttaactctacttacaattaacagtgtaaaaattccccgctgggtaacgaatgtcggggaggacaggtccgggagaaggcccaaaaaggtcggggatgttgaacgggagttctgggtccgggctcaaccctaattgatatcattaaatttatcaggtgaaatttgtcattggcggctccggcggtgccaaaattccgtcgtctgttgccaaaacagtgttgcatgtgttgtgcctgaaccaaacagtgaaagaggccattgatgcgccagtgttgcacaaccaattcactccgaaccatgttatttacgagaatgggacaccgccggtaaaaaaaaattatataatttattgtttatagggtcagacatgggtggagacagagatttttggaaattagaaatggattagccaaggaccaggaaagtcgggatccg

SEQ ID NO: 6635 - DNA, 5928 bp, Heterodera glycines
  misc_feature (69)..(69): n is a, c, g, or t
  misc_feature (4337)..(4337): n is a, c, g, or t
  misc_feature (4376)..(4376): n is a, c, g, or t
  misc_feature (4390)..(4390): n is a, c, g, or t
  misc_feature (4455)..(4455): n is a, c, g, or t
  misc_feature (4476)..(4476): n is a, c, g, or t
  misc_feature (5910)..(5910): n is a, c, g, or t
tcaaaaaaaaaattctggtactagtgcggtttgcggtttgtcccctttttcaaaaaatttttctttgtntaaaaatagttggtttctgatcacgaattagggattaagttcgaccaattccgtatcctcaagcccgaatttgaacaaaaaaaccaaaactttcagaaattttgttttatgcccaaataaaaacaaattgacacgcataatagaataatatgattcttttaagcaatttttgagtagtcgccatattcggggtttgggattggtcgaaagggatgccagattcgtggccagcagcaacccgtaaaactccgagaaacattttttcacaattaaaaaaatataatattttttttttaattggggcgcggcaaatagcactattaccgaaagtttttggtcttactaaagtttcttttgggttagggatttttttctgaaaatttcccatgtcaacaatttgatttaatttttttttttaaatttgcgccgtgttatttatatattcatttctagaaattgatcaaagatctaaacgaaaacttcgggcacattatgaagtcgtacgacaacaacaacgtggttgtgcaagctattcatgtggccgatgacggcttcatctatgcaaatggggacttccgtcgtcgaacttacatgcacccggccggcttctaattggcgtggcacggtgccatgaatttgtggacggacccccggagttttctagactgaatatacaatataacaccaccatcaacgcataacaccatagattatagacaaaaattgaaggcgatgggaatagaaaataaataatcaaaaaaattgatgcgaaaccaattattgagtagcataacattgcatttgttgtattgtttgtttatctcaataaataattggatttatttgttgttttttttgcggtattttattatggtaggaaaagtcagcgcgccatgcgcaaagtgtgccataattagtgcacctaattagtaatgctcgcgagtctcgatttcaagaaaaaccctttctactaattttaaaaatttaatattttcttaagaatttttataatgaattctttgataaacaaaaagagatttagttcatacggtgctattgtcgttataaaagccttcaaaaagggcattaaaaaccatcaaatgaaaaatttcaaacaaaaaaatgccataaccttgctcataccaaacaaaattttaatcttttgccttaacaattctctattagcctggcaaattttcaaaaaaattcgtctagtttgaataaagtgatggccaaaagtacccaaggaaccaggtcttcaaacatttttggctataacttttttgaaacttaacgagattttttaaattttgccggttagtagaaaacacttggcaagaaaataaaatataaataatttataactaaaagtttttaattagaaataaaataattttgatcataaaaattctgatgaaaacttcttataactaacaaaattaagtgatcttgatatcattcgatagccctaagttatgcgtagatttttaggggtttatttttctgaaattttttaagtcgattaagaaattttctaaaaaatgtcgaaatagtgaaaaaatgccaaaataatgaattttaactattttggtgccgaagcgacaaaatagtgatttctaggggaacgggtcgtttcggcgccgccgtttcggcgacgccgttttggcgccagggtcgtttcggcgccagggtcgtttcagcgccaaaaaatattccgatttttaaggacctgtaacttttgaagcagacgaaaatggttaaaagttaacaataaagtttacaaaatccaaaatgcataaaattaattattagatcgaaaggatccgaacctgaccaccgccatcccttcagaatccacagatacggatggatttttaggccttaacgaagtcttaagatcattctgatcatatattcgtgatcagcggcttaaataacctctaaaaacaatttttggaagattttggtgaaaatttttcccactcaaaaatcatgtgctccccctttggtactgaatttcaaaatcatttttattgaaaatagggaattcaaataaaaagcacaaaattctccagatttttctttatttttagagcttttttgcaatataattggtccacattgaagtgtcaaatatgcaggaaatttataatcgttttggcaaaaaaattttttgggggtggcttctaatttagaggggtgtggttctaaacgagtaaaacggtaaacaaaatgaatttttgtgaaattttcttttgttagtttattgttattctacatttttgttaaaatttttaatttttgaaaatttaaatcgctcaaaaatttcgcactcattcatgattttttatttttggcttggcgccgaaatgaccctggcgccgaaacgaccctcgcgccgaaacgacggcgccgaaacggtgtcgccgaaacggcggcgccgaaacgatacagactcatttctagtgacgaaaaatgacatcattttttaatgcagaagtgcgttttttgagccatttcttcgaatcaattgagcaaaaaaaaatagtttttcaataaaaatcgcggccctatttataagccaaaaatttcattgagtttcaaaaaatttatgaataaaaaatctgactcaagatatttgaaattaattttaagacacaacttttttatattaaaaaaaaattaaaattcgaaaataatcttctcatatagaactcctaagctatggatggactgatactgtgaatattaatttggttgtatttgatacaaattatgaatttatagttacattttttgttttcgtacatcttcgctgaatttagaaaacgttctatcacccaatcgacgacattcgacaattcgccgaacaaaagtcatagagaacatttttgagcagcgattttgttgaacaattttcaattaaatttgtaaaaatttttttatttattttttcacagaaatttattgaattcaacatttgtggagctaacaatgactaatactttttcagtttagaaattcgtttttatgattttttatgaaaaaagagtcagtcagtcctctgaaaaattgttgtaaaaattcgaatttgcgtgtttttgattaatttttttttttgaattttaacataatgactcagacatatatgaggacaccacacttagttaatatatgttcttgaactctaatctaacaaattgtttatgattataaattccaaaaattcatcagccattctccaattcccgttccaacacatccagcgaaaaacttcggtgacatcgaaatttctaatagtcactgtctgaatcggcaaaacgaacgcgtgaacgtgatctcactaaaaaatgatttttattaaaatcaatttagttaagttaattagagaggagcaatatatttttttatcggaagaaagaattgggtttgaattgatttgatcaatgatttttcgtcaaaaacaaggccggatgtttttctgcttgatcagaaactttcaattttctttattttaagtaaataattgtgttttttttaaaaccaattcataaaatttacttagattttttgtaaaaaaaaaaattcattaagttttaatattcttaaaatattatacaaaatattttggcatttttattaattataaatcagaatgctcaaaattgctgttaagctagctgataagaccaatgaccaaaaatggactcttttaccttaatttttcgtttttctaattttaaaaaaataataaaacttaattttcgttttttcatttgtttctgccaactttgttcgttcattcattttgtcccttttacttaattcgtataatttttcagcgactttatccgccgaaagtgcgtattttttcccatttttcaaatcaaagatatgcacatgatgccaatctgtcacatgcacatattcttttgtccaaacgcttgcctaaaaatttaaatgcctttttaatattagtattagtgtggatgaagaatttttcgttacgacacttatgattgaattctcattattttaaagactgagtaatcgataagatttacgtgatcaattagagtgcttaattagtcttcttagtttatggcgatcaaaaaattggaaaccggatctcgatacttatattttttgggaattgaactttgagtccagaacaggaaatcggctgctttactgatcaaattcttccccgttattccggaaattgtgagtcctaaaatttttaaaattctcatagatggactgcaatntaattattaaaataaaaaaaataaaaagtgaaattattntaaaaaatgtaccncaaaaatgtacaaatgcacaggcgggagacgccatcgtgccacttctctgctcttattctcaatntcatattccaatttgaatttnccattctcatcggtgaagcaatcgtgtggcacatttaattccgatttgatcaatctttgcgcttcatccatttcaaagccttttacgtcccaaaaaagtttgtacttgccttcgggccaaactcggccatagaatgtcaattctttcgctgtattcaattaatagcgggattcaccatgccatttttatgtacaaaaaacccacaaaatgccggtttttttacggttaactccattcatttattttcagaaataaaaaatatatatttactcacaaaaattttatacataaatccactaaattataataattaaacatatttttgggtttttaatttttgaagagatattcgaattcataaaaagtttccagaattttatagataatttagaaaatatttttcatgaagaattttaagttataaactgaaataataaaaggagttacaaaaaaaaattgtctttttctacataaaaatgggtgaatccctttattataaatttttatttaaattataattattagaaattaataaataatttgaatttttttaaagccaactttctccactggcaacactgtctcttagctttagaaattccaagtccaaattttgttttaacacatcttgtacatcattagtggccaaatccacaatgtaatgattgtcccaatcgtcaacgcgtattttcttttcataatgtgttccttttcgctgaattgaaaaaaatatgtatgacaattttaaaataatggcaaaaattaaattatttgaaatttggatattttaaatttcttaaacatccaaccgttctcgcaattttcgaaaaaaccggaaacatgagaaaaaagaattattcagtcaaaaattaaaaaaaaatattgtatattattagagaatagatttttagtttctattttttcgcggatagtttttgatgatagagtcacgaaaaaaaattaccctcggttttcgaatttgaccaatttagcaatttttagttaaaatttattaataaaaaaaatttttttttaaatgtgtgaatttttgatttattccttgatatgaaatgaaaaattgcatttttttttctcttttgagtgccaaaactagaaatcatattctcgttgattcggcactggatttcaaaattcctaaaagtgattttggtctttttggcaactattctaataagtttcttcctcggttttaagtaattaaatatcggcattatgagtaattaaaacaaaaaagaaaatccatcaaaaatcatagaaaacttctaatttatttatggactaaccagggccccaaggggccctgtgaaagcgccacgggcgctttcaacaccggggccagccgggaacagttgaagctaagtattttaaaattagccgagtgagtacgtcaagcgtttgaataatagcaaaaanggtggtgtacttaaaact

SEQ ID NO: 6636 - DNA, 4078 bp, Heterodera glycines
tttcaaatttacaactataggaagtcgaagttggtcaaaatggatgtcagattcttgtgcagcgagcgatccctaaacccgaaaagcaattttcacatttttttattacaatttacaaagcataatggtctcccccccctctttggtttttgataaattcaaaaacggtaacttttaaagtagcgttagtttttttattttatgttgtaaaaaaaacactgctttgtcccttgtccttgatggggccgaacccgaagccaggccagaaaaattttgtattaaatttaagaattgcaacgggttgttacgggtggaaattttccggcgaatttgggccaaactgttgggcttcctgttgcgccgaacgaaacggacatagtaagaaaatttcgaagacagatagataacatacattattagttgtaagcgaaaaaataaaaattctggttttttaagaaggaatggaaaatttttgaaaattgttacgaatcggctaccccaataaattcgattcgttaaaaattttaaagaaacgatgaaaagcaattcggtagataattttgtcatcactctttctgacagacctactcaaattttacagaaaattttcccaacccactaggaattttttcgaaaattttcccaatttttagtgtattttatgggtgttaagatgagagatgaccatcaaggagtgatctgatttatgttggtccaaaagacttttgatcggcatcaaaagttatcttagaaggaattttttcagaattttatctcgacataaaatgtcggggcaatttttggctataattagtgcactaattgatgttttttcttttgacgtaaaaaagacctttttgccaccattcatttttgagaaaacgaattttacaaaaaatgatacaatatttttgagactaacagtaattaacatttttcataatttataaatttacaaaaatatcgaaaaaggaaaataaaattcttctaaaacaaaaaaatcttaaaaactcatttatctcatccgatttggagtgcaacagaacgacattcgcaaatccccgtatcgaatctggggcttaaccatagtttaaactagagccagggaatttctaatttgcatgtcccgctgcgggattggaattcaaaatagttgctgctggacggttttccacgagattcatcccgcaaaatcccgctttttccaaaaatgcaggattgcggactgggatcccgcaaaatcccgcgccggcctctagtttcaaatcttgaatggaaatcgaatttaaaaatatgtttttcatgattttcaggccctttaagccaagatttgcttacaaacctgaacatattcaaaatatttttgttttaaacaaaattattatttaatctggttcaaaccaattttaaatttccatacatttaattgtttatttgactatttaaggcgaacttgcaactgaccagggccattcaggtggtcaaaatatgttcagagtgtcctgcgatgaccgttcaggaattgacgaagctttgtgcatgtaataaattgtaatactgtatttactgaaataggttccccgtgggctttttttttcaatgcccctcaaaagggggctttatttgagggagggctcttctatttgaagaagtgtgcgggcgcactttgacgctatataacttttcttagaagcgcccaaatttacattcttggtatcattcgaaagccctaaatcctaaatgcctctattttactgcaaaatttcaaaaaaattttcttaagtttcaaaaaaattatggccagaagaatccaaaaaacctggttgtttgaacatttttgtcataactttcttgaaatttgatgaaactttttgtaatttgaaaagctattaggggcgcaccacttagagctttcgaatgatatcaagaatgtaaaatttggtcgcttctaagagaaattataaagcatcaaacggaaccgcactagaacggcccgcgtggtaaagattaattgatctattaatggatatgtgccaggattgatggatttggtcgagagaaaaaaaaaagaagttgaaaacaaagttacaacccataaaatcgggttctgctagtgcgaggacatttcttaaatttcggcaagggataatgaaaatgaaaaaataaaattcctaaaattgcttaaagtgttaaacaaatttaacattcttggtcatatatattgttctaaggattctttatctgaatatttaattttaaaaattttgaaaaaatttttaaaaagttatgaccagaaaactctgaaagttcgattttttgaatttaacaaattatacacataatttatttttttattttcaattattttttgttaaaatttttcattttaattatctcatagagcgcaacgcatttatgaaacgtcccaacatgaaccctattgatgatatgcttacactcacttattagtttaaaaaaaaaaaaaagcccttaaaatgctatactaattagagatcggaccggtcggtttttttcggtatttttcggtttcggtttttaaccgaaaaaaaccgaccgagaaatttttgagtttttcggtttttttcggtttcggttttttcggttttttaaccgaaaccgttcgaccgaaataattaaaaaaccgaaacaatcgaccgacttttttgacaaatcagttggccattttttttaacaaaattcattaaaaattcttaaaattttcctccggcggcgcctatcggcaccgccgacccccccaaaaagctatcttttcttaaaaaattagcccaaaatctcaaaatttggtatttttagacaaaatctgctaacaaatagcattaaaattacaaaaaaatttcccggcggcgcttatcagcaccgccggccctaatgttatggctagagctcacaattaaggcaccaaaaagcgcaaaatggcactgaaaaaaaggcacaaaaatcccgaaaaaggcatgaaaaaaggcatttaaattttttttattgatgatttttagggagcaaaacacgtaaaaactaaccaaaaaactaaattttgctgatttattgataattcaattttataatgtttttcaataaggaaatttttaaacctaaaattttttatcaagaaaaaaaatgaattttggcgttcaatttataaaggtatattctctgaatttttttagatcatttcttaggggtgtatttttccgatttttttgaatttttaatggaatttttcggaaaaaaacgccaaaaaaggcaccaaatcgctaaaactaatctttgtggtttttttagaatcaaggagcaaacacatgttttttggctgccttttctatcattttccaaacctttagtacaccattcaatagagtttcaatagctctacaattttattcagaggaatttttgctttttctattaatagaatagtttattgcttttttgaaaaaaaataaacaaatttaaaaaaaaaccgaaaccgaaacgatataccgaaaatttttcttcggtttttttcggttttttaaccgaaaccgttcgaccgagaattttttgagtttttcggtttttttcggtttcggtttttttttcggtttttaaccgaaaccgttcgaccgaccctcttgtccggtctctaatactaatgttaagaatttaatattttatttttaaagttctatccaagcgtgcgctcaatctcagcgccaaatactgcttgttgccaccggcggatgattagtgtaaaaattaactaattttccatcaaaaacaacaatttcatgcttttatttattaacaattgaataaattaatggcttctaatgctttggagacttaaaatttaatgtgtttttattttaatatttgaaaattcaattgactttaacaattacagtattttttattgcttgtgaattttgatttttgtacaaattttgagggtttacatttgtcaaatttttgaaaattattataattttttatttgttgttgttaaggctatttgggtagtttaccgagaaaatagaggcatcacttttttgtcacacct

SEQ ID NO: 6637 - DNA, 974 bp, Heterodera glycines
atgatatttaaagttcgaaactaatcttaatatattcaataagaaaagcgattaaaaattttttaaatttattaaattgtgatataaacagaaaaattctttgtaaaaacagaaaataatcaaaatataatttttattattgtaatgcttttgaagaaaaattttaaaatctcggcttaactgcaatttgaaaaaagccgcacgcatatagggtggggtgtccaatcctttttagccaaaccatttcaaataaaaatagttttgttttttaaaatgggggacatcatttgtattattttaaaaacatcaaatttttaaactaatgctcataattgaattaaaaaagactaatttaaatataaataaaacgaaattttgcaattgcattataaattgattaaaaaattgcaattttcgttaattttttaaagtataaaccataaaaatgtaaacaatatgattattgattatgatgaaagcaaaaaatgaagattatttatgataaaataataaaaaaataacttattatgatttttcagcagcccgttaaaaatttattatcatggaattgcagagaaactattggcttgcactcggtcgtgtatggttaattatgtaatttcaatcactttgaaatctgtcaaaagaggtgtcatagggggctacccgacttttggggatttgcaactttgggacccgactgttgatgatcttgacattaggtgacccagatatttatggtgatatcgactacttatgaatcgcgtctttaggggatggagagattagaagggttgcacggactgctacaggctgatcttaggctgaatcacaagaatgctacatcacccacatcccacaacaatgtgcgcgagtagaactgtcgcattgacttgggtatctgtgagaacaaatattgcagtttgactgtgtgccctcggcccaaggatttcgggtcgttgccatgagaagtg

SEQ ID NO: 6638 - DNA, 2472 bp, Heterodera glycines
catttggggacccgacacttagggaacccgacatttgggagactcgacatttggggatcccgacatttggggacccgacatttggggacccgacatttggggacccgacatttggggacccgacgcttagggaacccgacatttggggaactcgacatttggggacccgacacttagggaacccgacatttggggaactcgacatttggggatcccgacatttggggacccgacatttggggacccgacacttagggaacccgacatttggggaactcgacatttggggatcccgacatttggggacccgacatttggggacccgacatttggggacccgacatttggggacacgacacttagggaacccgacatttggggaactcgacatttggggatcccgacatttggggaactcgacatttggggatcccgacatttggggacccgacacttagggaacccgacatttggggatcccgacatttggggaactcgacatttggggatcccgacatttggggacccgacacttagggaacccgacatttggggaactcgacatttggggacccgacttttggggacccgacacttagggattttattaaaacatttaaaaatttatctcaaattagacaaatttacgactgctttagccagagttaactccattgcaagaaaaataaaataatattttctaaataactctgtttccgaactctaagaaaccgaaaagatgacctcagcattttgttgctgtacgcaattagactgtaaagttctttaactttttgaatgcccttgatgaatttctgttcccgttggcccttgggaaaggcgttttaaataaaattggaaagggtgtactgtacatactaaaatgtattgtggtttgtctattgtgttgtggttagtatgggctcaaaattctgcgcctcctcgcggtgagtccggaaacagagttaatttttaaaatattaattaattttttttgcaatggaattaactctggctaaagcagacgtaattttgtcaaaattttgtggcttagaattaaatttttaaatttttttttgttttattgaaatccccaaatgtcgggtccctaaatgtcgggttgccaaatgtccgtggttttcttaagtgtcttttgctcaaatgtcgttcggtccccaaatgtcgggtccccaaatgtcgggatccccaaatgtcggatccccaaaagtcgggtccccaaatgtcgggatccctaagtgtcggatccccaaaagtcgggtccccaaatgtcgggatccccaaatgtcgggtccccaaatgtcgggatccccaaatgtcgggtccccaagttgcaaatccccaaaagtcgcaccacggtcatagggatgtcaatttttatgtatatgcatattttaaaaatggcctcttctattaaagtcgcccttttgacctcgaaggaccgaaaaattttttcaaataccattttttggtattttctaataaaaaatgtctttttgaaaatgtatccaaaagtaagtccaaaatggaaaatttttctgttttttttgagtttttttctaaattaataagtttacttttatttatattcatactatatttagctattttcgggattttctagctgcttttaggggttactattttgagttttttggatgcagttttttatagatttaatccgaaaatggaccatttgaagccctttttaaaagcaaacaaaaaaattagtttgtccccgactgaaagcactgctgtagaaatttggaggatttttgcctgattttggataattttttggattttgatataattttaattaaaattaatcatttgggctcgcggtaccaatagacgccgccgggaaaattttgaaagttaattgtgatttgctaacagaccttcactaagaatttttaattttgagtcattttgttacatgaacgtgccaattcctaacaaattgcaaaagtttttcttatttcgaaaaattatgacaatttgctaccggccctacacatccctgctgtgtagtagtcagtccggtactgaaatgactagcccaaattttgtttttgcctttcccccgaggggcaatctgttccacatatttttgccccattcgcttttctcttatcattccatccaaattgcccaatttcggattttcttatctccttccacatttgtgaccagctgcttctctcatctcccgtcgtcgttctccgattggcgatgatcacaagacacacccaattcatcacataacataaatcaacaacttttttgaaacgagaataaataatatcgctttatcataaaagccaaaacgaaaggaacgctttttaagcaaccaagaagaaaaatattaattagggaattgtagtatttgtaatatttgtcatttttaatatttaaataatatattttaagtgaattaaatgattttgaaaa

SEQ ID NO: 6639 - DNA, 1453 bp, Heterodera glycines
tcatttaggccaaaaagcttcattataattatgttgccatacaataattaaatttggacattcttatttttacctttttcccggaaacgcataatcctcaaaaactccaaatccataaaaagcatattttaaaaatttatcctcctcgatcacccccaaaaatcacaaaatcaggctaaattctcacattttgcttgtcttacgtaaaatattctttttttttcgtgacaatattttaatttaaatcttgaagatatttaaattaattgcgtttgaatataagatttttgtgatttttttttgtgcctaaaaatgccatccctaataatgaaaatttaagtctcttaactagggctccaatttttaggcaaaaggctatttttttcctgagctccccgtggcctaaaacgcacgaaaaacatgtttttttgggctgttgttaagctacttttcgagttattagtgcctattttctaggcttttatttttagcgcctaaaaagcctaaaaaattttgaaagagcctatttttgcctattttggcgttttgcctaaaatttgttaacaaaaatgcaataaaaagaaaaaaaatacacccctaagaatcgatttttttgaattttaaaaatacatccctaagcagagattcaaaaatttctgaaaataaatcccctaagaaattaaaattttctcaaaaatcgtctttaaaaatttttttggacaattttttgaatttaaaaaataatgtaactcaatactgatttgacttatttttttaccatttgaataaaattttttcattttacacccctaaatttgagactttttagagcctattttccattttttggagcctattttgggggttttctagagcctaaagcctacctattttggcggtttttagtgcctataaattggagccctactgatgacgatggaataaatttttttaattaaaaaaacagaaattttaatggcttattttcatttgtcgtctctgttagagtttatcggaatttcgacaatgaatattttgcgaaatggtggggatcgtatgaaactgctaaacatgcgatcaaaaggacaaatggccgaggaattgaagtggagaagaggcgaagtatggaaacattgcgtggaccaaacattgaccaaaatcaaagaacatataaatatggtggaaaataatatcctatataataaatagacataaattaattaaggacactgagtaccaaaaattggccaaggagaaattccatttgaatttcccaggttgggacgcactctttgccaagagccgctttttcttcatcaattcgctgcccgatattgattttgcccagtccaaaatttttaagggcgatcagcgggtcaaatttattggcggcttaaattttggacgtccgtcggacattgacgaaaaaaagatggaaaatgtaaaataaaaa

SEQ ID NO: 6640 - DNA, 1330 bp, Heterodera glycines
cagctgagtttggcactccaattccggcacttttcagcctgaaaaagggcaagcgtgcctctaattctatttttccaacccatttcgaatctttttacatcgattctgaccgtttttaagcatttttgagtttggggactatgaccaatatttatcggcggtgttgttggcatgaatgctcaaaaacacagaatgcgaacaaattaaagcttttaaacgttttaacaatttgtgataattctgatttaaattcattgaacttaatctttgaaatgaattaacaaaaattcaacatttgcttgatcacaattgcgatcatgctcatcaactttgggggttatattcgaattcttgtacgatttcatcagttgtcttctcagcagaagaagttgaaattcaataaagtgaggattggatgagttttcggcgtgtgccaacttaaataatttttacaaattttgtttgtccgacccagtttttgcgaggtcatattttttcatgacagcctatttctttttttaccaaatatcgcccctcagttgtttcacagttttgtcattgaatcggggatgtcccaattccgcgcactcttcggcaacttcgcgtcaacaatactcaacattgagaaaatcggaccccattacagtgtgaaaaaagatttcgtgtcttttctcgacagccttaactcaaacggcttagacaacaaacacatctcattttaaacaactctttacgaaatcatttatcactctttagccgcacatttttctaagttatcccaaaatttgccaatttttgacaaacatgtgtttattatttatttccataaaaattcagaacaagcgacaagcctctgcaaatttgttaattctaattggacgacaattcgacgaacttgaacgacaaacgatttatttttttgtcgtgacaacaaattaggtaagagacaaccgaaaaaattgtcgttcgtaattctgaaaggcaccatcagcagtccctttctgccagttcttttccaggtaaacttaagaagccataacttttttctcaagtgatcaacacttttttttgagaattgttaagcaagtctaatcgattaaacacttataattgtttcaatatgaaaacacaagtcagaatattcctgcaaatttatttataaaatttttatagctcaatattacttataacagtgctaaattcggaaattaggaacttcgattttttgttcgagttcgggtccggaattggccgaatggataattcgtgatcagtgagacctcaaaaccccaggaattgtttttatatattaaaatttccactgacgcat

SEQ ID NO: 6641 - DNA, 1426 bp, Heterodera glycines
  misc_feature (1384)..(1384): n is a, c, g, or t
cccacggtcacaattcacggggtcaattcacggtttttcgtgaaaaatttacactggataaaattgaaaatttacgaattacatattgttttcatagagaaatttggtcattttttgggcaaagttgctaagaaacagagcaaaattttcaataatttccccggcggcgcctatcctatcggcaccgccggctccctcccctattcctgaaacttttttgaacaaagccaactacctatattgtgcgaaaaacaaataaaaagcaaggtttcaaggatgatcccatttaaataaaaactcattaaatttcttttaaaaaatcgctcgaaataaagttaatgtctcacaaaagcattttaaaaaggttggaatcgatttagaacgcaaaatgatgagaaaaatgcaaattataggcgcgcgtgccaatgcacacttcagtacccgattttttttactgaaaaatgacaagcctatagtaatttacaattttttcatcgtttgccttttataaatcgattaaaagtgcaaaattggttcattttacgacaaaatctgttaacaaattgcaccaattttagatttttctcccggcgaggctccaaaagtttattcgtttcataaaaaatggttcaaattcgcaaatttggccttgtttggataaaatttgtgcacaaattgaactcaaattttaaaaatttttgcagcggcgtctatcggcgcccctggaccccttttcccaaattttttttttggaaaatcataccgcaaaaagacggtatagaaatcaaaaaaattggccgacagagaaattaaaatcaaaattcaacggcatcttcattggaggcaattttctttttaataattttgggaaattttcattcacaaacttttttcttttttgcagtttaaattttaaaatatttaaggtagcacttccggacttaccagtagaagttaccaacacattgttaagcagcgttaaaaaaaagttgatgaacataaaaagtcataaatatacattttaccctgctggccaatatgaaattattgtggcacttggaccatatggtaagtttttggggaaaggcgtttaggaaaaaaatccatgcattttgccaacaagtaaatgtacaaaatattaaaataggtgctagcagctgcaaactgaaaagtttgaatgaagtttcaaaaaactcacaaaaatctatttttgggcaggaaccttttctaaaaaccttacaataacagattgattgattaaggacctacttttatgattatttttcagacttctgggccagtattcagcttgagaacaactatgttctaaagaaattgaaatattttaaaacagtggatttttaagcaggccgtctaaaattanagaaactttttttacatttatttttttgaaaaaagcatctaa

SEQ ID NO: 6642 - DNA, 2896 bp, Heterodera glycines
ttttccctgctttaatagtaggaaaattttttttacatattttatgaattacagatattgcgattgagaaataattttttttaaatgtaccctaaaaattggtttttcaaaaaaaagatataccaaaattaatttttacaatagaaatacatgaaaaccattaaaaagccataaattcatttcaacaaattttaatttagatggttcaaatcgtttcgcatttttcactgataaaaagggtaatctctattggaatttcaagaaacatattcacaccaataaattaatcagaaaccgatatataaaccataatttacatgaaaaaattaccattctggtggagaaagggtccgataagcgaattatgagtgaattcttgaattatgccgatatgacaaagactatggaagacaccaagggccaattgtgcaattctaagagcattaattttaacaaactagcggtatgcttttaaatttaatatgtttgttaatatttgcattaaaagtaataattatttgaaaaaaaactaaattttataaactcattaattaaaaaaagtttctttaatgattattttacaattaattatcaaatgttatcaggttgcaccttatgacactttttcaccagaaaaaatgaacaaaaaattcggagaagtcgaacagaaacttaataatgtgcatgagcaattaattctcaagcaagcggatattgaggaattaataaaccgagaaaaaagtccattgaagttagaaggacaggtaataacaaacaaacattttgtaaaataaaaataaaagtaattaaagaatgaacagcaatcaattgagcagtcggccgtagaaactcagattcgcaatgagcaaactgcagaaccaaagtcatttggccttccggtgcttgttgatgtaaaagatttaaccccgacccatctaattgaacctcccatcgaccaaatcgcggcatctcctaatcacaaagagccgaaattaaagccaagatatcataaagtcataggagacggcgattgcttctacaggtcgttgagcttttattttatttttttgaaagaataaaattttacagagcaatatgctattcgatttttcaagttgatgaaatcgaaaactctgatgctttacgagtggcagcaagcagagcgattgaaaaaattgtgaataacaaagagatattcccgagaaaactgtatgaaactcatgcggaattcatcaaggagttagaattggcacttttggagaggccgtcaactaaggactacaaccaaagtcttagtgcctatgccaaacacatcgcaaaaccggcacgaaatggaaaaggccaatgggcccagcttgaagatgcgcgggttgcttctatccttttaaagcgcaccgttgtaattcttcatccaaatgaggaaaaggagttgcttgaagaacaaaggccaaaatatgacgatccatcgataaagaaacgcattaatgtttatttcccagacggggacacaatggttacgatttatttttaagttgagcgaattagtgaaaaattgataatttagggaaaaaatggcatgattgatgctggagaattgagcaattttacaataaaatgtgaatggtgccaagacaatcaaatgaaatgtccaagatgccaggataaggttttggaaaaagcagtagagaatccggtagtaatttggtttaatggactagaccattatgactcaattgttttcgtaagttattaatatcatttaattattattttttttcttattgtatggtcaggacggggttatgaagtttcaaaaaactatcaaaataaaaattttgcttataactttttagaaaaggaaaactaaattttaattcttgatagttaccgattgcgcttaatgttctcgggcagctgaaaaaattaatgtacatatttactttttataatttgaacatacataccacagcactgcttatttttttattttctgttataggatccaagaatgccaaatgcttcagatggtgccgaatacgtaaaagcatatattgccaaatgcacaatcatacctaaaggagagtataaaattatatttgcgatcggccactatggtatgtgatattggaattaggggagatttaaagcattagaaaggaaatacaatggtataatgtgacagacactaccaatccatagtatttgatcagaaaataaaaagtaatttaataaccagtcagagaaagtcaattaaatcatttatccttattagggtattataaaaaaatattaaaaacataaaaaagtggagtccgactgcgccaatatgtgccgccgggtgaaaacttgaagattcgggtctgatttgactatttttgtggattttaggcagaaaattaaaggaatttaagaaagagatttatgtatgacccggcatcattttaatgaaagaaaaatcagcatttcagcaaagaaagttagctttgacccccttcaaaagcagcataatcctgacttgagaatcctgggttctaattgatttatgaaaaatgaattgtgtatttgttgtttaagacggcccaaaacagtatactcttttgactgacaaagaaggcaatctcgaatgtaatttctacaaaaacatacacaacaataattttttaaaagaaaattacataagcactaaatcggcagaaaaaataacgattttggcggagaagggacccgataaacgtattataagcgaatttgttaattacgctgaaatgaagaaaacgatggatgaaactaacggacaattatgcaattcaactttcatcaattttgacgcacttacggtatgcttgaatcacggacggaaagtgacttctttgtgaaagtagggatctgtgtgagt

SEQ ID NO: 6643 - DNA, 1750 bp, Heterodera glycines
gctaaaaatgcggaaaatagtaaaaaacttttaaatttaggatgtaaaatcgtaaaattttattcaagaagtaacaaaattaagccaaatgaatattattgaaataaataatttaaaatctaaattttttgtcatgaaaataaatgaataaattttggaggcgaattttcgataaaatttttcatttattatgagggtattttcagaaatttttggagtcgattcttagggggtgaatttttcgtttttattgcatttttgttaataatttagggcaaaacgccgaaataggtgaaaatagtttttttttaattttttacgtttttaggtgctaaaaataaaaacctagaaataaatgctaatactcgaaaagtagcttaacaacaaccgaaaaaaaacatgtttttcgtgcgtttcagatcatagtgagctcaggaaaaaaataggtaaaaactaaaaatcgtagccctactcataatattttaccaaatacgaatctgtttgccccctgcataacacttccattttttattctcacaggaagcattgccggacctaccaccaaaactgacaaaatccgcataaggacagaaagaaaagctgatggggaaacagcagaaattttatttgatgagatgaagcagacttctatagtattttttattcattaactaaaacacctctctatatgttttatttataatgccattggtttattctaatttatgcaactgaaaaagaagttaggtaaacgaaattatggtgattatctgaaccatatcatatgacccagaggcaaaaacccacaaaaaatcttgtttaaaataccttccaatttgaaagttttttgcttttgcgctttagcgaaccggtgtatcgacatttgctcggcatcacttgcgacgccctacaaaacccatttgcaccgctcattcagattttaaaataatcaaaaaataaataaataattcgacgtgtctatcgttgtgtttagtttttttgcatttcttttaatttcttttatgttgctgcacagtagttttgcataaaattcgttgaaaaattggtaataatatttttttctgagcggcccaaaagtccattattgcttggcggcgcaagtgtcgtggcgcaaatgtccgcagcgcaaatttcgcgtcgcgagtgtcgcggcgcaaaaatcgcaacacggctcaaaaccccgaagaacattatatgaaaccattaaaataattgtaacttgaaacattacataatttccggtttaggttttaattatgcgctaaaagccagcgcactttccactacggcggccagtaggtgcgcgagactacgaaagaagtccgcgcgtgatttgagtggggcacattatatgtaatatatttctgctgcagcagcaggtgaatatttggtccaccgccgtaaaacacgctttttcttcgccatcgctttggatgtcgttgacatggcgaatttgtccgcgacaggagcgagcattggaaagacactttttggggcaaaatggaacaaatttggtgataatttttgttggttgatggcgttgtgtatgatcaccgctaattgataagcgggtggagagagcggcggccggcggagtatttaagcgcaacggcgagagcctggcgaggacgaaaaaggttaaagaacacttggagcatcgaatgattatcaagaagtaaaaaaaaagattgcttttttagcattttctgttccaatgaaaaattcatta

SEQ ID NO: 6644 - DNA, 2153 bp, Heterodera glycines
ccaaatcagaaccattcttataaataataacatagtaattttctaagatttgggccttccaaatcagaacatttattagaaataagacatatagaatataaataggttgcaagaattattattaaattagtaattgttaaataataaactattaaaataacaattgttaacttaaataaattgttgaaatatttttggggtcatttaattctgcgccgcaaatgtccttttggctgggcgccgcatgtgtctgcgccgcaagtgtcgctttgactgggcgccgcaagtgtctgcgccgcaaatgtcggccaatcactaaatcgactatgctctacatgatagaagtggctaaaaattgatttggacactcacagttcgcgatgtttgttctcttgttagatgatacgacccattttttaattgagtttgtgataaaggaaaatgtcgaatattttaggacaaatttgtcatttgtttgtctatgtcattgtcgttcgtgattgtgattggcgcctctcggagtcttggcataattagccacaaaatattcgttaataaaaaatttaatgatcgcctgataggtaattatggttacactcggagagtataagtttttaatggttattatacttttaaacaagatggtctgaaaaccaccaaaataataataaaaccggtcataaatcccctccgtccaggaacccttttttacatgtctgtggaaaaaattttaagcccaaatcagtttatagctttattaggagttaaaactcaaaaagatatgagatatggctccataaaattctaccataaaaatgtgtcccagtcaaaataagagcttgcgacaaataacagaatcagctgtcctattattatttattacgaacctcattaagagacagaagatatacagctgtgaggagaatcattgaggcaaatgtggaacaggtaagccattagtaccacttttttcttactctggtcaatacccatattcttggtaccaagcgaaagacaaaagtctcgagattttataaatgcaagaaaaaagcaaatgctggcattaaaaaagaaattacaatgaaaaaatacgaaattcaacttttccgagtataattttttgtctattgcctttagctaaaaataaagttatacaaaagcttctatagaccttaagcttttgttcaatatcaagaatataggtattgaccaagtaagaaaaaagttatggcctaagaaactggcatgatcattcatgggacgcataaaaccgactagaaccaaaaaacccacaaaattggcctatttagctcaaaatctgttagcaaatttggcaaaaatcctcaaatttctccggcggcgcctgttggtcaccaataaaattaatttttttttctttttcttttaaaagcgcttccaaaatggctcattaaatttgtataaaaaagctgcattcaaaaaaactataaatttctcatcatttttacacattggccatatattttccaatttcgttactctctttttccatttcttttccttccgttcccttaaaaatctctttgtctatcttttctctggccattcatctgccgactccgtggcgcaatggtagcgcgtctgactccagatcagaaggttgcgtgttcaagtcacgtcggggtcaatagctttttaatttttttttttgttgctttgtttttatttctttttaaattgcgccaaataaaagtatttacattaaaataagaattgggacataaaaaaaactttttaatattttttattgaatgaaaagacgataaatgcatttttaatttgtaaaaatttttgaaattttttcctggaaaagccaaacattttaatgaatttctcgacaaattgttgacttctcggcgtcctgtttgtattttagatgtcgaaaattggaaaaaaatcgctaaagtctactttacgaatgaatatgtttagcgaaatgacaaaaaaaaattgtgtatttttatcgacggttttctttccgtttttctatctcgggttgaacgtgtgcgtgtacagctgcagcgcctcccattcggactaaaagtgtaagggagaaaaattcggggaaaacaggattaaatttcaagatttcaataaaaatgaaataataaaaa

SEQ ID NO: 6645 - DNA, 3169 bp, Heterodera glycines
atgtcataaaaagagggaggaggggattaagagtgacaacattcggcaagcggattttacgtcgacaaggacaacaaacagcacatgaaaatgaaatgggcacggtacaaaatgatgccgtcaaatggacaatggtgaaggttgtgccaataagggcggcacggaattccgatttcagacatatttggggtcggaatcagatttttctaaatttttgggggctcgaaatgccatccctggtgccaatggatgaccggggccgcccgtctccggcggcgggtgccaaagaattatgtgccaccaatggacggtcagtcggatggacgaacccgcgtggtgacgaagccggaaaaggtccagttgatccaaccgccgatgaccagcatgggcaccatgttcagcatgttgcccttgaccatctccgtcatcgtggacgggtccagcatcttttaggaaaatgaagggataaattgaaaaaaactgcacaaaaatggtagtaattcaatggcgcggcgcctctgtcggcggcacctccccttcctttagtgcccgattttcaaactcggcaagtgcccgatttttctgacttttagaggaatggcacccctttggatcggagaaaaaaattttttaaaaattctaaaaattcttttctgttttgcccccgcccccgggctaaaccaactgtaccgggttcggctgcgtgttctgtttgtcctgccgcttgaccagctggccatgctgctcgtcacacagcagccagcgccgctgggcaaacgaatcggcgggcaaaaagcgcccattctcacgcaacagacgcgccttcagcagccaatggcttaacgaacggaaagggctggtagaaatgaaaagcgtaataatttctcaaaaaatattcatttgtaaaacattttttaaacaagaaaattcaggaaaagaatttttgaaaattttttctggcaatttttcaaaaaaaaaaaaatgcttaaaaattttttcttatggacaaaaaaacgcacctgtcccgcactgactgcaggtcagcactcttcttggtgaccagcaacaggaacacgtagtgccggacaatgccaaccaaaaaagtgattaactaaaaggaggggggggggggggagaattttgggatggaaaaacagtgcaaaattctgatcgcggagtgatcagaaactaatttgggcacgatttgtgggaaatgagactggtagaaaattttttaatgtcattttcgagccccctgacacggagcgtgcttagagaacccggatttgataaaaaaaaaacggcataaaacggccggcatttcggggcacgggcgctgaaaagtgcaaacggctccaaaaggaaggccccaaagtggtggcccgtcgacgacaaaacaaaacaaactgactgaccacaatgggcacgaacacccatgtgcggatggccgggtccagcaacaggtcggtcatgcgccattcgcccggcggaagcattttataaaaatagaaaaaatgctaaataaatttaaaaaataaattaaatagattaatttaaaaaaatataaatagattaaatttttaaaaatgtacaatttgattttgttgggacaaatcaaaatcgaattccaaatgaacaataaaatgtggtaaaatgtattattgttattatgcgaaatgcaaacggtaaaacaaaaacaaagtgataataaaagggcaataaattttttcaatttgaaaatttcacttttttttttaattttagacggcaatttcggcaaaatccaattttaagtagggaccgacgggccaatcgatgcgaatattggtaaattgggaaagcaatcacacctaattgagtaatttaggggtagagccgggcacacaattcgcttgtgatttgacgggcgggaaaatggcaaaattacaaaaaaaattttgggaaattttcgggaaatcgaacggatggacactcggaaatgacacggaaaacattttttcgtaagaatgtggcaccatttcatcattatcatcgtttcgcggcacatcgtttcggcatgatcatgcgtaatagttgcaacagcggcgccaccgggcggacaaattggtggcgtttgggtagccgagacggaaggcggcgtccgccgtcgacttgggcccgccgcccgtgcccgacgcgtccaagtggcccagctcatcgtagtgacgcttcaggtggtgggccaactcgtggaaaactgtaatttttataatttttcaaattaaaagtttttcaaaaaaaaattagaaaaattttttgtacgaattttcaaggaaaaaattgtacagcgatattatcaaaatttatggtgaattactgttttttctaaaaacagaaaaaaaaataaaccactgacaaatgagtgccgaaatgccatttggccaattaattgcccaatctctccgccaagaaaaattgcaaccgaaactcgggcgacaaaatgaatgccatagaaaaagcttgaccgaccacatttttcggtgcctatgccagtccgaccttatttgttagccccggcactccaaaatcgcttgcttttaaatgaccatttttggaaattttgagaggggggggggtgggaattttctggaaaatccgcaaattttaatgcaattttactccctctcccggccctttaaatttgtcgctttgctttaccctttcgcttacttgtgtcaatgttgacgttggtcttggaggacacctccagctgggcaagcatggcatgcgcccggcacaactgttccgcctccaactcgtccacccgccgtcggcatcggccagtaaccgcaccaccaccaccacccgccgctgctggtggtgttgaaccaccaccaccgttgtcctcttcgccgtcttcgtcatttttgccatggttgacgtcaacaccatcttcttcgaccaggtcagccttggtccctacaaaaaaattttttttgtaagttgttaagtttaagcggtttttgaagtttgaatgtgaatttttggaaaactcttcgattagctcaaccaattggactgttttaagttaacagatttgttttttttctaaattggtattaaaaaatcttttttagaaatagtaaaaaataaataaattttttggtttttttatttgaatttttttttt

SEQ ID NO: 6646 - DNA, 3163 bp, Heterodera glycines
cgcactcacatagctcaggatgatgccgttggcggaccggtagtaggactgggtgatggtgcggaaccgctcctgacccccggtgtccctgaaagacgacattttagtggccatgcggtcggagagtgatgggaaaaacggatttaaaaatgagggcttggccccctctgccctcagtttcaaaaaaaaaaattttttttatcaaaaaccgaaccataaaaattctttaaaaattttcggtttgatttcctctgactatgccctctaaacagccttaaaatttaattggtaaacattttttgattgcaattcccccggtccccgaaaaaccccgaaaattggcccaccaaatttgcaatttgatccgtttgccctccaccatcagcgttttcatggtgaaatcgacgccaattgtggtgccctgcttctcaatgtacgtgccgtttttgaagcgttggaccacgctgaaaatgggaaagggaaattaaatttttaattttcaaacttttggatttgtcccggtaaattttcgtgtcattgtttaggggttgccatgccattgcttttctcagtgccttcccatacagacaattatgttaattaattttaaaggtgatggacatttacgcttttttaccatgttttgccgacgcccatgtcgccgattaggaccacctgacaaaaaaattttttcaattttttttaaattcgagaggggctgctaggggggggggggtggaaacaacgaaggaaaatgaagtttactcaccttgaacaggtagtcgaacgagtcgtcagggtccatcggatgggtttcgtcgtcgtacacttttgacggcccaattttggcggtggcacttcagcagcagaacgacgctaaacaattgggaccattttaatgaccctaattaaacaactaattagtctttgatgaagcggccaattggcgaacacaaaaaggttttaattccttaaccggacaagaatcttggaattacccgaactttaacccacggagaattacggaatttaaagatttgggtgcggacgaaagcgattctttgaccgatattttacaaattatgaaaacaatacattttgggattggtaattaaattttcaaattaattaattactcctatgaataaatcaattaattaattaattgccgacgaaagccccttgaggggacgaaaagcaacaaattacattggatgaatggcattattaatgccaaatatacgctaattgtaagtgtctgtcccctcatttggcaaacgacgcaacaaatggccatcgttttgcgccatttccatcttttgtgtccctcggcgcaattggacattttcccccggtggcattcgtaaaaaatataaataataatatttccgttttctcaccagcagcagaggaaaaatgaggaggtgggggaagggagagggaaggcatttttgacaatttgaattggcaccaccgctcaatttttaatgcatgagagagagagagagagggtgagagagaatgggtaaagagagaggggagagagagagagagaggggggagaaaaaagagagaaaaagatagagatgagaaatagaggaaaaaagaaaggagaaaacattttatggctcaaaccaaaaaaaaaatttgaaaaaattccaatgaaaaacattttctatgggtttaatcgtcgccaaattggcaaacgttcccaaaagtttcaacaaaatgaccgaacatttgatggaaaaaaacgtataaatttttctaaattgccaaaaaatcacaggtttttcaattatattatttccccactttcacaacgcaccaccagcagacagcagcagcaacagcagcgcagagcgtacgacaacggcgacagatgagcaaaaagagagagagagaaaaaaaaagcttaatggaaaataaaactgtgaaaacatttacaaaataaaaaatggtaaatgattgcaataaaacgggttttaaaaacccaaaaaataaaaaacaattagaaaatttgatttttaatttgctataaatgattttgaaaatgggaacaatgaaaaccaaacaaaacaaaaacgaacataaattaaattaaataaaaaggcatatgtaagaaacagaacaaaaaaacaacagaaaccatcgatgagtgacaaattttccaaaatgatcggtttgatcaatggcattttaggtaaattattgattgatcagtcggtccacgcgcgggccgcgcgcaacgcgtcccacgcgacgcgcgcgtagcgtttcgcctccgcgccgacgtccgccgcgccggtgatgccccggccgaccaccacaatgtcgcacgcgtcacgcgccaccgcttccgcgggcgtacgccagcgttggccgagtccgtcgcccggggcgccgctgagattgacgcctttggtggaggggggggggggaattaaattaacaaaataaaacttattttaaaaaaatgattgactggaattttaaatttgaaaaaaaattttttttttttaattaaattggattttttctgagttttcttttttagttactattaaaatttaacattttgagattagcctggacctggattccatgttggacctagactttctggacaaaaatccaaggcgaatccaagtccaggttgccaaaaaatggcatggacctttacctagaaaaaaactcaggcctggatcgaggccaagtggagttctagctatcgtttttctaaaaaaaattgggtccttattttttagttaatttgatgcatttggttgccatttacccaaaaagggatgtgcaaatgtaagataccgtatatccggtatttgaaggcccccccttggtagaaggcccccctctaatttaaggcccctttttgtaggggttgaacaatagaaggcccccctctggtagaaggccccctccaattaaaggcccctttttggaggggttgaaaatagaaggcccccctctaattaaaggcccctaaaaaagacttcatggggcgatcaattttattaaaaaagaaaataaatttgatcaaaatattattcattagcaacgtcgacagagacatcgctttcatcttgtcctaaatcaatttgttcaagtgctttcacaacattttcttcattgcgacgttggctca

SEQ ID NO: 6647 - DNA, 1296 bp, Heterodera glycines
gcattccaatcgccggaactcaattctccggcgttccaattacttagactcaaactcaacaatccttcggcattccattcactgggacttatcgcaccaattaaccagccgattccatgcaaataaatgactgcccgtcacacggatgaccatggcattgatgagttgaacgtattcaactagcttgttgagatggactgatcactgatcagcggactgatggatgaggacactctttttaaggggggagatgttgagaagggtatgatttatcccgtttattttattttcctttctatctctgcctcccactctctctctctctctgttgcccgtccataaatacccacgtcctttgaccatccgttcattccctcatttatttgttgtttatgtcccttctccctcaatcgttattcgcccccatttctcttcttttatttaattgtttcttcgcctaaattggaataaagtatttattctttggtcaagtgcaaggcacaacagttatctacatttttctactaaatttttaataagggtcgtagaatccgaatatggccttaaatttgtcctatcttttgaaccagagcttgtactgcttcaacttcgtgcatgaagttctagctgtacaggctcattgagaacccagagctcaaatctaaggccatattcggactcagtgtgcatgaattaaccaaaattatgtaaattcagtgttttcaatggcattgtcgctaatttttggatttccttttttaattttttaaagtattgcttcatcttttttaatttgtcatcgttggaataattattttgtgcttaataataaaaatttaaaataatacaaaacaaattctcttacttttattataatttggcagcaattcttttttccatctcgtaaatgtcttttcattaatgccaaattccgtcacaaattctttctcttcgcctaggcaatgtaaatttttaaattcaccaaattgttctatgaattcgcgcattttcatgttataaaaattcgtttctttatttttatttaaatttaattcttttaccgggaaccgcccagttcggcgccgaccgtttcggcgccgttgctaacaatttctctcattatcaacctaattaaatatttttgggtatcttctgagagcttttaaggttctctattagcctacaccccaaatgattggctttttgtaaattttaaattaatatattttttggtagatttttgttctatttattgtattttctcatatgcgtgtctagtgggttgtacttttgcgg

SEQ ID NO: 6648 - DNA, 2563 bp, Heterodera glycines
tatcgtatgatacgatgattattgcatttggttgataaagaaacaagttataggtcgaaactcggcccacgcgaagacgacgccgacgcgcacttttgtttatgttattcatttttgcgttggatcagttccccttcaagtagttattttttcttctaattttcaaaattattcttttttcggtgagaattcaatcacaattttaacaattaaaattataaaatattgttatttttgggctaaatttgttcacaaagtgcacaaaaaagttaaattcccggcggcgcctatcagcaccgcctgcacccaaaattcctattttctttttaaaaattggctcaaaaccgcaaaaattttggacatttttggataaaatctgttaaaaaattgcactcaaatttaaaaaattttcccggtggcgcctatcggcaccgtcagacccctgttcccgaaaagttttttgaaaaaagagcaccacaaaaaaatggtgtaaaaaagtcaatcatatgaaaatgaagaatggatggtagcctaaaaaaggaaagaagcaaaaaaattgtgagaaaaaacctcaaaagattgatttttaatcgaattataagtttgtaagaaaattttttggaaaagtctcggtctcgagtctcgactcgagagaagtctcgggttttttgggtctcggtctcggtatcaagtctcgggatcaagtctcggaatcggtctcgagtctcggggtcaagtctcggtctcgagtctcgggaaattttcggtctcgaacatcactagtattttgtgcctatttcaccctttacgaagaattttccaaaattaatctattttgggctttttgcacatattatatttcgtgattataattttttttacatatatttggaatttagttgaattttttcataaaatatgtgcaaaagttgctttctggtgctgatttgtccagcgcttagtatccccattttgttaacgaatccgaatttccaattaaaaatacacccgcactaaaggattaaccttgtgccatgaaggttaattaactaatgaaatgaaaaaaataaaataaaaatttcaataattagttaaattattttctgtcaaaaaattatgactccgatttggataaatgcgtattgagtgagcacccatcgatgcgaaaaaatgcggcagaaatttaaaaaaaaattaattaggtgaaaattttttaaatttgttccaatttaattgggtcatacacatgcgcgcacctgcaatgaaaacattcatggagctaaatttaattccaacacctagaaactggaaagaaattttttagggagattttattgtatttttgcttgtgcctattcgtaaaaaatccatggaaaatgcttcattgaatcagaatttcttgaaaaactagaacggtagtatgataatttttcaaattttaagcgtgacttataaagaaactaaaaaatttttttattttatatgattatggtaatttttcaaactttaatacttcagggctttattttaaaaatattgaaaaatgattaattttccgggaagcctaaaccaaagttcttttcaagtacgtaatatgctttatttctaagcaaattaatgaaattttttaaaatttatgtaaaatgcccaaagactttctcacagttaattataatagaaaaacatatgaatgtataaacaatttactttacccattttgtacgctataaaaatcacattttcgaaatataagcaaatttctttttccatctgatcaatgttcgtgcggtaatttgaataaattttttaaaataattagtggataataaaaaagatgaatgtgaaatgaattcacaatatgaaaaattttaggatttttttctattttagcaactacaatccaattattataatcgacatatttcataaattacagagttgaaattaatgcaaatttctttttccatctgcgcaaagtttcacttccaattcccaatttcccagcaattattacgtcgctaatttttggatttcgttctttaagtttaaaatattgcttcatctttctcaacttgtccttattggaatagttcttttgtactataagtacaaaatttaattaattttctaaaaatttcacttacttttccgataatttggcgccaattcttttttccattttaaaaatgtgtctttggaaatgcccaattccttcgcaaattctttctgtttgcgttggccatataaacttttaaattcatcaaatcgttcaatgaattcattctttttcccctcataaaaactctttttcttcgttttatttagatttaattcttttttccatttgtatattttttggcgattttggcctaataattttgcaattttacattcaattttgttattgtttttccattcatattttcctttttgcttcaacctttctttaattgcttcaaatttttgaattgtttctcttttttgttgatcagttggaccatttccattttctccatccaattgatcaacaaaatgaatattttcattttgcccattatgttca

SEQ ID NO: 6649 - DNA, 2782 bp, Heterodera glycines
  misc_feature (885)..(885): n is a, c, g, or t
  misc_feature (892)..(892): n is a, c, g, or t
  misc_feature (955)..(955): n is a, c, g, or t
  misc_feature (957)..(957): n is a, c, g, or t
  misc_feature (968)..(968): n is a, c, g, or t
aaatttcgaaaatcccaaccctttgccagcagttggcccatttcttcgccggtgttttcctcggcgcccgcgtaaaccatggacaaagtgacggcgacagaaaacggcgaaacaacgcacgaacggtcgtcggtggacacctcacgcagcaaattcaacgcaaaatcggcctgtgcctccaaaatgagcgcggcatttggtgttgggggagaagacataattggcggatgagaggcaatttgaaggaaatcgaagagattaagacgaaaatgagataaacgctaaaaataaataaataaatataaacaatatcagagagcacaaaacccatacactttactcgagtggggaggggtcgtttcggcgccagaacaatgttttttggactatagcttttttgattgttcaacaattgtagtatcattcaaaagcttatcttgtttggaagctctttctatgttaatgcttagcgattagataattagcaaaaaagttataacatgaaaattgacaaaaagtagaaaatattaagttttttcttaatggttgctagaaaatttatactttttgtaatagaacgtgtgaaaggtttaggaatgataccaagattgttttggtttggtcgaaaaaaaaattataacccaaaaactttggctggcgccgaaacgacccagtcactttttttacggcgcgcttttttgaaaactttttgggaacattgggccgataggtgggtacactaatgcagtttgggtcccattttggccagaaattttcaaatgtttttttttttgttttttattatcagaattgctttaaatgacaaataaaaggtgctttatgttttatggggtacattcagcgatttgtgacacaaattataanaaatatncggtcctcgaattgcttacgccacaaaaatccgaaatatttccaccgtcgcacctgctgcgcntnaacttatcatntaataaaacatttgcaaacaaacaaaaaaccgattttgattggatttctgctgtaaaattctgatgtcacatctctcatgaagtttttccaatcggtcactgtatcacttcccaatatcatttgaaacataatttgatcatttgcaaatttgtgggcccagtagtacgaaaatttaaaaaccttaatataaaattgattcatgtaaatttggccttttagaaaaacttgtttaggcgaaagatgtgctccttcaaaaaaagtgccggtgaaatatccagcagttggccgtttgccgtcgtgattcttcctcgaatagcatatccaaagtggttgttgtcgatcttgcttccatttgtagctcatttcattgccacagtcgcaaaaacgggtggtgtgtagaagcttaagttctttgagccattcttcgaattctttgtcttgaagagccaatactttgaataaatcgtcaagagtgaaatttttaagcgtttccattaatctaaaagcatttctgataataaaaaagaaaaaaaatttgaaaatttctggccaaaaaaggggacccaaacccaattagtaccacaaaatgcttatttccaaataaaaaattgctcaaattgatcatggaaataaaaaaaaataatatttgaacattttaaatgtgttttgaataaattttgtaaaaatgaggctttttgacccaaaatgaggcttttgcctgccaaatgaggcttttgaaaattttgatctgggagccctggttttgagccgttctaattcggtcccaaccgtctgagcggtttcgagtttggggagtcagattaattcttccaaaagtttttttaatttttaatatttttttatttctgccaactctttcgctgtttcgtccgtcactcattccccccccccctccccgctatttttgtctctaacaaattttatgtaaccaggcaattttcttcatctcacacaaagcgttcatttttatttccccaaaaattcgtgcgttttcaaatattcctcctttaactctctgctatttctttgtgctctccattctttcatcatttgttttacgcttttgtccaatgagagaatgtccctcatcccttcattttccggcattcccctggaattcgtgcgcttccttcaatttctctattttattttattcactctttccctatttctttggttagccatactattttcttcttttccatttctttcccctttttcttccaatggatgaaattccctctcccttcctcattgcctctttttccctggaattcgtgcgctctccatggtttctccatttactttctttctctgcaacatcaaattgcacaactattttctctttttcctatttctttcccactttttcttccattgttttccaatggacagacagccccttgccccgcttaattgtgttccttccgccacagccgcgccctttcgcaaatggcagggaattcgtgcgtccttaaacaatttttccccccaccattgcgagacggtccccgtcggcttgtacttatataaagcgcctgtgtaggcctcatccctcggaattcgtgcgtttcccactatttcctcgtgtctcccaatgtctgccaccgctaaactcttctcagcccattttacacaaatgcattgaaggacggtcccctaaagccagcagcagcggctaaaagccccatttgtgtgtggtgtgttgaaaatagcgcgcgctttgtgcgactagagtgcggaggcggtggaagagaaaaaaagcgcacaggcgcgcgcacacgcgtgcgcg

SEQ ID NO: 6650 - DNA, 1439 bp, Heterodera glycines
tattgtggtcgggtcgtaaatgcccggcatgcgcatcaccggacggttcaagtagctgaaacagcacacaatttaggaaaaaacaagatataggaaatgtaaaaagacttttttgaaaagccaattaaaccgcaaaaaactcgagttaaaaagaaaatttggaaaaaaccgtagtactttcatgaaaaaaatgaaattgatgtataatttattttaagcagccccgaaaataaactaacattttcaattttttttttaaatttttgagagaagaatgcaaatttttttaatgtatattcatgaaattttattcaacggggtttttggggttcccgatcacgaatctgtcaactattctgaccaattcccttttcctaacctaaatttgaacaaaaaaaatcataaatcgaaaaattcaaagttcgatttttgttcgggttcgggattagaaattggtcaaaataaatgtcaaattcgtgatcagcgacccttaaaaccccggagaaccaattttaacggttctttatcacaaaaaattttttgcaaaacaaaagggtccctcccccctattgtttttgataaaattcaaaaaggaccttcttttaagtagtgccggcccgtgcccccagaaaaattcggtgcaattttatgggttttttcatgaaaaattccgtgtgcaaaaatttgtgtgccttgcattttttcgatttgcccaaaattgtgcacaatttgcgcttttttcaattttaaaaagcataaaaatgaatcttacgtaaaatttaatgcagttttatgctatttaaaatgtaaaaaaaaatgaatttaaaccaattttggggtatttgagcaaaaacacggtaggacacaaaaaagtcgggtaaaactcccaacaaaacaaaccgcatgacgtggtagatgagcaacggcaaattccaaacgatggcgaacagttgcatggagagcaggaagaagaagaaaatgaacgagtggatgctgtactcgggcaaaatcagctaaaattgggaaaatggaaatttttggaaaaatggcaaaaaaagtttttttaaacgaaaatttccgcatttttcccttgaaaacaacatgccgtttttggcttggaggggtacctcccccgggcgaagaccttttttttgttgaatttcacaccctcttttttgcggctattaaaaaaaaaattgggagaaaaataggagttaatgccataattttttaacagaacttggtactttctttttttgctaccgcccaccgctcgaaaaattttaaattttcaaaaaatcataggcattttgttaaatcaatgaccagatttcatcaactattataaaaaagaaagaccattttcgtggtcaacgacattgaaaactcacaagatatgaaatttttaaatttttcgtgggaggggggggggggggggg

SEQ ID NO: 6651 - DNA, 3886 bp, Heterodera glycines
atcgggttcttgtagtccgttttcagctcgtcaatgcaaatcacctaaaagcatcaaaatttcaaatatcttttaaaaatggtcgtttggcattttgggagtgcgttgcccacccaatttcgacccatcgccctaaccctgacatacattcgaagaaaatttttgaaaattgcaatgttttcccattatctgttgattatttgctgtggataatatgcctttattagccgtgtgaacccaaaaggcatgggaagaaaacgttgtgttttgcgcttcttaaacatggggttggtggaaaacccggaccgcatttacctatatttttaaatttgcagttaaaaaagaaacaacattttttgatgcattaccaaaattaagtattggtttttaatgcggatttatatgctatctaagattgagaaaactgaaatttttgaagcccattttgggataggcgcaaacattgggaacggcttggcataagccattaatatgcctttttataaatatttttaggctatttttcagttttggggaagcttttatcgagcaaagtttcaaaaatttctttaagttatgagaaaaaagtggaaaaaagcaatttttcaagcttttagccgtattttttcgaacttaacaaaaatttttgctttttaatgcttatagggaacaattaggacaaaatgatggtctttttaccgtataaatggcgaaaaatacgcaaaaggcgacggcgatcagtgcaaacaaatagcagaaagcggcaaatgtaaatgccattttgttgggcgcaaagcgtactcaaataaagcaaaatcaaaaaaaaaaattcttgtttataataaattataatcaatcgatcacaaataaatttttatgcaaaaaaataaagataaggaattctaaggcaaggacttatgacccttggctatggtggggggggggactgaattcaaaaattcgatttttgatagcactaagaatcctctattagcatgcaaaatttcaaaaaaaaatcgttgggtttcaaaaaatttatggccacaaaatttcaaaaagttagttttctaaacattttggccataaattttttgaaattttgcaggctaatggaggattcttagggctatcgaaggtgccctgacatttgcggtccgacttttgcggaacaaatcccgcccatttgaattggatcaagaagcgaacttaaaaatacaaagaaaaacgtggaaagtatcagatcgagatcaaaaattttgcgctatgaagtgcttggaaatctgtgatatatagtcaaaaaattggcatatgcaaaatttaaagaaaatctgtgcaaaaggaaacatttttcagcatatcaaacattttaatttttttttaagaaaatttaattattattttttattgtcaaatcaaacgaaaccttaaaaatatatatatgtatataaaaaattaatcgaaattgacaaatacctaacttagtgggacaaaatttttcggcccctcccattgggaaaaaatatatttttgaaattgacaaaaaaaatgaacaaaaaattagatgtgaccaaaatcgttgtcctctccgattcttaaaatataattttaaaaaataaatataaaaaattaaaagaaattgataaaagaaaataattggctaaattcttctcttttttccatagcaaagaaaaggtttatcaaaattagcaatgaaaaagacttacaataaatggccattttttttatcaaaatctatttaaaatttcaaataaacttttaaaggaatacattgatgaataaatttgataccaaattcgtaataaagcagtttaatataaatgaattaattataataaaaatcttaccagacgtgacaatttttgcgttttggaaaactagcaactttttgtttttttcaatgaaaaaatgggggtggattatcagtagaattatggccaattggggtggatgatcagtagaattatggccaattggggtggatgatcagtaaaattatggccaatgggtggcggccgttaggagaggataatttttttgcctctttctctcgcttttatacaattttcacctctcctctgttactactgcttctttaaaccctgacttttcccgtaggataaatagtgatttatccttttatttattatttttcatgacgattgttttagcgtaatttccctatttaaatattctttgttgtcaattttaccttttttatgtttgtctcttcattcgaaaattgtattcgaattatatatcaatgtttttatgttttcattttatattgaaatattgaattcattatttatgttttatgaaattctcctttaatttcctgataaattccccaactttgattacccttaactttaaagctgccgttacaaaaacgagcagctaatatttgactaaaactaaagtggtgctgaattggaattatcccctcaaatccaatccccaactctgatttccaattccctccccacaataaattccgcttttctccaacgttccaaattgagctgattttctacttttttaaatgcgtatagaaaggcctatatacaactgtagcgatttatatattcatcatcagtcagtcattcatttcatttctttacattttaaaaatattttttccaactctcaaaactcattcggataaaatgatgataattttatcaaccaaactgctcacaatgtccgttctgctgcttccaattttgcttggcaatgcaaatgccgctggcattggcgaccgacaaaaaagggcggtggaggaggaagaacaaagaattgtgagcgaactgtgtgccaccccacccatgcacagaagttcaaggagttattcaatgctgaaaatggaagtgctgaaaaagaagttttatggatggaaaacattgaaatgaaagcggacaaagaggaggaaaaggaacagcagaaaaaaaatgaaaagcaggaggaaagggaaaagcgggaagagaaagcggcggaagttacaatggatgccaaaaatgaagcatcgcttagcactttgttgagaaatttaactcattcttaccacttcggcttttgtctgtcctcctttaggttgacgaaaatgctgttttggaatatggaaaaaaaattacaaccctagcaaaaaaatttatttccgacaaagttccaaaaatttatccttaaataattcaccagagtttggtaaataaccatttaaaaaaatgaaaactaaaaattttaaacatgaacctgaaaatatctcaataatacatttaaccattaacaaatatattaattagttcgaaataattgcaatcatttttgttgaaataaagaaaaaaattactaatattaattattcgttcttaaaaaatggtcatttttggtttacagttcatgtttttcttccaatcggattcagtttgcacaccgaaccgtcgaatggcattttttggatcggaggacaaacggaattcgacggttggtcaaacttaagggaattaaatttgataaagctgagttatccatttcgaaaacaattctttaaaatgtttcttttcagtaactcactccaacaacctactaatttctttgcaaaatttaatctatccaaaatgaaaatgaactaaactagggcctgggaaaatcctgtacaaaattttgtcctatccaggctataataatgcatagccctaataataatttaaaatttatacttgagtttaataaaataataaaaaatggaaaaatattttttattttcaaaaagtacaaaaagcaaagcaacaattatcataaagaaaaaaaactaacaatggaaccaaattttatctcattaatcctttaatcctcatttaattcttct

SEQ ID NO: 6652 - DNA, 1032 bp, Heterodera glycines
  misc_feature (290)..(292): n is a, c, g, or t
  misc_feature (299)..(301): n is a, c, g, or t
  misc_feature (303)..(304): n is a, c, g, or t
  misc_feature (307)..(308): n is a, c, g, or t
  misc_feature (313)..(313): n is a, c, g, or t
  misc_feature (318)..(319): n is a, c, g, or t
  misc_feature (323)..(324): n is a, c, g, or t
  misc_feature (340)..(340): n is a, c, g, or t
  misc_feature (342)..(346): n is a, c, g, or t
  misc_feature (353)..(353): n is a, c, g, or t
  misc_feature (355)..(355): n is a, c, g, or t
  misc_feature (382)..(385): n is a, c, g, or t
  misc_feature (387)..(387): n is a, c, g, or t
  misc_feature (390)..(393): n is a, c, g, or t
  misc_feature (401)..(403): n is a, c, g, or t
  misc_feature (407)..(407): n is a, c, g, or t
  misc_feature (410)..(410): n is a, c, g, or t
  misc_feature (412)..(414): n is a, c, g, or t
  misc_feature (417)..(417): n is a, c, g, or t
  misc_feature (420)..(421): n is a, c, g, or t
  misc_feature (423)..(426): n is a, c, g, or t
  misc_feature (440)..(440): n is a, c, g, or t
  misc_feature (447)..(447): n is a, c, g, or t
  misc_feature (454)..(454): n is a, c, g, or t
  misc_feature (460)..(461): n is a, c, g, or t
  misc_feature (464)..(464): n is a, c, g, or t
  misc_feature (467)..(467): n is a, c, g, or t
  misc_feature (472)..(473): n is a, c, g, or t
  misc_feature (496)..(496): n is a, c, g, or t
  misc_feature (501)..(501): n is a, c, g, or t
  misc_feature (509)..(510): n is a, c, g, or t
  misc_feature (514)..(514): n is a, c, g, or t
  misc_feature (530)..(530): n is a, c, g, or t
  misc_feature (533)..(533): n is a, c, g, or t
  misc_feature (535)..(535): n is a, c, g, or t
  misc_feature (537)..(537): n is a, c, g, or t
  misc_feature (540)..(540): n is a, c, g, or t
  misc_feature (544)..(544): n is a, c, g, or t
  misc_feature (546)..(546): n is a, c, g, or t
  misc_feature (550)..(552): n is a, c, g, or t
  misc_feature (556)..(557): n is a, c, g, or t
  misc_feature (560)..(560): n is a, c, g, or t
  misc_feature (562)..(562): n is a, c, g, or t
  misc_feature (566)..(566): n is a, c, g, or t
  misc_feature (569)..(569): n is a, c, g, or t
  misc_feature (572)..(572): n is a, c, g, or t
  misc_feature (574)..(579): n is a, c, g, or t
  misc_feature (583)..(583): n is a, c, g, or t
  misc_feature (587)..(587): n is a, c, g, or t
  misc_feature (602)..(602): n is a, c, g, or t
  misc_feature (605)..(605): n is a, c, g, or t
ggcttaacggttttttcaaataaagaaaaacaggagccagactggggcctgggaaaatcctgtacaaaattgtgtcctatcaaggctctaataatgcatagccctaataataatttaaaatttgtacttgagtttttaaataaataataaaataataaaaaatggaaaaatatttcttattttcaaaaagtacaaaaagcaaatacatcccctatgtgcaaatccatgatgacgtttttggacactgtaattacgcattacggttcaacctttttgagttgaactatagnnntcagagnnngnnttnntttanttttnncatnncgtttggtggcgggcngnnnnntagtttngngcccctgcgctccttcgttttgttctnnnncncgnnnntgggttcnnntggnggngnnntcntgnncnnnnttctgtgtgtccgngttgcgngtgcttngtcccnntcntgngtttnnctgtgtttttgcgttttgcttcnctctncgtttgcnnctgntgttttgtttcctcgngtntntnttntctntntgtnnngccnntcngngttntcntgntnnnnnntcgngcgntggggcgggatgttnttncctctttaatgttcatttgattcttttccaaatttctcttccaattgaatggtccattgattaattttcaatatttttgcatttttgctttctccgtcgttctttcacccattctaaatcatttcttccttctcataattattctacgattaactccaattttcatacagatttatacatattttttcatccattcttttgttgaatactttctcccctttttaaaattttctcttttggtttatagattttcgtaacaatttctcgcattttctgatcattttctttttctctttccaaattttcttctttttcttcccatttttctccaaatatttcgtcaaattcattttgttccgcttttttcttttccgctccaatttcaatttgaataattaaaaataatgcaattgaaaagaataatatg

SEQ ID NO: 6653 - DNA, 1582 bp, Heterodera glycines
  misc_feature (29)..(29): n is a, c, g, or t
atattgacattatgccaatttaaaataanagaaatgaaatcattttattcgtttcacacacatattttagttgtagtccttaattttgaacctatcaacgtccaaaataatcgcttttataaaaattattgatggaaattgtttttgttgaaaaaatgactaaatttatatgaaaaatttaattcaacgataaaaaaaaaagaaaataaaacaaccggcaaaattttctcaatgattaaaaatatgtttgaaaaacacttaaaaggagcttaattcccctttatcattcagtaagaagttcttttccaaaagctctgatgaatttaaactagagtagtgcggaaattttggacaattcctggactgggatttgccgggagtagagaagctgggacagggacggaaaactcgattttcgtacgggacgagaaccggagcaaaccgggaattttcccaataaaaatttaaaaatattaatatttagttgtttgaatctttcaataaaattttctttacgccaatttcattcacaatttttcactcaaatcataccccatatctttccagtgctgaaagtaattttaggtgttttttctccctaaattattatttcttatcaaagccattttcggaggttttgaggacccataaaaaatatttgtaatgggcgaaaacggctaagatctgaggctttagcctcattttgtggtgttttgataggtcaatgaggctaaattttaaaaatgaggctttgagactttttgtggttttttgaggatttttgaggcttttggggaaaaaacgaaaatctggcccaaattttccaaaaaaatttgttaaatttttcataaaataaccaattttttccaaagttcacaaaattaagaatttttttcaatgaaaatctgctaaaaatatggtcaaaattcttaatttttcccccgcggcgcctatcggcaccgccggccccccttgccctgtccccaaaagttttttggaataagcgtgttttgaataaagttgtaaaaatgaggttttttgactcaaaatgaggcttttgaaacttttaatctgggagcctttttttttgcattttaattttgattcataatttttcagttgaataaatgcaattatttcaaacgtaatagtaatttttcataatttttaagaaataagaaaatttttaaaaaaagtaattcccctccaagtagttgtttttcttctaatttttcaaaattattcatttttcggtgggaattcaatcataattttaacaattaaattcgtaaaatattgttatttttggactaaatcagttaacaaattgcacttaaattttttgttttgtgcgtttttgaaatgataaatattgtaccaattgaatcaaaattaaaaaaaaccaaaaattagttaagaatagagtcaaaaaatgtttttaacgatttttaagcgaataggaaaattttttgaaaaaagtctcgagtctcgggttttttgggtctcggtctcggggttttcggtctcagtctcgggtctcggagtcgagtctcggtctcgagtctcgggaaatttttggtct

SEQ ID NO: 6654 - DNA, 2348 bp, Heterodera glycines
ataattttggcatcattttaaagtcctatatgtttagaagctgttgataagctatttataagcgattgaaatccctataaaaaagtcgcaacattaatactgcacaaaggttagaatttttgcatattttaatttataacttttttacatgtcagtatatctttgtgatttttgggaagctgatagagcttgttaagagctttcgaatgatatggatttggtcagtaaagaaaaaagttatgatgctctaaacttggctcagactataacggcagactatagtgtcccagtccgaagttaagggactaagcccctgtcccggtactttcaattttttgtggtttaaacgggttcaattttgagtctgggagctcagaacaatgtttaccaaaacattatttattgccaaagaaagaaagataattaatttgttcatgtccagcaacagcaatacataatataagtaagaaataatgagatcgaaaaagcaagaaaatgcatcaaatttaacttttctatggcgtaaaattatatggaaaaacaatttttttttttccccgtagactgtgggaggttatgaaaagcacgaacctagagcagggaattttgaaaaaatcgggattgggattggcaccaggccgggataggattactgggatatgcaaatcacccgcgttatgccgagatttgaattcagactccggcattcaaattccgattttgttgagatcccgatttccggttgtcattttagtgccgagatcccccggcctagaactgggaatttttccagcgataagcgccgtatagaaaaattctaagaatttttaatgaattctttaagaaaataccgtagttggccatttttttccttttaccaagtaatgaatttcaagaaatttttttgaaaatttttcccctccacaatgtccatcataatttttatggccatatttcacgcacttttatatcacatataattttacgcccttgtcatcatcatatgtaaattaattaatttttgatgcttgccaatttcgccgcacactcaaaaaaaatgtctgtcaatttttgttttttttggcttttccctcatcaatttttccgtggcttttgctttcaaagatgcgcaattgatgagctggtgtaggaactttgtctgctccggctgttgttgctagcagagattgtgccaatgctcagcctgttcacctgcattttttttttttttgaggaggaggaggcgatgtaaaattttaaaatattttcaataaaagagtcgattgatatgccaaaaagatgttttatgcattcaattgagttcggcattttgaaaaaagcctgaacttggacattggacctggttttcctggacaaaaacaaccaggtccatgaaaaatccaggcttgtcatggattggatcgagcgaggcgcctggattttttggaaaggcgggaggggagaacgagctctgctcctcgccctccgattcacctgcgcaccaccaccaccaccaccaccaaacatgtccgcactgtcctcctcctgcttgtgctggttgccgacaatggttgttgccgattgtcgtcgacgacgtcccgtcatggcggcaccggcacaaccaccatcaaagtgattgaaaggtaacggcaaaatgcttgttgtgactgtgccaccaccaccacaatcaccatcagcagttgcggtaacgacagtagctgctgtcttcggagaatggtcgtctactgtagctgttgtgtctaccgtattcccaaccaccaacaccaaactgttactggtgttgttgttaccgcaagcatttgcagctgttgctgtgccaccaccaccaccaccaccaccaaaaccaccaccaccaccacagcttggacccattgaaaatgtgccggccgtactcattgatggacgctgctgtgccgtcagcatatatttgatgcgcttaaatgattattttttcaaacactaaaccagcagcgattttcgcggcattttgggttgatgccatgtctcattttgtaaacctacttgatcagtgatttgctggtatccaaaaaattagtggtctccgagattttattgttacggtgtttttgaaattatggtaaattttttttaaattagttagttatttaggtccaaaaatatgtaagaccttgtttttaaatttttggaaaaagtgtttaaattcgaatgaaaattaattatttgagaggataaaaaaaaaattcgcattccgttttttgaggttttgatgtatgtatgttgagggggtgcactattttgccatgcccgtgtccacaaaaaattctcggggcggacactcggttttt

SEQ ID NO: 6655 - DNA, 1807 bp, Heterodera glycines
  misc_feature (1797)..(1797): n is a, c, g, or t
gaaaatcttcttgaaattttctttaaaaaaatttttttaaaagaaacggtggcgaggggggggggaggggtgagtggagaggaacagcataactgctccaatttgttggttgatcatgtgcatcacctgcatcacgttgccgcgtgagaagatgaacaggtacagggcataggcgggcacggacgcgcaggagagcaagcggaacagccagccaagccacacggaccatgcgggatatgtgtagttggggatttgcatgggcgaaaacgaggtggagtacagtgccaacacgaagatgatgccgatgaacaactgagaaaaatttgaaattaaaaaatttcgcggatttctccaaaattaaatttttttttgttggtctagcatatatttcagtcaaaaaatttttaatttttaaattgatcagtacaaatcttaaaaaaaaataaatacaggaagcatgccaattcccaacaaattgcacatttttttttctcgtattttcatcgaaaaatttcgttgggcaaccggaaattggaattccgagctcaaaaagaaaaccggatttcgacatatccctgctggtgtgtatatggcttcaactatagagatttaaaaaaaaaacttgaagatagtttactaattttccaaaaaatcgctgaaaactttttcaagaatttttttctagaaattctttaaaagttttttttaattccatctttcgagggggggggggggaggggtaagaaccagtgaggtggaaacccctatttccaagccaaaatcttgggcagcctgtctatggccaaaatctagaaaattttgctaaaaatcgcaattctgacataacaaaaaaaaattttgtgctaattttactgggcacagtgtccaacagcagcgccaatagaggcccgggtagaagccgagcatcgagtggatgtcctgaaattttgtaaaattttttaaaaaaaaattagtgaaaaattgttttttcatttttctttttcttgcctcgctgaaccgccgaataccgtagaaccaacagacggcaatcatttcgcacattacgatgaacagcacggacagtgacacaccgtactcgtccaggaacggtatcacataggagccaccctaatgaggggggggggggagaagaattatttgtggaaaaaaaatttaaaaaaaaaaattttgtatataaattaaatgggcaaaattgtaaaaaaatatataataataattaagaaattaattcagaaaataaaacttcgtaaaaaaattaacttaagaaaaagaatatctatgtaaaccaattaattttcttcgaaaaattatgtgaaatcgaaaaaattagtctaaaccatttaattttaaaaaataataaaatttttgagcgaaaaatttaaaataaaaatattttttcctagaaattgtctagcctaaaacggcataaaattcgatgatttaaaaaaatagctaaaatagaaaaacaaatttttatgaaaattaaagcaagaaataaatggcctattaaaattaaattgaaaaatttaacaaaaaaatgaataaatatttattggaaaactaaacattttccaacacatctaaaaataatagcaaaattttcattgttttttttttacgtaagttgtggccggcaatgagccaacgtaatgaacggcgatgacgcatgcgacaaaaatttcgcgccgacgtgccaacagtcgcgggtactcgtcgcagaagccggtgatgaatgcttcgatgcagggaaactgggggaacattatgaacacacantatatgcaaa

SEQ ID NO: 6656 - DNA, 964 bp, Heterodera glycines
  misc_feature (948)..(949): n is a, c, g, or t
cagggaaatttactttgaaaattttcttaaaatttttcaaacaaatttttcgacggcggttaaagaaatgttcgaattttcttaaaatttttcaaacaaatttttcgacggcgattaaagaaatgttcgaattttcttaaaatttttcaaacaaatttttcgacggcggttaaagaaatgttcgaattttcttaaaatttttcaaacaaatttttcgacggcgattaaataaatgttcgaattttcttaaaatttttcaaacaaatttttcgacggcgattaaataaatgttcgaattttcttaaaatttttcaaacaaatttttcgacggcgattaaataaatgttcgaattttcttaaaatttttcaaacaaatttttcgacggcgattaaagaaatgttcgaattttcttaaaatttttcaaacaaatttttcgacggcgattaaagaaatgttcgaattttcttaaaatttttcaaacaaatttttcgacggcgattaaagaaatgttcgaattttcttaaaatttttcaaacaaatttttcgacggcggttaaagaaatgttcgaattttcttaaaatttttcaaacaaatttttcgacggcgattaaataaatgttcgaattttcttaaaatttttcaaacaaatttttcgacggcgattaaagaaatgttcgaattttcttaaaatttttcaaacaaatttttcgacggcgattaaataaatgttcgaattttcttaaaatttttcaaacaaatttttcgacggcgcttgaataaattttttcgaattttccctacggtgctgtcaatgcccaaagtgatcagcatcaggaagaagatcagtgaccagatcggcgagtagttcattgtggcaattgcttgtggatagacgacaaaaatcagtgatgatccatccttttttttggggggggagggtggaccnntgcaggcccatgcaa

SEQ ID NO: 6657 - DNA, 2163 bp, Heterodera glycines
  misc_feature (1249)..(1249): n is a, c, g, or t
  misc_feature (1318)..(1318): n is a, c, g, or t
aatagaacgaacgcaacgacaaaaaagggaaatctctccgtccgcccctcggcacgcgctgtttaattgctgggcgactccgcaattgtcacctccacgtccacgcccggctcaatggaaatgcccgtgattttcttcagcacgtcgctggagctgttcagattgatgatgcgtttgtggatgcgcatctgtggggacaaaatagcaaaaattaaaccaagttcaccttaagaaacagcaaatcggaatgccactttgagtgtgactatttgccacggtttaacaatgtactgctcgaaaacgatgacataaatatttggatttgggttggggttttgttggaaaaagacatttttgtcggtctaacttgagtcctaatgctttttcttaagaaattccttttcgggggaaaagggagccgtgcgtatatgggcacagattaggacccgctcattgtcagttagcgcaaaaatatgtataaaatatttattaaacacaaacacctaaactttcaaagaatttgatgttcgggtgaatgctttacaatagcttggcaaatcagatgatcgaatgtcgacggaactttttatttgtcatccgttatttttccaagttatagtacttgatcagtacggtttagagctcggaacttttgtgtcttcctggattttttcgtctcttcaaatgcgcgtgctctctccgctctctcgtaaggcagagacgcatatagttcactgtcactcactgtccgctgagaccgtaagtcagagatgcatacggtcactcagtggtcactcgctgcgcgctgggattcgatatcgatctctggtgcagagtgaccagtgcgtgaccatatgcgtctctgtcctacgagagagcgccttcatgcagcgcctctgaagagacgatacttgtccaggaagacacaaaagttccgatctctacctatcatgccaataccactcatactggacattatagattattgttctttttgtttgaatagagctgtttataaaaatatggatttaattttatcaataaagttatttatttcaatattttttaaaatattttatgaaattctattttgaatttgcattttttttaatatatgcgcacaatttcttggttcataagcttattcgccttcccagttttgagcttactatttcttctaatttattattaaaattcttatttatttactaactcttgataatgtatctaattctgataattaccaatnaagtttttttttattaaattaaataaattaatgaattgcgcattctaaacttatatttcatataaatanataaaaaagtttctcttatttaatttaatttaactgaaattaagaaattttaataacaattttttcttagatttttgcatttttcaaatatgttgattttacaaataaatcatttttttaattctttaaaaatacttttttcattaatttaataatccaagaaaactcttttctttgcatttcgagatttgcagccaaaaatttttgaaaagataatttcggagaaaatttatttctaaattatttaatagtaaaattttattaaataaaaattagcatttttaatctttctagtcagaatgtgaatccgctttaatgttatactttattaaaatttattcaaacatattttttctattttagtttaaaaatttacttaattcatggcaaacttttgatatatcacatcatataatgcacccgttttgcaattattatttgttgcgtcttacaataaaaaaatttattccactgtttttaagtttgtataataattatttatttataaaagaaaattaatttttatgttttatataggacatgcaagttattgcttttttcaattttttatgagatttaataaataattatttgttaatgcatttctttaaattatttgcattctttgattttgaagtcttaaatatgctagaattttttcaataatcatgattaatgcttataatttagtaaaagtttaatattttcgcatttttaaatctaatttaaaaaaatttgtcaattattaactttattttagttggttttactttgaattaattttttatttattatttaatcaattaaggaaaaacaactatcattatttaggtttttgctttttt

SEQ ID NO: 6658 - DNA, 3997 bp, Heterodera glycines
tctgaagagacgatacttgtccaggaagacacaaaagttccgagctcttagttcggttgcttattgttagtgtttaacaagaaagttttctttggacatggcaaatgcggttttctctctaaaaacgtgtcatttatcagcaaatatttaccatgctttatatttttcagtaactgattgtgagtgggcctaatctgtggcccttttgcccaatttccctctccgtattctgggaccactgctggtttttaatatatttatttatttgcttttcttggtgccaaattattaagccataatattctttattgtaaattctaagatttccgttggtttgtttacctggaaacggtcccaagtcttcgacccctctccgcacggcgttttgcgtgtggtaatgcgcagaatttttgtgggcattctcactgggcctttgaccaccaaattctcgtcctttgcgccgcgaataagctgctcacagactgacaaagaaatattgtgaatagtcggaggaaaattggaacaaaatgggagatgaattgatgtatttccaatttgttaacggacgtttaattgtaaaaattaatgccaaaatgaaatatcagccaaaagtaggtgaaaacgccatatccttggagcaatggacttcacgggattactttaaaagtttaaacctttttcgagcgatttcacgttctgtgatgttagggtaatgcgaattcggtcctcaacgggcgctgcctcttgcggtttgtcatccttataaggaaaagcctaaacagatttttttttattgggaggagcgcacttcgtgtgtttaccatgttgtttttgtcgtttgttgtggcgtaaaacaattaaaagagacgatagaaatcgcaattcaatagcaacgcttatatcataaaattaggtaattgcaattttgaatttaaaattaaaaaaatcagagcaacgaaataaaggcgacgggtccaaaatggctttacggcagtttacgcgttcaatcgatgaccatctttagtttcttaggctataacttttttcattactagataaatgcttatatcttatatttttggtatcaaattaaagcatacagctgcggaagtttgtaaatacactgtctttaaccaagacaagaatccaattaggaatataaaaataaaacttattggttgttgttgattgtttataaaaacgcctttacaaaaaattggcattttgtcaacgcgctttggcgcttcagcaatggcgtcagtgtcagtgcgtcagcgcagtgcgtaatgcccaggcgtccttcactccacttcaaaaagaagtgtccaattgacacctactttgtggcggtgcaaaaattgggatccataacctttctttgctgttaacccaatatttaccactcgccgggcgagcttcgctctatctgcattttaaatttattattacaaatagcatctaacttttgtagtttttttcccttttggggccacacacagatttaaaaaagtcaacaaagagcgcgttgaacattcgtatggttcccatattcataaattaacatatttaaatggcggactcattcgatgttactttggcacagataaagggggggggcgggagatcatcgatagtattatccttttaaaatgaatgtgtgaccctcaaacggaaaacacccttttgtaacatttttttaaagaatatttttgttttgctttgcttcctgaagagaatacgcaactgaagatgcaaattttcgtcaaaaccttgaccggaaagaccattactttggaagtcgaggtatcaatttaacaattaagaaaacattagtactatttgacatcttaaggcgagtgacacaattgaaaatgtcaaagccaaaatccaggacaaggaaggaattcctccggaccagcaacgtttggtaaaccaagcaaatctgagaaagcggataatggaaaaaatggccctttcagattttcgctgggaaacaattggaggatggacgtaaaattctttaatcgaatgttgcgggtgtaaaaatcggacctttttccccttttcaggcactttggccgattacaacattcaggtacgccgcccaatttgaggaccacaatttttactggttcgtctcctctgttccagaaagagtcgacgctccatttggtgctccgtctgcgcggagggatcattgagccgtcgttgcgcatgttggcacaaaagtacaactgcgacaagcagatctgtcggtacgaattggcacccatttcaagcaacttttcacactttgttttgcgatacttttgcattttacatgtttttaagcaaatgttacgctcgtctgccgccccgtgccaccaattgccgcaagaagaagtgcggacactccaacgacttgcgcatcaagaagaagctgaagtagaggaccaaatgtttgctggacgaatgggattattgttgatcgaattatttgattttgtttgatgtcgtgagaagacaattttatgttgacgacttattcattacttctgaatatgcaattgctattttgttttagcaactttatcttcgtattttccatcaaatttttcatctttttaagatattattgtaaagcaaacatcaaaatgccagtcaacaactttttgcaaaaggatgatgtaagtcttttcatatttgaatgactgtactgaattagttctttaagatttcgctgagtggtgagagtgctggagaggaatacgaagttgaccaaattctcggtgtgcgcgttcttgaggacggaacgaaggaatataaggtaaggcgaatttttgggttctcaacattgctttgtattagtactatatttgtcgaatgattgctaaattatttatttttgttgagtttaggttcgttggaagaattacggaagcaatgacgacacttgggagccgatggacaatctcgttggtgcaaaggatgcattggacaaatttctcaaagcgaataaacaggccaaaaaaacgccgaaagcatcgcgaacgccggtgagcacatttagccgaacaaataaaagaaaagcccaatttaagaaggcaacgaagctaggacgaaagcgcggtgggggtgacattagtcaggaggccgaagacggggagaacaatcggagcagcaacgaggacgagtcggacgacgacttctcggtgtcatcggccagcaagaagaagaagacaacgtaagtgcgggagaagaacaacagcaaaaagggctgctggtgacaattggaaaatggggcgacagaaaaacagtcaattaatgtgggaaaataattatggaaattgaagggataaaaagtcgaagaaggctcccgtccgccgtgctgtcactgcctccagcggtcgtccgtcctctcgtccgaccccccacaatggggactcactggtgccgaccgattccgctttgccccctgcatttgttgtcacttccctccacccttagacaatggcaatcagtcggcgtatgaacttgggtcagcacagctcttggctggacagcggttccgagtccgactcgaatacgacgacagcgaaaaagaagggggccgcagatggagaagggggaaagggaggggcagcagagagacgacgagacgaagggaacaagcaggccaaagagaatgacaccaaaatgccaacactcgctcctgccgagaacgacgacgccggccatatcagtgacgacagtacagcgaccgaaaaattggccaattctccgtccccacattttgacaacgaagccaaaggcaatggagacgaattgtaatgccaattgggcaccataaaataaaagacaaatgggaaaattgggaagggggggggagggtggcggagtaaaaaatttacgactgaattcaaatgaatttctgtttaggaatatgccaagtgaacatgacccaactccagccaatttgtcgactgtttgaacggcgggaccatctccaaattcggca

SEQ ID NO: 6659 - DNA, 1075 bp, Heterodera glycines
aattcggcagcaaagagggttggacacattttatatttaacaaaaaagttttagcttttttagtcatcgatttgggaccattctaaaaaatcttcgagagcgaaacgaaacactcggtcgaacgtgggaatggtgaccagatttttgcaatgagacaatattttgttttgaatttaagtatgcaaagcgaagcggacaaacgccgacgagtgagtgacagaaaaggggggggggttgcaattaaagcattaattaatggaatggttcagcttccaaagcgtccgaacatcacctcaaattcgacggaatctatttcgacaagaatggtgtgcttaaactcgtcgaaaagggaggaacgcagcgggtgtttaccttcgaaggtaattttttgcttcaaactaaattcagattagtttattgattagcattacaattctttcctttttcagaggccaaggataagaattcgagtgccttgtgcgattacatgtgcgacatggtcacattcacggaaaagggcaagccgcaaatccaagtggcaccgcaagaaatggagacggaggagggacagcatgaggaagaggaggagaaagtgttggaacggacccatgacgacgacgggaaactgaacttcgacgattaaaagggcagagacataatttgagaagtttgagacggcactttacttcattcctcacggattttactcaatgatatattatcttcaatgtttgtttgtagccccacccaatgaaagtgaactcacataaaaccgaatttggaataaaaatgaattttgatttcattggaataaaacataatggatgcattataatacgaataattggagagcaaaacacaagcaaataaatgtatttgaatttatttctctaccagtttaaaaaggttgagggaaaacagagggggactgaaaagaaataatattcaaaaactatatttaaatcgggagaaaagattttggaaatcaacggatcggtcacaagcaaataaccaccaaacagaaattaacaggacaaataagaagcacaaaaatactgtaaattaattaattgat

SEQ ID NO: 6660 - DNA, 5923 bp, Heterodera glycines
aataaagctttaaaaataaagaaaaataaggagaattttatgagatttatttggttttataatgttcaaaagaaaaaaagttattccagaatttctggaaaaattcggattttcagataaaattttataactcggttcagaaaagtcattctgtaaaagtaaaatactacaaaaaatccgcaattttttgctctattatataaattttatttggtatttttatctcttctttaaaaaaagatataaaaataaaagtgattttgtgcttcgggtccaaaggggggtgaccaggatttttgagtggaaaattttttttcacaaaaatcttccaaaaacatgtcattaggggttatttgggccgctgatcatgaatatgtgatcagattttacttttgacatcgttaagacctcagaatccctgtgtgattggggattctgaggcatcatttttgggggggggcaaagttcgagtccggacggtgtaacattatttttctgtgcatttttacgttattttcaatgattttaattaatttaaaatattttgttgagttaataaataaaaaattatatttaaattaattttttttttgatgaatacattttataagtttaaattaattatttttttaattgatagaatttcttgtatttttttaaattaaatttgttaaaaaatattttcattttaatttaatgaatttactaattaatcactgttgtacccctctaatcaaatttgtactacttctaatcactgttgtacctcttctaatcaaatttgtactacttctaatcactgttgtatctcatctaatcactgttgtacctcttctaatcactgttgtactacttctaatcactgttgaacctcttctaattactgttgtacctcttctatttactgttgtgcctctctaataactgctgtacctcttctcatcactgttgtaccccttctaatcaaatttgtactacttctaatcactgttgtatctcttctaatcactgttgtacctcttctaatcactgttgtactacttctaatcactgttgaacctctcctaatcacagttgtacctcttctaatccctgtaaggtcaacaaattttgaaaaacgggcgcgaagcgcccgactaaggccgcgaagcggcctaacaagctaaaaaacgggcgcgaagcgcccgtatgagttcaacggatttaaaaaagggcgcaaagcgcccgtccaaggccaataatttgaaaaacgggcgcgaagcgcccgactaaggccgcgaagcggcctaacaagctaaaaaacgggcgcgaagcgcccgtatgagttcaacggatttaaaaaagggcgcaaagcgcccgtccaaggccaataaaattgaaaaacgggcgcgaagcgcccgactaaggccgcgaagcggcctaacaagctaaaaaacgggcgcgaagcgcccgtatgagttcaacggatttaaaaaacgggcgcgaagcgcccgtccaaggccaacaaaaattgaaaaacgggcgcgaagcgcccgtcttgagcctcgatgtggactaaaaacccataataattttttaaaaattcaaaaaaaaatctccaaccaattcgatcaatttgaatcgcttcacagtctaggtagcgaagctccgaaagcgcgaagcgctttttcccagctaaatagccgacggttcacgcacccgctagttactatatatgttatattgacaaggagtttcgtttgcaaaaacaaaatctctcggccgaaggccgggagcgccctgaaagtagtggaagggtctttaaactttttgaggcgcatctgggaaaactataggttttttgatccgagggccaactgagtaccagggactgaattctcacttttgtttgcatttgaagggccctaactttttttgtaaaactcgaatcaaaaagtgcccgctgtgagggcactccgccaaagtgtcctctaaatgctggtatttttttaaaatttttttttgagcaaacccctggcctgcaaaaaatggcaactgaagcgtgctcaaaaagtacacttcagtaccaggtgaataccgcgccagggtttgatctgagcggggggtggtcagcgaacttattgtagagctttcaaagctcgattttttgaaattttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtatttttttcggaaaaatttcgattttttcccggaaatagaaaaaaattttggcctgagcgggacatttgagtcccgggcccataactcgtcaggcgtcggttttagacaaaaaatgccttagagcaaaattgtagagctttttaagctctatctaatggtatactatatgtagggaaattttcaaaaattttcgagctaggccccctagaaattttcaaaaattttttttgggttgaaaaggagggtgaaaaatatttttctggggtaaattagggtcctgagcacaaatatgatgtttattttaagtttcagattttttggaattttttaaaaattcgaaaatatttttaatttttttggtccttggaaatttgggttaaaatttgaaaattcataactcaatgaaggactgctcaatttaagtgaattaaagctttaaaaatagcaaaaaatcgggagaattttatgaggtttatttgaaatttataccacaaaaacaaaaaaagttattccagaaattctggaaattttcgatttttcagaaaaaaattcagaactcggttctgtaaaggtgtttttgaaattttaaatactgaaaaaatccgcaatttttttctttatttaataaattttatttcatccttttatcatttttttgtaaaaagttataaaaataaaagtgattttggaattcgggaccaaaggggtgagcataggatttttgagtgaaaaaattttttcgacaaaaatcttccaaaaacatgtcattagggctttttgaggctgctgatcactaatctgacatcagatttcagttattacatcgttaagccctcagaatccctgtgtgattggggattctgagtcatcttctgggggggggggggggcggcaggttcgaatccggacggtgaacattatttttctatgcatttttgggttatttttcagtgcgtttaatttatatttaaagatttgttatttttcaaaatatgctcctatgaaatgaaaaaaattttcccaaaaatttactttcttggcaaaaatttttaattttaaaaatttttttaggtaactattttgggttttttggtcttaaaaatcccagtcctactcatttgcaactgcaaatagtgaataaaaattatttttgctcaatttttggctgaaaattatgtcactattcgtcactattttggacttttttcactattttgtcactattttggcactttttcgtcactattttagttaactatttcgggatttttcgtcactaaaagtcccggccctaaaaattaatttcatattaatttaaatatccaattcttgtacatttcaaaattctctttgtaattaataaaaggaataattaattttattttttaaagtttataataaattgcattcaatttttgtacctcttctaatcagatttgtacctcttttatcactgttgcacctcttctatcactgttgtacctcttctaatcacttttgtacctcttttaatcactgttgcacctcttctaacatttgttgtacctcttctaatcacatttgtacctttttaatcaccgttgtacctcttataatcacttttgtacctcttttaatcaccgttgtacctcttttaatcacttttgtacttcttctaatcacatttgtacctttttaatcaccgttgtacctcttctaatgacttttgtacctcttctaatcacatttgtacctcttctaatcactgttgtacctcttcaaatcactgtcgtacctcttctaatcactgttgctcctcttctaatcactgttgcacctcttctaatcactgttgcacctcttctaatcactgttgtacctcttccaacacatcttccaacaatttttgtacctcgtatgagctcaacaacatttaaatacgggtgcgaagcgcccgtccaagttcaacaaaatttagaaacgggcgcgaagcgcccgactgaggccgcgaaacggcctaataagctaaaaaacgggcgcgaagcgcccgtcttgagcctcgatgtggactaaaaacccataataattttttaaaaattcaaaaaaaaaatctccaaccaattcgatcaatttgaatcgcttcacagcctaggtagcgaagctcccaaagcgcgaagcgctttttcccaggcccaaatccgacggttcacgcacccgctagttatatatatgttatataggttttgagtttcgtttcaaaaaacaaaatctcccggccgaaggccgggagcgccctgaaagtggtggaagggtcttacaactttttgagtagaatccgggaaaactataggtttttttctccgagggccaactgagtcccggcggctaatttctcacttttgcttgcgtttgatggcccatttaaaaaacgggtgcgtagcgcccgtctgaggccgcgaagcggcctaaaaatcgctgataattttttaaaaattccaaatcttttcacaacccgatagctaatctaggtagcgaagctcccaaagcgcgaagcgctttatcccagctaaatagccgacggttcacgcacccgctagttaatatatacgttatattgacaaggagtttcgtttcaaaaaacaaaatctcccggccgaaggccgggagcgccctgaaagtggtggaagggtcttacaactttttgaggagaatccgggaaaactataggttttttgatccgagcgccaactgagtaccggggactgatttgtcacttttgtttgcatttgaaggcccctaactttttttgtaaaactcgaatcaaaaagtgcccgctgaaagggcactccgcctaagggtcctctacaaggtggtattttttaaaaatttttttgagcaaacccctggcctgcaaaaaatggcaactgaagcgtgctcaaaaagtacacttcagtaccaggtgaataccgcgccagggtttgatctgagcggggggtggtcagcgaacttattgtagagctttcaaagctcgattttttgaaattttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtatttttttcggaaaaatttcgatttttttccggaaatagaaaaaatttttggcctaagcgggacatttgagtcccgggcccataactcgtcaggggtcggttttagccaaaaaatgccttagaacatttttgtagagcattttaaatgctatcgaatggtgtactatatgaaaggaaattttcaaaaattttcgagctaggccccctagaaattttcaaaaattttttttgggttgaaaaagagggtgaaaaatatttttctggggtaaattagggtcctgagcacaaatatgatgtttattttaagtttcagattttttggaatattttaaaaattctttattttttggcaattttttggccctcgggattttggcctaatatttgaaaattcataacaaatcgaagggttgatcaattttacaggaataaagccttaaaaatagagaaaaa

SEQ ID NO: 6661 - DNA, 3835 bp, Heterodera glycines
  misc_feature (3828)..(3828): n is a, c, g, or t
aataacacggcacttcaagagttcttgccgtcctttctctctgatgtttatataaaattttgtcgacctattttaaaactatacatttatttaacaaaatgtctcacagtaagatttaaaaactttttatgaagcttcttctcaacaaatacaaaaaaaattattgaaagttttttatcttaaacaaccaaaataagttttgtaaaaaagaaaaatgcaacaaattgttaggcagacatacaacgccgctttctctcgacaattctttatttgcctcaaaagcgctgttctcgcggcggtttcggttgcgcgttattttcgcccttgctgctttggggcgctcttcgtggtttaggacaatctttcagcctatgtccagcgccacaattccaacagcgcagaggttcatggcagttccaacaggtgttctgcttttgcgcacgcccttgcagtttggtgtggcaattccaacattgagttgttcctgaattgtaaattttataaaccgcgataatttggtttgtcagtactaagccgagactcaggagccctataagggcaatcggcgctcatgtgatcggtattgaggcaacagacaaaacatcgtggttgcccgcccctgcgaatgagctgcccaagtgagttgcgagcccatgaacccccaatagggcaattagatgctcgatgcccagctaagccacaccgccagcagcaaaaaacttcatcactctgggggtttggaggcaccccttgcgtttgctgtgcaatcagctccacaattcctggcggaattggatagtcctcatcaaactaaagacgtcaagaattgtcgcaaaattttaactaaaacctcctgatcttggtgcgccccctcttcaaaatagacgtcccacaaacccaataaatccatatcttaatttacgtttcttatcaaataaatatttaataaaaacctcccaaatattcttggagtgaaaactccgcagaaccactgccaaaagcaatgttccaaatcgcgccgatcagctgcgctctccgcagaattcgcccttgctcatcttcgccaagattgttgaagtctggaaaacggttcgtgtgatgctccaactgggcttttctcattctgcgccgcacttaaacaatatgtttaagacttaaattttcgcttaatatttaaatttaataaaactcacactcggtaatatccgaaatttgactgcttccgcccctgcgaactatcagatcggcagcgccaacaatagcaaagagatttatggtcccaaattcgcccttgctatcacggaagatacgagctcttcggccaaaaacagtatcacgcctcatcagcagttgctcccattgttcttcactcagcattttttaaacttttttcaaattaaaattaagctgataaaaaattatatcgttgtaacgatggtagaaattttatatacaaagtaaaaatgttggactacaaaaaaaattggcatatttttatagttatataagatagccgaaaaaagaaaagaaataaaaagtgaatatttaaatatgaattttattttagaaaataccgctattttttcaaaaataggaacatttcagtttaatgaaaaattatttttccttaattaaaaatgaatttattggaataaatttaagtagagggaaagatgtaaccaatgctcttgcaaatataatacgttggaatcaaaatgagtcttatgaacgaatgattttaaattttgtctttcatgctcttttcgctctttcatactgaacattttttgcaaattaattttgaattgtcttttcatataaaaaactgatgaaagagaagcattctttctcagattatttataatcagaatatgtacattagatatgtacattaaaaaaatgcattattttaaaaaaaaagtagtttcacattgccctgagcaattctattgactgacgtttttgagttagaacttaaagataatccaattcgttaagaaagatgtgagacagaattaatatataaatgaatttaaatttaaaatcatttgttcataaatatcaattttgatcccaatgtattatattaaaacagcatgggttgcatcttttccgttttttaaatttattaaaaaaaattttgttaaaaagagcaatttttattaaaaaggaaatattcgtttttaaaaatagcggtagtttttaaaaaattctttggatttaaaattccctttttttgacttcttgttcctttttcaactacttttatttttaaataattttgactatatttttttaaagagaaataatattaatggctgtacgcaaaatgaatgacaacgaatttgaaacgttgttgcaagggcgcaatttttttgcgcgtttctcctctttgatgagggacatgcgagctgaattttcaactataaatatgttggcaatagtggaagctgaagacctcatcgtctgcaagggcggagctgggacgcaaatttttaatttggcagagtgtaatttttttttgttttttttttaaatttattaattaagtgcgccagcgtttgcgtagagctcaaatggtccatcatacggacagaattggcaactacaatgaacttccactgtatgagcaagggcgaaaactgaacaaagcccaaattgttggattaatttggaatatttggtttggaacggggtcaaaaccattctcaccggaagaatatctgagaggtttaaaaattgaaaaaaggtaatttaacaatttaattctattatttagaaatggaccgtcataatttatgggacgtctacttttaagcaatgggcgttgtccaaatagcaggggctttatcaacttggttgttgacatttatataataaattaattttgatatgttgttatgtaattgatatattttttgataaagcattaaatataaattaagcagttatctaaatgttatattttgtgtcgttgatacagccatacttttgccttttgttaatataaaacttcataaagaagcgttatttcaaaatctgtcgaaaaaatggtgcaaaaaaaaaccacgaaagaatagcaagaagatttgtatgggcgcattttttatgaccaaatagcgtcgataatataggatatataatttttgttggccacaatattgttggttatcgagcatttacacgaagtagccgacaataacaaatttattaattaggaaattaaaaacatttaaaaaatatcaaatcacaaacataaaaaacaatatctcatttaaattaaataattttattaaggtaagtttcttgcacttagagagtcaaaagctgtttttggggaggccactccttaagtgttgggcatattatcttcctaaacaaacaatagttagtaaagaaaataaaatattattccaccatgtttttatccatttgtggagaatcggtcccagacgcccctgcaagcaggggcgcatcctaatagaaaagtaacgattattgtgcttaacagaattagaccaccataagatccttatcactgtcgagacgcattctttttctgatcgcccctgcaggcaaagtatcccactaaaaaaatgtaagcaaattttttgttataatctagtttacctgatttttgtacttggctttgttcattttttgggctaatgggataagttcagcttgcccacggagggcccatttgtccgcaaaatccttgcacatctgttgaattggtgcccgttgaagagcccaaaaacgtgtaatttcacaggaagcgcgctgcaactcggctgttatttctttgtcaaattttttgcgttcaangtagaag

SEQ ID NO: 6662 - DNA, 1848 bp, Heterodera glycines
cccgaagctgggctttgggcactggtttctattgttttcgcttcttcgtctgagtctgacacgtccaccaacttggtatgcttttcgttggtcacaaattgctctacatcgcccttgccattgccttaagggttggcaaataaaaacttattcccaatcccgcacttttaatgtagaaatgttaaattaattaatccttcaaacctgtgtcagaagcaggcggcaaattacaaccaaacacagcagtattattaatatccttttcaccaatttcctcttccatagtaactaccaaaaatatatatatgcattaaaaagggaaagtattcaagaaaatgttaaatcaagcagtaataagtcacaattaatttaaaaacgatattgttttaaatttaatttaaatgcgtgcttcccactaagcacaagacccatcttttgaagtgtctgcccttgcgacttaaatacgaaaattaaaaaaaatagaatgtacaacaccttattgactgtcatagcaaagcatggacgaacagggaattgtatacggcggaaacgtaagcctcgatgatgacgcccctgcccgtattcaaacttaacacgtggaatgagaaagtcttgtccttcgcgagagcccgtcagaatacggcagtgcaaattttcatccgtcatcgttttgatttgcaaacgcgttccattacaaaggccacacgttacatccagatttctgataagcatcactggagcccctgcctaatttaaaaaatgaaactaaaaaataaaaaaataaatgcctttaaaatgagtttatgtggcggtactccagaaggggtttcgttatgaatcgcttcgagattaaagtccgagcgaaaagtgccaaattcctcttgagcttcgagtggagaatctattgactcgtacaatatcggagcccctgctaaacgatcgattgcgaggtcgttgattctctgcacatcattgttagtggggcatagtatcgctgaatctttgatgatatccgaatgacgatttggatcgcaaaacaatgcactcggaaaacaaaaatcgatgatagattccaaagtacgcgcaaccatttcctttgggattttgagacgaaactgtttgttcgcccctgcatcatggaggccgttgccgatggtgtttaaccactcgcgaaattcaatttgtcctggaacaacgcgcatgttttgcgttaaactgaaaaagattgaacttattaaataagggaaaaataacacctgagctgtttaaaatgatcaaaaaaaagtgtctccattttaatgctctcctgcacttgatcttcgcgcgtgccgtgttcaacaacaggggtcagttgtctccaatctccgccaagaacaaccacttttccagcaaacggtttgtcaacggcacaaacatccctcaagagacgatcgacgtagcgaaggacttttttgctcaacatgcttatttcctaaaaattaatttgtttatttaaagcggaagtgataattacatcgattatgattagttctacagcgcgtagttgtttcgcccttgcagattcaaacgcaattttcggcggtgaatcatcatcaatgtcattaggcacggagaactgtcgatgtaccgttccaccaccaattagcaacaacgcggcgattcctgtgcttgctgctgaaagcaccgtgccgtttaggagctgaaacaaaaacagagatgaaaatagtcgttatagcatacctttcgcccttgctcattattgttagcaatttgatcaatttctggctttccagcgaggcaccaacggatcagggaattgtatagataagtttacctatttataaataa

SEQ ID NO: 6663 - DNA, 1585 bp, Heterodera glycines
  misc_feature (1536)..(1536): n is a, c, g, or t
cattaggtgatgcatcggtgaaaacatgtaattgaatcttttccagtgttaattcgaggcgtgaagcgcgctatgtgcatcgtttttgccgcccagagggctttaatttcatcccattctttggtctcttccgctgggattggatcgtcccagccttttgaaccatcccataatttttggaaaaacaatttcgccccaaccaaacaaggcgaacataaccctaaggggtcaaaaaatgacgcaactccgggttaaaccgtccggactaggaaccgtaggaaaagtcaaagacaaattgtcctcacaaatagtccattttagtccgagaggtgcctcatttcggaggcgatcattttcaggtatttcgtccaaacttgacggatcagccgcaatgaattcgcacagacgcatttgagccgcggcgaaaattttttgtgcttcggctgcctttctgcgtgcttcctcaggcgaatcagccaaaagcagaaggttatcaacgtaaagcagagatttttcccggatttcctctgctaactcactgggaaatgcttccaaatgatgttggagtgtcgctgccaatagaaaagggcaagacactattccaaatgttatcctccgaaagcggaaaacgaggagattttccccagaaagtggtgcaaatatattttttacccacaaaaattttgaaaattcacggtccgattctttcagacttaccatcagaaaagccttttctatgtcggcccaaatagggtattttgtggccctaaactgaatgagttttctaagcagttcgactaaatgcctacttcgaatatttgactgttataggcaaagaatttctaagaaaagaatattgtacggttcccaaagagcatgtatttatgacggaaaatcctcagaaaattaatgagtcgcttcaatgtccaaacatcctaaaaatatcttttcataaaaatattcattagcaaagaattcaaaaccgacttccttttgccatttgattgataattttattgcaatatttacaaattaatttctccttttagtactaattcgaattttaaaattttgttgccgtaataaccgactacaacgacgcgtcaccaatttattttagaatctgattataaaatcaatgcgatacaaatgattgggttttaactctaagccgttcgattaaatgcctacttcgaatatttgactgttataggcaaaggatttctaagaaaagaatattgtacggttcccaacgagcatgtatttatgacggaaaatcctcagaaaattaatgagtcgcttcaatgcccaaacatactaaaaatatctcataaaaatattcattagcaaagaattcaaaacagacttccttttgccatttgattgataattttattgcaatatttacaaattaattttctccttttcgtactaattcgaattttaaaattttgttgccgtaataaccgataccacgacgcgtcaccaatttattttagaatctgatgataaaatcaatgtgatataattgattgngttttaactctaagccgttcgaataaatgcctacttcgaaatattgact

SEQ ID NO: 6664 - DNA, 4297 bp, Heterodera glycines
ttttcataaaaatattcattagcaaagaattcaacactgacttccttttgccatttgattgataattttattgcaatatttacaaattaattttctccttttcgtactaattcgaattttaaaattttgttgccgtaataaccaactaccacgacgcgtcaccaatttattttagaatctgatgataaaatcaatgcgatataattgattgggttttaactctaagccgttcgattaaatgcctacttcgaatatttgactgttataggcaaaggatttctaagaaaagaatattgtacggttcccaaagagcatgtatttatgacggaaaatcctcaggaaatttgtcggcaatttcgttgccgacgagagggccagaggaggacgaagcggaatattggtgttcaacgccgacggtacggcgagggaactgtcagaggatgaggaaaatgagtgggccggggggatcttctgccacccccccccccccgcccaaccgcgggacccgaacaaaggagggaagaagcgccgaggaggacggcgctgatcgaaaattccggaggggacattcccggataaaggccattgccgtggtgaacgatccattttttaaattcgacgacatttttcccccctctttatttctctctttatttaaacttttcatttcctttcacttttgctcatttacataatgttttccttcaacttcaccatttgccttttctttccaatttttttgcccattcacatctgcctccgattttgattcctttgttcacactttctccgatcgccatttccattgggccgtttttgcattcatctcattttttccctttgtttggcatttttctccccgccgatttttgtacccttcggcgtcgcacttttgcatcttaatctttgcccccccccagggggaaaatgtttttggttcttaagtattgtttatcgtctaattctccacacacattcacctcttgctcttcacttttttcactcctcaccatctttttctttttgctgaatcattcccaatttttgaccccctcaataatccttatcgcccttcccttcctccaattttcaccatataatccatcaacatctcgcatataatcatccacctatttttgaccatttttatcatcatcatcaccaataaacattttgtcggaaaagtgttgaaagggtcagagggcaaaaaaaggggggaaaaatcgggaacgaagtgaccaaggggagccaaagccccgagaatcgaagcgggggacaatcccccgcagagcagcagcaaacaaggacgggagccagttcccggcggttgacgcagttcgcggccggaagtccaactcttctcccgaacctcaaccgggagcgccggcagctcttcaaaaagtcggtggtgccgttacagcaacaacagccaaccccatcttgtttgtcctccccaccccctccccagttcactcccttgggcacggacccaacggcagcagtagcagtttcaggaaattgagtgaattgggcccgagggacgggagagaaactcccgcgcacagaccccctagccgtcagcgccggccgagttttctttgccacaaacaatttggtgccgttagcagggggcaactgcagccaccaacaatcggtctacgagcgaccaacgagcacgaattcgagaagctaacgacaatttggtgccgttagcagggggaccagcaacaacaccccggtcgcaaaggaccagcacaaccaccagcaacagcacttcagtcgccgaggaccaacacaacgcatttgaacaaaaatggagcgacacgacgacgaccaattcaacgaaaacgcgaatcagggggatcctcccccctctgatcagcaggacgagaggcgagcgatcggagctcagccagccaagcccaagacagtcttggaagcgcacggacttgggacaagccaaccgggtgttacacccgccgtgacgaagaatttgcgtagcggactaatcgcagtgcggtcggcacgggaccaaatcgaaagagcagcgggcactcttgccgcgcgaatcgtcgaagcgcgggagctgatggacgacgattacacaagggggcgaagcgctcgaccacgccgctcggatgatggcaatggagcgggggctcggagaagtcaagcgaatttttgaagggcattttgagaagggcatagccgaagcgggtgcagcacccgaggagcggcaggatttcttctatgattccattgccgcccctttgccagctgcaacgaaataccttcgactgcgggagcacccaactcccgccgaactccttcaaattgcggccgagcacctcggggatctgcgagcaatgcggcaaacattcgaggacgaagaaagggagagcatctcccgatcgagcagatcagtcgagaccgagaacaatcaggcggaggaagaactcccacgtgccatgccacgacggagcatgcaagagtgggagacatcgttcagagaagcttatgttcgacagcatgacgaactgttcggccagcagcaaccattggtcaaccaagcggaacgggtggccacacccgtaatgtcaaacatggccgcgcttatccaacgacgctcaaatgctccctcggtggccagtgttcgtgtgaacaatccggtcagggagtggatggcaaggaaccaaggggtcgggaacggacccccggcacaggcccaacaaccaacacaagcgcaacgcccgctacaggccgtacagcaacgcctcgaacaacttacgctcaacgatccaagagccaatttccctcgggcagcacctcatttccatgtccgacgggaggaacctcccactcgggaccgtacccgagctcagggggtatttccttcacggcctcatcgcccagacgaatcagctggcatgttaacgacctttgaagcagtgcgcctacaaccgccgacattttcggggaggccggaggattggaccactttttgggcctacttccaacgggccgtggacgacaagcaaattcccggcttcgagaagcagcttcatctgctgcggtgcttaaaagaaggatcgccggcacggagagcggtggaagtgtacccaccgtcggatggtaattatccggtcgtggtgcagctgctgaaggaacgatttggggacacgaacgacttgcaaagagcgatccgagctcagcttctacacttgcagccagcaaaggacaacgtgtcgagcttgacggcagtgatcgacgaattcgagagaggagtgtgccagctcgaacaactgggagcgaacgtggacgacgagtcgttcggcccgttgttggaggccaaactcccggtccacatcctcacagaattgaggatccgggagagtacgatgggagcaaaatggacagtgcgagagtttcggaaagcggtgggagtgcaagtcaagtgcatgagggccgccgaatccgcgttggcagcaatgaaaggacccgaacgccgacatgagcagcgatcggagcccgaacgaggcggacggaacgcccgaacaggacaaggattccagcgggcatttatgatcagagatcagcccccggagaaacgaacgacgaacgaagcacacaccaggaccgaagtcgcgatgccacccactcgaccagcgaatccgaatcgtgtgccgctcgggagttactcccgaccgatgggagcgcattcccaaacacagaatggacaagaaggacaaccccgacaagggtgctcgttgtgtggacaaacgggacaccaaccaagccggtgtggcaaatatgggtcagcacaagccaaaaggaggagactgatcgagcaacgccgttgtctcaaatgcctgggatccgatcacaccgcgcagcagtgtacacggaaaaccgcctgccggacgtgcgaacaaatggatcaccactggctgatatgctggaagggggagagaaggaacgaaccccctagccactcgagaacggaagatgcacaacaaaatcggacgatgatcattcgggaaattgaagcgaagcacgtgcgcactccccctcccaccgagtccagcaaggacgggatgggggctaaaggggaggacccccctttgctcgacggagagcagagagcattcaccaccgtgggccagcaactcccggcctatttaatggtgtgcccggtggtggtggcatcggaggatggcatgacagaatgcaataccaaatcttcttctcgacccagtcagtccatggcgactacggggatgcggctcctgatcaagca

SEQ ID NO: 6665 - DNA, 6111 bp, Heterodera glycines
taagtatcatttcatcatagaaaaatgtgaaatattcacctgagatttggtacattatacacatattcataaatttgtacacttcctattttttgcaaaaaatttgttttcaaaagtctcaaaaatagcgagtaattttggatcttgggctcccagtgccagtgcaaatattaattttttattaagtaatcagaacgccaaatttgtaaaattaaaaatttatgggattttcgcttgtaaaaaacaagagcagatctcgagttaaaaatctaacgttcaaaaataaaaatagggattcgacagagggaataaaaaatggatctaacaataaacaaaattttaaaaaattggaattatagtaaaatttttacaactatgcagaaattttttctttttctctcattttggcgtactatttccatgtctctaatatataagataactagggttgtaaattatatggactaaaaaacgtcaaatatggacataaaatatggactaaaaaagcccgaaatatggactaaaaagctcaaaaatggccaaatatggaccaaaatatggacaaaaactgtcaaaatatgtgttttaaaccctcaaaaattccaaaaaaagtgtttgtgttcaataattgcttaaataaacttaaaaaaacaataaacaaccaaaaatggatttaaaacataaaaatgcaaattttttttattgtcgtccatcgtataaaaaatatttccaagtttgccaaaatttcaaaaaaattcttttttaaaaaaagaaaagttcgcaaaaaatggcaatgacgacgaaaactcaaatttttcggattttttggggtctaatttttttttaatttccaaaaagtccatctttaggggtgcatttttcgcttttcttgcatttttttttgtgaaaatttgccaaaaacggccaaaatattgactaaaaagacaaaaatggcgaaatatggatttattcccgaaaacccccaaaatatggatttatatgatggactaaaaaccttcagcaaatcaaaaaattttaacgtagaaatgctatttttgagccccaaaaatatgttaatccatataatttacaaccctaaagataacaaatggttaatttttgctaataaactattttaaaatttttaccaaattttagaaatgttaggcacttttgcagttagagggcgcgaagaataacgacagagaatttcagaaagagatttatgaaaatatatgtggaaaattttgtaaaatatttttcgggtgcccttcagtgcaaaagtgtcaatagtaattgttaactctattaaattgccttttggatggaggatctatgatctatgacatatatctgctgggaaagaagatatcaaattttgcaactcaaaaatgtctaatttctaccgtatttcaagggaaagtgattaaaaatgatcaatttcttcagcgggtcgaagtcgtaaatcccccatttttggcccactaaagccccaaaggtattgtaaattcggttttcgttttccaccaaaataaaaaggaataataccaccacatcttttcactttcaattatcacaattgattagccatctttttaaacatttactacgtctaatttttcatttctttttacagatttactttgaaaatttcctttgggtcctaccgaattttctctctctgaatcaaatggccttatttatgtcgcagaacaatgaaactagcaaatctataaatttttgttattatttttgcttattttgcgcttccttctccattaaatccggtttgttttgtcaggagacaccaaatgagtatcaattcgctgtaattttgcgcggcgtttgtccttccgccgtctcattattgccttggcgggtcggcccattattcactttcacttggcgattcgttcgttttcgccgtcagtcggccaaatttcccccagcaaaatatgttttaacgcgtaaattctctttcactttttattatcttttcacatttacgctgaattttaaaatatttcactcttttttaattaatttaatttaatttttttttttttgcttcccttcgtcacaaatttaactttcgtttcgtttccttttccaaaatgaattggtgcgccgttttgtgctttttgcttctcatcgaagtcgcctttgtgccaattgtgaacagtgcgccactgtaagcactttctgtgcttaattgcctcttctatcccatttttgccttttccaaaaagtgagcgggaaaaacggctgactgccagccaattgggcaaaggcgccgtcgtcggtgccggcgtcggcttagtcggcgccgcactttacgccggcggcaaaaagttttggaacaaccgaaaagcaaatgctgcggcaggtaaaaaatggactgataaagcaaagaaaagtaattggaatttaagccgacgcaggcggagccgacgcggccaatttaaaaacaaagggccgaaaatgaaaggatgccaaagaaagacagaaaacggagagaattttaaatgaaatttatgaaaggacagataaaattttaaaggtgcaaaagttgagaatgttttaaaataagaaataaaaaaataaaaagaagaaacagcaattcattagccaattgctaaaggacttaaaatattttaagaattcattgaatcttaaaataactttattttatcttgccaaatatattcgactaaatttaataaaataattatgtttgctttaatatacaaaaaaagaaaaacttccttttttctgcccattaaaatcaaatgatggaagcgagctgagcaaaaacggccaactcagcccacagttattcctttggaggtgtctatttttgtttgtttgtgaacattgcaaatgatggacagtacgaactcattagtgggtaataatcccttgcccgtaattgtgttcgcccgctttaatggcggtgtttatgcagcgggggggggcaaaatttggccattgctaagggcgccattcgttgacgccaccttttttggccttataaataatcgcaaaagaagcgcaaatgcattcattccctcaaaagcaaagccatccatccatccgatcattcgcttcatctgccaatccgcaaaatgtcccttctccgtcctcaatcgctgcttcttctggccgctctttgcctgtcctttgcgctgctctttgtcacttcgtcggaagagggagggcgagtgaagcgcggcggatggccttgggattgggccggcaaacaactgtgcaaaacatcggcaaattgcaagtgcaagtgagtcgaagagagtaattgcgctaaaaatagtttggaatgggaataagggagggaatgggcgacgacgacgatggcacttcacttccctttttagggatggcaaaaattgggccaaatgtgtaaagtcggaaggctacgcggccagcaattgttgcgacaaaaattacgtgtgggcatgttgcgggaagaagcccaaacattaacgaggagagaagagaaagggagagaatgagaagcgagttcccataattcattctgttttggatttttagtctttttttctttttgggtttttttggtaaatattttctttagttattataaattgtttggcctaaattatgccattggaaaaaaatgtatttgttttctattacttttttctcttaactccttgggcctgtacgaaaaactttttttaattgctgctgtttaaattactttttgagttatttcatcttttttagcgcatttattttttaggtacaaaactcctaaattttgaaaattcttattgtcaaattttgccatttgccgaaaatttctaaagaaaaatgtacaccactgaaaattgacttttaaactgtaaaatgcaaccaaaaataattttaaaaattttaagaataattttggtgtttccggtcctaaatcctaaaatattttaacggatttcggtagaattcaacgcaaacgcgcagctcatttttaatcaaagaagtcaaaaatagtttattcatttttgtgaatagcttattgtcagagaacttaacttttttatgcttttaataaaaaatgtttttttttcatttttgcccatttggcggctttataaaatgcattagcatcattgatgatgatcatgaaatagcatgggcatcaatcattctctacttccaaccgtaaccgtatccgccaccgtatccatatccaccgttgccccatccaccgttgttaccccatccgccaccgtatccatatccaccgttgccccatccaccgttgccccatccaccgttgttgccccatccgccaccgtatccatatccaccgttgcctccccaattattgtacccatagccgtggcctcgttttggacgagcaatcgcagggcttaaaaaatgaaaaataaattttgcctaaatcaaatgccgaaaagtatgtttaatgttgatgcgtcactgactttttctgtccgtcctccgttttttgcgctttatcgtcagccaacacagaaaagacgagaagagccaagagaattgagagcagaatgttcttcattttgagggccacgagaatgaattgtccgagtcgcaattccctccccttttatttgccatttcgccttcgaattccgtcaaattgtctgacctttcgccgttttttgtttaaacttttgtcaatgttctccgatttacaaagtcaaatccaaactccaaagctcaaggtttttccaagatgttcccctcctagtccaacccaaggtcaccaataatatgattagcccacaaatcattcgttcgctaaactgtctcgaattggtcatgacaaaaccaaagaaaattagggacttttaattggttctttgaaaggtggagcaaagtcgggaatggagccgaaattcttatacatacaatcttatcaaatttacaaatattctgaattattccaaaacctatcgttatacctaattacggaccattttatacggtcgagaatttttttgcatttccgcattcgactgacctcattttatttaatcctcaactttaatctggagaataagaaaggcgaccatgatcatttaaccctatggccatgattaaaaaagataccacgcgaggggagagagggcgggggcagaaacaacagccattttagtccctgataaaattagacacaattaattttaaaaaccaaaataatatttttgataaatcaaacttttatcttttagtatgtacatactaatcaacagggcttctttttttatgtaaatacatgtttttttcctggattctccatagcctaattagtaggaaaatcactttcttttttgtgtttgcgaacaaaaattggacttttatttacatattttgagatttttctacatattacatatgtacatattttggacttttttcccattttttcgtacatattttttgagaatttttaaggaatttttttaattaaaaatgcccccaaaaatatccaaaatttcgcaattttttcaaaaattttgagaatttatagaattttttgtgaaaagcaaaaatttttttgaaagtgtgctccaaaaaaatatatattttttttaaatactaaaagatgattctaagcctatttaggtcatttttattgcaatttgtgcctgtttcaccctttagtaggaattttttccccaaaaaaatcaccatttaaaaaattttatttacatattttagtacatatttctggatttttgtacatatttcatacatattttagtgttttttatacatattttatttacatattttgcgatttttcttacataataaaagccctgctaatcaattaaaaataatttagattaaatttaacttacctatttagtttaaaaaatataccgtaatttataaaataataattagaaaaataaatttgtttaaaatgttaatacagtcatatgcaaaagttttgagtaccaattttctcgaaaatggagactgctatgaaataattacgatatcagaaaaaacccttgcctgtaattaagagaaaagagcgttatttatatttttgctagaataagaatttggctgtggcaaata

SEQ ID NO: 6666 - DNA, 1295 bp, Heterodera glycines
  misc_feature (455)..(455): n is a, c, g, or t
  misc_feature (470)..(470): n is a, c, g, or t
cgaaatgaaaatttttaaaaattttccagcaaataatggaacattttttcgaattccccccccccctaaacgaaaattaaaaaatttaataggcaattttcgtaacaagtagcactcaaatttccaaaaatttttcccggcggcgcctatcggcaccgccggacctccattttccactatttttacaagttttttgccttaaaacggccaaaattgggtcatttttagtgaaaaaaagttattggttaaatagcaaaaaaaaaaggtcttcaggtcgggtccccccccccctcccgaaaaatgtttctagatacgcccctggtttccagtttctttttttcttattatgtaagtgaacaacaaattctttaaatattggtttgtaatccctatgaatatctaaaacaatttgagtgggaaagcaatttggaaaaaatggggggaccttgcgactntaaagatcgaaagtntaaaaattccttaattttttaagtgaagatgttatatgaagaattttatgtaaaatttgcaaaataattaaataagtgaatcaaaagggacaaggcaacaaaaacacaaattcacagaatcaagtaaaaaagtgccgcactttgcagttcaaatgtttgataaacaatggcaacgtctcaattgtcctgggccatcgctccgttgtctcttcaatcaaattcccattacgaaatccatcaatcttaaaaagtgcaatcacaatgcaaattccgattccatattttttcccaattaactctcacttgaatatgatccggtctgtgtgtaagtatcagcaaatcgccatgatgacggagaccattcccttttggcgttctgctgaagaggaaagagccgctaaatcgaagcttaatgcttattcatcactaatcgtccgagattaacctcctttcctccaaagacagcttttgctcttctccgattcgtttcagaacagaaaaagttgcggcatcatttaaactgaaaagtggcggctgaatgctaacaatgccgaaatcgagctggtgaagcaaatcattagaagaaacaaatgcaacgggggaagtcggcgatggaaatcgcttcatccgatggggacgagcagcggttgttgtggcctctttcatggcttgtcgcctcgtcaccatgcgcttctttaccagtggcatcccaccatcgctggtcacttctccgtctgatgtgtttctggccatgtcttctccacgtcgcttcccccttttccttcggcacattctttccattggcattcttttcgccgttctttt

SEQ ID NO: 6667 - DNA, 6051 bp, Heterodera glycines
agagggcattagggacaataaattaatgaattaattaatcagagcagtgaatcccttcccattggcagacaatggacaaattcaattgtggcaattccttttggaactgctctcaacgggcgattcgtgcattacgtgggaaggcacaaaaggtaatttagcaaaaaaacgaaggaaatgggaaaacattttgaggagaattcaaactgttgaagccggacgaagtggccaaaaagtggggagaacgcaaaaggtaaggcgaaaagagaaaaaatcagcaaacgaagggagagcaattaaatggaattgattcatctgttaggctttacggattcggcttaatcacccgccgtttcagcaagccgaacatgaattacgacaagttgagtcgcgcactgcgctattattatgacaaacagttcatgagcaaagtgcacggcaaaaggtacacgtacaaattcgacttggacacattggcaaaggcatgcgaagcggcggcggagggaccgaaagaaatgccaaaagaaggacgaaaagggacggcagaaacaatggcagaggacgaaagggcagcgaattggggagggacaaccgcaggtaaaaattaaacgaagagcaaaatcaatgggtgccaatggaaatgggtgtggtgccatcattaattgtgcccttacctcccatttcagtgtgccccttcggccgatcatttggcatttcctccgcaccgttaaaacccttcgaattgtgccaacttaacaacccgtgcaattcgactccttttccaactgctgcacttccgtgccacgccgttgctgatttccctgcatgtgtgcctgattcgacccccttttccccgtggcactccgtgacccatgccattcccggccacgcgatccctccgtccattttcactccttccgccccttttggcacttttaattactcttccaatgccttttattctcccgaccgatgaaaaatgagaatttaataacaattatattttctatatgttttattttgtaatcaaataataatgcacatttaatgaatgtttcgttcgtttatttgccaatgcaaaccaaaaaatggcctattttgggctacccgaattgccctggcaaatgccccccccccctctcagcaaaggacgatgctttccgccacgcccatcccttctccgtcccctcgggcatcgttgtccgccgatttcttcgcccccagccgaagtgccgttgttttgtcctttcgtttcttttttattcttttctcgtttcccggtgtttgaagacattgggctggcgaactccgttcttcccaaatggaggtgaaatttgaggaggaagaagaagcggacggacgagtggcgatggcattggcattttgggcactgttaagctgctgttggacggagtggtgcagggaggacgagcgggacaaaaagctttgcccactcatgctttggttcattctcgcactgaaaaaagccaagaaaattaatccgaaaaacggagaaagtgattcaccgcagcttcgcctcgtgccaaatgtaaaaacggagatacaaagcgcggaaacagaggagggcactcagacagaaacagaacgccaaaagaatgccaattgaaatcggacttagcgaagtccaaaagccgagcggttcttccgtttgaacgtcgatgcaagttttgaaaatggatgaggacgaatcagccaaatgaagtagaaaatggacgagatggtactccagacagaaagtgtaattctgaaataatacactcattggagagacattggagggcagagaaaaagtgggaagaaaaaaaacagacggtgaggggacggagacggacgacgttgtaactgcgccagggattgtgcagcgacaattggatggtccgtctctgttgggtgatcgcatcgcgcacttccaacgacaaatggactcgctcagcagctcgaatctgatgacaaaggtggaaaatgaagaaaagcaatagcaatgggaagaaaagaccttcaaagagtcattccaagccaaagcaacgtaatgagagccaatttcaacggcactgagctcaatgacgggcttttcaacgagtagccgaagcacaaccacagcaccattcacgcgacacgtgtaattgccggaatcctcaaaaaagtcaatcaaacagtccaaatgatttgatgggctaattggccaatgattattgttggcctaattagtatcaatcccagtccccgaaattgtcaaaaactaaacgcacttctgagaccaacacttcaaaccgaagttgctctccgtccgcttgaatccttgactttggccgtggcatttgggcaccgttcgtcgaaattggcatcgatggggatggacgattaagctgaaagtgtggacaaaaaaaggaattttgacgagtttgagtgctcagaaacgaccttcagttgaaagagcgacggatggacagagccaagaaaaggcgagtcgaaaaggggcgaagaaaacaccggcggactgcgcaattggacacgacggcggagatcggcagactgatcagtgggaggggatgacggacggacttcgatcggctaaaagggacttccatttgggccgatcagtcggttttacgtctccagcagaggacgcgttcgttgctgctgccacatttttggcactttcgtccttcgtctccttttgatcagttccgtgctgtctctgctcatctccgatcagtttcgtcccatttggcattgtccattcagtccctccctcttttccttctccgtctcctccttttccaccgtctctgtccattctcggcgcacaatacaacgaaaaaaactggccaacttttgctctaaattctttgcccatcggcaaaatcggctcgcgcggacactctcccgttctttggtcggtgttttgtctctccgcaatttttgccattgaaattcgccgctgattttccccctcagctgatgacacgcaaatagcctcattaaggtcagttattttttggaaaatatttggcatccaagcagaaacgcaagcgcagaaaaagggattggaactgagatgaagacggacggggagaagcagaaggttgggcgagagggtggacagcgaattgttggagaagtcgaccctaaagagtaattattgagaggagactgatcagtgatagggaaggatgaaaggactgatcagagacggaattgtaggagcaattggaacatactgatcagtgatcgagagaaagaattgatcagagaaggcattagagggtaattggacaatactgatcagtggtccgaggacgggggaaaggactgactcaaaaagaagtgagttgttggagaaggcgcccggggacacaaattggagctttggattgttggccaatcggacgaattgcaaatttggcaatgcggcgaacgcccgcctttcgaccaaacgcagaaaatgacagtcgcaaatttgaagcgtctttaggcgaaaagtgaagcggattaattggttaatgtatttttattgcctgaagcattggctgggccaattccccttcggcaattttctcgatgggatttccgctgaaatttagcattcgcagggccacaaattggcggatgtccggcggagttgcggtgaaattattccaggaaaggtcgagagattccaactaaatttaattttaaaaaataactgaataatttaattacttggaaaagtggagaaaaggagtcatagtcgaatttgtggagtcgattatgagacaaattcagaagacggagatgttgggcagcgaaaaaagacgaactctgagggggggggggggagtgatcagagaaaggaaggacaaaatcagactctgatcactttgagaagagtgaatcactcactaatgagccaaagatattttggtggataagcgaataattaattagtcaattaattattaattttgctttggataattaacccatagattggtgattttgtgacctgagctgaggccaaataattatggctaaggtccaattcttcaattgccggactgaagcgcagaatatgttcactgatagtctaaaaaaggcaaaaaacggtgaaaagattagggaaaagggaaaagccaaccaaaaggcaattagcgctgagggaaaggcgccgcaggcgaaacagtcgaaaggcctcccattcgacgctaacgatgcgattggtgttcaggcgaatttcttcggcattcggaaaggcaatgaaactgtgccgggaaatactctgagagagaagagtgatcggagtttaaacatccaaagttaccgtaattaaattttggctgaggtcgagaaaaaccaatgcgggaaaagcgggcatgaaatgagaagtcattcgacgatcggtgaatgagaaaaagctaaaatgaaggtggaagcaaaagatcgttaacgaaaaagaaaatacataaaatttcccaattttggcataatttgccttaattgccatcgtttgactggagtttaaggtgaatcccctccccatttcgtaaaatgccaaaatgatctcctctgctcaccttttctctacccgcaatgtctccactttctccaatttattttcgcgcaaatccaaccacattaagcgttccattggcggcaaaatgtccaaagagtccaattggctgcggacaatgctcagattgagcaaagtcgaggcgaattgttggccggagggagtgccaccgaaaagagaaagaaacaaatgaaaaaaattgagaacagtggataaaagatagagaagtgcctgaaccgaagaggtggcgcaaatcggcacggcttaaatcgctgcaggcgatggaagagccatctgatcagtgaccggaagtcagagggaaagtgatcggtcaaaacaaaataccctgcgaacagtggcatttgaggggacaaatgcgaatttgctgatgaaattggaaggacggcggagaaacggagggagaggagggcaccaaagggggaaggagaagcaatttgagcagcacaaacataagaagcaccggcaaaggcaatggcatggggaagagagggaatgacatcgatggcaaagagttatggcattttgggaacattttggaaaataggcaagcagcggaaaaaagacataaaaatggggaaaaagctgaaaaaacaaagaatttgaaaattaaattttaaaacgcgtgaaattttaacgaattaatttgaaaaactgagaaattaaagcaaaacaattgtggacaaaaatgaaaacagaatgaattggcgaagacggaggaggaaaagcgcataaataattcagcgcttccccccccccgccctcctcactcattttcaaccaattggtccttttgtggacaaagagtatggccaatttaaaacggaagtgtggcattgataggcaattgcccataagaattttgcattagcaaagccacggaaagcccaacggaaatctcgaaaataattcaacagataaattggtctaattgggtgctaaataacctaattaaataaggtaaggcagccacacattttctcatcctttggcacttctcgaggaacgatagccgtgggaaagcgatggaatggacggcaccgccggagggcatggccaatgcgacgcctatcgcaccctcaaagcttctcatttaaagcaatttgaagggattgcgggaaagggatggacagcataaattgaagggctttctcttcccaatcaaattttacgcttcccgaaaatgaaaagcgaaaagtcttagcttataaatatgtttttgagagagacagaggagcagcagaaggccatttccgttgtttttgttgaaaataaaaagcgaagggaggggcaaaggggggactgaccacaactcagccaaacccaagcccaagcccatccaattcactcactccgccgcaattcgactgactttttttttacctttccatcgcaatgccacgagcagaaaaagcaacagcagaagcagtagcaggtgtcaacgtcaatttttgtgatatgag

SEQ ID NO: 6668 - DNA, 1117 bp, Heterodera glycines
ggctcgtccaaaaacggacctttagtccggaccaatgatcaagtccctcggtcccgttcaaattccgaactactactattaattaccaatatatattggggtttttatttattatatttgataatgtaatttcaggcattaaaaacgcaatcggaaaatgccaggaagtgaccgatggccaatccgaacaaataaatgcggagagaattgataaaacaacgtcgaggcgaaattcgcaatttgaggacgaagaaagagaaaatgaacaagaaataagaaaggcacttctgccaaaagcacaacagaaagacatttatttatccgaaatttaattaaaaaataaataaatttttaaattttagcattaaatttttctgtttcgggcggagaccaccgaagagaaatgagaaaatgggccaattgggaggagagattggccaacccaacaaagtcaaaactgagccgacttttgtcgtccatctgaacaaaaaagggagaaaaaggggaaaaacgaacaaacaaacggacattggcaatacgaaatgcctttaaagaattcaacgcatttttgacaatgtccgaagaaacaatttgcatgggaattgtggcattttgacgcacaatttcgatgagtttctaaaaattaaaaatcggagaataatttgtacgacaattaattaattaattacccgttggatttgacgagttaatactgcactcgttaacaagtcatttgaacggttggtgagaaggaaagcgaagattaaatgataagcgatgagaaagggctgaaaaataaaatagtaaataaaaaaagcaattgtaatttgagtgtactgtacgagtggtggtacggtacaaaatggccgttcatttaaaccttcaaaatctgtgccaaatgccaaaggtcggaagtgtccatcaattcagtagaagaaaattcatcaattgaggaagattcagtgggaaaggaaacaaattcgtggtcaaaaagacggcgaagaaaactgaaaagaggaaaactaattgactaattagcttaatgagcaaattaagcggcgcactgataatgattattaaattgatcgtcggcgcacaatcggacaatggcaccaaa

SEQ ID NO: 6669 - DNA, 1303 bp, Heterodera glycines
taattaaggaattaaaccccctttcaaaactaaaaacattatttaaaaaaaaaaatttaaaaaaaagaaaaaaaaaatttaaaaaaaatagaaaaaaatcaaataattaaaaagatcctttcgtacatttttaaaaaaaaaaaattaatccagataaacaattctaacttacgtcgaattaaactaatttcacgtttaaaaaatagaagaacagtctaaaaaagaaaaaaaactaaaaattttacttatttataaaaaacaacaccgatgtaaaaaaatcctgttaactctagagaaattttaaaaaaccaaaaagggtcagaaaaaaataaaaaattttaaaagaaagaaaagaatgacactataagcggtgctatgacgttatataaaaagcatcaattgaaaatttctaacaaaaaaagcctgttgaatgccagatctacactctaagtgccttcattattccctacacatatttatttttcaacctaattccttggtttattctaggaatttggtgtcaatttaccggtccccgaattagtaccggtttcggttagaataatggtaccgggtcgttcatcaaaaaaccatcaaaatgaaaatttttgacaaaaaattatttataactgcgcccaaaagcaaccaaattttaaaaatttgatatttttcaatagccctaagaattttctaatatcctgcaaaatttcaaaaaaattcattaagtttcaaacctgagaaactcaaaaaactttttttgattgggcccctcggtttcgataattttcggttattgcgctgccagtaaattttttgaaaatttgagtgaaaattgttacactttttgtcaaaactaaattgaagaatattttataaacatattaaattatacataagaaatgaaccaaaatttaaaattttaaaggtaatgtttccatttgtttagagtgacgtttccgattttaataatttggcaatttttctgtcagttattttcaatttggtcgcttaattgataataattagggagcggatttatatggataaaaaaatccaaaaaatggattataatatggatgaaaaatcacaaattatggacaaaaacgctgaaatatggtcaaaaaatacgaaaatatggataaaaaatttctgaaaattggtttgaatttaaaaaaaaattctaaaacccataaattttttgtcaagaaagaaaaaaatcattttaatatatgaattatagaatttgataagtgagacctcatatttattcttaactaaaaaaattaaatttacttagaaaaaa

SEQ ID NO: 6670 - DNA, 5560 bp, Heterodera glycines
catccaaaatcgcatccgaaattccccgccctcagtgtaatgtccgcgtgctcaattgttccccgcccccctttggccatggatgaaattgtcaggaagaaacaaattgccgtaaggaccattccgaacctaatttgccaaaaatacagttaaacccaccaaataatgggaaacagaacggcgtccattgtgaccggctcgaggtccgccaaaacggcacttaatgcgagaaattgcgaaagaagcgccggttttctgcgaaccgtgggacaaatctgacgtcagctgcttccttataataaacattgtcacgttccaattgcaagtcagagtcgccccggtaaaagccatccggggaaattccatattcgtcggagatgagttcccaagactaaatgtgtcacagctgaaatgttgccccgatggggaatcacctatagtctgatctaatattgaatcaggtaaaagaaatcaaataaacgtttatgtcccaaaggcaaatatggtatcagtggaaagcccataaaaaatggtatccaatggtatgctacttatctgttgaaattggaaaatgacaattttatacgcaattgtttttttcaaagcatgatgggacaacacttatgaccatgactgtattcactgctttccctcaacaatatttccaaagtggagacaattcactttatttaaatcagcaacaataaaaatggggggaaagtacgaggaaaataactgataacaacaatataaaaagtgctctgctaacagaatgaattgaagggaagccggggggaacattttctgctgggaaaggagtggcaaaatatagattaggcgagagactacactgacagacaatgagacaaaaattaagaagggacaacataattactaaataaaatgccaataatcaaacattaacacatcccgaccctccgagaaaaaggcgtcccctgccttttatgctcattcgcatccaataggtggtgggcgagttcagcttgtgccggcgtccgtctcctagcattccacgatcgggctctttacggcattttcctccacgataaaaaattctttggccaaatttggtgttagtctcgccgcgatggaatgatgattggggacgagagtcagggcggcgatcgcatagatccaacctcccatttgccgacgaagccgttgttgggctggccttccccctacccaaattttcagttgtccccaactgaaattggtccaaaattttccgtctccaaacgcgctttatcgcccaagcaatttcgccgttttccttccgctgtcgctgcttcttccgctctcctaaattctctgtggcattttgaattgtcgttttctccacagttgtgtgcttctgttgccgatgtttcttattatgtttcttcgtcttagtgccattttttgggcccgactcgtcctttctcttccctccaaagtttcgcggtgttttgtccaaattttggccatcaacaacaatttgacttttgatcacatctttctatcgtatctgatcttgtcatgggacacaaatgttttgaaaacgattaaaggcgaattttcgggcttcgaagctggtgtgaagtgtacgatgttgttgttcactacatcgagcatttttaagcccaattgattcaaggcattcgtgccgaaaatcaaatcgtacccaaaacatgactctgcgacgaatacacgaattttcgtgtttaaaggcccgcgctcaattggcagagaaacaattccatagcacttcacttcctttccgtttatgtcgatgacttgactttcggagcgggagatcacatcctttttgctaactttatccatgatttgagagaaaaatttggccgaaatcagtgaaatttgggatccgccgtccagcatggcatccaacttacgtccaaacaccgaaactttggtcgtcaaaattataccaaccgccgggctttcttccaaaaatcgacccttatccgactcattcgttgcttttccgaagaatttctcaatctcgggacggtgttccaagtttatggcgccaactaacaaatttccctttttcggcggttcgtcattttgttgattcaatagtggtggtggtgtcgactggagattgcagtttttactgatctgatgcgtctgatgtgtcggctgtgaatagcaatttcgagaagtgtgtccgactcggccacaattatagcaaacaatatgccttcgttggttttggaaacagccgttgttttggctgtttcgccaagaatttcgtgcggcattttgaactgcctcggctcgtgctgcttgtgcgatgaactcatcgaatgttgcacccggtttacgagtcatctccaaattcattgccaattctgagttagggagtgccctaatgaaatgcatggccgaatattcgtcgtagagctgttcgctgagccccggatatgcacaacggaccaagcgcgaaacacgttcgccaagctgatcaatgccttcattcggccgaagccaaactcctttcatcagttggtcaaacgccgtcaattgtttggcgtccgtgtcgtccaattgccgaatgatcgatgttctgatcagttggtagtcatggcgattttcagcaaccgcggaattgaaagctctctcagctttgccaaaacatttggaacgcagcgcccgaactcgcttctgttcaggccattcttcagtcgcaatatcaaattgcttgaaaatggcgttcaccgaatcggagcctctactgccgtccaaattcggaattgtgttcagcgtcattgtgtttgaaaaaccatccaggcttcgaatggcctgtgccatcatgccgtcaaatataagccctggatttggaacggtcgctcgttgtcttcgaatccgtttggccgatggttaattgtggcaatattttgactgttatgtcgctgatgaatttggttgccactatgcatcaataagtgtggatttggtggtgtccgtcgcggaattgctggccgttgggcctcatcaaaaagtggcctttctttttctccgtggccaatgttctgattgccatgtctcgacaaatctgcacttccatcttgtctcatcattacttgaagaagtcgacgccgaatttcgttttcatccatttcgttggcgaattgcacatttccttcgtgtataattgacgaattagtccggcgaatctgctcgagttgtgttcggtcatccctctaagcggcggtgataaaattcggcgtttcgaagtccaagacgttcgcaacaatgcgttaataaatcggtaccaagtcctcacttatcgcagcaatgcgttagcagtgggacgaaatcggtgaaattcgcagcaatgcgttaaaaagcagaacccagcaatgcgtttgttctttccgcaacaaaagaaaaatgcagaaccgcaacaatgcgtttgttctggtcgcttcttcaaatcagcttcttctcaatagtccaaaatttcataatgccggcacagctaactcttcgccaggagcgccacgtgctaaacttatgctgtttgggtcggggcctattcactgctttccctcaacaatatttccaaagtggagacaattcactttatttaaatcagcaacaataaaaatggggggaaagtacgaggaaaataactgataacaacgatataaaaagtgctttgccaacagaatgaattgaagggaagccggggggaacattttctgctgggaaaggagtggcaaaatatagattaggcgagagactacactgacagacaatgagacaaaaattaagaagggacaacataattactaaataaaatgccaataatcaaacattaacacaaaattaatttttacacgaattttgctgatgaaaaatttttttcacaattttttttttcgattttaggacgtattttcaaaacttttccatctttaggggtgtatttttcgaattttttgagaaaataccgaaatatggatatcaaatatgtaaatatggacaaaaatctgaaatatgaaaatgtggaagcaaaaaggcatactagaagcatcaaaccaagctaaaaacactatttacgtggtttttaggccgaaataagtgtgcaaaaaaaacatggaaatccatacaaatccggtccctaataataagtagggatgggatttattgttttttcagtatttttttcctgagctccccgtagcctgaaatgcacgaaaaacatgtttttagtggggttgttaagctacttttcgagttattagcaactattttatagttttttatttttagcaactaaaaaactataaaattttgaaaaaaactattttcaactattttggcgttttgtgctcatcttgctcaatttttttttcttcttctgttgagtaccgattcctatccttcaataataaaataaagatttgaaaattaatatttaaaatatgaaatttttttcctttttccatctttttagagtgctgcttccgatttccaaaaatctggcaatttctttgtcacttagagaaggattttctttcttctttttataatacaaattcattttgactgttttttcttcatttgaataggcatttgcttctgaaaagagaaatttttcaaaaaaaattttaaattaataattttacttttgccaatttcgatgccaaattcttttttccattttctgaatgtttttctgtgaatgcccaattctttcgcaaattgcttctgttttccatttttggacattcttttaaattcatcaattctttcaataaattcctgctttttcttttcgtaataattcttttcattaaaattcttttcataaattccaaattcttttttccatatgtaaatattctttcgagaaattcccaattttacgccaattttttgttcaattttatttctgtttttttccgaatattttcctcttttattaataccttcttttatagcgtgaaatttgtggacaatttcgtgttttttgtggtcattcaaatcactggcaattgaataatttaattcattttgattattttgataataatttgcattttgttccctttgccaatttgaattttccgaattttcattttcccattctttgccaaatatttcatcaaaatttggccgaattttcccattcttttcacacaaaatattaacagtcaacgttttgtcatttaaattgattgtgcataataatagcacagaaattaaatgataaaatttcattttcttcaacaaaagcaaatgaattttgtaatacaaaaataataaatattattttgggttttatttttttaaggaaatgaatgagtagcgagaattatttatttttatttttaaattaattttgcatacaaaatatagttttttgtggttttaatattttttttacgtaaataaggaaaggaaatcccatcatttctttcgggcttcattaatcaatatataaaattgtccgaaacgaaaaatattttaataaaattgtataaatttctatctctctctctctccttctctgtctcttttctta

SEQ ID NO: 6671 - DNA, 1037 bp, Heterodera glycines
tgagtgtacctccgcggtcgatgctgtgttttgtcattccattttttgtttcggttgcgcaacattcgatggaattgtttggtcgaccaatcgaaccgattttatcacttaaaaagcaaaaacaaaattagatcgttttttcgtacaataaaatgtaaccttcttccaccggaacatcggaaggtgaaatgatgaggccacaagtttggaccacattctgtaaaaaaatgaagaaattattaaatgacacaactgtttttgcaaaatcaaagatttgaaatgccatggatttacgaattcaatggaaattctgtttgttttttagctgtccgactctcttcaattgtaagccaaaatgtggaaattggaataaagtgtgagaaataggtcacctaaatccctttttttaaatttagtcctgaaatttttaaaattttcggccagtttagaaccccaaggctaaccgaaattaaagtaaaattgggatttttaaattttgggaattcgaatgcgagtagtgtcaccatcgctttgtcttgtctttgtccaccaaacgcacctcgccttcgtccgccacactgccgcattcgtccgcctcgctgaccggggccgaattgttggtcgcctcatcgtcgtcatctgcgcacagttcaacaaaacgttgctgcaccaactgttgttgctgatgtggctcaacgacagcggacgactcggcaccgacggacaaagtgtcgacacgacgagaggacaacgccgcggcggtgcaggaggcggagggcgaagaacagacttgaaaaaagccatttaaatttacgattttctgtggcacctgaattggtacgagcgttgaatttgatgatgccaatgccaatgctggtgggtcggtcgcgactcatggattaataagcgtggaatctaaaatttattgggtggattattcgagatcagtgatgactgtgattttggcggtgtcattatatctcaagctgtcatcaaaaagttcaaaataagcacatatcactcgtacaaaaactaca

SEQ ID NO: 6672 - DNA, 1497 bp, Heterodera glycines
gttggatttggatgccaaagaaaaaagcttaagtggaaaaacgagctggcgccgaaacgggagcgccgaaacgcgagcgccgaaacacgagcgccgaaacgcgagcgccgaaacacgagcgccgaaacgcgtgggtcccacgcgccagtgtcagacaaaattgctcataacgccaaatagcgcatttggcgtaaatttttgcgcgttaattcaaaatttacactggaaaatgcccagacgcaactggccagacgcaactgacccgtttcggtacccatagtgaatgttgcgggccaggacgttttcgtaccgccattttcgtaccgctgttttcgtaccgccattttcgtaccgccgttttcgtaccgccattttcgtaccggggacgttttcgtaccgccgttttcgtacggggacgttttcgtaccgcaggggggtcgttttcgtaccgccgttttcgtacggggacgttttcgtaccgcaggggggtcgttttcgtaccgccgttttcgtacgggggacattttcgtacgagttcttgtacaagcgtcagattcaaatagaaaaacttaagaactaataaaaccaaaatttatcattttttgtttcccattcataaaattttgtagaaaattcataactttataataataacaaaatccgggacaaactaggtcgcatctattaatttcggaaaataccagcgagaaaattgttaaggttttcgggattgacattggcattggcataattgtgatcattttgagggacaatattgttattgatatcgttatagcgtttgacgcgacgaagaatccgtgcgtcggcatcgcgatacttctttttctatgcaccatcatgcaccaatttatcattatttagttttgttttaattacttgctgctggttcattttgtagttaataaaagcttaactgtcaaaacattaaaagtaattaaaaaaaattaacaaattatttgaatgcaatttttctttttgcatatccactcgtacgaaaacggcggtacgaaaatgtcccccgtacgaaaacggcggtacgaaaacgtccccggtacgaaaatggcggtacgaaaacggcggtacgaaaacgtcctggcccgtgcgaaaacggcggtacgaaaatgtccccggtacgaaaatggcggtacgaaaacggcggtacgaaaatggcggtacgaaaacggcggtacgaaaacgaccctgaccggaatgttgaatgttatgaatagggctgccaattttatgtaaatacatttttttttcctgacttctccttgctctaaatagcaggaaaacactttcttttttgtgtttacgaacaaaaaccgggacttttatttacatatttttacatatttcgggattttcttacatatttgtacactgtgttttttttacatattttgagtattttttacggaaatttttggaaatcctcaaaaaaaaaatccaaaatttcggtaaatattttggtac

SEQ ID NO: 6673 - DNA, 1067 bp, Heterodera glycines
cagtagtttttatagtcccagaaataaaaggcggcgtatctcagcgggcctaaatcgtagacccaatattccaaaggcaattcggtagcaaattttgtgctctataaaatgggcctactcaaaatttccagaaaaattttcccaaccccctagaaattttttttgaaatttacccctcgttcccagccaaaatgggctgatcagatcaccatgaaggagtgatctgatcaacttggtgttgctaccttttttgatcagcatccaaagttatgcttacctgaatttttttagatttttttaatgctgatccagagaagcaatattttaaaaatgaaatgggacaacacttttgaccacctatattttgatcaaattgtgaatatggtaaaataaatcaaataaatgtttatgtcacaaatgcaaatatggtatcattggaaagcccataaaaaatgctatccaatggtatgctacttatctgttgaaattggaaaatgacaattttatacgcaattatttttttcaaagcatgatgggacaacacttatgacccatgactgtattttgaagatttataaagaaaaaataagtttgaaaatgttgcctaaaaataccaaaaaaagtaatttttatgtcattttgtggctatttggttgtaggacatttgcggtccagacatttgcggcctgctgaaaatcgaacatttgcggcccgacaatgcggtcggacatttgcgcctcggacatttgcggcccatttcttaagggccattttcggacatttgcggcccgacatttgcggcctgctggaaatcggacatttgcggccaacggaacgccaaatgatcacttttttaattccaaaaacgatatttgcggctcaactttttcgaccccaacaaaatataaacctgagaaaattattttccatccaatttaaccgattttatgctatctaataagcttccgattcaagtcttctagaaaaaaataatttttaaccccacccaacttgaagcaacgaagaggaggaaaagaataccagcgaaacaagaccctaaattatga

SEQ ID NO: 6674 - DNA, 2322 bp, Heterodera glycines
ttagggctgccaattttatgtaaatacatatttttttcctggcttttccatgctttaaatagcaggaaacactttcttttttgtgtttgcgaacaaaaaccgggacttttatttacatatttcggggtttttatacatatttacatatttcgggattttcttacatatttgtacatattttggatttttttcatatatattttcattttttttacatattttgagtattttttacggaaatttttggaaatcctcaaaaaaaaatccaaaatttcggcaaatatttttttacatattttgaaaatttataaagaaaaaataagtttgaaaatgttgcctaaaaataccaaaaaaagtaatttttatgtcattttgtggctatttcatattttacggggattttctttcccaaaaataccattaaaaaaaattttatttacatatttggggttttttgtacatattttggaatttttcttacatatttatgtacatatttagaccactttttgtacatattttttgcagccctaataataaaagtcaacgtagaagcctcaaaccaagtggaaaatgtgttgtttatgcttaatatatcgaaactaatgcgcagaaaaaaaaggcagctctagttattacgtaatgaaagtttgaaactcccacaaattttttctgaaatgttaaatttcttagcatttgctttgaaaaagattctccatttcaaaatcttttttaatatcaaatttgttcagtttagctggaaattaagcgagttatgccagatcatcaaaataaacaatacaaaaaaggcatttagcagtatattttttgaatttgcgcgcaaaaaactacgccatttatgctatttggcgttatgacgcaaaagtgatcatttttgaacaaaaatttgttaaaaaattatccaaaatttcaataaattttcacctgcattagacactacccataccctaaaattttttaataacttttaaaaattccattttttcaaaaaagagatcctaccataggcagttttacaatttttgtctttaatttttctggttcaaatggctgttggcaaacaggtaaaactaaaaatacaaacatatttcaaaaagaaaatatcttattttaattgaagaaaaaatccgcggagaatatcaatgcgcggctggccatggtgacaaaatcgggcaaatactgcctgggctacaaacaagcgcttaaaacacttcgttcgggcaaagcaaaattggtgatcatctccagcaacacgccgacactcaggtgcgattttgttttgaaattgttcgattttttggagaaaacttaaaatggtggaaattttttggatttttgaggggcagatcaggccgatttaaataaattttctcggcggtgtctactgatactttgaactactaatttctctgaaatttccaattttgactcaaaagttcacatagcttgacaacttttggcataaaaatgagataaatttcataaaattttttattaaatcaaaatttttggtaaggaaaaagtctttgtatttacaataaagttgccatttatttattcgattgtcacaattattgttttatttgttcatggcctttagacgcagtgaagttgaatactacgccatgctgtcaaagacgggcgtgcacgagtaccatggcaacaacatcgagctgggcaccgcttgcggcaaactgttccgagtgtccatgctgtccatcactgacccgggcgactcggacatcattcgaacaatgccaaccgaggcctgacaaatctctgtgagctgttgtgatcacacactgtgctcatcgccgttgaatttggccgaccaacatccgcccaccattttgcagaagcaatgcgcaaatacgtgctgatgtgtgccgactgggtgaacgcgctgttcacgttggccggcctcgacaggaaaaggtgtggaaaagggcaaaaaaattaaatatgagaaagaaagcacaaatgaatgccgtccacctcccgaaaaaacgggtttcataatcttcggattattgggtaaaaatgcgcggtttacgccaaaatttgaccgatttgaacgtatagtcgccgacttgctaaaaaatcgcaaaatttgacagtttttgatgaaaatctgttaacaaattgcacacgaattttcaaaaattttccccggctgcgcctaccggcaccaccggcccccttttgcgaaattttcttgaaaaaagtgcgccgcaaaaaaaagtgcttttaaaagcaaaaaaaaaaaaggtcgatttacatggccgtgaccccttcgcaaaa

SEQ ID NO: 6675 - DNA, 7629 bp, Heterodera glycines
  misc_feature (7546)..(7546): n is a, c, g, or t
cttttgaatgtttctattaacaaacaaataaatttatttattatgaattttcttatcaaaattttctatcagcacaaattaattccagtacccataaaaagggctaaaacaaacaatcaattatcaaagggaaagaatgcgggaagggtgaccaataaacaaatcaattaacggatttttgactaatttcggtttgaatgaaaaaaggaatgggggaccgtataattaaaattatattttattattattaaattaattattaaaagattaattaatattttaaattgtaaaactaataatgatattttataaaatctcgaaaataattaaaattatttattttttcttaataaaatgttatttttgatacataatttatacagtccctttttagcttttcattttactaaaagcagtttatttggtttattgttaaagaacttttctcaagatcatcaaatttgtatttctattcgctcaaattaataacagtactccttaagcgcgccaaataaataaattatcaaaagggaagggtgggggaatggtacccaataaagaaaacaattaatggatttttcctaatttattaataggttttattaaattgttttttctcaaacaatacttataattttttatttttaattcgcaaataaaaaatttaaataaataattaattattctataattaataaaaaaattccatggaaggagtacccaataaagaaatcaattaacggaattttcctaattaattaattaattaaaagaattatcaaattggtatttctaaacaatataataatttaattttaaattcacaaataaaattataaataatttaataattattctaaaattaataaaaaaaacattccattttgaattcgcaaatatattttttctttctcaattaaatattataatatcatgcacaatttattttcaattatcaaaagggcatggtgctggaagggcgtcaaataaacaattcaattaacattatttttgactaattttcgcttttgaatgtaacgaattgggggactgtaaaataaaaattaataaactaaatttaatttaaaattgattaattaattattattctaaaattaataataaaatattcatttattcttataaataatttaaaaaattattttttttcttaataaaattcatttttaatacaatttaatttactacctccatcttaacttttgattttattaaaacaaatgaatttatttatggttgaagaacttttctcaacatcataattaaattttttatttctattcgttaaaattaattacagtactccttaagcgggccaactaaataaataaattatcaaaagggaagggagcccaataaacaaataattaacggaattttccaaactttaaagttaaaggaaatgatggaccaaataattaaaataatatttataaattaaattaataattaaaaagatttatcaaattattattattatttctgaaataataattatattttttattttaaatttacaaataaattatttatttttctcataaaaatttttttataacagttttatttacctacatgattacttttgtacgattttattatttattttgaaaaattttctcattgtttattcgatttttccttgttttcattggcggtccgtcgttctcatctaacaaccttattcatttccctatttttttcaaatcaataaggttctttattctttgccattttcggctgattgtcaaaacttaacccaccaaaacaaatgaaccgaattcgaaaagcatcgacagtacacagcagaaatgaatcaaaaattccggtgttgaaccctaaagccgatgtttgtaaaagagcaaattaaaatgagtcatttctcggtcttataacctcaaaagcaaaactttgtttatgtagcagcaaacatgttcaagggggagtacatcatgtgcatggaaccgcgggtgaataggaaacataattttgaattaccggatttttaggagtacaccccaaatctcaccggcgaatttttttaaataattaaacttattattataaaatttttttcaagaaataaagttgaaatgtttttcacgatttttcttgaaaatttcaaaaaattagtcataactttgtatgcgcattataaaaaggtgctgtccgggctcaattttaacctcagcgtgccatactccatgcagtttctgcgtcgctatcgcttctacgatttgccgtcaaaggtgtgtgggcgtttgcgaagttgtcatggtctgctacgcgctggcccacatcccaccttccgttgttgccgccgtatccctccatttggctgcgtttgcgtacgcatgttcgctgcggttgcccgagctgtttgtggacacgttccgaatgcccgaggcggtcatggatcgcatttcacgctcattcgtcgaccatgttgttttacttctaaaataatcagcccgggccggccttttttgaaaaattctgtccttaacaggcactacaaacaaattttattttctgccccgacaacgcttctctgagtataagagggatgagagaaaacagcttgaaggcgtgcaggctctgggccaggggtgcaacattgacatgcacctgcccttatattccatagaggaatatggagaaataattcaggcacaaaattttttattcttcgcaatatttatcattaaggactattatgaggtgctccatcccggaatgtttcggcttttctgctttgagacgtttggaaaaatgaagccttcgtggaaatcaactgtggaaaattataaacatgaagtctgcgttatttttatcgacggtgaaggcggtgttgaagggcactacgacccggttaaaaatgttggaaaacttttcagtgcacgcaactattgttttggggtatttatagataattagaaaataattttttttaggctgaaaattatggcactgtgctggacaccatgccaccaattgagaactattacccaggtggactcttcccggcagatcgcgcaaagtttgagcaatggtacgacgagaaccgggaaactgggtttgagctcaccgaagtgatcgcggattattgcaagacaggtacaatttttgaagaaaaaacatgcaaaaataacaaaaaaaattgaagatgtccaaatcctggcacatggtatggtaaagatgaggcagctgtttttgtctgagacgcggcacgacataaccgactcggtcaccatcccgtccggttgcatgaagtattgggtgcagttggctcaccacgacaaagaacgggttgccatcatcccacacttgggatacgagaagcgaggcaaacagagctccatcgccaggaaatatttgaaggtgtatccaaattattttaattttacattttgtcgactctcagtggcgtgccgaagaagaattgcgggagaatggccgagtccaacgccatgtcgaaagccctggaggggagttcaaattcggaaactacagcttggacgggatgatggagcgccctgatgaggacaaaaacttggccatcgaggtcaatgggtaaggaaagaattcgaaaaatgtgccaatttacccattcaaaaggtgctattggcatggatgcccaagctgctttcccgacgatgcggcaattgtgggcggtggtgagacagcaggagccccagggcccgggacgcaaaacgaacccgggacattgcgcgggaattcgaagtggaagtgatttgggagtgccacttgaacgcaatgctggaggacaacccagccatgaaggcgtatttcgacaattgtccggattctggcccaattgacttccacgatgccttctttggcggtaccttttccatttaatttttaactaattttccggcacaggtcgaactgggcccgaatacttgggcgcttcagtgatcaacccagagacgggcgactggaaaagccgaacgatcaaagtgaaagactttaacagtctttacccatcgcggtatgaaaatgcgaaaaaaaataattaaaatctttgaaaattacagaaacatgttcaccaattacccggttggacaaaccggacgctgttccccctctgtcggacgtgttcggaaatgtacccgcgcggcttgatcgaccccgagtacaattgcgatcatcttgaggactctgaaaggggtgagtttgaagcttgtaattaagcaaatattttttcttaataggcttttcgacaacagtcacacacattgagctggaagccgctctccgctcgtggtacaaggtgacgcatgtgtaccgtgcctatatctggcctctggcgtgcgattggagcaatgggctgttccactcgtacctgctgaagtttctcaaaatgaaatttgaaggtaaaatttaaaaaaaattaataaaaatcattaacaaaaatttaagcaagcggatatccggcgtcttgtacggaggcgggcatcagcgaggaggagtcggcacggagaaagcaggaacacatcgacaaggccaaagaaaaggcccaagtccctcttgaggcggaccgaatcaaacacaatcccgggctccgctacctgtccaagttgtgtttaaactcgctgtggggccggtttgcacttcggtaaaattttggttaagaattatgaaaaaatacaaatcatacagaaaccggcttaccaaaaccgaaatcgtcgagtgctatgccgagctggccaaactgctcaacgactcgaagattgaggtcagcagcattgatcagctgacggaaaagttctggatggtctgctaaaaggccaaagatgagcatgtggtggagcacagcacaagcaatgtaagaaaagttttaaaatatttaaaaaaaacaattgaaattttctcaggtggccattgccctatggaccacctctgctgcgcgaatccacttgctggaatcgctgaaaaaggtgtatggccctgcaccaggtgtagagcgctacgacacccgcattctctacatggtaaaattcagaaaataaaatgaaaatgtgaagtaattttttaaaatcaggacacggacagcatcttttacgactacctgacgcggctgggggacccacttccgggtggtgagcagctcggggagctcgccgacgagtacccgaaccacacgattatggaattcatttgtggtaaaactcattaaaaaaaaatagatcaaaataaatggaaattttttgtttagctgggcccaaggcgtacggcctgtggttgcgcaacaacgcgacgggggaggacgagtacaagctgaaggtgcgcggcatcacgctcgactcggatgcctgcgagcgcatcaccttcgagaagatgaaggacatggtgcagaacaagctgggacagccggacaacaacgtccgcttcaactacccaacgaagaacttccgcatcaccaagaagggagaaattttcaccgtccccttggtcaagcagttcaacccgacagtcaataggggggtgatcagggatcacggcttgaaggtggtgccctttgggtacagcgacgaagagtggtgtaagtggaactgccctggcgcttgtacctgtctgttcaacccagacctcaatgtgaacatgttcacagaagaggagctgaacgaccccgacattatgccataattgtttttattttttaattttcattaaatttgtaatatttttattcatttatttcttcatttgtgacccaatatttttccggaaatccaatgaatttcaccaacatttctcttttcccatctctcactcgttctttgtatttcttttcaattcgatacattgtgttttcatccacttgtactattgttaattcgggcaaataaaattttctcttcaactttgtgccataatagtctttgagcaaataatgctgggggttggttgagcgggcctcatccacagtgtaaacgtgatcagagtaattggggatatagccttaaaaatttaaaaaatgaccggaaaatgtgtgaattacagtacccttctcgaaaatgtgcttaggctcgggaatcctgaccgtttcccctgctcttatttttggtgtcttgttcgattgtgcgagtccttcgccgtacaccctcttccacacctccctcgcattggtgtcgctgatttctctcggtctaagtccggtcgcgcggcacactgagttgttgatggcactcaaaaactttggcagcacatccacccacaccgatgtgttgttggcggaaaaatatttgtacagccgagtctttagggtgcggatggcacgctccgccacggcggcctttttctttgaactggtctcaaacttttgaatgcccttctccgcgtaaaactccttcaacggttttgccacaaactccagccctcgatcggtgtacagtgtgtccggcacccttggcatttactcaaatagctcctcaaacgcccttttcatgtccactgggcgcttactctttacgggcgcgccgaacattcgcctcgatagaacatccaccgccaacagcaagtaacggtagccgctgttcttgcgcgaaagggcttggaaatcggccaagtcagcctgaacatctgaaccctgaattgtgcgaaataagccccagtacaacttaccggtcatgaaacccgcaggcacagtgcgtaggcgtcggaacttctccctctttggcttgaacagcgtgtaggtggtgttcctctgcaaaaagtcttcaaactcggtacgcttcaacttcgggtgcttcttcttcaccgccgcgtacagggcactcgcacccgcatacccgcccggattggccgggtcggtgtatattttgtttattttcttgtccattttgagggaacaaatcctctcgtttgtttgacttgtccgacgaacccagacccaacaaacagtcgattgagtaggctactggcaagcggattctgtgcgagtttcctcttcaactctttggttccgcgtggcgaaggggcattctccgggcgagggtccaccaggcgttcaattgaccaggccaggtccgagtcgataaactctcggcccgtctttgggttaatgattttcccacggtcagttgcgccgaatctctgcggatcagacataatgatggccaacaggtggtccttcttctcgatcaatttttgctgttttgctgctttcttattggtcctgggtgatcggctgcttttctgcgtctggcttgttagggttaaaaactttggcacttcaatttcttcctcttcatcttcgtcggtaactatcacggacttgtccttcggttcgtccggaccaggccgtacctgcacacccgtctccactgttttatttagcagttgagcgccgttgctgagctgtacccggacgggccgctccttatgttccttgcgcatcttcaggtaccggcgcaggtgctggttgtacactgcgttccgttcgctgacgtttcccttccgcttctgtactgcagcggtcatttgtcgtttgacaagncccagtttgtccgctcagaatgtcggtcgtcgtcgtcattctttgtctccctcgctgcaccagccccttgtagtgctcgtacg

SEQ ID NO: 6676 - DNA, 2131 bp, Heterodera glycines
  misc_feature (1258)..(1258): n is a, c, g, or t
aaattatccaattaggaaatcaatttgggatttactcagttcttctgagttttgcgcacggaacagtgtccgactcggccctttgagtgccgccgacccatccaccgccattgtctttgtgctcgaatatctcgtcgcttctcgcacggcggccaatgtacgaattgcacacgatcttttcttcttcaatcaatgcttgcttttcgggatatcctttccgatgttcggatggtccgcgtcggttgggccgcgtggactccgtcgccccggggggcggtcagtctcgcggacactgtcacccttcaggtgggccgttgttcgacgggggttcagttcgaagttcggttcagctgcttggcgggccccgtcctgctcccttcgacggcttctgtcttcgcgacctttcccattgcgctttcgtccgccattcaccgattgtccaacgccaattcccttctccgtttccactttcctgcaccaaaattcaaattcgcttcaattttgtgccattgatggttttgttgaacagccgaacacaatggcatttttggaacattttggcatttctaaggaaagcgatcgcatcggcgcactctctctgctgtcctcccatcagcaaactccgctgcctcggcccgaccttcggccgcgctcctccgctgccacccgtcaagtcgaacacgtacttcccccgttgccacccgcggctcagacaaaaggcacttcggaatcgcaaaagttggcatttgaagaagacgacagagaagaagcggaattggaggaattgttgtcacccgtcgaagaatgaccttatttacataaaaaagcaattaattgtttaattttagaaaaaagacgaaacattcgcacgccacagaacaacaacagaacggcactgttcggtgtccgtgctcgaaaattggcaaagtgccatagaagtcgaactcccttcggcgaggcaaatcagcagcaaaagcctctttaagctttgtcttccaccccttcagagtgtcggcttttcctcgtcgagtcgttcgccaattcatgcgatttcctttcccaaaaatcatcgaatcggaccaattcacgcacatcaacccgatggaaaaacgacaaattcgtatggaattggagcgaattgacaaattcggggccaacgaagtgtccattcagtttttggcattcaaaaagtgcacagatttggcatcattttctcttttgttcgcatattttaatgtgttcagattgggctccttanacacaattccttcttctcatcgtctctttttctccttccaatttttctcttttgagcccattatcactgaaaggtgtttttcttatttatttctgatcagtgatcagtgataaaaggtcattgattaaaattctttccttctcagtctttttttggacgccgaaagtgccgaaacgaacgacggcgaagagccaaacgtactttaccgaaacggcggagaagaggagcaaaaggccccggggcttatcgtgagcaaatttaattgtcaatcaaattacaatttgcaaattttaggttcgtttcgtcgttggcagtcaaaaaaaggaatttttgcgttatttgttagaagaaaacgtccatattcacatttgggaggccgattcattgtgagtttcttcttttaattttcaattatttctaattaactattttaggttttacgtcggctcaacttccgtgccccttcaggtcaaaagggggagagagagaaaataaaaaataaacaaatttatgttaattcggtcaaacagccctcggggggtgccgccggtccctcccattcacatttgcctgcccttttgccccctccccgtagtgccattcccactcccctccccttttaagatgtttcgccaaaattgccatttttatataaaaatttatgagtattttaaaaagcgcattttggttacccttttttatttcgtaattttatttataaatgcaggaattgtcttttaactttttgatctttcgtctgtggatcatttgtctctgtgcgtgcttttgcttcgataaaagccacaactgtaccaaattaaaaaaacacataattaaggcaaagaacgtgagtaactaacaaaaaatgaggag

SEQ ID NO: 6677 - DNA, 1477 bp, Heterodera glycines
caaattgggggggtccatttcagtcctgataactttagtcccttccctttttgatcattcctttcaatgactcatttctcagtctttgccatttcagtcccttccccttttgaggtgttttcctccgtcaccacttcccttcgtgcggaagcaattggcggccaattggttcatcttcaattccaacttcgaaatccgtttcccgaggattgcatttgcgcaatggaagtgaacgataagcggctgagcccggtcatttcgaaaatggagttggaatatctgagaaaaaagcaccaaaagggagaccttggccgtttcgtattcgaatgggaagaagggacaaatggatggacgaccgttttgaggggaatggaaagggttggtgaggggaaagagaggatagagatgaccaatcgaacaaacaaaggtccaaatggcacttcgattcgacacgggcaccgccgaaagggcgtgggcatctcccacggaagcgagggtcggcgcaggcattggcactgaaatgccaaaccttttctcggtttaggcatttttccggcggcttccccacggcaatccgttggccattttggaagtgtccgtttccgtctcgcgctccttcctcagtgaacacttccagtggttctccgacgaaggtcggaagttggttcgggcagtgcccgtcagtcggtcgccacttccgaaggcgtcgtctgtcagagtgtccgacccggcggtgctttgttcgcttcagccgagtcattcctccgacgatgccattcagcttttgcgaattgaagtgccgtccctttttgacacatttctctcaacatttctccacttaagtgcctttctcgaggactgtccgaagtgcgcgacttttccgtctttttctacgccgatcctttcctttccgaactttttgccgtccatcgcttttccgtccattcaatcggtcggctccattccgtggcggtccaaggccaagaagtccgtgtcccactcggcggattcgtccgccctccgtctggggaattggtccgtctgttctgctcctctgccgtgccgtgttcctcggtcggccttttgccgagtccgtctttcgcctcctctgcccattctctctcccaattggccgtcctttttcgtcctctttctcttggccattgtcagcttctgatcagtgcggtcgccacaagcacttgtgcaatggtaagaatagcaaattgggtaaaatgaaactgatgaagtgaacagttgggccaatggcttctcggagtaacggtggacgagccgaacattgccaaagtgttcgaagtgattgtgccgcgggacagcggcggcgtcgttcgcaaagtgagcgatgcggctgatttggcccgacatatgccaatgacgatgatataatttccattattcagcgaatcccattgcgcgggggcgttgggcatcccccgtcagttccgactcgtctcttccg

SEQ ID NO: 6678 - DNA, 1381 bp, Heterodera glycines
ccctccaatccctcccaattcgtccctccctttgcttctgctcatccaaactccccaggccaggccatgcactgttcaggtgggcaatgttcggcattttatttttatgtgtttcaagtgcctttctttctttcttttttttgcgcatttactctaataatcgttttgctccgcaacagactctgctgttcgtggaggacattcaaacgggggccacggagggcgcattcgctgtgaatttgcgattcgaatgaatgacgcggcagagaagaagagaagagagcacagtgcctgcggatgttgttgttgttgctgggatgggacggaatgttcttcccccgggaacgtggggggagtgggacaactgctcgcctttctcttgctcaacttcctttttcttcctctttcttcctcatttcctcctccctttcctcttcctttttccttttctttctttccctcttccttttcctcttcttttccctcttccttttccttccttccttggcccatcgtcctacacttccccctccccttcccccccccccctccaccaattaaacacatttcctccgtatccctcaaacttttgcctcaaacccttgcaaatactttctttcgtttggcaaaggcacttagtcgaggagaagacacagctgttgatgaataatatggcggcaggatcgagttcatccaaacaactcaactcagctcttccgacgccatttgcccagcaaagcaaagaatgtccgtccgatccgtcggtcccttctttttggatcggtttgatcggagggaaagagcatttggcgaggagagagcggcagagagggagagacatcgctgctgagaaggagcgccttgggcattttctcgaatttcccgactacataaattgaatgattggagaggggggagagattggattgggtggcgatgcattttttggctgcatgggataaagccaccacccgggcggagaacaagcaccgttgttggctcatcgtccgtccgtcccactcggcccacccccggcccaattccccgccccccgcccaccccacgccattgataaactcatcccccgacccattcagagttttatccgttcacaattttctccacctaatcattggtttaatgaaggccaaggctttaatctcagtcaataaaagcaaatgttttaatgaatttatattgcgaaaataatgcaaatatcattttgatatatggctcttaattcgatgatcatataatcgtcactaaaattataaaaatttatactgcagagattatccattattgagtatgtttttcctttctaattacactaaacatgaattacattgttcactttactaatgcatggtattcaaaattt

SEQ ID NO: 6679 - DNA, 2362 bp, Heterodera glycines
agggactcattcccgggaaatggccgcccccacacaacggacacccgtcgaatgcctccgagtcccgtcacatctgtcggcttcgcccgtcttgccgacgccgatcggctccctctcccccggcttttccttcctccccaaatcactcattcttccgcccccccccctccgtcttcaaaaagcctttcatttctcccaccgccccctcctttcttagcaacttccattcccttaaggggcattcgcacttccgaccattttccgccgctaatcaccaccgtttcatcttccgtcctttttccattcttccgcgagcacaaaaatgagcgaggccaagtcgtacccggaccttgagggggacccgggcctcccctttctggccttgtcccgcgaggatgtgatgcaaaatatgtcgcaaacgtacgactccaagaaaaactgttgggtgccggacgaagaggaaggtcatcttcattgacttgaccatcgacctttaaatcctcacaaattggaaatgccctctttaaggattcgttgccgccgaagtcaaatcggccgatggcgacaaagtgaccgttatcactgccaaaggaaacgaactgacgctgaagaaggaggagacgcaggagatgaacccccccaagttcaccaagaccgatgtacggcattggcacaattggccactctctaattgctttggcatttctcgcaggacatggccaacttgaccttcctcaacgaagcgtccgtgatgtccaacctgaagcagcgttacggttccatgatgatctacacatattccgggctgttctgcgtggtgatcaacccgtacaaaatgttgcccatttacactgaatcggtcatcaaagcgtacatcggcaaacgccgtaacgaaatgtgagtcgacaattttggcacacttttgcgcttgggctaaacatgccgcttccttttcaggcctccccatttgttcgcggtggcggacgaagcgtaccgcaacatggtgcaggacagagagaaccaatccattctgatcaccggagagtcgggggccggcaaaacggaaaacaccaaaaaggtgccggagggggaatgaatggcgaacaattaattaattgggcgtgccaaatcggaattaattgtgccgcatttgcaaatgctttttcttttcctgcgcgtccgtccctttatttatgctgcttttttctttcatttggtcttatcgcgtcccgttcaggtgatctcgtacttcgccatcgtcggcgccactcagcaggcggcggagaaggagaaaaaggagggccaaaaggggggaacgttggaggagcaaattgtgcagaccaaccccgtgctggaggcgtttggaaatgcgaaaacggtgcgtaacaacaactcgtcgcgtttcggcaaattcatccgaacgcatttctccgccgcgggcaaattggcgggcggagacattgagcactatctgctggagaagtcgcgtgtggtgcggcaggcgcccggcgagcggtcctaccacattttctaccaaatcaactcgggattcaacccgggactgaccggccaactgaagctgaccaaccccctctcctactaccacttctcatcccaggcaaaaagccaaaacgcaaacggaaaactgacaaagcaatggcaatttacaggccgaattgaccatcgaaggggtggacgacaaggacgaattccgagtgacgcaagaagcattcgacgtgatgggcttcacggacgacgaaatcaacaacttgtacaaaaacgtggccggaataatgcacatgggagagatgaagttcaagcagagaccgcgcgaggagcaggcggaagtggacacggaagacggtgagtggggcgggaagtactaattggccaattaattagtcaactaatgattgccaagtggtcgaattgcaaattgaccaattgcactaatgtaaaagcagcagtggaccgtttccaagttcagacgccaaaaatgcgtccttttgctttggaatcgaccacgaagcctttctgaaagcgctggtgaagccgcgagtacgcgtcggcaacgaatgggtgaacaagggacagaacttggagcaggtcagctgggccgtggccggtctggctaaggccatctacgcgcgaatgttccgctggttgatcttccgctgcaacaaaacattggaccaacgttccaccgaccggaaactttggatcggagtgttggacatcgccggcttcgaaatcttcgacctgaactcatttgagcagcgtaagtcagcagaagcacaaaactgaacgcattggcacccttttcagtttggatcaatttcgtaaatgaacgtctgcaggtgag

SEQ ID NO: 6680 - DNA, 1425 bp, Heterodera glycines
cattggcacccttttcagtttggatcaatttcgtaccttctagtctgcaggtgagaaagaagtgaaaagcgattggacttggcacggctttgccttttccttctgctaaatcggcacgtgcccacccctctccctccccccccccctttagcaattcttcaaccaccacatgttcgtgctggagcaggaggagtacaagcgggagggcatcgcgtggactttcatcgacttcggactcaacttgcaggcgtgcattgagctgatcgagaagccccttggggtcatctccatgcttgacgaggagtgcatcgtgcccaaggcctcagacatgactttcgtgcaaaagctgatcgaccagcacttgggcaaacaccccaacttccaaaagccgaagccgcccaaaggcaaacaggcggaagcgcactttgccattgtgcactacgcgggaacggtgcgatacaacgcgaacagtttcctggagaagaacaaagacccgctgaacgattcggcggtaaacaaaaaggggcaattcgttaattaattaatgagctgctaattgatcattgacaggtgtccgtgctgaaagcagcccaagacaatgaactgttgctgaacattttcgaggattacgtgacgcaggaagaggcggccgagttggccaagacaggccaatccagcggcaagaagaagggcaagtcatcctcgttcatgaccgtgtccatgatgtaccgcgagtcgctgaacaacctgatgaacatgctttaccagacgcacccgcacttcatccgatgcattatccccaacgagaaaaagcaaagcgggctgttggactcggcgctggtgctgaaccagttaacctgcaacggcgtgttggaaggcattcgaatttgccgcaaagggtaccccaacagaatgcagtaccccgacttcaaggtggccagtcaatttaaaactattgccattaataccaaacaatctcagcaccgttacgccattttggccgcggaggaatccaaagttccagacgagaagcaggccagcaaacagatcacggacaagctggcgacggatggcgagctgaaggacgaggagttcaagctgggcaacaccaagattttcttcaaggcgggtattctggctcgtctcgaggatttgcgtgacgccaaactgtccgtcatcatgaccgggttccaatcgcgcatccgctggttcttggcccaaaccgacgtcaaacggcgcatccaacaacgcgccggactgctcattctgcagcgcaacatccgcggatggtgcacactgcgcaattgggactggttcaaactgtacggacgagtccgcccgctgctcaaattgggcaaggaacaggaggagatgggcacactgcagcggaagatcaaggagttggaggagagtctgcagaaggag

SEQ ID NO: 6681 - DNA, 697 bp, Heterodera glycines
taattaaaattacccattctttccgaatatcaattggtgattgcctttgccccgtttggcactgccctccccaacgttctaattcctcataactgaatgtctcctccccactcggcacgtgaattactgtttaattggaaaatcggttttagtccacaaataataaaatttaaatttaatattttgattcgttattcaaccgggttatttgtttcagaaaaattctgtatccttttgaaatcaagaaatgcaaaacatatttacgaaaatatttataatttaataaatattttttaaagaaattcagattattgatggttttgataaaaaaagtgacaaaatgtgaattattttttgaactaaattctttgacttgtttttatgattttcctaaatttttcgtctttttgtgccaaatgctgattgtttaagtagtgttgagcgggaccgggaccgagcctggaattctcggtcccttctgtcccggttgggccaccggcggtagggaaaaatatgcgctgatcaaaaattcactcattagacaaaaaatttttaatttattttttgttcataaattgataaaaaaatagtcctttttttggcattatccgttaagcaataactagggatgcaaattttaagtaaaaacctaaattttagcgcatataacacgcacagatgagcatagcaagagcat

SEQ ID NO: 6682 - DNA, 2502 bp, Heterodera glycines
agcattttccacttggtttggggcttctaagatgacttttataataccttttcttgcctatttgggcgtttttctacttattagctaggtacctatttttttacctatttcggcatttttgtattaccttttttaaggattttcagaaaatccctttacgaaaatacaataaaaaccaaaaatacaacccctaagaatcgacctgaaaattttcaaaaaatatactcctaacaaataagatctggaaaattttctcaaaaattcatcccaaaattttgtttacaaatttttctaccattttcgggattttggtatctatttaaatacttatttcgcgtttttccctacctaaaatttgcatccctacaaataacaatataaatttcaaaattttccaaagtgatgcctgtcgtacttcctgttttcaaaagcaaacgattttttctgatttttttcatttggaaaaataaattgattttttttttttgaaaattatagttggtccaattccctatttaaaatccataatcccggccaaggtttttctggtccatgtttttccaaaaattcccagtcccgttaaactctttggtaatgttcaaatttggtcgaccttaccttctcgtggtgctcttccctccgggtggcaacaccgaatttgtgtgggcagaaataaaatggcataaatgacgcaaaaccattggtaacagaaaaaacggcacatttttgcgaaattaccggcggaaaatgacaataatttgttggaaaggaacaagcgaattatttttctgcaacattaaaatagacacttttacacattcgccaagttgtgtttgtagttacaagtttcaattaaatatttttacatttttaaattttatatcggcatacatataaataaaaaagaaaaatatgtgagtagttattatttattttttctaaaggacatcatctcttaatcttttttggtcattggcatggaaagaccaccaattccgcgcatttttaaatgctttgaagcagaagcgcttttcccgggtggtcatcaatgacaagtgatacctgcttaatcggtgatgcgtcttcatcgggcgggaggaagtgcctaatggagcaacaataatgtgctaatatggaaggaactggatatttatcatccatgccctgatcaaccgttatcatttttgactttttattgtaccgctcaccttgcgccaccaaaacaaaagccgttgtgcaatggataattaattaattaatccgtgcgagtaccaccaaaacaaaagccgattgtgcaatggataatttaattaattaatcagcgagtgccaataaacaaaagccgattgtgcaatggaactggattttcaattacggaatccgtaattacggcgattttctcagttacggaattccgtaatccataatgacggaggtcaaaaaccccataatttcccgtaatccgtaatccgtaattttcaaattttaattttatttaaaataattttcaaaattttgataaaaatattcaatagactttttaaaagcgatttaaaagtaattaaaaagattgggcgtgtccggcagtgtggatagacgccgctgaggaaaattttgatgatttgagtgcaatttgtaaaagattttgcgctaaaatgggttaaaaaattaatttttgtcagaaaattaattttgaaaaaacctattttgacattttagaaaatttattaacaaaatgcaataaaaactaaaatatttatttattttcttgaaaagaatttttgatttttaacattatttatttcaatactgatttggcaatacaccccaaaattttaggatttttagagcgtattttccatgtttagtgcttatttttggggttttttaggacctaaaacctatctttttggcgattttcagagcctaaaaattgcatcactaatcattagggttagatttagataattatttcaatattgaaaagattacaaaaactaaaatgaagataaaaataggggcgaaacaacaaaaaagggacgcctctattttctaggctaaaactaaattagggtgtagcgttaacaacaaaataaattaccaaaataaatgatttttaattcctaaaaaatcgaaattcgggtagcctttgaataaaaattaaaaaattaatttttataaaaaaataatcttacaagaaaacgtctcgaaaaataatccaaaatccagttacagatcaaaattacggaaaaatcccaaaaacccgtaacccgaaactcctaatccgtaactccaaaaaccccttaattttcgtaatccgtcattacgcccagcgctggtctgcatttaataatccttttgttataaatgattaaaatagtttttcctagggtttatcaaacctggagggattgatcttcatttttcaattaaaattgtcaagctcatttaagttcctccgtgccatttccttcaataccgattcaaatattgctatttaag

SEQ ID NO: 6683 - DNA, 1805 bp, Heterodera glycines
ttcctccgtgccatttccttcaataccgtaattcaactatttgcataatttaaggttttttttgtattctatacttacttaatgacgtaaactttgatacaccaaaaaaaggtgcgagtaaatttttcaacattaattgtcaaataatcaaccaaaaaattttaattgctctgtcattgtccaaaatatttgtaaaaaaagacaaaaattttgcataaacgaggcaaggctcaaaagaaaaatgcttaatgaggtagaaaatattcagacatatttttttgtgatttaatttgagtacttaccttttgtgtgtttttcttaccgaaaagtattttcatataccaatgaataatttccaaattaagtcaaaagcacagatatatttatatacaatggcaaatggaaaagcaacaaaaataaattacaaaaactgattttctaatataaattattcttcttttttctgccttcaaacgaattcatttaaatctttttaaatttaataaattattataatttttatcaaaaacaataaaaattttatttatttattttttgataatggatttgcttcttttccaacgcgataaatacgctttggcgtacaattgtacgaatttcgatgccaatttggtgccaattgggcaacgcattcacactgttcacggcatcatcttaatcattatgtttttcgtgttcgaagtaagtttcagcagaagattatttcaatggaaatatttaaaatgtttgccaattaaaatcttagcattttcatgaaaaatttttattttatggtgaaaaaatctgaaaatgatataaaatttatggtaaaatcgttccaactttttttttttgaattggatcaaaatctgaaacttaaatttcttaaaacagtcaaatttaattgttttcttattggttaaaaaccaagcacccttgtttttacttttttttccttgtctatcaaatccaacaatcttggtatcattaccaagttgttttaaaacgaaaattgaaaaattcggaattcttaagttttttttcttccttttatatgcttgagcgaatagagcttgtaaagaatctccgagtcatgctaagattgttggatttagacaataaagaaaaaagttagaaaattttagctgtcgccaaaacgtcggcacaaaaacgaccttttcatttgtcacatgggcatgagtattttttttccattagttgttgtacattccctgcatgatgtccatgtaccacaatttgacaactggtatcacagacatggtaaataatagagaccggcgcgggacgggatcccgcgcgggattttgcgggatcccagtccgcaatcccgcattttttggaaaatgcgggatttgcgggattaatcccgcgggatcccgtcccgcaaagaattttgagttccaatcccgcagcgtgatccgcaaatttgattttttgtgcgggattatgcgggattttattgattttttgaaaatttttcaaagacagaatgccaaatatttttgaataaattaaataataaatttaattaaagttaactcatttttcatcgaaaatttcattaaaatttgtgaaattttcccggcggcgcctatcgtcaccgccggatggactccaccttgttctcttttaaaaaattcggcaaaggtgtagaattatggtcccaacggaaaataaacttaaaaattttatttttgtttttctgcgatgaaaaaatgtgctgattacgaatctgagatcagatttttgtaaaatcactgattttgtctttgatttttcatcaa

SEQ ID NO: 6684 - DNA, 1424 bp, Heterodera glycines
tgtattcagtcacactttatccctcgacatttattattattattaaatttatgggaattaattaattttacgtttgggagaaaacataagaatttaattacagctgattctgatcatttaaatgttaagtgttttttttcactttgtgccaaataattaaataattagccgtggcactattcattttctctttgaaagccatttccgacggataccaaaccactttttttagaaattacaaaatttgaatgattttgtgttttaacatataaatttggatactgatttaactttgcaaatctgaacaaaacttatacttacttacttttctttccgaaaaattcaaaaatttttatttttcaaaatttatttattttatccgcagaggaaaattaaaatccgacaaactgggaatcgatcattattagctgcgattaatttttgttctggcagcgattaaaaagcttaatttatgaaaaaatatatatttttgagttattttttgtattttaaaatataaattcgttatatgtacgtaaaggtttttataataaaatggttcataatacaactttagtctttttcttggaaattgcacgcactttaaaacaatgcgatctaaaaagcaataaagtgcaatcattttcttcaaagtgattaatccaatttgcatgtaatttttgagtgaaaaactcgacatttctatgtgccgtatataaaagaatgccaatttaaattcaaacaatgccaaattcactcataaattttcgacgccagtgatcaatgttttcgcggtgataataaaataatttcaggatttttttttaatcaaagaaaatgccatctccgtccgtcacaatcgtcaacattgcatatttaattttgtcatttgaaatgttcacagatttatctgtgttggccattgcgtgcctgaatttggccgtgattgtgcccaacaaactgttgcacaccaacctgaaaagcattctgatcacccaaagttttgccgttttgtattttggcattcttcgcttagtaatcatatgccaaagattaatttatgttgagccattaatgtccgacgatgtgattctatcggtaactttttaagatttccaatctatgcaaaatacagtagtcactgaaattcacacaggattactgtaccatataaaaattttaagccgtggtcacatactttttttttcaaattttagatacttatgaatttcaactcggtattccgtcgattgctgggccatatgttgatcattgaacgttttcttgctacttttcgtaccaattcatatgaaaaattctcgaaaacctattttactgtgacttggttcagcattacggtatttattttaatataattgtgatattgtaattaaaaaatattcatgattttcaatttaaaacca

SEQ ID NO: 6685 - DNA, 6639 bp, Heterodera glycines
atttagaaaatcagataccaaatccccgacaggtatccaatcgttggggtccttgggaaacccaacccactttaccaggtagtgttggtggccgttgacgcgcttttggccacatattctttcgacctcgaattcgtggtcagaagaatacgcagccgaaaccgcgtcttctaccatctccactacctggtcgtgcgggttgggacccaattccggcacttcgtcgacatcttgaccaaaggggacggtgtctgttggcaaagagttggctggagaaagagactcgtcgtcgggatagacgggcagttcgaaagattgttcaagttccattttttgataatgggaagggtagagagagctacttaaataggagcaactcataggagttttttgtccgatcacaaacattattcgtctctcagggcacctagcgcaacgttctcatatgaaaagagcaacagttttttgctctccgtcgctcgtttttgtccgaaacacccccaggcgcttgtacactgctcatgttttttgaacacagaagtttttgtcacatacccacgacaaaatgtacaaaggcagagattgtcgtgggtagaggaaccagtcacacccgttttttgcacatcgcccgcgggccgacgtcgcgcaaaatgcacattattttttgcttgtcatttattttggcatttaattgtcttttaacgaatcttttcaaaatatttttcaatttccttttttttgctttcttccctttaaagtcccaaacccatgagcttgaggatccgattcgtggcttaagttgtcgtcaccctcgggaggggtaggccgggtgtatggcgttacctgccaacaccaggcagcggcttaggagggattgggaggcttacgttgcttcccacccgcggatggataggccgggtgtatggctttaactgccaacaccgggcaggggctgaggagggattgggaggcttacgttgcttcccacccgcggatggataggccgggtgtatggctttaactgccaacaccgggcaggggctgagggattggtggcttaagttgccaccactgtggattgataggccgggtgcatggctttacctgccaacaccgggcaggggctgaggagggattgggaggcttacgttgattcccacacgcggacagataggccgagtggttgccggcactggagggtgattgagaagattgagaaagtttggtggcggcatgaaacaacaccaaccaaagaccgattaagctcgggtgtgaggcttaagttgtcgaaatctaatgaggggcaatatcactcagtgtgtgaggcggtcgcccgtacacggaccaactcaaactaccaatttttatttttccaagcgtttccgtaaatttctgtgaatcattttatcccctcacccccattacatcaaatgtagaattgcaatattaaatacgcaaatcaattttattcaatttgaattctccattcctctgccaccatgttattcaccacagtcctccaccttcaccatgaattttattcatagcatttcccattgaagcagtagacttaaatgaaaaattcaaatcataaaaacacaagaaaaaattttcattgccttgaaaaacgagccgtcattgtgccgacgctcgaagtggccttccttgtagccatcccatgtgtgctccaaccgcaaatcccttaagcggcgctcctcaccggctcgcttttcctcctccaatattcgcgcccaatacaccgggttttcacgctgtagtcgcttcctttggatcagattttcctccttctctcgccaatcgttggcaacgagcggttcgttccatgctggaaaccgcgtccaccccgtgcctgttcgccggacaagctgttgttgctgctgctgcacctcgttttgctgttgttgttgttggtgttgttgatgttgttgttgttgttgctgcacatgccacacgtccgtccacggcgcatagagcacaacactgccatccccccgttcctcaccgatccattcaccaactgagttgctgacgggaagagttacatccatttgctcgaatgacgatcacaataactttctaccgtcttaaatagccccacaaacggcaaaccgaaaccaaaatgctcacaaaaaacatgttttttacacaaaaactaatgctcatttggttaataatctgcccattttgactgatagtcgaccatcatctctatttattctgggttttcatcatatttctcccacaaaatacgcacccacaagttttttgctatgtttttgcccaatcataattgctcacaatcgcacaaagttttttgttccattatcatttttgcccaacataatttgagcacaaacgcacaagttttttcctctcatttaaattgtgcacaaacgcacaaaaattttttgtccatcgttactatttttggtttttttgcaatcgcaattctttcatccttcgcatttgaattttttatgaaaattccgtttggtccttcaaattttcttttttatgacactgaactgtcaatcaaaactaaacttgcgaagaaatttcattttctttcagtccatttttgccctcccatcgcagtgggcaataacggagtggtgcctggcaggggagaagcgcaccgaaatgcaaaggcatattcaaatttccctatcaatcatccaacgaaattgagaaaaaaatttcttttgcccactcccaacagtggcgatgatgggggagagatggcacagaaagacaaaagcatattcaaatttcccccatcaatcattcacattattgtttgctgtccgtggcgggctgagggtggagccaatcacagccgggctgagggaggagccaatcgcaatggcacggcaaagggaggagcaaacttaagcggggtaatgcggctctattcatttccacgttcattcttcaaaattctttgctgaccaaattcaaaaatggatttcgactattccgcgtattataacgcatgggtttttgactttaaaaaacactatggccaaatgttcgatccatcccaaaccaatcaccaaatgccattccacaaagaggctgtttctgattttttgtaaaccattcctttaaatgtattttatcaaccagttttgaaggaaatggcgcaaagactggcacaacatgcaacgcagccgacgtgacccaactccaccaacatctcccaaaagaatgagggccccaactccgcgaccaatcgttggactaccaattcctgttgtggagagtgagtttgtgctttgacaatgagagaaacggtttcatggttggccattttatcccccaaaaatttaggcaatcggccagcggaagatgtaagctcagacgatgacgacggttacggcaatgtcgcccaccaaaacattgtgcaaagacaggaactggacattggcgcacgagctgtccaacgtccaattgcccgggtgccgcctgcatttcgtcaaggccctgttcgccgcccctttccaccacttctactgccacgtcaggtcagaaaccaaaggcttttgagctttctttgcccagattcacagctttgggtcttagggtccacaaatgccacatcgtgtattcccagtcccgcaccaccatgtccaacaccctcttctccacgtccgaccacttcctatgccccgtcaggtcgaaatcgaaatcgctttttttgctttgccacaaattgtcaaatttgggctttagggtccaccaatgccatacaacgccctccgtgccccacaacaccccatccggtttccaattgtgaatgttccgccacttccgctgccccctcaggtcggatactgttttttgaccctattttgtgccaacatttctcaaacttttgagttcttagggacaaccaatgctgcgtaatgttgttcctgttcaccaccaccatcatccaatcaacggcctaccacttccactgccccatcaggtcaaaactcatgactttttttcgccttctcttgaccaacatttcccatctttgatttgttaggggccaccgttgttgcgtcatgttgtacctgttccgcatcaccatgtccaacctccaccgaatggtctaccgcttccattgcctcatcaggtcaaaaaatgacctttttttcgccttctcttgaccaacatttctcatctttgatttgttaggggccaccgttgttgcgtcatgttgtacctgttccgcatcaccatgttcatcatccaatgaacggcctaccacttccactgccccatcaggtcaaaactttgaattcttttgacccaaatttctcatctttgatttgttaggggccaccgttgttgcgtcatgttgtacatgttccgcatcaccatcatccaatcaatggcctaccacttccactgccccatcaggtaaaaactcatgacctttttcgccttcttttgacccaaatttcaccgctttgagttcttaggggcaaccaatgttgcgtcatgttgtgcctgttcaacatcaccatcatccaatcaacggcctaccacttccgctgccccatcaggtcctaaacccgcagttttttctaagacaggagaaatttaggctcatcttgtgccgccccaaccatggcatttcccacctgtcatcgttcgcgtcccgcccgtcgcacaaaggaacgaagctcttcaagttcggaactttcaaaacacccaaaatcatcatcgtgaatttatttaggcgcctccaattgtcaatccgttggggcaaaatccacagcaaatgatccgttggccaagacaacaatggattgggagaccaattgacccccgctcacccccacattaatgagaaaaaagaatgcatttgttaataaatttttattgattgatcgttttatgtaaagggtttgagaaaattccctgattcctaaaaatttaagtgacagaattaagttttagcaaaatgttaaacgacacagaaattaatcagaaagaaaataacgaaaaaataattggattggctttgattttagtcatttattcgttttcgtttttgtgtttctgtgccgttatcgttagagaatgccaccgtgtcttttttagctaacaatgccactgccccctgagctattgtttgaaataattgaagccttcccctcctcaaaattgtctacagtcttcttgagcaatcatctcctgtcgtcgtgggctcaaaagcgtctcagagggactttcaattcgctgatgtcacagaaacaagaatggaaaaatctgttaaaaatatctcgtttggtttttgaaagtcacaacggattaaatgtgtaataattggtttttagtttttagtggttttatgctattttattgttaattcttaacgcgtttttaattagttttcagcaaaaatgtcagaatttctcattttccttttgggtttctcctttgccatgcttctcatgttgtgtttgctggtttcgctggtgctctttgttctttgtgcagcatggtattattggacaaaagaagaagaaccagaagaatttgatgattttccagaatacccaccgccttattaatgaaataaattttttgttgaaatgtgtcatgaaaaaacttggtttaagccatgtacattttttctgctttaaaatttccatttcaaatatctaagctttgaaaaatgttcaactcatccttttttgctgatgtcaaagaactagggcgtattccaacaccgaagggaaaatttagtgagaagaaaaatgaaactcaatttatgaaaatatttaggtatattttatgcacttgagttcgctaagctttatcaaacggttggacgtgaaatttctcgtgataaattccgacatatcatgaaaacagggaaaaaacaacatgaattagcattggttttcatggaaaaggctgggataaatacacaggagaaaacttttgggcttaaacacctcgaatttgtgcaaaacttttgggacaaagaattcccagatatatttcgtatcgttgcgtttgatatggtaaacgaacatttcctaaacttcgtgtgattgttttatttagaaaaccggacttagaccaattttcaaagggaagggagtaagaaaaaacgaagtttgtgtgataagagagggcgaacattgggatggtttaaaatctgttactcaatttttcgcagtcaaaaatttttgtgtaagctgtgaggtgacattcgatcgacccgaccgtcaccgaatggaatgtagggagcgctgcaaaaagtgttgccggatggggttcgggttcccctgtttggatgtttgtgaggcgatacactgtggagaatgcaatcggaatttctacaacaatgattgtttcgagtctcacaaaaagacagcttgtagggagtacaagaaatgcaacaaatgtggggaaacatatcaaacacgatcaaaacacacgtgcggagagaaattctgtagaatttgcaaagactatcatccgggtcggcaatgtttcattaaaaaaatcaaactccgacagcagaaagcataccgaattgtggcttatgacctcgagacgacggatgtagggcgcgaacacaaaccaaatcttgttagagccgcgcatact

SEQ ID NO: 6686 - DNA, 8129 bp, Heterodera glycines
  misc_feature (8123)..(8123): n is a, c, g, or t
atcatttgtggcgtaattaatatgtatggtgatggacacgaatgaatatttttaatacacaacgtacgcttcgcatgtgacatgtaatttttgataggggaatgcagcaagcagcccatcgatcggcaaagataatgagataacagcggacagcagcatgcgagggccatcatgaccccgaggacactttgaaagcggacgaattaattacaggcacagggggggggaatcataatatgaacgaatgggcatgacgagttgagtgaaagtgaaaaaggtaaatgacagacagacagcaaatgcattgtaaaatcaattaaaacaattgaaaaacaagccgtttattcatcgatgtatgctaatgactgtggaaatgtgtgttgttgatcaaatttataagatgaaaagtgtgtaaatcaaaagcataaatatcgatcgcgaacataaaacgccaaaaaaagtaccaacagaaacttccttcgaccactctgtcctgtcctttgtcctcccctcctcctctttcaccagcattttcaacgccggcgatcgcgcgaacggctcctgcgactgctgcgctcccgggagcgacttcggctccggcgtttggtgctgctgccgccgctactaccaccgcggtaaggggagaaaccacgcgagccaccgccgccgccattggccatcatcgccgcctcttcggccaactcacgcgccaacattgtcgccttggactcgcgcattcggcgcgtgtcccccttaccgccacccaaccgacgcggcagccatttcttttgcgtgcggccacgctcgtagtccaccaccacgcgacgtccgtcaattttggtcccgtcggccttcttgtaagcggctaaaggacccgaagcaatgcatttggagcggatttttagcccaaacccaaacagccaacaaaaaacagaacttaaacgtggcatgacatacaacccaaacacttttttgtgtctctgactcacgattgggagtgtctttctgtgtgtcgtccgatcgagaaggcctctctcgttcgacttacctcactgacttacccgaattttcatttttttaaatccttaccgaattttcttaccacaaaagccaatttttcgaattttttttaaagaaagagtcaacttcttgtcctgcttaccattacacacaaaaacactcatcggagaaagcgtaaaattcgattaaattataacggggacaaggaatagcatcattttccaaaagacctatattttcgtaatttgaaaataattcttcaatgttttattttaataatgctcaattagcgatcccttgccccgttattgcgtattaaaataaggtttacccgcgcgttttccaaacaaacctaaggactttttgagtaatttttaggtgagcacagcaaaaaatgtgtgccaatgcatgcacatatttgcctgagccccgcggaagctgcaaaaatttcaaaaaatgtaggcaaaaattgtttttattttggccgtcattttcaggacaccgaaaaacccgaagcttaccgccgctgtcgcgtgcctttccccaattttcattgttataattatggtttatgggtaaggaaagagcaattcgaagtgttattgccgttcaatttataaaattcactgaaaattgtcaacaatttgctactcttagccatgctcttcccatttttggcataatttagttaacatatttacaacatcttcacaaaagtgaggacctgacatctccgacttatgggcatattcgataaaggcgtaaccgcgcggtttgctgtttttgtcgtgcaccataataatctgaaagtgtcataatatgacacataccataaacgatgttaaaaattgcctaccttcgttattttgccgtacttctcaaattcacggcgtagtttggactccgaagtttcataattctaaatgaaatttttaagttttaccatgtatttttctttacaattcggccaataaaaagtgttttgtacgggtcaacggtcgccttcggattgtccgcaggtgtccaagtggcaatgccttgctcaattttgtaggccattagctcctccttttccttgcgctgaattttaaagtttcatccaaagtttttgttgcaaaatgcgtttaaaactgacttttcgcgctctcttctcctctcgggtctcaattttgggttttggaggagtgtccttcggatcctaacaaataaaaaatccaattcattaaaggtgttttgtaaacctcaaaaccatggacacactcggccatgccccccatttgcatgtgttttcggtggatgaatagatcatctggcggcggtttgaattgaatcggcggacgaggcgcaaacagagccaacaaattgtcggggagaaattgcgtcattatgttaacaataagaattactgaaagtgaaggctttaagaaaacatgtaactttcttgtgagcatttgtgagtaaagaaaaacataacttttaatttatttatttgacgtagaacaattaataatttaatttgcaattgcaattgtattttcttcattaataaaattatttaaaaacctacaacttcaatttttatgcattttcactcccttcgctttgtttaagctctaattcgattcaaagttttgcaaaatcctaatttacccaatttacattaatttctcattttcttacgaatgaccgaagaatctgtaatcctcagtttttcctgtctgtgagtaaataaatacctatttaatttacactttatatttgaaaacaaaactttacaagaaatttgccacttgaatgttctgatggctgccgattggtaattacagcgcgatcggataatgacgcaaattttgttgaggtgtctttttttgaatttaatttccttttttgattagcctacctaaaattgtttcgctgttcaaagattggccaaacagaaacacggaatggcattaacccgaaattcgaggcacgggtttcgttgcttctgcggttggacaaatgccaacagttgcgcattgttttgtgagtccacttgatttgcaatttacaattcttttttcaatttcttatttattaaatcaaaaatgcaggtactccgtcgatgttcagtctggtcttctgcggacactgctcgccgacgcgcatgttttgctgctggcattgctttgtgccggttctaagccggtcgctgtgccgctggcacttcacttactacaaaaagccctacaccaacagtcgttggtgctggccgaagccgtgcagcaggaggaggcgagcggaagcgccggcggaacgcgtgagacattgacatttttaaataaacatccaacttttaaaatgaaagtttttgtctcacaatcagttttccaatttgtcggccacaatttggaaacgcccggactgctcaccgccccttattttgtgttggaattggtgccaaaaagcgaaactgacgagcgaatgccagtaaaaattagtttttctaattctgcaatattttcattctatcatcagattttgctctatcgcagtgaagtggcgcaccaaaacgcaaatccccgctggcgcgactttgtgcttccgtccaaatttttccccagctctttggaatggatcttgcgaatttcgtgccacaatttcaattacaatcgcacaaaggacgaactgatcggaagcgcaaccaccaatttcttccaattgctcaattcgaacacaaaatatttggtcagcgacgagggaggcacatagtcggtgaaaaacgaagataatttattttttgaggcttaacttggcaatttgtttgaataatttgtcgtctttccccttcagttgaggccgggccaaaagagcaaagacccttccgccagcattgaacttgtccgcgtgtgcggtgcccccgtgccgacatttgtgagccgactgaaattggggtgcaatttgcttaatttagttcggcatttacctaatgctgtttcagtcagcaattccattgcacaatcgctgtcgacttcacttccaacaacggcggcccaaatgaccccaattccctccatttccgttagtttattttaagaagaaacaaaataagtaattgtcccttttacccttttcaagtgcatccccatgccatgaatatgtacatgaatgcgctgggtgccattgccccgccgttggctcgactcgaaaagttggagcagtacacacgacacaatgtcgctttgtctgatatttttctgattttccaggctgggcagactttcactgctcggattcggtgccaaagtgccgcccacttttgcgttttccaatatttttgctttggtccgtgtctttatatattttttattgaatgaatttctgatttttcagaacggaacattggacaattcctatgtccgtggagtgagcgacgcactaaacagttacaggtggaagatttccctgaaaatgtttaatgggtcaaaaaatccctcagaaaaatggcgatgtccgtcctcccatacgcacccactgaatacgcccaagtgattcaccacgtcgtaaagtgtgcttataatcaacccttttaatctgtgcaacaatggacggacgttttccaggttagcaaaagcatccgagaaggcacagactggccacttctttctgctggtcattctgacgaacggagtgatcaaagaccaccgggatacggtggacactatcgttgaggtgagttacggtacgacaccgtccgtggagaaacactcattttggcataatccatggggaaacttcaaggagtacaaattgtttgctttttgtctaggcctcttcgctacccattgccattgcatttatcgccgtaagcaacgcgcaccatccatcgcaggtaaatgctggagaaaaacgcccaatttttttttattttgattgtttttgaaatgactgactaataaatgcccctcatttgcttagttggctgcactccgtcaacaatttgccgtccatacgctaaaatcgtcgcgcaatgtgccgcttgcgcgagagacagtgactgccgtgtcatgcgcggacccatccatggcataccattttctgatggccgttcaacgacagctcattttgcatctgctaagggcagcgacggacgcggacgcaatcactgccagcggatgaagacggaaatgacttcaattcttcaaatttcacaatttcaaaccaatccatttattccatataatccatttttgtattttccctctcaaaacactaaaactgtgcctatagcccatcataattatatacttattgttagtaaaaatatttttgcatggataacaaaacaatttaatccatgccatgggtcagcatgtgctaatgccgccactttctgttggctgagaagcgcattaacacaaaaagcacttctctgttgaagtgtctgtcaagttcagcatcccctttctctgtgtttcctcggcgagtggaagaaatgctcgaggggagggagggggaataacgccttgatgcttgacacgctgatgacaatgaactggacttgtcgcgaatttcgaatggcgtccgttggtcggtcggtcattgctcaccagcggacggcggcgaattcagcaaaaaaacatgcacaggctaacagttgccaaagtgaccacatttttgggcaaatgttttgtttttttcgtttaatgccttggaattttgtcactccgaaactttttttgaaatttataaaaatcactgcctttttgatttcatttgcatatccatcctttctttgttaagctttgcctctctcttcagctgtttttttgtctcgaaagtgtcttaatttccctcggggcatttgtccgtcctccgcttttctcccccccccctcccccttttcatctccgccgtccgattcgctgctcctctcgtccaaatgattttatcagcggaacggcactttttgcttaatttcacaatatttttccgctgctttgaacaacgccaacactaaaagagaaggaaagggaaaaggaggcgaaggaggagcagtatcagcagcaacacaaccaaaagaagcgtgggaaaagagcaattaacagcccatcactgagttcgttcgtcgtcataattctcgccattgctccgttctccaattagtcccaacaatcgccgcttcgtcgacttcgccaatcgctcgtcccgataatccatcatttgcttcatctttatcgtcaccgccctaagcgcaacagcacttcttctgtccctccgccactgctgctaatttttctacccaatcccccgccgcgtccgccaaaaaaggctttcccttttttccctttcatttacctccccatcccatcggctgatttgtcttcttatcccattatcttctccattatcatcctcacttttgccttcgtaatcgcatctcgacaaatcagtcactctcgccaaatccatcgcacaaatcgacggcggatgtaaacgaaggccaatgctttttccaccggcaatcgcaatgccaatgcgcatggcagtcattttcatcattttggagcagcaagtgaggcaaaagtgggaaaggatcagttggacgaaaattggttcacttggacctctcggagatcgaatctcaaaaaaagctaattaatcttccatttcgttttgttccgagtatttctctttctgtcccaatttctgtaaaccgttttcaggcatccattttcggcattgaccagaacattaggtcaacaattagcgaaggtgcactgacaacatcaaatggaaatggtttgaccacttttgaccaactgatggcacatcgtgagcatttctttcgaacactccgacggcaaaaacatcggagaatggccaagaaaatgtacgaaaaggcgcgggacagagcggaaaggggacgcgttttgttgagcaatgagcggggcattggtagggcgaaggaaaagccaatttaaaacaaaagaaacacattttggacaccaaagaacgttcctcaatcattctgatgccaattgatcagccaaaagtgctaaccgcagaaacttttgcgagcggacgaagtcgacgagtgaaaggcgaagcgcaagcgaacggtggccaaatgagggctaattagggagcaaatctaaattattaaataaaaaggtggggcccacacggagagaaagcccatcaacggaccatctgcggcaaaaaggccagcgaatttgcaaattgcgactgacaaacacgcggacgcaaatgcaaatgcatcgcaaaacaccgtagtctacgggccaatgtcagttgggcaaagggatacggtacatcgacctgtctcgagaagaactgttcgcggatcttatgttttcttgtgtttgctgttcagctttcccgccgactattggcaattgcccccagcgcttttagccgcgcggctgaggcgtttcagcaaggcggacattatgcgaagccttcggcaaaatgcccgacggatgggcgtcgatggaggcaaactgcgtgcggtgatgcgacacatcgaaataatgcgacgggaggaagcgcagctgcgcaatcaacggcactatcagctgcctgaaagaaaggtggcgcgaacaatcgatggattgggggggggggggaggaaaaggattctaaactgatcagggtgatggaaccgactgagaagaccaatgagcaaatcttgagaccgaaaatctccaaaacttgatattttctcggtccaataacgagactctcgaattgtaataggcacaaaaatgcaaaagtgctcaagatggtcagaaatgcgctttttcgcagaatcacacgccgtcagtgtcttttctggtcgaccgtgattcgtttcaccgttccgtcgacgtcatagacagcgagaaagtccagtcgaaaagtccattcgcagccaacacaaattcacacgcaaaatttcaaaggaatgatgacgggtcaaccaaactgatggcgagggaagagtgtaagtattacttaaaactcaaattctaagtcggtaaaaagggaggggaggggaccgcatcaggtaattaagcatcattatttaattggctccacaaaatgcgcattttttcagccgnatttcg

SEQ ID NO: 6687 - DNA, 2633 bp, Heterodera glycines
aatgttttttttgtcaattataaagaaggaaaaacttataatatctatgtttagctacaatataaatgaatatcccaattagaaaataaaaacaaagcgaaaccttcagtttggcaccgcctttttatagcttcaggcaaagtaaaccctaattttttttcattcaacgggcttttgcttgtttatatccaactgttttccgcttcatcaacacaattcgatatgagaaaagtcaattgatgcagacatcgcccgatgcatcgctggtgaagtccctcctctaaagaagcccaaacatcgtgccgccgatgcgagaattcttcgacttttgcaggaatacaatgccatcaacaataacccggctatccaaaatgaccacaattaccatgccaatgttaatcccgataatatcatcaatttgctcgttggtattctcgaaattatgaaatgcgcccgtaatttttcaatgcttgttatttttttgttgttgttaacacattgataaatatgttatgttattaattttaaacattttttcggaaaaaatcagtagaatctattttggacaaaaacagcttgccgtactaaactgaccctcgtactaaaccgaccctcgtactaaaacggccgtactaaaacggccgtactaaaccggccgtactaaaccggccgtactaaactgacccggtccgcctttttttgacgtttttttccgattttagtgcattttttggcgttttttttccgaaaattccatcaaataaaatacacctttaagaaatgacttgaaaaattttcagaaaaaacatccctaagaattgaaaaaatttcagaaaatacacccctaagaattgaaaaattttctcaaaaattgatcgccaaaattcattttttttcttgataaaaaattctcggtttaaaaattttccttattcgaaaaacattataaaatatttaataaccatttaaatgaccaaaattaagtttttggttaagttttacgtgttttgctccctaaaaaaccttagaaaaattttttaaaatgcctttttttcatgcctttttcgcgattttcgtgccttttcatgcctttttttcaattttttggtgcctattatagtgcctttttcgcgatttttggtacctttttatccgagctctaattataaaattaaaaaataacacacgattaaaatgtcttttttcaatatttttacattattttcagtaccgttaatttgccattaattcgacttttgttgcgtaagggccatgtctttcttccacttctgcaattgtcttgtcttggcttatgctccccatttcatcgttttccggtattcatcgctttccgaatataccaatatttggaagtgcggccaagcagcgattggtaaaattcttttccaattatattcctaattaccccattaatttaagtttatttaattactcaattcgtcaaaatggtatttttttcaatttttcaaataaaatgtacgtctttttcagttgacattagcaacattttttccaattgctgaaaatggcgagtacagtttcacttatgtaagtgcatgacatttttactgaaattttgttattttaaagtattgcaattggtaatcgttcacatcattggtcccataaaaaaaagtgaaaaaggggtcgttttttgcgattgtgagaactactaaggggttatcgagggcgctgatcacgaatctgacatcagatttatcatatgacatcattaaatctatgattttatctcatgtctatgaattttcatcaagtttttttttcattttttaaaattatagttccaaaaaatattttattgggttatcggagtcgttaatcacgaatatttcatccattccgactaattcctaaacccgatcccgaattcgaacaaaaatcgaaagttcaaattttcgaaatttggatttatgtttcgaaaatgcttatatgatttttttttaattgcaggaatgatggtttttggtttgtttccatgcatttaaaccattttcgaaacataaatccaatttcgaaaatttgaactttctattttttgttcaaattcgggtccgggtttagaaattaccttgcaattaaggagatgatgaagagtgcggttgacataattgatgtgatgggattgcatttcgccatcgcttattttctgtccggcaaaggcgaagttcgaatgctaaccgccggcttgggctggacagcggcccactctttgctcacttattttgtggtgtttttcgtcggtgcacgcgccacggggttcagttggcgcttcatgcagacggcattcaaagcgaaccttgacttggtgtgaaaattagagcggagaaaactgccgaacacaaataaaataatagcagagacaatttttgggcaaattgagtgggccattttaaagtatttaagaaaattatagcctatgaattgtttgcatatttttgctgtccctgggtttcctattttctgtaaagcttcacccatctgttcgctgcctgtctctcagcagcgacaatgcgtgctgactttctccaacggacgcattcccgtcctgaggacgggaagcggctgaatgttcccaacaaaattaaagaacg

SEQ ID NO: 6688 - DNA, 876 bp, Heterodera glycines
cgacaggtggggctcgctcattttttcctctaattaccaaatttacggggtcgttttgaaagtcgaatctatagcctggcttgctaaggattgaaaattctcctttactccaatcatttttttgtttctgttttagcttcctaccgtacggcgggaccgaaaacgaaagtgccagacaaaaacgaatggatgaagcgatgtgcggcggaatacgagcgaaagtactgcgttgagacggacaccaaactgaaacagcagacgacgaagaacaaggagaagaagcagcagcaacagcaagacgaatcgccggaggagtattacccgaccaattacgaggtgggcaccggcgaacatggacagataagaccgtcttcacatcaggcttttcctaggaccaagccatgatggtcctaggggggggggttactaacccccaagacccctccacacgaaattttatgcgaaaaaagcatcatatgcttaaaattttcgttttttttgataattacataaacgcttgttttttcttggatttaattttcttttttagcccgccttcaattatgacaaattgcatgtgtccgatataatccttccgtaagtctattgcaatctatttaaaaaacacacatattacgtacaattagacactaaaacttcattttgtagactgacaattcatcaaaaggataaatatcaagcccaaaatggaccgactaaatacgaaccgaaggcggaaggacagcacgtgacgagttcagtaacaaccgcaggtgttcaatacaataatatcctgacgtttcaaaacattttttgagctaactcaattttttgtttagttttgattctgtggaattgtgtcgggattgacctttt

SEQ ID NO: 6689 - DNA, 1941 bp, Heterodera glycines
  misc_feature (1906)..(1906): n is a, c, g, or t
tttcttccccccccccccccccgcatcatttcccccgagaaattaaaaaatagaaagttttttaataacaaaattaaggaaacaaattttagaaaaatttatgatgaattactaaaattttctcaagagaaaattgctgaaatttttcgagtgtttgcttctcttacctacttagattatgagttatgttcttccacattttgctttgaaaaacaacaattttgggttgttgttattccatttcgttttaccctttcttttaggactcctattcgagggacagaagtcggtcgacaaaacagcggaccaaccagccttataagtccgacgaaagagatgaattggaccaacgtttggggagacatttcggaaggggtacggatggttttattattagcatggcgtatttttactctgccaaaaactaatgggctgggctcatctcattatgtctaattatagggcaccaccatcgagcgcattaccgccggccaagcaacgcgccgtatccgccgccatcgatggtgacacggcaccgttaccatccgtaccaccgggcccggcattacccggtaacattttcacactgtcttttccatagcattggcaccgccgttttgggttcagccttcgtttccaccagcgatggttttccggcaacgttcatcaccaactgaagcacagcatcaacagtctgccgaagatcagcaaaaggcaatcgaagaaaagaaggaacaaacgcggccagaacaagcgaaaaatgttccccccgaccaacaaaaggaagagcaaacggaggcaatttccaagcaggaacaacagcagcagcagaagaagggcacggacaatgaacagcaacaccaaacaacatcatcatcagcaacatcatcttcaacttcaactgaggtgcccaaacaacagtcatcatcgccgccgccacctcctcctttcactcagttgacggacaatggctcagcgcgacggcaccgtcgtccgtcccgctgtgtgcgcaaagcggtggagaaatgcagttcgttctccaggtgcgcggacggaacgggccgagtgcaaaactgttggcacaaagggaacgacatggtgtttgacgaaccgacgcaggaatgccgaagtttcatgacattgccggactgtcagagaggcaattttggcattttctaattttatgccattttgctgttgtcctttttagaatcgtattgtgtcaatcgtccgttgggtccaacttcgttgggcggtgtttgctcaaaggtgctaaaacgattaattatgacttgagtatctgaaattggaatacatttcccgttttcaggtggccatcatttgtgggattccgcggcagcaagacggcactgacaccgcgcccttcgtgtgccgtggcgtacgggtgctgcatccgcggaacaaggagagatgcgtgaatgacatcatggtgccgcaatgtgctgaactgctttcttagcagattcattgttgatcaattacaaaacagatttatcagtgatcaatcagattatgatggcacattaccaaatgtttttttaaccggattaaagtgttatgtgcttgtgctggttgattcagttttttgttcggatttatctttttctgttttaatacccatcattttgtactattcttttctattatttttttgtttgtgtattttaaaatacctattttaatttcgatggacgaactgaacagattggctgagagagcggtcgagagtgatcagatgggacgggttgatgatgccattttatattacaaggtggggtggttggatgtggagtaggacaaatcatcgccgtgtgaaatattccaaaatgaatataaaatttttgcctttttcgaggccattgcggtggtggggcccaaattctanaaaacagttgaagactgtcggctctagaggtcccc

SEQ ID NO: 6690 - DNA, 1184 bp, Heterodera glycines
aatatttgacacccaaatgggtggcattcattggactcggtgccgtttcggtaatgataatttttttaattaattttaattttaatttaatcaatttttcgattaatttaaaatttcttatttgatttctcaggctgctgtgatgtcttcagcagattcatcaattttgtcagctgcttcaatgtttgcgcacaacatttggaagctgaccatcagaccggaagtgtgcttaatcattaaatttgaatttaaaatttaataataaaatataaattctattaattaaattgggggctttaaattggtttatgtgtgaatttgaaattttaaattttttataactcaaggccagcgagcgtgaggtgatcatcatgatgcggttcggcataattgctgtcagcatattggccaccgtgatggcactgacaataaattccatctatggactgtggtatctgtgcgctgatctggtgattattttgatgcatttaatcattattgattggatcagttagtctcatgtcattttaatgattgctctaatccgagcataattacgtttgtctgatcactgaacaaatgcaacaaatgactgtctgtcatccatttttctctagtctcatgtgtatttgtctgatcccggacataattaaagtttgtctgatcactgatcaaatgtaccaatgactcacctgtcatccattttttgtcccatgtctttaacgattgatccgatccgggcataattatgtttgtctgatcactgatcgaatccagtcaatgactgactgactgcctgtcatccatttcccctttaatcccccttcaagatctatgtgattctgtttccgcaactgctttgtgtggtctacttcaaggagagcaacacgtacggatgtctgtgcggatatgcgagtatggatttttaaatatttgttttttaaaatttttttaaataaatttagttggcatgctgttgcgattgtccggcggtgaaacattgcttcacttcccagcaattattcactacccatggtgggacaaaaaaaaatgttttttaatttttagattggattttttaaatttaaaaatttttttgaaaattacggattacgtattacggattacgccaaaattacgcctttttggacctccgtaatgacgattacggatggccgtaactg

SEQ ID NO: 6691 - DNA, 2524 bp, Heterodera glycines
cgtgatccgagatcacggcaccccaaaaaccccgtgatttttgtgatcacggccagccctgattctgaggaggtttaaaaataatcccccatgggctataattagagcatatacggtattcattcttaggggtggaaattccgcatttcgcgccaaaaagcgaaatgcgaaacgccaaaaaatgcgaaaagcgaaacctcggcccatcttgctggagacatattttttcgtgcatagctcctcgagacgaatcgattggtaatatcatttgtgccgtttttttacggggcattgactaaagtacacccgtgtctttttttatggtcgtgtgaactgcaaaatagagccaatttttgattaaattcagcttgttttgatcaattttagaacaagtgagaattttcaaaaattttttaatttcgacattttgtttgtattcgggttctccgaccctgaaaacccccaataccaatgttttgacatagtttggtattattcaatagccctaagataacagcagagccagcaattgagttttaaactgaataaaataatacgatataacccacaatatttattacaattgagccgaataataatgaacaatgaatgatgttctaatttgataaataattcaatctagcatcgcttctacgcaaaagcaaacccctctgaacattcgcgactggccaaaagcagcattttgtgaagagtttcgtaatcagggtattcgggcaagtccagctggttgaagcacgtgtgggcggatgggagccgactgttggaacgcgtgtccttttgtatacttaagtgcgtgtttgttagagaggaatgaatttgtgtgctaatgcttacgtgaatttctgtacaccgttcattccatcgagatgcgcgaaaccctgcagcggaaccttcgaagtccctgtgacaaattgaagaaatttggccttgtcctcggcatcgaaagctttaagagcgcgccagaacctttaaatgtatggcaatagatatttaatttgttcaatatgttatttgttgcactaccattgaatttgcggactcgtccgtgtgtatgttttgtattcagtgtttgcacaaaggtcgtcgatgtcgatatcgggcaggccggagataagcaattccaactcttgctcgttgaaaatcgagatgagctttttggggatgacctcgtagaaaccctcgagaaacgcgttcaactgttgccgtattgagcctaaaaatgttttttttgtgtaagaaattctctttcccctccaaattacctgtcattttcatttggcacatcaaatggacgtattcgtgtttattggcatcggtcaccgttgtcttgttcccattttccaacaactgccgagtcgatcgcacaccaaactcctccacctcaacagtaaaagtcagctcggctccgaggtcctcaacggcattgttcagcaaaaattccagcgatttgaagaggtcggggtcctcactctcaatgtcctggtaccgaactggaaaaaatttaggtcggaattaggttctcaggttcttaaacacaacgtccggtgttaccatgcttgttcaagatgtgcttgtaaaaggcacgagtaaagtagcaatcaagttgtttgttgtcataaatggccttggcgatcacacgaccaacaaactgaaatcaaacaagttttcccaagtgagctagaggggagggaactgaaccaggaagaactgataaagggtaaaggcgggggaggaagggggggggggggggggatgataaattgctgcattccgaatttctataagtataattaacaaaatttgcaaaaatatggcaaaatatttgctacaaaatagtccaaaaaacaattgcataaaaatactcatttttttttcttatttcaatttgtccatagattagctatcttgcaaaaaaaaaaaatgccatggcccaatggcttgggcttgtaacccgatacccccccccccccccccgcctcgttgccgtcgttagtttggttgcttcgtttgccgattttcccatccaatttgagccatacttgagccgaccaacatcggcagggagcagcaacaacggcaccactactctcagtcgagggaagaagaagaagaagcggattatgcccgggtttaagcggatgcgccccagccaaggcatccgagaggaaaagcatttattaattttttttttaattaaaatatatcaattgaaataaattttatttggtgaaataaatttttttgctaaaatagtgtgcaaatccatttagtaaaataaattttgtaaaaattaatttatatttttagtgtaaaaacccgttttataaaaaaactagtaaataattgattaaatttattttttattttcatttatatcattttttgaaagaacttcatacttcaatttatttcaaacatttttgtttcataaattttttgcatttttaaaatttttctttttcaaatttaaattgctcatcaacaacattacgccaaaaaatgc

SEQ ID NO: 6692 - DNA, 1339 bp, Heterodera glycines
  misc_feature (1253)..(1253): n is a, c, g, or t
  misc_feature (1255)..(1257): n is a, c, g, or t
agggggggggggggggggctgctccccaaaatttgtacccggaagaagcccaaatgctcgggattgacataagagttcttgttgatcatgtaagtgactcggtcgccgggagcagtgatgaacagagcgtaatccgggtggaagatttcccttgtgatcaatgagtaccattcgcgcaacagaccaccttcaacagaatttctggggtattacaaggcaaaaaaacaaaagcaaaaaaattagacccttgtcttgccccttctctccttcgaaaatgatgtacagtctcgccttccaatcattcgggcgcaatcgatagagctcgcgaaaactgtcaccgaacaaatgagaccggcgcacacggattgcaacgtcttcgtgacgatatctaataccaatttaaaatgagctagtttgaaatacgtgagctttgtaagggagggggggggggggggattatgggaaggcattggcgagcttaagtaaactttcggcagaaaattcgaagcggggggatcgacccttcccctaatgtttttctgtaaaaaataaaaacagtgtaattaaaatcaattggcagcgaaaattctaacccgcaaaagtgaacatttccttctggtatcggcccagctcatcctcgccggagttgccgcccgcagcagaggaggccaactgaggtgaagaatcgccagttggtgcagtttcagggagtgcagatggagccaattgagcagtttgcggtatcaccaacgaataagagaggaaaaacgcctcggcagctaaaggacaaaattatttatttatttggtgcgttatttatccaatgaaaaaaacccgaccattttggaaatacaaaaccgcaggttgcgaatcttcggccttctcgagaagggacaggcaattgctcagctcctcccaaagtggcgccagctcatcgaccatgttccggaccagtgttgcctcgtcactttcctccttcgcgtgtgtgtcggcttgaggtttcgatgtcgttgcctgctgctgtgccgcggctccatccttctcagtgttgttcttttttttttttttgagttgcgctttcttccgttgtttcttcacctttttcaactggttgcacaaatattgaaactgaaaaacaccaaagatatataaataagttgtgataagtgatgcaatcgcaacaaagaaaaactcaccgtttccagcgacttcagaaatttgccgggaacaccgtctagaccccatactatcgngnnncagcaacaagctttgttgtccttaacggaccatgtcaaaatgcacaagggaccaaacacaccggctccacactcagcagcac

SEQ ID NO: 6693 - DNA, 1730 bp, Heterodera glycines
  misc_feature (92)..(92): n is a, c, g, or t
ctatatatttactagatttcaatgaaaaatcattattttacaaaaaaaatcaattcttaccagtacatttttactcccgtttttgggtaaanatttccgggagcaggagcgggatcgggagttcaaaattttccgggacgggagtcctgaacgggaatcccgtaaaaatcccgctcccgttaaaaatcccgttcaccgaaaaaagcgggagtcgggagcgggactcccgtaaaatcccgcgggagtcccgatcccgccggactctagtataaacattcaaatcaattttctgggtaatgaatgaatgataaggaaggttgttcttcaattaggttgctgatggagcgcaaaatgtgtacgcagtagaagaatttgcacaattaaacgacgcattggtcggacagcttaaggctaacatttacgaaaaaacattgaaagacgaaaagggcaatgagaaagatgaggaggaaacggaagaacaggccgaaagtcagccccaatcggtgagggcactgaccgacgccaaaatgggaaaaacgaaggacgaaacaaagagcagacggatattctccgaagaacagacttttcgcgaattttaattgatcaaattaggcttaagactggaaagaaaaaggtagaaacctttatgggcttaattcctttttccacaattttcaaagctgggtaaaaccacggcttagccgtcactccgggggcagagtcttggaactattgcaaatggaattgtgaatttataaaaaaattcttaaatactaagaacgaacagcaggcaaattatatgcgtaaagtgatgcgatggattattaatttcaaatatgacccaaaaggaaaattttctctaagaagggcaaatttgtgacctcggcattggcatcactgtccgaaatgaatctgtgggaaatgagcaccgtaaatctcctcacctcccaaagtccatctgttcattctcctctcactaacaaatgagttcattcttctcaaccccaactcctcctgccataatcaaagcaattcaattttttctctttggaaacatttgaaaataaaatgtcttaataaatgcatttcgccaaaataaaatgttttttaatttttttctaatttttcgtaaaaatcttcctctttcccggcgagatttcctttaaaaattgacgatattttacggggtcggaagaaaggtgggaatctcgttcccgtcccgctttgaaaatagatacctacctaatttttattcacaagtttaggttttgactaaagacaaacaataaatttataaaagactgcattcaaactaatctttttttctctagctttgttgttccatttttgactttaatttgtattttattttgcgtctattcttcaccatttgttcgaatttaaaaatgtcaaacaacgaaaatgaaaatgtgatgaatggagaagccgtgggaggggtggaaatcaaagtggaagccaatgaagaagtgaacacggaatcgcaggaggacggagaggaggcgaaaagtgagcggaaaatggcatgaaatcgcttacgcttaatttgttaattggaagttctaacaaattcgcaaataagggatgttttcagttccccagttcagcaaagagcaaatggaacgttcggtgatgtgctgcacaaacgaaggcgaaattgtcaatgtacgtttgggatttttaatttgtgtgcccatttaaagaaagcgaat

SEQ ID NO: 6694 - DNA, 2999 bp, Heterodera glycines
tattctttttatatatttattttttaatttatatacttcaagggccatttgtttgttcttttcgtgatgaatgttcttttttgtcctttaggtgcccaggaatgcgctcgttgcataatggacaaatcggcagaagaaattcgggagatgctttgtctggaggatgtgagacttttcagtctcaacgacttcttttctgtttttgctcatttttaaaattttaggatttgaccgaggaagaaaaggcggccatcaccagggaatacgacattccgcgcgactttcccaccattccgttgccggaccaacccgagctcagtgacgtgccggggacgagcggaacgtcgtcaaattcgtcgaacaatgagggaaagaaaatgaacggctacgcgaaaaggtgaccgaagggaaagggcatcgaaactgaatgaatttctaagaatttttacatttatcgttcgcgtttttcgtgcgaaatttaaattcttttatttttagcgccgggggctcccgtcagtcgtaaattttcaattggatgaaaaaaggaccaaaaaacattttgattttgacgatttgtacaacagcaattgaaggacggcttggattctcttaatgactttgtattgttttcatttgtttctcattttgatttgcttcttcttaatttaacaaaaataaaagtgtaaatgcctttggaaatgctctaattcgttttatgtcattaaaatatttattccacccatttgagtgcgtccgatcatccgattttatttgttccccgactcggtcgagggcagtcctaattttaatccttttaaaactcgattacactttttttgttgctatttcagaataatttaaatggcaaactttccgcctaattctgacgaagagttcgaccgtggcaatttttcatcattgtcgggaatggtcggcatgaaccaacgacacttggactggttaatgaagtgagtcattacaaagttcgggtgagcactgacagtttcaattcttcagaaacatatcccgcgaagacatggccgaactccaacaaaggacggggcaatgcgcccgaaaggttggaaatgtttttgcggcattttgagtgaccttacaattagcaaaaccatttgaattcgatttcaaaatgtgctttttttagtgacttgcgccttcgattgtccaacttttatttattttttcagtgtgctgtgacgtatggaggtccgatcgtcgtcgttaccatcggtttcctcgagtttttgcgccgtaaacagaaccttccgatcacagcgccgcgctttttgatcggctaccccattgtttgtccgtttcccttccatttggttttttgagttgctaagttttcagatgtgtctcacttcggtggcccttggctcttccatcggcttcaaaaggtcgggttgcggtgcggaaatgcgactttttctcgacaagctctacgccaaagttagacatccaaagacaatttttttatgtttaaaacatacagatggatatttcctcgttttttcagtacgactcccaaatgaatgccgctagcgctcagatggcgccaggcgttggcggtggcacttcgccaacaaaaacctacgcccaattgcgcgaggccaaccgcgccggtcgtccaattgaattgggacagttgaagcaacagcaaacgcgacaacagcagaagaaaatggtaggcaatcacacaaaaagatgagggagtagttgctaacaattaaggacctataaatgaatttcaaacgcaaaacagttttaatacattatttaccagatccatggcgaaggggagggtccccaaaatgcaatgttttttgggtcaattttctttgtcatattagccaaaaaccaaaatgtgttatcctcctccgaatactttctagttaggctcctttttctgtacccatatacttacaatcggtcatatttaaccaaacatatacattaaggaaagggggcgggcagccaaattttttgcgaagatggtccagttatataaaccaaaaaatgatgaaatttcgtaactttgaattatttttgaaagtttgataattgatgtatttttaaggaattttgttcaaaatttcctcataaaaaaacttaattttttttttaatgaaaatctaagattcccctccctccctcaatgcgaaaaggtcccacccccattttgggcatctgcggcgagcaacaaaccttttgtttggtggaaataaattaaccaaataaatgtctccaggacggcaggaaagcgacgacggaagggactgagggcagcggcggagtgccctccgacgagtggggccgtttcgggttggacggagtgttcgccccctctccgcccgcttcgtcttccgccgatggcaccgccccttctccaccccgtccaaaatcgttctgagtgatcatttgctttttcttatttcatcaggcaattattgctcaattaattaattaacaaaaaagcgccgaatggtcgcaaatgaataaaaatggttcactttttgacctttgtttccttactttacattcgttacgattgttttttctcttatgaataaataaaaaatgcgaattcattgcacatttattatttttcgtgatttaaaaaattaagttttctgcaatagaaaaagaaaaaatcatatagcataaaacttttgtgttgatcaaagagaagaattgcacaaccaaaagagcacaaaattttggtgcaaagtgaaaaagacccaaattctctacggcgtttccgatggaaaaacgaaaggtcgaaaaccgagtttcccgaagagtttctgtatttaagggaaattgcttaaaattggcaatttttaagtaggcgattttaaacttagattattgagacacttcgtacaaatcatcttgagttcgtcacattccaaagaaattttccagccaatgggaaatttttttccaaaatttttcccaattttttcagggcttttttt

SEQ ID NO: 6695 - DNA, 2253 bp, Heterodera glycines
  misc_feature (2214)..(2214): n is a, c, g, or t
gaaaagcctttgtgctaacagagcgacctttggtcaaaaataacgggcactccttccctttcccttccctttgtccattctttgggccgttctctctttggcccttttatttcgggttttttcaattttctttccaaatttcgcatttccaagggtttcccatgggaattcgtccgtacgatcgccccaggccctttccccccctttccctgctgaaggcttttgccctttcgctttgcattgcctttggcgttcgggcgcaggacggttccagcgagttggtcatgtcgcagaccgtcaaaagtgcgtcggtgctcggctcgcggctcagagttcgctgtacggatgagaaccttcgactttattcggtgttttccgtttaccgtattttgactcattatcgtaacgaatgagtcaccgtctcacagaatgccaccacttgtgccgatgagcgtgaccccgagtcgtgcaagtagggcaaaagcacgaatgaagaagccgctgcttaatgtgacgatttcagaatgattttcaccacgccggcgtcgaacaatccggcggggagagacccaaagtgtgacaatccgttgctcaaggatttggccgaccaatgccgaaggtgaacaaggcatttggcaaccggtttaaagcatctcctacctaaaaaggacgtgcgcaatttgttgcgaagatcccgtctacgcgtgccaaaacgacgaaagtgggcattttcggctaattaaacgcctaattggtcggtccattcgttcattaaggcggcattgtcaactgcaatatgaacgtggagaaatgcgggatgttgggtaattaattgattgtgcgtcattttatgcccaatgcgcaatttccaacagaatactcttcgatgatgatcaaattttgccccgccacgtgcggccttgcttaacgaagcgatgccgtgaccaaattgaagtcatttttgagcaatttccgagttggcatttaatcattggcattttttaaaggattgcgaagacatgaaaagtctttgtacaaatggtaaaatgtttttttaatcgattttaaataatttcttttgccaatggcaaattgatcagaattgtacgccacttttatgaaccaccaatgcgcgcgcacttgcggcaaatgcgagcccgaagatggcgactttgaggaggaggagaagtccaaggagaagggcgagggagggacggacgaaccgcaaatagcggagccggaggagggcgaccgggtcgagtcggccgaggatttgccacggcgaattgtcagtccgccgaggggacggccaaaaagtgaaattcgaatttcggcggaattaaatgccaccgatttccaaatgattttgctttttcaagacgaaacttgcgtggatttgatgaagaattgtcgccgcaacaaaaggttctgccaccacccggtgtacaaggagatgatgcggaagaactgcgcacgcacttgcggctattgcaagccgagcggagggccgaggggcggcacggcgtcgcggggctcggcggaagcgaaggaggagaagtcgcacacgacgggcaaaagccgcaacaaaaaagagtgcaaagactcacaccctttgtgagaggggggaaaaccgaccaataaattgaccaatcattaacaattaatgaggcaattagaagagaaaaacaaaaccaatcaaatttagctgcaaaggatgggcaaaaaacggatactgcgaaagcgacgaatattctgaggtaatgggtattataactaattaatgaggactcactcaatagaaaacaacatttgataattgaatctaattaaggaggaaaaacgagaaaagtgcgccaaaacatgcggattgtgttaatttggagatgttaatttattttatgcttatgtttttgattgaatgttttaaaatatcatcataaagcggttaaatccgaaaatattaaaaataaaataatgtgaaacttatcgtatagtaatcagtgattactaatcacttttgccgtggaaagcgtgctgattgtgcctaaggacttccatagccattttgggaatttgagaaccaagcccattagaaaaccacttgttaatgaggggtttccctgggctgatcggtcccaatttacccgccccaactcaattccaattccattgtaaatggctttattatagggaaaatgcaaaatgtgaaattanattaaaatgaaaaacaattttttatgtttcgctgaataa

SEQ ID NO: 6696 - DNA, 1459 bp, Heterodera glycines
acaaattcattatatcgctttcgccgcttccgttgcctttatatcgctcttcccccccccccccctcgcccattcattgactttcccgagaatatgtaccaaccaaccaagccccttccccaaaactccatttttatgcagaaactttagggttgtgtgtgtgtgatattagggttttcattattgctctgctatgaaaagttgtagaaatttcaaaaaacttcttgttcaaaccccgtgccctttccttgctttgcttgttcgaattcagtttcagggttaggtatccgagaagtatacgaaatggagcattttgcttctcaaaattgcttgcgagaaatgatttttgccaagaatcgaaaggcaaaaatggcaccgaagatcacaagacaagaccaagataaaaaaataatggagaaatttggcgttaaatttgcgcgcccctttgttgattttttaaaaattttgtcttgcagtcacataattggaaagtaccaaaaaaaacaattgcgattcatggccaacaaatttcaggatcttttgctcactaagcagcaaattattttattcttactagccaaaaaaacccaggaagaatccatcataatcagcttcatttatcgccacttatttcttcgcttgcctattgcccgccgctgtcgccaaacctcaacaaatcatcagtctcaacaatattacctaactaactaacaaaacaacaaaacatttctcatcccagtcggtgccaattcagtcccaaaattttcccgcattttttccaccaaaaaactcaccattttcgtgtgtaagagaagtgctgaatttaaaacaaaacggtgcaacaacagcaacaaacccgccaataattgccatacccagcagtaaatggacgtgcctttgtcaggtagaaaaaaaaaattttttttttttggggggggggggggggggggtagaaattgtaatttttacccgggaggacgtgtgctgttttacaaagctgtgtaaatatatgcttttaagtgtttgtacaattcggatgaaacgaatcaattttcaccaacattaattttttgacacaaattttttcgggccggacaatttggcgtcattcagttaactttttttcaaaaaatatagccaaattgaatgctctgaatattcttggcatgtttcaatctgcaaaattccataaaattttgccaagtttcaaaaatgtttaaaagaaaaagaaatttatacattaatttttaacccttaaaacgctcatcgatttaaaaaaagtttcttttcccattcgggattatgccaccaaatcctcggctacaaaaatgctattttttcaaatgcttactattatctaacctttttttttggaattctttgccctcttccaaagcccgcgtttttccattttttcactcggggattacggtttattttttatttttttgacatttac

SEQ ID NO: 6697 - DNA, 2524 bp, Heterodera glycines
gtgagtggaaaattttgaaatatgaaaaaaaaaatctttttttttaatttcagaggctcaggaatcttgacatggctctcagctaaagcggttgtcgtcgttcaacgaattttaggggaaaattgtaacaaaaaaattttttttagggtctcatcaaatgctcaaagccgaccaaggcgaccatctcattccagcttaaagacttttgcgattcgggtgtgacagacttgaacacggttctcaggtctcggaaaaaaatgaatttttgtaaaaaaaaaattgcaaaaattttcgctttttagagtgggctttcatctcagttttcatgccattccaaacacaacgagtccaaaaaatgaatggatcgccaattatgtgacgccggtcatcgaggttatttttgaggattttttgtggttttttggcgactccaattttttaaaaatttccccatgtccgcaaatggtgatatttagggagtccaaaaatatgcaccaaaaatggcaaaatatgcacataaaaagtgaaaaatatgcacataaaattttccaaattaagcgtaaaatctctcaaaatttcttccaattcgttaaatttaagctaaaatagctaaatatggtataaaaaatcatttttgaagaaaaaatacaaaataaagcatttatttattaattttggcgaaaattgaataaaaatcgaaaaatttcagttttttaacttatttttgacataaattaacaaatttttaagaaaatttaaatttaatcattatttcgacaaaattttgctaaaaaatgtctttttcggaaattttttcggtctttaggagtcaaaaaggccaatttacctcatgggggccgttttaataggggttttttttggaaaaatgcccaaatatgcgcataaactatgcatgaaatgccaaaatatgcattttagccgtctgatttaaaaagattgaattttaaatgcaataaacaaaaaaaaaacaaatacccacaaaattataaacccataggagcgtaaaaaatgccaaaatttccatgggatcaaatttttcccctgattttaattctcgccaattttttgaggctttccaattctatcattttttttttcattccaatcgctccactattttatttttctccatccataggaaacaatcactgacggtggtccggagctgaacctggaggaggcgttctggtccagcgacatggacaaaacccacccggtcaagggcggcaaggacacgtactcgctggagttggagatcaaggcgctcacatttctgttccaaatcttccaaaagagcaccggcgctgtccagtacatcacactgtcaaagtatggtggcgaggcgagaaaaacaaatggcatggccaagcaattttgtggcaattttggagccaaatttatttggaaccaaattttgggtttattttttgatgccaaaaaaattggttaacctcacatttgtgccctagacattttgtcctaacaaaccaaaagatacagcgattttttttgcaaattattaaaaaaaggaaactaattcttcataaaaatttcaaaaaaaaatcgctgcaaaatttacaagtttttttaactcttctcgaaaaaaaaaattcagcgcaaatgatagggagggggagggtggtgaccgtaatgtacccaaaaatgccgtattgtaggatcaggtcaggtcttgttccttgagtccctctaaaaatgccgaatccggtccaatccctgcagttttttcccatcaaatttatgcgcttgaatttcttacaccttggcgtcatcgaaatgacttgccattattattattaaaacgctgtttaatgaccctaaaatttgcctgctgttccctctccacagtttgcacagtcggatcagcaactcgtgcgagccggagctgatccgctacatcgggtccagctcgatgaagcggcgccagttcattgaggaccgcctgtacatcttcaacctgggccaactcggcgaaaatgatgtgatctacttgcaaggtctgtctgtgtgttgtgtttgtgtgattgatgaccacgagcgggagcagttcactgacccttttgccaaccatccttccataaaaaatgaaaatttttcaatttttttaaagattttgtagcatttttcttgaacaaaccaaatgggaatttaaaaatttttcgtttgacggggaaaaagcagggattaatagccgtttcgttccaacaatgaccaatttttaccatttgtagtcaaatttttcaaacttttaattgttttttttttctctttttgcacacaatactaaaaagctggtaaaccatcatggtaaatctgtcgaaattttgctttttgtttcagcgcccgaggtgtacctgacggtcacgcagttggcccagtttttgctcaagcatggcggtgtgaccagctcggacatgctgtttcgcatcttccaaacagcaccgtccattccgttgccaatccgggaccgtattcagaacaaacg

SEQ ID NO: 6698 - DNA, 2581 bp, Heterodera glycines
  misc_feature (98)..(98): n is a, c, g, or t
  misc_feature (2438)..(2438): n is a, c, g, or t
  misc_feature (2516)..(2516): n is a, c, g, or t
cataagttttgccaatattcctgtccaatttctaccgtaaccccctcgtctctcgttgcagttccttgcccagcatccgtttgtgttcgcgccgttcnccgcccaattttatgtgggcgtccggcgcaatttgccctactttgactacggcgcgttcatccgcaaagtgagtaagaaatttaggaaaattttttggcccctcaaaatattatttttcccgattttttaccattttaaaattaaaatttttccgatttttccctaaccctccccccgtcccccgtttttgcagtcgttccccaactttcaaaatggcattggcacggtgtccgccgtcgccgcagcagcagccgccgcctctgtgcgtgcccactcgcgccccgtgctgcagtccaacgacagttttgagcagccctccttgctggtggacagcatcacttcggcgctgaacaatgtgaatgggccgggcggtggcgtcgccggcggcggattgggcgccattgccaacgggtaaataaattcacatatagtcattgtactggtagcagtacttgtacaaggatatggcatggccagggcgtggtgtgcggctatgaaaaatggaaaatttttttttggaaaagtttgccgttaaaaagcaaaaaaaatttccatggcggtgccttagaccctaaattcccataaaaattaaaaaatttgattaaaaaattgccattaattggtcaaaatctgtttaaaatcctttccggcggcaccttcgccaccacctgacaccaaactttaattttttttaaaaattatttccctagaaaaatgtaattaaactcgaaataatttctgaaaaatggtaataatttttctttttgtagggcacgttacggtgcgccgcccacactggtcaacggaggcggtggtggacaacatggtcaagcagtagttgctggagggggcggtgccggaggactccatggccacacccattcccatcacggttcatctggtggcggtggcacaacgccaaccgttgccggaccgccgacagcgatggcaccgccgccgcaactgcatcaccaccaccagcaccaacactctttgcatgcccaacagcaacatcaggccgccgccaccatggggattggaggaggcggcggcggaggagggcatgccgccctcctcgtgaacaacaaccatcatcatgccgcccccgcccacaataatcatcatcaccaccagctgcatcatcaccatggcagtgcgggtgccctgtccagcatggcgactagctcaaacggcatcaacagcaatggcacgataatgccgtcgttgacaaacggtatcgtcagcggcaccggtgctggtggtagtggtgccgttgtttcgccgtcccttatgcaacaacagtcgcagcagcagcaccaccatcatttgatgccggtccagtcgatgccctccttcttggcacagcaacagcagcagcagtcgacgcatcatcaccagcaacaacagtcgcaggggagcagcgccggcgccgccgccgcctccactttgttgtccgctgctatgatgaacggacttggtggttcgcagcagcaacagaagccattgttcgcgttgttcgacctcaaaatgggtgtgtctgtctgtctgtccctctgcttacaattagtctttctttatctctctttttatttctatcgttttttccctcctcctcccctctctttttctttttttccctcataattctccttcctctctctttctctctatctatcttttcttaactctctctttcgttctttctcttctccctttctctctttcaatctctctctttctttctttttctctctttctctctctctctctctatcgctttttctctttccttaactctctgccgtctccctatttttcttttaatattttcattctcgccctttccctttctctctctctacaactcttcactgtttccagatgaccatcatcaccaactcacttcctccatccatcaggacggtgccgcttctgctgcttctgccggtgcttcgtccagtcttcgttcagcaacgaccggtgcagccgctgcttcagtgccgtcaattaccacagcgtcattgccgctaagcggtgccaatggcagcgcactgaacggcattggtggtggcggcagtgttgtgacaacgccgacaaatgtgtgcggcggtggcgccaacaacatttggacatacgggccgtcctggggtgaggagaaccgaaacataaaatgccaattttgagatttttttggcactgccagggaataacttacaaagattttaaaattcattactttttcattgaaatttcattttttttcattccttccccctttgttcccgtagacatcgagctgctcaagttgtccgtcctgtcctcctcgttcggcacctgcnccattggcggcggcgctggcgctgggggcagcggcgccgcttccctcactggcggcggaacagtcgactcggccagcncgttgtcgccccgcgttgccgtgagagcgggtgtgggcgggaacaggaagcgcgagtttgtggaa

SEQ ID NO: 6699 - DNA, 3276 bp, Heterodera glycines
cctgcaggtcccccccctcatttatccatctactttcattttaatccgctcaaatcccaccacattccttccctttacaacatcatcccattttcccactatcccattcccatcgcggattggcttagattggattacatactttggaacaaaatgattgagctttcagattgcatttgttttttcccatagaaatatgtaagtggaattaatgaaattcaaagtaaaatttaaaataaatggcctatcagcactaatcatcttttacagatccctatttacttaattagttcaaacaaattgctacttgttaaggatcttctctatataaattttaattttataattttgataattttcatttttttttaaattttattttaattctatttataattttataaaaatagtaaaactttaacatcaatatttttgtgtcaatttaagccttattttcctaaatagcaacttttaagtaaataaaaaaacattgtaaattttcaactttcaacttcaaacgtcaaaaaccattgccagaaaatgaggaaggagaacaacaaaagcagtgccgcctcagcagattctgatgccaatgccaaaagtggtggcgatgcttctctcaccgcccccactgaagaggaggcggaagaaatcagtgccaatgagcaacagaaggagcagcgcaagtcgctggacgcactgtacgctgcggcacgcgaggagttcgatttggacatgagccctttggacagtgcgatgaaaacgttgcgggagggccgtgagatacaaaagttgtccgtgctgcgcaacctggtcgagctggtggagggcgagccggacgaggcgttacaccgcctgttgcccatgatgcaggtaatgttttggaccagggccggatggaattaacggacttgcgaaattttatttctaattttaactgactttgcaccaaaggatctttcctcgtgggttttagggaaactattaaaaataagaaaatttaatatgaaaattttcataattatgtaaccaatttttaagtataaaaaaaatggcaaatgccataaattaaatttatcgtaaatattaaattctgatttgattcaaacccaacttaatcaaacggggttattttgtattatactgttaccgtaataattatcttggtaggaccaagattttggtttagggccacaaaagtgagcagttgtttcaattgttattcccaaattaggccataaattcatcaacattaagggacttttgtcggttacgccaagcaatttggacattcattgtgaagcggcaattgcctacaaaaattgcattaaggagaagaaactgcagcagaaatgcccgtaattatttaattgagcaatttaatacttttgaataattttttcccattttagagaactttctgatcgttttttggtggcaattctcgagaatattgaggcgcagaaggaaaatggtaagtgaaggtgaatgattacagagacaaatcttggacaaattaaaggaaaagagattaagaaaatcgcatttatgatttttaataaacaatttttttaaacaatcaaagaattaatattacacttaatgattttaataaacaattttttttaaacaattaaagaattaaaatttttctcatccgcaatatcttacactttacgataggcgttaaaacccaacactaattggtctaaaaaatattttagctggttttcttttgtgtcctattttctggctctttcacagaaatttttattcaaaggtcgagactcccgacttttaatttgcatatttaatctaagccgcgactctcctcgaagcgacgcaatcagtcaaagcatataaaattatgaactttcgatatttttggaaccgaaatcccgagacttttggccattggttgcctaatccgatttttttggtgggggagtggtgggtgaatcatcagctgctgactgaaatgtgtcatatgaataagtgaatgaatgaatgggtgtatccctcactcccttcacatattcccccgttttgaataatgatgcaagtggcgattagcatgtaattagcacgctgaatgatggtcatacgtttttgattttacaatcctttaagcatttataaaatgatattcggtgttggtttttttgctgttgttgcagcaattaatcaattgcgaaatttataagcaaaaatttaattttattatttgtaaatgctaaaatcaaactaacaaataagcttaggttttaaaaatttaattaccactacagtaaccgccactgcttggctggaatcgctggtggacattgccgactgtgtctccatgcaatccatcgtaaatatggtaaaacaaaaataaattaaaatttatttaaatgataaaattaaacaaaaagcgccaatttagcccataaagcagctctgtttttttgtctgtttgtttgtttattttatgttggaagaccataaattttctctttacccaaactgtgccacccaaagtggcccccggggggcaattgttgccaaaaatgcggggggggggggggggggcgaacacaacaaaataatacaaaggcataatgccaaagatttccccaccttatagttagggctgggatttttatgttttaacatatttttttgcggcttagttatggcgagagaagcccaaaaatagcattttctccgaacaatttttgatttggagcgacttataaaaacataaaaacacatattttggcgttttcgcacataaaaacatatcgcacatatttcggggtttggcacatattttggcatttttgaaaaaaatatctaagaaaaacacaaaaaattcaaaaatgcacccctaaaaatcaactttcttgccatttttataggctctttcaaaattttctttatttatttcgtgtaccgaaaatcgaattcttcattaattcgttactggatatcgaagtttcttgctggaacttactcaactgatggaaaaataatctttaaaacaatttatcaaaaaaggactaattttacccccaaatacctccaaatgttttttatttgcaattgtgcgggcaaaaatgataaagaatgagttttttggaatttttatgcaaaaataccattggtttttccaatttttagcacatatttttgcattttttaacacatatttaggtcttttttttggtttttagcacatattttgggtttttttagcacatattttattacatatttcaggatttttagcacata

SEQ ID NO: 6700 - DNA, 1587 bp, Heterodera glycines
tttttaacacatatttaggcctttttttggttttagcacatattttgggttttttagcacataaaattcccagccctactgtcaattttcgattattttttttacctttgttctttattttaggtggttccattggccgttgcacaagcggattccggaaagagggttcaacgacgggttatttcaactcggctaattgagaaattggcactgctggtgcccaaggaaatgtaagttgttgcaaagtgcaacaaaataatcaaaagtgtttaatattttgatgatatattggaactataaattaaaaaaagatgccattaaattacaaaaacgtttagcaatttttttaaaaatgagatatatgacatctaaaaatatatatattttttttgtttttcagtctccagagagaattgtcgccctgcgcccaaatgctgtgccaagatccgagtgccgcagtacgcacatcaatcgcacaaaagttgtcaatgttggcacaatcgctgaagtaagcttaccctctaaatgtttacagtattctaattattaattactgcctaattgttttagctaattactgtctaattgttttggaattactgtctaattgttttagcaattacacggattgttgcactttgcttttgccttgcatcatccaactgtgcaaggacgaagacccatccgtacgggaggccattctgagctccatggcccaatgtcttccacactttagcaaaggtagaaacaaaagcaagcagattgagcaacgatatttctgatcacaatcgcttggaagatgaattttcctatttggatcagttaaatctgatcataaattaaccttattagcctcaagaaatgacgaatctttcttggccctcattttctaatgatcaccttttattgccaattagatgcaaaaaagtccgtgttgttgccgttgttgcgcaaatgcactgaacaggcactgatcctgcgcgacgcttcgttgcccatcgtttcgcgccactttggctcgtggttgcattgtctacgcgacattttggcaccggcagagttgcgctggtggttggacacgtacgtgcgcattttggactttgcatgccaacataacgccatcaataatgccatccagcagcaggcgacggcacaaaaacaaggtgaaaagaccatgagcatggcatgaggacgatgctcgagaattttgagctgatcagtctcgacaagaaacagcatagccaattaaatatttttaatgtttgaataaaacattttaaattctactaatctttttcttacagcatcagttgaaaatggcacaccgccagcagttgcgggcaatgcgcaacaacaaaaacttcagcaattgtgcgtggcatgccgaagaatgtgtgcttacaattttccggtttgttaattattttagaagttaattttaaaacagttaatttgttaaaaacaatgcagttgcttaattaaagcttggtgtttcgtacaaattggcagattctaccgtacttagatttcctaggctaagcttttcaatagttgtacgaactgcttctaattcttattcctgtcata

SEQ ID NO: 6701 - DNA, 2228 bp, Heterodera glycines
aaaaaaaataaataaaactaaaaatgttagattctgttagaattaatactataattgattcttttcaaattttatgcttgttcccttttttattagtttaaaaatgcaaattgctaaaaaatattcagtgaaaatcccccccccccctccatcattcgtattttgtctttattacaccttttttgtaattttttactaattttaatttcaataattttaaggctccaactgtgccggacactgccgaagatcaagcagtatttgatgttcccgaacaatgacgagtcgttgtccaacttggagcgtgttgtgcgcgaattgctggcatccgaacagaacgcactttcacgacaactcatccaacaggtgggctaaaattgactctttttttaatcatttcggtgggaaaattcatgataacctccgatccaaaaatgcttatcatattcaattccattttcgtcctgtttcagttcgcttgtgaactgtcgaggacagaaatggacaagaaggagtgccgtgcaaaccgtgccaaattggccgaggaaaagcgactgtggaccgagcatgaggaatccacggacgaaactgatgaggctgaggcgggccagcagtacagtactgagcatacagtaaccgggagcgatgcgataggctcgcccgaaagcggcatcttcttcgaggaggactgttggcttggcactggggtcggaaacggtgccagacctaacaaccaccagcagatgggcggtcgcctgtgccgttcggctaccaccacaagcatatcgcaacacatggagacggaggtggacaaaacattcaaataaaaaaatattggcaaaatgataccattaaatttttaaaaaaactgaaaggaagcgaaaaacagaacccaaaatcaaaaaataaaaaaggtgaacggaactaaaaaataatgataaagataaaggaaggaaaaaatattgttcgatttcgaccattaattaattatttatacgtttatttcccaatttaaacgcatcccttaataattaattacctaatgccttagctcgactaagcttctgaaaaacattttaaattatatttttcaaggcccactccaatctcattaccgctccgtccgcttcctctgaaatgctttccgcaatggcaattgaaccctttgccgcttcatcgcccaaggtcagttacctgacgaataaaataatttattttaattaaaaaaaattaggctgctcgacgccgtcctccgccccctccgccaaaaagttggcgcaccaccaccacaattaaatcagcaaatggtccaaaattggccattgttcgtccacaacctcaagtgaaggtgagtgagcccatctgaacaggtttttagctggttttccctattttttgaaggtggtcaaccaacggtcaagcagtccaatgccatttgttgacgctgagcaacaacggaaaatttcgaacaacaaattgcccaatgagacaccgtcggcagcaacatcaaaagcagaagctaataatgaacaaattagtgataagaagcagcaccatcagagtgacactgatcgccattattcaacaacgacagccctcggggaaagaggaaaagcaccggcagaaagcattcgaaaatcgaaacttccattgtcaacgaatggaggtgagagttaaataaatttattttatttagtcttgtagaaaaatattcattaattcattttctgctttattaggccggcaccgctcgtcgagttcggcaccgccggtgccgccgcctaagcccaaattgcctctgttcacttcttcgtctggcaactcacctccatccccatacacaacggcggcctcgggaacaagttcagtgacggactcgatcaaactgaagaaataccgtccacgcgacatttctacgacaagtaattacttatacattgaaatggatcagctcccaatgccatcaaaatagaggaaataaagttttacctattttttatttaatgattttttgaatttaaatttaaaccatcaacaactttttcaatgcttttcattgatttacgatttgagttttaggggctaattatttttaaacaatttataattttttttcttgaattagtcgagacgaaaacagttaaatgagatcattgatcagctaatcacttttattccctttagcaacaatgacaacacgcaaatgttcgctgtcgtccgctagcact

SEQ ID NO: 6702 - DNA, 6532 bp, Heterodera glycines
ttttacttttatttatttattttttaaatttagacactctaaaaaactctctaagccttttaactccttccacttcttcttcttctgctgattttgaattaaaaccttttctctctcaatcgtttgtcctttgccaatccttccaaaagggcttttccaaatcccttttcaattcttttaaatctccaaatttccaccgattaaccacttctcactttcctctcctaaaccatccaaaaatgtcgcgcatggaaaagatttgcgaagacgtgaacagaaatgccgccctgctgaacatcttcggcaactccgattccgtgctgctgagctgctccgatttgtgctctgaaaatggctgtggtgcgatgtcgcgtgcccaaatgatttgcgaagatgtgaattatgaagcgatggccaattcggacggcgggggagggacggacgacgaagcgtatgcgctgatggaatttggcggctctcttttctgcgtgccggcctccatcttcgccaccgcggtccgcgtgccacttcagtcgtcggtttggcccaatcagccggccaatttcaccgtcggaaacccgtcgtcccaaccacaacaaggagatgtgtcggtcggacctcgcttgccggtgagtgactgtcccacggagtggcacttgtgccaaattagggcttaaagctgatgccttgggggttgttgattaactcatctctcgctgattgcccaatttctgtaggccgttcgtcacggcgtcggcggcctcaggcagtgggaaactgtcgccgaagatgtcgaaggctgctgctccacgacgtttgcggacgggccgaagtgtctttttaagttcgtcgcctcaacccccgacgcgtccattcgtcgcggagtgcgcggcctcctgcggggatttatgcggggaggagcagcaaaggtgggcaaatgccgagattaagtgcccccattccgtgccgtgcttcacctcagtgttgtcatcatcgccgcttccgacgccatcagcgtcagcgctcttccgctcataaagcctccaccggaatgtctcttctcggcctcgagttgtgcgttctctgagtgggaaaagtgtgccgcgtcggaaggtgcggagttcgcttggtgtgcggcggcgcagggggccccgcgtcttttgccggcatccgtcggcttttccgaggggtccccgtcatcctctctcttcccttcctcctcctcctctttgtccccttcttcctcctcctctctcttcccttcctccgcctctttgtccccttcttcctcctcctccctcttccattcctcttcaccccctccgacttccgcttcctcctcatcttccacttctgcttctgcttcatccccccattcgtcctgctcctctttctccccttcgtccgcttcaacttcatccccggcctctctttctccgcttccatggcaattattaattgaccaaatgatccgtgaagtacagactgagatccaagctgagaaggtcaccattccgccgagtgtggttggatttgccaattcccttttctctgttcaggcacttcgcttcgactgtcccaacttccaaatgcctcggaagcgttcgttccgtccggttcgcccggcttctcctcctccgcttcctccgcggtgctttcccttcccatcgctttttttctcacctcccctcccccttcttcagattgacttcccctccaattcttcttcgtcctcctccaattcttcgggatccccccgtccgtttctttgcttttcccaaaacactctgcctcaggcaaaacgtgccaaaaagaattcgctcctttcgctttctcacgaggaattggccgagcgcaaaaaggaacagaacagagcagcagcacaacgctaccgaagtcgaaagtcgaacgttttggagcaggaaagggatgaaatttggcatttggagacggacaacgcgaaaatgagggaagaaatggcacaaatttcggatcaaattgccaaactgcggacgaaactttcactagggagataaaaggggggcagcgggctttgtttgttcatttttgaccacattcattcgcaagtgtaaagtgtcgagccacacacagcccatttatttgtttaccgtaccccactccccccactaccgtatacctttgttagtttttgtcgattcaaaaaataaaatattcgtccattttgtttcgtttggtgctttttcttcgtccccctccctctctaatcccctaatttacctaatcgctcccttttatcttttcctttcccgctgccgttacgcatcgaccctcaaaattggccaacatttcccaccccgccgcttcggctgttgacaaagaataaatgaagccacttttgccctggagggttcgccttttggcttttcctcaccttttccggtcctttgcacttttcctccaaatattaacatttctcgtcattcccttcttccgaatgttttttcccagcttttccctcctcctcttctgctccaactttttgctgcttccaattttgagtaagcgaagtgaaaaagcattggctcagttcgcctctgatcactccgattgtttctcttctcagcttacagcaaagaagcatgtgacggggctcaattcgcgcaaatgccgtgccgttgttgcaaaatggactgctggtattccgtggcggggtcggccatgcaccaattgggccatgtgccgggcgaggcgggagagcgcgaagcattggccacactgcgactgatccgtgcgtgtatgatcgcggaatgcacgccgttatgtgcacacaatttgatgcagaaacggatgtcaagacaaaattaaaaacactgaagaaaagaggaagtgggaggggggcgaagaaggacaaaagcggaccatcgccgcgggggtggctttttcctccacggcaccgtccccctccccttcctccttttttgcctctttttgcccctccccgccctctccgctcattttatgctattgccaccactttcctaaataaaaaatgcacggatgaggcgaataggaataaacgaatcctcgacaaagccgtgggcaatacgtcaaacagaaataaatggcttcgctcggggcaaccgattcattccaatggcaccaaatttggtcctaagggatacaattaattaattacttttcaatagcacattatctctatacaatttgttttgattctgtgttatttgtctcgctgataaattggccatccaaaggagctcatttttgtcctctgttgtcgccattggtcggctctcgaattttccttcagccgagaaatgtatcgggtaagaaaaatgccgagtaattggccctaatcggtcgcgcaattctaatttggaattccacgctaatggcacctccggggggggggggaaggggagcagtgccatcattcgcattctaaaagcggtgttttctgcttcgtcgattttgttaaccgtgaaacgtcaggcattcgtcccctgccctcctctcctcccattgtttctccctcccccgcccttcgtcgcctccctccctttctttaatctttgcgttaatccgctgattgcgcactcattggcactaatccgtggcattttgccccagggcaaaccttgttcagttggccgattattctttattggtttcatcgtcataatccacgttaaatttacatttgtcggctctctctccgctttccccccccccctcctttttattattaaatattcccatttttataactttttattttccaaatcctctcaagtttttctccgttgctgaagaggccgtcagcagcacttcctcctccgtttcgccccattcgatttgtcctcttccctccgcgccgctttttccctttcccaaaatgcttgattccctccaattgaatgtgcccgtctctggcaccaatggaaatgctatttacggggtcggaatcggcattttgaatggtcagaaagaaactgaccaacaacaaaagcgatcggtgggtgattaagagacgagaaggaaaaaaagggaagagggagggggggggggatacacactaattagcgataataggccggggaaaattgggggggggggataggggtacgtaagagggggagaagcattcgccgaatgactctttaaacagtggccccaattatatgcccctttcttttgcccattttttgtgtgttctcttaagagtgtttttgctcgtcaaaagtcgtcttcggaggaggcggaccggaagaagcgactgacgatgccattaatatacaggtgaagtgaaaatgccaacccaacccaattggatgcttaatataaatcccgctttccttttctctctttaagagcagagaaagtgaaaataataataatttgttggcatttctataattgctttaaatgattacgtcatttccaaaaagagaaataattgccgaagtgcaattataattgaccaatcgttggctaattacttcaatgagttaaacttgctgaatatttcagaatgtacgaaagtcaaagtgacgaactttgcggcaccgtccgggggccggacgacgacgcgtttcacccggaggaggcatcgaaacgccttcgccacgccttagccgccggaattcgtaggggggggggagagggaaaaagcaaccgaaaactgtgcagaaagtgacgacaaaacactgatcgacgttctgttggagcacaacaatttccagcgtcagaaaatcgccacagcttatgaaaatatgtacggaaggtcagtgtttaatggggagaagctaaaggaatgaaatttgcaatttatttgaggattttggcggatgacattgaagaggaatcggggggccatttcatggaatccattttggtaagaagggcaataaagaatggggggaggtaattagtgggaagggggcaataataaaaggggaagggcactcagagagggggggggggaaaggacgtaattggcacagagaaaagccatccctcacttttgttcgttgaaggctcttctccaacctgcgcatgtttattctgcaaacactctctattttgcgatttctgtgagtcaatgaattgccaaaaacataaacaaatccccgccttttgttagggcaaatccttcgagcgaagtgccgcggtggaaattgggctgaccagtacggcatcggttggtatcccttttaagaagtgtcaattgttcattcattttctttccaattcagcaactcggcgtcatccgcgacacttaccaagtccgttttaccagagaataccgtaacaaccccacaaccaccgtaacacttttcacagaatgaatttcgtgtccaattggagcgcgacttaagcataaaagttgagggattattcggcaaaatgctcgcccaccttttgatgcgcaaaacggactttgccgaagaatttgacttggaagaggcgcaaaaggaggcggacattctttttaaagtggaaacccaaaacaaaacatttgaatgaataaaagaaaatcccatcaggagggaacggtggaagaattgggccgatccatggaactgttcaaccgcgtgttcgggctcagatcggcccgacagatccaagcatttgtcgatcggtacgacaaaagagtcatagacgcgcaaagtgaacacggaaacgaattggcgagcggacggagggagtcgcggacagtacgcaacttcgaatggaccatccggaagagtgtgaacatccactcggacatcaaacaagcgattcttctttatggtcggaatggggaggagggggggggaaggaatgaaaaagaagcggagataaagggcaaagagggataaaaggaggggtaagaaagggggataaatgagatgagggggcggcggcgattttcaaaaaagtaaaactgccatttcagttcgaatttccaaaaacatgcagctttactttgcggaaaagttgcacgaggcggtgtcccaaactcggcccgaccatcagacaatcattcgtttgctcgtctcgcgcagcgaagtaaccaatcgcttctcaattcgattcgttggcccattgttgccattttgttcagattgatctcttcgacatttgcaacgaatacaaaagaaaatacgggcacaatttgatgttcgatttgcaggttttggcatttgtgaaggaaatgcctaaaacgaactctttggacagaatatgtgcagcggcgactttctgcggcttctcagccgattggtgggaaaatcgaaaattaattaatttgtaaagagcggactaattggaggtgaacccaacggacgtcgcctcgggggacggccctttgtcggcataatttggaattgaaaaaacgacgaaaaattaataatgaggaacagttgacttatcacacaataaaagaacaaattaacaggccatcattttaatttattaatgtaatcaatttaatcatcgaaatattcgacgaaaatttgttggaaattggaaaattgggaatggcaaa

SEQ ID NO: 6703 - DNA, 6924 bp, Heterodera glycines
agcacgcgactgttgtggctgaaatcggtaccgaggagatgcccgcggactttttcgacgtcatgcggatgaatgacatcgtaaaacgagggagagttcaaccattgttcctggaaatgtgagaaagaatgtgctcatttgaacaaaagcagcggagaaccggcgaaacattcaaaatgggcccaatcgaatcggacacaaagacaactctcgcactttcgcaggaaaccacaaacaaaaagccattggccgcctcaagaatcaaatgtttaagttcctgatccgtgaggaaagacggttggcttggcattgtgccagacaaattgttgctttgcgcattggccccacgaatcactttcatatgtgaaacggccatacgcagaatggtcagctgagcgaaaagggacaacattttttcgatattctgttatcggattaactttgtcaggtttacgaccaagtgcagcgcactgcggcacctgagaattcacatgaaatgtttaatagcgatggcaacagcgactttcagtaccatgtccgcaagttcgttgatgtaatgtgtcattttgttccgtcttcgccgttcaatttcactgtgattttcacgcgcaaaacgctcttttccctcggctccaatcgaagggcttggccgtgtcgaaagcattggctcagtcaatccatccatttgttctaatgaatagtcagacgcaaaccaacaaatgcaaatgattttctgtaatgcaatgtcttttatattcatagaatcaagaggacttctcagcctcataaatatggaaattcttatgaatctctcccttttatttttcaatttgctcattataaaataaaaataatgcattaaataaataatgtcggagtatttcacatgagaagagaacaaatcactaactaaggtttttaaattataattcatttttttattttacaaatacatgtatgaaaaaaacagctcacatcgccattaataataaaggggattgtgtgtcacccaatgggctgttggctgctttttggcctcttcactggttgtgaacatcgacttgaccgccttcggcacgttcggattgtcctgaatgctgctgaacttagtctcttcttcgactttgctcttcttttgctgatgctccgcgccctttgaatcgccggtcgttttgcgcttcttttcccccgcctttagttttctctgcgcaatttcatcaacaattcgttgttcgtacagcagaaagagttcttcgtccgggtacagcttgatgaactgttgctcctgcattggtcctccgcatccgtaacatgagtccgtctttagttcgttgtgcgctttctcggagaacacgcaaccacacttccaattgacaaaaaaattgtttactccgttcattggcaaggcagtgattgggcaaacccatggcgtctcattcatgtcttaaagtacaaatgtaaatgggaaaaacaaagtagaacaagcatttgatgagcaaattaaacgatcttaattctagaaaacaggctagggatcgtactaattaaattactcaaaattttgcatttttattttcatttttttctgaaatttcaaggacccaacactggccaacatacaaatacccgagattggaatctttcttatgattaaacctatttaaaagattggggattatagtgaatgcttcaccgatgtaaatgtctcctttctccggtccattgtccttccacgctttgttgtcggtcaacatcaactccttaacatcggaaaacgcgtgaatgtgttcagtcgctttgttttttgccaaggttttgtccagctttgcctcaagcaccgcctctttgttgtaaagtctaaaaattgcaatttcagctgaaaatacagtgaataagaaatgagaggcgcttcaccttccaagcttgcaacatacaatcggctttttcagaggttgctgtgacagctggcaagtgcgccattttgtagcagcctcatacgatttctcgattttttctttctttcgtttcttcttgacgagttcgcatcgctttggaatagttcctccatctgcacccattttgtattgctagaataagaaattgaacctaaaatttgatttttcttcagttaatttgctgtgtatacattgttagagatacaaacatatgtatgtatgcatatgccaatattttcgcaatcttggcattctgttttgaatttttgcagcacaatgtaagttttacatcgctttttattatcagaagcgcgaaaagggataaatgtgtgatctgtcctcataaaccaaaagatcgaaataaataaacaaaatcattttgtttcgtctttcacttcctccgctgtcggcggaacagagttctcccacagaaatttagtggcagatgtagcatttgtcaacaacggcgaaaattccggcttgggaagtatgtgcaaattctgacgagtgtctctccattttgacggtgtccacatcccttgcacagatttattgtgagaaaaatgggagttttcaactgaatttggggagcttattgttagttacaaaatgtgttgttcttacatttataaattggaattccactgcgcgtcctaaggttgttcatatgcaaacaaactcgctccatgctttaaaaaagtaattacaaaataaagattttcatataataaaaatagtaacttctttatgaagagagaacacagatatatgcgtgtccagacattttcgcctcggataaatttgaattttttcattttttcaatccaagaggtcataaacagcattaaagaagtgatagaaagtgactgtattcgatagtttgattgtcagtaaatttttgaaaataaaacaattacaaaaaattaatgctgctaaaaaactagaaaaaacatagtttttcttatctctaattctgcttatgacctctaggattgaaaaaactaaaaacccgtttggacataggcgcaaatgtctggagtgaatttgtccgcaaatatggggtaactgaaataagtggcttttggaataaattgccattaattccgattttctaggtagagcaaagataaggcacaaagatttcaaaataaaacggtcattctatacaaatccaaaaaatgtttgaataacttgaatttccaaaaaatttactcatttttggtctctgttcataattattcacctgaaagcctttgcgttcacgtggactagtcgcccatttgaatattccgcccttagcactggcgtcgcgttccttcccggcacaacgtaaatggcacagtatgggttctccgtcgcaaatttagtcaacgaatgttcgatgtaattgcgcatgccaacacttgtttcgctttgcttgcaaaatctgtggcaaaagaaacggaaattgcaagtcaaacatcccttgggatgggtgttcgtcccccactttattgtaatccgttgcagttgcggttggtaggcggacaccccattgaatgctggtgcgattggatttgtggccgacagtcgaaaagcaaaattcagtgccttcgctgaggaataaatggttttcaggcgatccgcgcggggaatagctggcatttcttttttgattaccaaacgagaataaaataaaaatataatgcaaaacaaacggaaagatacaaaacgaatggaacttcgtttactaaaaatgaatgcatttgctttagtttttctgattgtgatcgcaaatgtaatatatgatacagtagtatttttccttccttctcatttggtccaagacacctaaagattgatatgcctcattaaaaattaatgggtttttcggccaaccaacctttgggatgtcgttgaattccgtcagttcctccatttgcttgttgaacttctccactttctcccggtgactgatttgggccctctttgacaaacggtcgaacgccgtctcctcctgccgtttgagaaatgccaattcggccttcgtcttccgcgggccctcttgttccttctttatggtcagatctattgttttcgggtcaacatttcgcttcttcttgaagagagtgccacgcttcagtttcagtccggtcctcaccagcaacatttgctcatttgtctgcaattattcaaaaagcatttaaataaaatgaagcgaaattaacccaactttatgatcagtcttatcctctttggcgctttgagtttcctcctcctctttgttatcatttgggcttttgctccgtcctttgtccattatcagagctatttgtggctaaaacaaaataaatttgtaatgtaaaaatagagagaggcgggctaggtttttaatgggcccggtgatttttgggaaaacccaatttgaccggttgggaaaaggcggacaaaggaattgtctgcttttgaagatccaatcccaccctgcccgggaagatttgaaatcatggtctcttaaaatggataaaaatagaaaatgaaactaaaacattataaggctggaagaattttttcaaacaaatcaaaatttaatagttaggaaataaaaaattaaaatggaggcagaaatcgttaaataaaacaattgaaattgtttgatcaacattccattctttcttcagttatcctttgttcagaatgtccgaagataaatgagtgaaggctgatcggatcattttccaattctctgtgtccaactccgttctcatcctcggacattttttcctcatcagaagtctcttcctcgctattttcttcaatttgatgaccaatttgttggattatggcttctttttcatcgggggccaaaacatagcatttgtttttatttatgggctgccgtactctaatttgtgagggaagcgacgaattagagaaaggcagaaaattcccaaaacttacaatgaatgaattccataattattgagaacttgaaatgttttttcgaaatcattcaaaatatttgcacaattttcatctaaaatttctttggggtcaaacgctggatgatctgcagaaatcttcaaaagagtgtcgagaagtctgtaaatgttttttttttttcattttttgtcagaaacgtccaaccgttcagaaatagtctcccatttttggctctcgttgagttcctccaatttaaccaaaagcgatcggagcagaataacacagtccatcagagctttgttggtcgattgtaagtcgtaagcgatacggtaaacattacagaatgacatccaacaataacttaaatgatcgatgagttgcaaaccataaaaaagaccaaccaatccacaagttgttcgtagatgagtaaatggtcctgaccaaattcaccagggagtcgcaaaatttcaaacgaattcgagtctcgggagagaatgtgtattttttcgtcgtaaataaaaaattcattttggagattcgaaagagaacgacaaatggttgctgattatgaacaaatttgtttaaaaaaaagaagaaaaatgcccactcattttaccttcgttaatgcttaaacgacggatgagcaaaattccgccagaaaaaatgtccacgaaagtgtcagtgccagtcgaagataaaacacaaagaaaagaagaagagagcgaatttggcaaaatatggcggtaaaagtgttcaattgcacaacaaacatttcgatgctcacaatcagtagaagcattttgagtggagttggaattgacagcctaaaccaacggaaagtttaacacctttgaaacagaaaagcatatttagttccctataagattcgcttttgctgtcaaaaaagcaatccgtttttaaaataaattgcaaaaaaagcatgaaaatgttccaatgctttgccattttaccgctgtcaacgacgactgctcgccaatacgcggaaatttgagtgcaatgcttggtcgaaattttagccattcaacgcaaaaaggcgaatatgacaattttttaacgaaaagagtgttgccagtttgagtgtccaaataatagagtaagccactttggaaaacagtgagaagcacttggccatcgggggaccaacacagaaacaacaactgatccttcgacttggaggacgacggaacggacgaaacatcgccaagaaaatcaaagtgtttggcagaatcatcacgagaaaaatttctctaaaattaaaaagggaaaagtttaaactaatcgaattcaaaagcagcaccttccacccggtcttccacaagtaacgcttaaccaccacttctccatcaagtgacccaagcgcaataagactgattttcgggttccaaactgcgtgagaaacctaaaaaataacagaggcaatgaaatttgttagacattcactgatgaaacgaacctcaaatttagtcctaaatttgattttgtcaaaaatgtccttgttttccgcaaccgttattaattcctttttcatattccaattgctgaaatttagaaaaatgattacttttttataaaaagttttcttgaagaagacatatgttcacatttatttcatggaaaattgcaaattcaaaatcagaggaaatctttccttgtaataaaaagaaagtaaactaaataagcaatcttttcagcaaaaacaaatataaaaattttgaaattggaataaatacgatacgataaaaataaaatgataaataaacagaacaaaccaaaatcttctaactaaatattttagtagtataaatcttaaggtaataatactttaaatggtgggcattaaaccatttttaaaattcaaaggatttgaatttacgatctttttgttcgattccgggtatagtataggacgaaattgatgccggattcgtattctccgaccctgaaaacagtttttttcaaaaagagcccgccatctaaagcataccatttaatttcaatcgttctctttgcatttttctcggcgaca

SEQ ID NO: 6704 - DNA, 1808 bp, Heterodera glycines
ggttattttttgggaaaaaaccttcgtaaagtgttaaataggcgtaaaatggcataaaaatgacctaaatatgtttagaatcaccttttaacatttaaaaaattatttttggaggggtacatttaaaaaaagtttttttttaaattttttcaatagaaatttctaaaaattttcaaaaattctcaaaatatgtataaaaaaataaaaaatttgccaaaattttggatttttttttgaggatttccaaaaattttccgtaaaaaacccgcaaattatgtaaaaaaaaaatcaaaatatgtaagaaaaagtccaaaatatgtaccaaatatgtataaaaccccgaaatatgtaaaaatatgtaaataaaagtcccaacttttgtttgcaaacataaaaaagaaagtgtttttcctactatttagagcatggagaagccaggaaaaaatatgcattttcataaaattgacatccctaataatgaacaaaaacaaatacaaaattttcgattccattgaacacaatcgtttcaaaaaaaattctcaatttccttatccacctaattttcacccagacccctttcttaccagtgcttatttcgacccgaaacccgacccaaaatcatcgggtcgggtttcgggtcgagaaaaatgccgggtttcgggtatcgggtaacccggaacaaccctgatacaaactgaaatatttaagtacaaaaattcttaaatatgtttaccaaaatatgtataaaaatatataatatatatatgctttttaggcaataaattgtaaaagagcactaaataaggcagaaagccattattttttgtttaaaaattggttttgatacccattaaaaaaacgaatttgaaaattttttcattttccataagaaattactataaattctcaaaacctctaaatatattaattaataaacgaaaaaatgtatgaatttactgcctaaatcataaaaagatgggcaataaatatgctgacacttacgtaattggctaggcaaattttcaactccgaaagggtaacaaatggaccaccgtaacgagcgctggcaccggtaaagccgaccaagcctaaattactgtagatgatgaatcaaataatattttaagcgaaattatttattggataataacattaatttatacagtacaatgagaacatacggtaccagtaaaaacatgcttaaatgcataaagtgttgccgccggagacattgcggagatggttgaaaacatcagggcaagcttggtcaaacacagctcggccttaaaaattgatcaaaaattcaaacatgcttttcctaattaaaccaaaattgttttaatttaaaatgaaaatgataaatcgaattaaaataaattatgtattaaaatatattttataaatatgattaaacaattctccccatttctttcagttgcttcaaccaggcaccataatggcaagagagcaaaaagtgatcaaacgcaaaggaaacgcggcattttgcccattttttgttgcggcgaataaatctgatcatttccagcaaaagttcggggggaatttttttcattttatttttgtggagagaagtcaaaaaaaagaagtgatttaatggaaaggttagcgaagaataatcattcgaatgggaatttatcttttttatccctttttatcatttgcatatattttatcggtgtaaccgcggcacaaaaaatgaaatattttatgtaaatattttcaaaaaactttcctttcgctcaaaaacggatccccacccttatcattttcgccattgcatctgtttt

SEQ ID NO: 6705 - DNA, 2220 bp, Heterodera glycines
ttgaatttccccgtaaatgttctcgtgtgtaatggatgtatgagtttgtgccgcctcttcgtggggcttcactttcagtcgatggaaacaacatttttcaacacgtgcagtgcgaatttgccatggttaaatttattggcattttgtttgaattccccccaatttctcgaagaaaatgaactcaacaatttgcttgccattttgcatcgcgtgctaaactctctgctcgatgactcaatgcgttccaatcgcgtgcttttggagggagtggaaacgcgagaaatcagcgactttttcgtgatgttcgagaaagtgatttggcacggttttcgtactttttgtaaaattaaaatttgaaactgaggcaaaaatgtaacatttatgcattgcagcttctttgttggccaaaaagaggcccgaggcgcaactttggaatttaattgggcagacaaacgaaggaaagggcgaaattggcaatttatacgaaagcgtaaatgagatgagcaatttgaggtgtgattggaagaaatggttttcattggctattgagataacaaaattcagttctccgctcgccaaaatgagcaccttttggcgtttagcattggtgcagaaacggctgtccgattatttcaatgcgatttgtgaattcaatgggaaaaagtaagttttggatgggaatgatcagtttcaaaggccgggaggaaatttcaaagcaaaatgaaagaacaaagatcactttctttgattttacttagccacattaaaccacccgccaaagacaaacattagtaaaaccttaatttatacctaaagggccttcattgtttgaataattaggaaccattaaattttggccatttcggcccggcatggctaagatgtctgctgatcacttgtgctttactctttgaagaaattccgcatttttagccctttttacgaccatttggcttttatgtgctgcgacagttgctgtgcttttttgttttggctttgaatgcttaaaatctgcctttattttcctggtgctgcttggtaaacttcgtgtttttgtgccccaaaaattccaaagttttagtcggattttgcattatctttttaacaaaatccacgcatttttgagtcgccggggaatttaaaaagaagtgttctaccacactttgccattattttgtaattgtttgaataattttatatattttccaaatttgagagccgacgacaacaccatcggcacaatgaggccccaacaattgtcggctgcatcagcctaaccgaggtgtacctgtagcagaacctgatcggcgaattgcccagcaccgtcggggatttgaaggcatgttttggtcaggcccgtatcaagaaaaaatttcggggaggacatccgaagtaaaaggaaaaggagggaggatgaagaggaagataacgaaggaaaaggagggaggatgaaaaggagagaaataaggagggatggaggggaagagaaggagggatgaagaggaagagaacgaaggaaacggagggaggatgaaaagtagacaagtaaggaggggaagagaaggaggcatggaggggaagagaaggagggatgaagaggaagagaacgaaggaaaaggagtgagaatgaaaatgagagaaggaagaaaaaggaagagaagtaaggaaaggagggaggaggaagagaatgaatgaagaagaggaagggaaggaggaaaaggagggaggatgaaaaggagagaaggaaagatggaggggaagaaaaggagggatggaggggtagagaaggagggatgaagaggaagagaacgaaggaaaaggagggaggatgaagaggaagagaacgaaggaaaaggagggaggatgaagaggaagagaacgaaggaaaaggagggaggatgaagaggaagagaaggaaggaaaggagggaggaggaagagaacgaaggaaaagaagggaggatgaagaggaagagaacgaaggaaaaggagggaggatgaagaggaagagaacgaaggaaaaggagggaggatgaagaggaagagaaggaaagaaaggagggaggaggaagagaacggaggaaaaggagggaggatgaagaagaatgaaggaaaaaggagggaggatgaaaagtagagaaggatggagggaagagaaagagggatggagaggaagagaatgaatgaagaagaagaagggaaggaaggaaaaggagggagg

SEQ ID NO: 6706 - DNA, 454 bp, Heterodera glycines
atggagaggaaggaacaggggaggcggcaaaaagggcgggagtgaattattgagagcgggatcggggggggcgaaaatgtacggactggtgagaggggggagggaaaggacggggagggaaagatgatcggcggagcgaattaggagagcgggaaggggggggcgaaaatggacggactggtgagaggaagggaaaaaggggagggaaaggacggggagggaatgatgatcggcggagcgaattattgagagcgagagggggggggcgaaaatggacggactggtgagaggaagggaaaggggggagggaaaggacggggagtgaaaaatgatcggcggagcgaatttaggagagaaagaaggggggggggcgcgggacgaaaatggacggactggcgagaggaagggaaaaggggggagggaaaggacggggagtgaaagatgatcggcggag

SEQ ID NO: 6707 - DNA, 5482 bp, Heterodera glycines
aaaactcaaactaaactattaccgagaattggggaattaacgaaaatttgaaagaattttgattatatcgcctaacagccagcgcacactcgactacgatggcaattacatatgtggtgcaacaagactccggaagaaagccgcgcatgtccgcatgcggttgactgattggcggggacctgattgattcgttggcgctagtttaaaagttcgatttgtttagaatttgcttggaaaaaattctcattttcaaaatctttttttaaatatcaaatttgttcaatttaattggaaatgaaacgagttaaggctgatcaaaaaaaaggcaattatcagtgtaatttttgaattaacgcaaaaaattcaacatgccaatgtaaaattcaaatttccttccgatctgccttgccgaaaattaggttgccccacaaaactcggattctaaaatccaattggagtttggtcagtccaacattttttgcttatgttttggtagcttcactcaattacaggtcaattaaatgcaatctgcagctgttcatttttctgctactgaagattgtgaaattcccgatgcgccattagcacaagttgacgaattggaaatggttgagggcagtttcgctgctttctcttcgtcactgaccgatatttcagcgggagattggtaaagacaatttcgaaaaagtatttcttcttttacattttaagtgagaagtcgcagtcagacgagggccctggcgaagatttgtcgaattgttctgtcaatttgtcttcgtcgctgcaagacttagtcgagtcttttgacgacaaagtcgcagtcgttctgaaggacttcgaaaaagatgctgaaaaaatagcgccaattaaaattcgttctcaggaagaaataatgtctgaaagccagtgagtttgggactgaacattttgtagtaaaatattaaaagttattcatgttgtagtcaagggaaaataaaattaattggaaaaattaaagttttttttttactttaatttggaaacagaaaatcttggcagtctgtcattaaaaatgtctttctttcattttcagattttggtggactttgactggcaattatggaaatttgccgccgattgacttcgataattcgcaaatccgaaggaaacaattggaagcactgaatttcaattctccgaaagtcatttcgcctgtctttacactaataaattgttttttgttttttttgttcttagcagggaacgccaaccgatcgaagtgtcgtctccgactgcgactcgtcggaggacaccgaacgaatcgactttcatcgactcgcaactgcgcaaacacacaacgaaaacggcgaatccctttcctttaacgccgacaaagtcatcgaggaaatcgatgagattttacaggtaaatgttaggagatgacttttttattgtgcaactcaatcaggccccagaccagaaaaagcgtatgaggtggaacccgaagactttttgtttgctcttccctctttttcccgttgtattttaccttctttcgcgaaaaatgaatatttggattaaattattaaaaaaaaaaaattttttttttgcccttttggttatgggtttgatgcaatttattcgatctaaaaatttctattcaattaaaaaatatttatccgtttaactgttgaaataatagatttttttaatggattttcttcacttggttttcatccatttcttttgcgtttttaggccggcgatttgatgaatcagtcgttggccacaaaccgtacgattgagtcggttgattcgatgtattcgtcgatgcgttcgccaaatgtttattcggacattgaggcggagttcaagtccaaagagagggaaggcataagtgtgtctatcgaaggtccgccatttttgttaattttttcaaggtttctcccattttaagaaatgaattcgttcacccatccaaactgatcacaattgtcagtgagatggagcaaatcattcagttgtacaacgaggaattggtcagggaattggcgcggaaggacgaatttgaatatgagaaggaaatgcgcaacaaattcatcactttgttggtggcggtgcaggaaaggagaaggaaacagaacggagggggaggaggcaaaaagcaaaacaaagggacgacgaccgaaacgaacaacacaaacaacaacaacaacgtgggtttggtgtggagatgcattttgatcagttgggccattgtttgatttcagttggtctccgtttccattcctttcgatgattcgaccgatggtccgtctctctctgcgcttgaatggctcgtcaaaagtcgggattttcccccttttcacactttggtatttgtttttcagttcttcaagcaatgatcgacgacagtgtccatttgccgtctctgctcactgattacattctcaacggtcgttgaattttgccgtggggctcacttttaatttgcccttttttcagttgtttgcccttcaaaatttgccactgattgactttttctgtgccgattagcatgccaattctttccctcgactgctccgtcgttggctctttccattgcatttgcttgtggcctgcttttccgttacgactgtctttagaatagaaatggcgtcacattgcttaattcgtcaatattattgtatcatttccaatcgtttatcaaattgcccagactgtcctattacaattagtccgatctcatcgcatttaataatttcgatttttgaggtccattaaaagcttttcattgtccatttgcggttatttttcctgttgctttaacttgccatataaattatatatatttttatataatttaacatcaattaatttttgaatgttttaaatgttcgctggtattgatgggcagcaaaatgttctcctttccgctcaattacagcgtttactttgccaccacggagaaacggcgaatgcattcgttttctgtcaccaaatgcaaccggagctgcaaaaggggccgacgtgagtgggcgagcggtcattcattatgtgcaagttaattgggcaatttggaattgcatttaaatgtaagataaaatgggtaattttggacgacaaatcgccagttgcggattcgccgttcttttgatggcgttgcgctgttccgtcggcgatggtacgttggaccgattggtggaaatgggcaaacatttcgggatcacttacaacggcgaactcttttccggttggttctcttttgagggtcatttaatttcgttgatctcaaatagcattttcaattagtacattggtcaacacttactacatttgaattcattttttaagctgattggatgtgtgaatttgtccaaaaacattggtcaaacgcttgcgaattgcgagtggcccaatttccatctccaaattccatcgtgcggcatttgatttctgggaaaaaagctcatcatcaatgtacaacgacagttttggtgccgtacgattgtgacaaaaatttcgagccatgcaatcggcagggcgttgcagcacattgggcaatcattgtgagttcaaaccaaaggcgtagccgaagtaatgaaccaactcaccgaattacaaaaatgtcaaaaattaaccattctcgaccaaatatcttaataaatgaaattctataatgcgtaaatctttttttgtgtaccgtgactccgccaaaggctatggctacgcctttaaccaattaattggtaatcgataaagaaagaagcaattaatttgagattggatttgttatttttgatgtcaccgctcaaaatgggccagaaaatcaaaatgcgaaagttattgcatttgacgaaaatgacttccgctgtgatggctttgacaacgaacaccttttgtatcttatagcgcttcaggggaaaagtcggtaaattttccattttgctgctcccattttgtgtgtttttctttgtctgtttagtcagccaacactttggtcatacaaagccttaagagagagcaatgggcaattgaatgtgccaaacccttcgggcaattttcgcctggcgcctgagggcatggaagcaattaggggcaaatgtgtgttggttggcggatcgaaagttggagagcgataaaagattggatgtttccgccttttcagtgccgagagaattgtacgattcgttttgcttgaggcatttttgataaacttagcaacaaaaaacggaccaaattctgtcgataaaaggtgcacaatcaatcggacttttaaaagcgatgtgtgctgtttaattgcccaccgccaattcaaaatggccacaaatataatcgcaggcgtttcaagcgtaattggcggtatgttttttaattcaaatacaataattaatgtgttttaatgggctgtaaattgaaaacttttgccagaaaggccaaagggatggaaggtcgtgcaaaaatcacttccgcgcattatggactatggacggaacgaaggcattctgcagattcgcgagttccaaagggtgcgttttgcgcgtgacggtgctacgatagtggcgggtacattaccttgttcttcgtagggcggtgccgtcagcaacattcccggccttgtcatcgctgcgcaggaagggctcgaagcccaacacgcaaaagagaacaaaggcggggacaaagtcaatctgccgaccaatgacataacacgtgagagagttgtcggaggaagggcatttatccatcagggctcgacttaactgattttcaattacggaaatccgtaattacggcggtttttataattacgaccatccatggcatccattcacagccattggctgctcaaatggaccgtttagtaatgcacgaggccattccctttctgcctttcccggtggcgttggcctgtctttttctcaacattgtcttgcccggctcaggtgcgtcaattgcattacaaaaagcggcaattacccaaaaataaatcgcaggaacaattttgagcggcgcttcggcactttgcatgggtatttggaatttgacgaattaatgaatcaattcaaaaagcgccagggaaagaatcccacgtaattttccatttgttcaattgactttttccaggccaaccacgggtgaacatcaaagaaggtcgaaagttggtgacactgctcgtgaatttgcttgtcgggatcagtcaattcttcacaatcacttttatgttcgtcggatggttttggtccatcgcttggggcggtctgatcatcatccacgcgagtccgtttcacgagtgcattatgctcccccccccccctccaaactttttaattttcaaacagaaatttaaaaaaaccttaggaaattttctaacaataaaaaaatttcaagaaaaaaaaagattcatttctttttcagtgcaatacagagaagcgttacaacagcgcaggcaagaggcagtggcaaccggtgaaaattgacttttaacagcccaatttgccatttt

SEQ ID NO: 6708 - DNA, 1740 bp, Heterodera glycines
ctgccctttgccttgagggagtggtggcggacagaggcaaagaaaggaacgacaaaatgcccaccggcgacatcgaagtgagatttatgagtgggattagcttcataattaaccattttatgtgccaattaggtggtcgtcgacggacttggtcagtgacttacttcgccttacggtcgattcgtttctgttcccttttcagaagtgctcaatccttccgatgcgccgttgcccgtcgatgaatcgtccaacgaatacacgaggcaacaacaacatttatgcttaattttgcgttcctcttcagaataacccatcgttacttggatttgcgttcggagaaaatgcaacgggcaatgaggtcggctcaaaatcattcgaaaaattgagagaattttgacgaatgcatacatttattaaggctaagagcgagagtggtcagcaaatgccgtcgcttcctggaggacagttgtggctttgtcgaagttcaaactccgaccctcgcccacacgacgcccggcggtgccgcggaattcccaatccccgccaacaaaaacggcgactgcttcagtctcccgcaggcctttcccccgtgggcacttccttttccaatggtttttccttttcagagtccccaaatatacaaacaattgctaatgtgtggctccatcgaccgttattaccaagtcagtccaaatccttccatttttacctaaaaattaaaaccaaaatgcgctctcatgctactttctcaccatctaaactatttccccaatttttttaggttgctatttgttatcgtgatgaaggtattttctgacaaaactaattagttaatttcccattctaaaattcccaaatcctttccgatgcaaagcccgacagacaacccgaattcactcagctcgacttggaactttcattcacctcacaagagatggttttgtcactgattgagcaaatgatcgtgaattcatggcccgatgaaattgtttgctttttaataattaaatttgattataattcttttaagactcccaaaccgaccatcccttttccgagaatgtctcatcgtgaagccgttagtgatttatcatgccactaatttacaagttccgattttagatggataaattcggcactgataaaccagtcagtttttttagttgggttactgtccattcttttgtccagtgatttttaaggacatcggctcagatgcctcttttcctcgtttcgattttgtgtgggttctcaaattcccgcttttcactcgaaacgactccaccaattgctttgaaagttcgcaccacccattcactgttggtattcttccgattattgttattcttccaaataaccaaaacttaggcgccaattcccgaacattttgaaaaactttgtcaggggaaggatctcgaccaaatcgaaggttttttagctgacactccctttaacccctttaaattaatgttagctcaacattatgacctcgtcctgaatggtgtcgaaattggcggaggctcgattcgaattcataattcaaaagtgcagcgatatgtgatggaacaaatactcaaattgaagacgaaagaattggtccgggcttttaaagaaatgtgataaaaaaatagcctatgtttaggagcatttcctcaatgctttgagttttggcgcaccaccccacggtaagttgctgacaaaaaacgcaggacgggaatgggaattctgaattcgagattt

SEQ ID NO: 6709 - DNA, 1245 bp, Heterodera glycines
  misc_feature (14)..(14): n is a, c, g, or t
atatgtgtgtgccncactttgggtccaccggcagattgcgttgcgactgcttcgggctgtcctccctctcctccctggtgtcataatcagtgcccattggtggcgctgcggtgcacggcgtgccgttgtttgcggcaacactcgccggtgccattgtcgccgctgtcgtttcgacgtgcgttccgccgccgtttatgtcagcagtggtggcaccaccggcggttttgccacgcaacaacactttgtgcttcagttgctgcggtgatggcaatggcttggtgtgcaagtcgtccgatggaatcagcaaatggtcaccaagaatctgcagcgggggaaagaaaaaaaattttaatagttttctgcgcacttttttgacgctaatttaaatttttgggacacggaacctagttttaagtgcaaaaaaaatattaattatgtttatatgtgcctcttggaaaatgtcggccatgatccgttgctgcacaatgcccacatggttttcaatggtaactgaaccgaaaagggaaaaaaataatggtttttgaagccgtaaattcaaaaaaaaatttgcttacggatcactgggtacggattttgtacaaatgcgtaattcttgacacatttcaacacattgcgcagactgatcgccccaatgaatgtgcgtttgtgcgttatttgtggctcaccatgttcaccgtcaaacacatccactaaaaaaatgtttattgggattagaaattcgttcaaaaattcttgggttttttcggggaagaggacgcaaaattttctgaaaattggattttttaaaaaatctgaaaaattataaacaaaaaaatttttttgtaaaaatttgaaattttttacaaatttattctttttttatttttcgaaggatggggggggggggggatcaaacagttcattaaaaacaaatcaatgacattccaacagccgtgagccccggcgaagtgccgaaatgtaaccctcgacggtggcattgccgtgcacttggagaccggtcaaataagtattgtgactactaaaaaaggggcaaacggaatgatggcattttgtttcgtcaaaaaacaacggcacactcaaagccaacaacctgttgatgaagtagcactgaaaaggtgggttaaaattagagatcggaccggtcggttttttttccggttttttcggtatttttcgattttcggtttcggtttttaaccgaaaaaaaccgaccgacaaattttt

SEQ ID NO: 6710 - DNA, 5141 bp, Heterodera glycines
aatgttcattgatgttcatatgcgctaagtaattccttctgagtttataaagccaaaaaataattgaaaatttcgcacttaaatttcataaattttcaaaaaaattcacacctggtccatcacgttaatgttcgagccttgggcaatcagcagggaaaccttgaaaaaattttgaataataaaattcagttttgtatttttgtttttgctgtaccatgtctttctttccattgactgatgccaaatggagcggagttccttaattaccatacatatttaatatttaaaaatatatttttaattttcaattttaaatttattattacttcccctccaatctttggcgtgctgttgctgggtggaacgggacagcagcatcccaacaacggcaatatggcctttaaagtttaaacaatttatttaattacaaaacttaaatttatttaatgattgtttaatttttaaataaattttggttatttaatttgtaatgttttaaaaataaatttattaaattaattcgtagagtttttcaaatttgatataattttaaaaatggtttttatttaaaaaaattaattttaataatgatttaaaaaaaggtttcaactttataattaataaattaatttcatttacattcattaattacacattaatgaaaaacctaattttcattttaataaataaatatttgaccttgttgtgcagccaaatgaagagggataacattctgaacacattcatgccaattgacaaacgatgatacaatacttatgattagagatcggaccggtcggtttttttcgggtttttttcggtttttaaccgaaaccgttcgaccgaaataattaaaaaaccgaaacaatcgaccgacttttttgacaaatcagttggccattttttaacaaaattcattaaaaattcttaaaattttcctccggcggcggcgcctatcggcaccgcggaccccccaaaaagctatcttttcttaaaaaattagccaaaatctcaaattttggtatttttagacaaaatctgctcacaaatagcattaaaattacaaaaaaatttcccggcggcgcttatcagcaccgccggccctaaagttatggcttgagctcacaattaaggcaccaaaaagcgcaaaatggcactgaaaaaaggcacaaaaatcccgaaaaaggcatgaaaaaaagcatttaaatttttttattaatgatttttagggagcaaaatacgtaaaaactaaccaaaaactaaattttgctgatttattgataattcaatattttataatgtttttcaataaggaaatttttaaacctaaaattttttatcaagaaaaaaaatgaattttggcgaacaatttttgtgaaaatttttcaattcataaaggtatattctctgaatttttttagatcatttcttaggggtttatttttccgattttttttgaatttttaatggaatttttcgggaaaaaacgccaaaaaaggcaccaaatcgctaaaactaatctttgtggttttttagaatcaaggagcaaacacatgttttttggctgccttttctatcattttccaaacctttagtacaccattcaatagagcttcaatagctctacaattttactcagaggtgatctttcgctttttctattgataaaaatggttttgagtaactcaatcagaaacgaacgatggcatgaaaattttgcaaatttttgtgtattgtaaaggctcccggaaaatgcatcagtcaaatttatgggattttgagccaaatttttaggaaaaattagttcgtcgtttttgggtgaggaaaaattttggatttttaatgaaatttaaagaaaattagacaaactgcccccccctctctttattttctatgaattatttaagccatttttgggaaaacggaaaaaagcctcaaggagaatgggggttcctggctcctcgggaaaacaaagtttcgaatttgaaaaatgtcgcaaatattcatcaaaatttgaataaaaatgtgcctgcaatggctggtccatttgctggaaaacggtctcatggccctccctgagaatgttgccccaacgacactgcagcaaccgacgaaaacctgaacgggaatttcagggagaaaaaataattttttttttatggcaaaaacccccaccactgacagacaacacttttggtgacgacgaagacgacggctcaccatccttttggttttcctgttgaaaattggccggctcacagaatgcgatgactgcctccgccttcctttgatcaacatctttgaactaaattttaaaaatttcattttaatttttagtagattttttcggcaattaaaaaaaaaattcgaagcagtggctaaactatgggaaaaaaaatcattttttggcgaaaaaactgctaaagtgcctcttttgcaacagtacctatagttttttttagttacggagccttttttttatccaatctttatttgcacttacttatattactcaatgttataatttgttttttttcaattattaaaatattttgacgccgaaaatagacgctttttcaaaaatgttgcccccccaaaaaattttttgtgcctgttgctcttcggtgagaaattgtcggagtgtgtccgcgtccaaaaagtcattgccctgtccgttggccaagcgcaaaacgctccgatattccggcaaatcggtgagcacgctgaacaaccggagaaattcttgctcattcaacgcattgcgcggccggccgctctttgaaacgctttccttgcaaaaagaaaaatggtataaattttgtttttaattaaaaaacggatttgattgagataacaaattggttaaggggtgtgttagacgaaatccaaatttttaaaaaaatttgaaaaaatcaaactcgcctggtcctcgttttgtaacaaaatttttgaaaaagagttcagtgccaaaaggagaggacgaactaattattaaagtttgggaaatttgggtggacttaaagtggtaaaatttcataaatttggagcaattcttaataaatttggccaatattaaaaaacaaaaaaaaaattcacaggcagaggctttgaatccaattttattgtccaaattcaaaatgaaaaaattccttgaattaccaaaacacaaaaaagcccaccttgaacaatgcttcaacatattggtcactaagctgcaaattcaaacgtttgagcagacgccaaagttcgccgaacgaaatttcatctttagcaaaaaaagaaaaaaaaaattttgtacgatttaaattttttttttttttttgtaaatcacagcaccgtttcgattcaaatcggcttgacgaaagttctgcaacagccatttttgctcattgaaattggtcaccgtattttgggacaaatgcaacacattggcaaaatgttcctgcaacaggttcaaccagttggttgtctgatccaagtccaccgccacaaagtcaagcgatttgcacacaaagcgagggtgctgtgattgaggaaaaaaaaatgcgaaaaaaaatttcctgcgcaatttttacaatttgagtgaattccaaatccgaatccctaacgtcgacttggacaaaaaaccggaatttgagtttttggttttcgactttctatggaatatcaaaatttttgggctttttttttaattgccaccaaattacacactttgcaaatgatggagaagcatcgctgttcctgaaatgataaatttttgtttcatttaatttttctgttgatttgttgaccggtgccatccgttggaatttgtagtccttggcagctttgtgcagcccatcggtgcggtagccttgccgaatttcaagcacatcagtcaaaattacttgaaaaggaatggtttttttttaattggcaaagcgaaagcccaattaattttgatcaactattgattgatccacgtgccatttcaaaaagaaaattgtttaaataaatttccgatattttcaataaaatttccctttttgagagaaattaaaaagaaaacgaagcacggaaggtcactcctttttaggaaaaattatggtaaataaaaaaataaacatttaattatttttaaaaaacgaaataatacatatttttgaattataaaatgagtcgcgccgaaaataagaaaaatatatatataggattgcgggttacaacaggtccagcagagtcgagcgagctctagttttttagatatacaaaaaaaaaaaattttttttctaagaccgattttttccccaaaaatttcgggaatcaaaaactcagccgacatccccgcgcccctggttgatggtggataaagatgaggacaccttttttgcgcctttccccagcgctcccttttctgcatccgctgatgctgctcaacagtgatgaacgcgttgcgccatagctgagcatatcctcatagatgtccagcgccacccgactgaccccgctgatgcgcccatttttaacacgacggaccggcaaatcgaatggcaccaccaccccaccaccaccattaatgttatttttttctgtccggtggttgcccagcggtgtcgtcgtcgtcgtcatcgtcccacttttcccaccccaattattccccgccgttgttgttgctcctacattttctccatctccaccgcctctgttattattattattatttttgttgttctccaccatcatctgtccatcagcagcagcagcagccatagtcatggatcaaaaataaataaattcacataaatacctccaaaaaatggcgctaaaatttttcacttactgtctgtctctcttttgttggtgcaaagaatttaaattactaaatggtgcgctatgacgtcattcaaaaaattaaacatttgtttattattttattattttttttgttaaaattttcattttgctgattttttggagtaacgacgaccagcaacactttaaattgtgtaggaaaaaggaaggcatttagagattgatgagtgaatatatttttgaagtgaatgaggaaggtcagagagaaagttaatcccaagaatgttgagggaaaatggagaggtcgcgagaagagaaaagacaaaaaataaataaacaaacagagagag

SEQ ID NO: 6711 - DNA, 5607 bp, Heterodera glycines
tcgaatccgggttcgtggttcggaatgggtcgaattgagtcacagaatcggattcctcgaccctgaaaaccctaaaaacgccattttctcgaaaaaaaaattttgaaaatttttttcagaaaaaggtggggaacattcttaactattaccgaaatttctattaaaaatttttcgcaggctttttcaagaaaaatttctgtttgaaaatttaaaaaaaaattgtttaaagaatttcaacttggaattaattaattattataaaaatagaaaagaagttattttttcgaaaaaaatataaattctatttatcccccgggcagataaatagagaaggggagattatttttcaacctacttcgaaaggggtagattattggtgacttgcatataattagagaaatacggtagtttgactctttattattagggcttacatttttaggtgctaaaaactgccaaaataggtaggttttaggttctaaaaaaccccaaaaataggtgctaaaaatgggaaaataggtgccaaaaagttccgaacttaggggtgtaaaatgacaaaaattttattaaaaagtcaacaaatattaagacaaattgagaaaaataatttttaaaatcaaaaattctcgtaaataggtaaaaatctaaaaatgtaagccctatttattattacgttggtcagttttcaaatttcaaaaaacaaatgcgcgtctaacatttgcaaatgaaagttggataaaaataatccgtcaaattgattttttattgattgatttgggggtaggggctaaaacgcccggcaaatgtcatcattttgcaaaatatattctcctctgttgcgttccttccattccctttttctgctcgctttttgtcaatgattttcgtctcccattggcatattgtccaacccctcgggcccatttgcaacaatttaaggcaaacaaaattcagaaattatttggataaaatgtgattttcgttagaatttttggttttccgcttttctcattatataaaaataaaacttcaacgcaattaattcttctgctatttgtgtgacatcattcggaactcgtccaaattgtgctaattgctgccaaaaatgaaccgacggtaattaaattaaaagtcacaaattcgtcgtttatttgactaaactgttttcccatttcagttggatttgcaacgacgtttggatggacattttcccatcctttgaccgtcctcaactcggcctcaaattggcacttctttcgccacgtttcaatgcgttggtggataaacattttgatggcaaaagcgaattgacaatttggagaccaatcgaaattagcaaggacatcggaccagaaccgaaactatctgtgtggatggatgacaaatataacaaatttatggaatttccattgccggaccgtccgttgcccagcaaaatccgttttatatgccttcggatttagtaattaaaaatcagagagctatgacaataaaagcattccttccattttcacagttacattgatcattccgtcatcgtttttcttcgttcaaatcaccaaattttcgacaaaagaggcaccaatttacagttgttttggatttcttcaccacacaccacggatggccagcggatttgggatattttgacacgtgaaatttggcccattttttcggcaaatattcgccatttgtgcttttcccatcgtgatcatttggacaatttgcttcgtcaaatttcgccgacaattctcatcgatctcaaccaattggtttcaatccattcatttggtctgttgcccgctgcgtttggtgatggttttgatgggccaaattcaacaacttctgctggccaagcattgtccaaatggttgcacattccgagaaaagctggccaacccaagcgattgcgttgcgaagattacaacgcacaagcgaacactgattggatcaacagtttcaaggaggtgtggggtccgggggggggggggggacaacacgtagccgcaaatttttattttaattaaaaaaattatttaaaatttagttacctagcctaaatcaaaaaaaaatagataaattcgaaaaaaattattaagaaaattcaaggaaatgtaaaaaagtcgtttttttatttttctggaaattcagaaaattagtttttatacgagacggcgacgttttaggggtgtacccggtctgtggatggcattctgagttattttctgaaacccgaccccaaaaaagttataaatcgaaaatttctgaaaaattccgaattttatcaaaaatttcggaaatcggaattcagtgccatccctggtgtggccataattcgacaaatgattgatttttgttttccaatcaaattgtttagcattttcttcgtgccaatgccatttcttccgtcagttacgaaattcatttttctgttcgtgcgccgtcaatggaaatggtgccgtttgaattggtaaacgaatggacaaaggaaaagctgacattcgccaaagcaaagggatgggacaaggcgaaatgagtgacggacaaaagaacaaaaacagtgatcagccgcagaagaaatgaattaattaagaatgatcgatcgaccgatcatattcatcagtgatcaaatgcattttatgaagaaaaacctctcaattgctaaataaatcgggtgtataaaatggtttgctatctatcgaatgaatgaattttcctttcaaaaatgtgacaattatttttcgggattttggcgggggatttccgacatccattagcaatacttgttccgttgctgctcctttttctccttccttttcctctctttctcttccgtctctcctccttccaatgttcttgcttctgctgatgttgttgtttctgctggtgttcagctgcaattttctttttcctcttcttcagttgctgctcctttttctcctccctttttctctcttttccccccattttctcttccttctcctcccccttcgctgtttcctttttgctgttgttgatttcgtgtcacgacatttgcggccaccagccaaaaacgacaattgcggtccgtcttttgcggcccgacatttgcgcctcggacatttgtggcccatttcttaaagggccattttcggacatttgcgtcccgacatttgctgccaaaatcaaaataggtctctcatcgaaaatcctttttttctcttcaaatttatgccgaaatttactcaatcgagtaattctttctcgaaattgggcttgttcaaaaccccatcagagcttaaaagttttctattaaaagtaattatttggaactttttcgccactatttttgccactatttagttaattattttgggatttttgccactaaaaatccgatccctacttctaacatgcatttttttgagactttttttgactttttttacactttttcggatttttatgacttttttgagtttttgcgacttttgttcgtgatttttttgacttattgaggcaaagtttgagttttacagaagaaaatgccgaaaaataaaattttcggtcgataaaaaggcaatgaaacctggatgaattttttcttaattattgggagattagaagtaatcattaagcagaagctaagcgctgaatcatctcaccaaaaagctatgatttataagacttaaaaattcaagaaaatcctaattttttgtaaaattttttaagtagattcttaggggtgtattttttggttttattgcatttttgttgagaaattttccaaaaaatgtcgaaatagtaaaaaatagtgacaaaacgccaaaataatgaattttcactattttagtgacgaagctccaatggtgacatgaaatttgggcatcagagtaagggatttcaaaaaataatacaaaataaatatgtaaaatgctaaataaatcgttaaaatctagtaaattttaagaacccttgtgcttaaaaaaaatttatgttttcttaaaaaacggtaaataaataaaataaataggggagcaaaatagaatttagtgctaatttggattttggtgatgaatggatttggcatctttcatttgtgcttttatatgccatggtttctctgcccatctctgctgttcccattttggttctcttctctcagattaattgccattgattaatctgtccattgattttccttgggttaatttgagtggcttaatgccctcctctgccagtgaatgggaacggacggcattttctttgctcgcacaacggcactttgggaaaagcaacctaatcctcaaccaaaaaatgaaaagcaaaattaattgatttgatttatgctcttctgaggccgaaagtgatcatttaaaagtgatttttttgtaaaaattaagcatatgtctaaataaaaaaaccggagaaactaattagcaactccttaaaataagaatcaactaaagcttataaaatcttttgagaaattattttttcatattataaaattggtaattttacatacaataaagaaggttgacgcaaattccgagtgaaaaatgcaaaaaaaaaatttgttcgaattcgggtccgggtttcgaaataggtcgaaatggatgtcatattcgtgttcatcgcccccgaaaacccccaagagcacctcaaaatcgctcaaaatctcttttttacctctttttttatgggaccagtaaaaccgatgattacccaacaacagcagcaaaaccaagaagttcaagcagtacaacaagaacaggaaattttgatgggaaacgagatgaagatggacaacagcaaaaatggagaaacaagggaataggagggaaatagcattggggaaggaggagagacggaagagaaagagaggaaaaggaaaaattcggcgcaaaaaggaggagagaatgaagctgaaaagagaaaagaacagcagcaaatcggcacttaatgttgccggtgctaattgctaattttgtgtgtcgtaaatcccgcgtcaaaatcccgaaaattaattgtcacaagtttcaaggagaaattcatacattcgatagataccaaaccatttttatacatccgatttatttaccgaaattgagagttttttcttcataaaatgcatttgatcacggatgaatatgatcggtcgatcaatcattcttaattaattcatttcttcttctggggttgatcgctgtttttgttgttttgtccgtcactcatttcgccctttttcgctgctttgtaccgtttcttctgccggtggcggagacaatggccttaattaagcgcaatttgaattatttaaacaaaattaaatgcctttttttattgctcacccaatgcaattagtggtactgaaaagccaaatgatcacattgttacaattgttgtcccaatttccgtctttccaatgaaccgccgctgtctccccaataattttgcttcgtttcattatccaaccgatgccccattcattttcattttccttggccaatgtcagcttttcctttgtccattcgttcaccaattcaaatggcacaatttgcattgacgtcgcacgaacatcaaaaaggatttcgtaactgacggaagaaatggcatggcacgaag

SEQ ID NO: 6712 - DNA, 7617 bp, Heterodera glycines
  misc_feature (13)..(13): n is a, c, g, or t
  misc_feature (52)..(52): n is a, c, g, or t
  misc_feature (93)..(93): n is a, c, g, or t
  misc_feature (99)..(99): n is a, c, g, or t
  misc_feature (7612)..(7612): n is a, c, g, or t
ctcatgaggattnggcgatgtgtcaatgaatccctcggggcaaagacatctntaaaaaacggcttacaattaattattaaaacgtaaaaaaangaaatntgagaaagcagcactcactcgaagccaaagtcattgtcaatgcatcgtgcctaaatccgatccattagatttatttgctttttttgaactgatcactttctgatcgcagtcgttcagtgtttcatctgcgcattcgttgactggaactgaaataattgcttttataattggcctcaattccaagtcaagaacggtttgatttttgcttgtttcagactgaattcaatttgaattgagacacttttaatttggatttggtcaacaacttagaagtttgctcgagtgacaagcgctcagcccattattagtgaaatccatttctggcactttttgattacgaactagaatgatcaaagtcggtcattttggcttcttcgcttggttttgtgtcccccctccctttaattttaccatttccgctaaattatccattcattgccttacccacgcaaatgcctttccgctttttgtcgcttccattcgtgcctttccctcctttgtccgccgtttcatccctctgcttcatcgcggcacgtattcttccgtcccctccgcgatccgcttgtccgttcttccgcgtcacattcgtccggctccgttatcggcaccaccctttttgtgccgatccaaatcgagtttgccgcccgagcgtcgggcggtgaccgtgccctcgtgctgctaatcgggaaaggattttttatgtaagccgaagatattagccagatattcttaaaaaatgaacaaattaaaaaatttgaaagcttaaaaatgggctataaactgaatagaaatataattttaaatttttaagtgaaagcatgaaacaaggaaaggcattttaaaaaaattgaaaaccgatttttactagataaatgaagggttcaatcgctaatcggtaaatttagtgcaataaacgccggcctaaattttttacaaaaacattttgggggggggggggggaaagtctgccaatcccggcattctgatccatggttcacgaaattcgataattttcaactgctctcgcttacctcgccccacgggcgggtgataccactcggatggtcagttggcgatccgtttccatcagttcgtcccgttgttttatggtgccaccgctgctgtttttggcatcctcgcgaccgttgaacagaaacagtgccgggtaaagccgtgccaaatcggtgaaaaggcgtgaacagctcgaatttgttgttggttgttcaccacgccggagcgcatccgcaagccgaaaagcgttggaggcgtcaaaatgagggaacgcttcggttggcacacaggtggacaagccgggcgctcggaaaaagcctagccgacacacacagcggggccgcgcatcaaattccttcaaaaaattaacattttaaaattagtgaacggctttgctaaagctgatcagctggcctgatcagtctgtgatttattttcacaccgacaccgttcactgtggttaatggcgccaattttctcatggcggcactgtgactgacatatatcaatgcaaatcagcagatcagattaagctacactcaaagtcgtatgaaattggacaaatgtgatcaaactaatcatgggattaagatattaaatgctaaggatcattaaaataatatcaattaattcaaaaataaaatattgtatgaaaactgtgctaaaattcatcaagaaaatgtcaaaaaatcggtttgaaaaattggatatttttataaattaatgcgagattgtgctttaaaaaaatattctcagatttcaaaatccatgagtcaaaatacaaaaatagaataaataaatcattaaacaatcaattaattttaagaaaagatttaagtgcaattggcaaatatttttttaaattaaattactcacacaaattattttaaagttaaaatgccaccgacatattgtacaggtcaaaatgtccggtagttgccgaacctccccactctgtgcttaccacgcacacttggcccaactcggcggggcattccctcgcgcgtgccttcgggcacagccgtgccgtccccgcccgcgtccgccatgtggccgagcgccgacttggagtgccatcgccgcacaaatcctcccatgtctcctccaattcgtccgttgcatcggcacagtcggccgctccatcactgacaactgaactcggcacgcacctttagaaggggaaggaaggaatggacaaaatttagctaataggatgaaaagtgcatggttacaatttgcgcttatttccttaatcggattcaaactgaagtttttcaatcccagatggcctaaagagctttaaatatgcaattgaatgtaattgtatctgatattttgatcgtcagcacatttttgaaaaaataattgttttctcatttaataaatatgtctattttaatgctgtttatgaactatagattcgaaaaaattcaaatttaatccgatttttggcataggcgtaaatgtccgaggcgcaaatgtatgcacaagaagggcatacacatcttcaattttagctaatttcatcggaaagtcatttttagcattgatcactgattaaaatttaagtttctgcatataatgattatgaaatttgaactgctaaatttgttcattcattgtgcttgctttgtgtacaactgatctgacaatcatcaacagaatgccaaatattgagatttaattcaatgaataacaatgtttgttggattggttacgaatagagttgagcggtaatcggtaattgtaaaaaaaccggtaccggtactgaccggtaatgcaaaaaccggtaccggtaccaactttttccaccggtaccggtaccggtaccggtaaaaaccggtaattttccaacgtaaaaatttttggacaaaattttccaaatacaaaatttttattcagttttcgcgcgagtgcctgttttttagcattagaattgttcagaagtatatgtatattgagggtgaccaagtttttttttcaaattcaggataaagaacactaaaattcagatgtagacctcaaaattcagattattgcaaaacaagggatcagcggccaatttccaattttgcgaaggggtctccggccatgtaaattaatgtaaatcaatgaccttttttgctttcaacaccgcttttttcgcggcacgtttttctcaagacttttggggaacaaggagggccggcggtgccgataggcgccgccgggaaaaattttgtattttttaatgcgatttgttaacagaatttgtaaaaaaagaccaattgattaatttttgggtttttaggatgcttaaaatgaaagaaaaaagttggaatatttttttaaattaaaatttcaattaaaataatggtaaagaaaatatgaagaatagaattgaatccaagcgaaaataataaaatcagaaggtttagccacttggccacttatgcatatgaacaaatgctttaaatgaaaataaataatttaattttttttctcaaaaaatttctccttcttcaccattccctactcttttctcacccagacccccattcttaccagtgcaaatttttaccggcggtaccggtactagacaaaccggtaccgatactttgatttttgaaaaaaccggtaccggtaccaaaaaaaaaccggtaattaccggtcggtaccggtaccggtaccggcgcccaaccgacccggtccgtcattcgaaagcacacagtctaacgaagctaaaatatataaaatcgcagcgttcaggcaattagcacaaaagatttgattaattaagtaattgctgattattttcgtttgtaactttcttgaaatgttagaattctcttgttttctcgtattattacattattcagactttgtgctttcgaatgataccaaaaagataggtttgctcgaatatgaacaaagttattgtataaaaacccgggattgtcaatcgattggactcataaagtgcattagagcctaaaaatgtgacttcaaggaatttttcgaaaatcattttctgaaaatctagctttatatactccaaaatttaaaaaaagcattggaacagagaacaaaatgtgtgctaactcggtttattcatcaaaaaaagcatgaaatgaatgaggtttttgagaaaagaaaagcacccgcgcataaaacaatttcaattagtgaaacaaaggcgccaaatgtgagtggaaaactaagttatttgtgctcctccgatcatgcatcactaccactgtcgctgtcctccgatgatgatgcaccaacacgaccgtcgccttcctcctcaatgctgccgttgggcgccgtggacgtgctttgttgactcgacgcaccagcaccatcagaaccacctgttggggaaagcaaaaatttttaatgaaaattaaaaaaaaacaattaatgagtggtgcaatgcacttaggtatatgtagagaccgcattttaaatgccttcctttttggcgtattttcccgaaaaattccattaaaaaatgcaaaatgggacaatgacaaactgacgaaaaaagaggacaaaaaaaaaattgattcaaaatattggcatgacaatttgatcaaatatttgatgaaaatttagagatgaaagaaaaattgcaagcgaatgtgatcaaatgtcagaaaatagtggacaaatacgtgatcattttttaaatgaaattgataaaaataaaagggaaattgtgcaaaaatttattaaaattaaagagaaaattaagcaaatgaaaaagaaaaattcgagaaaaataattgaaaatgaatttggactgatcagaaacatttattcaaataagcaaaagtgttaaatatttttgacagtaaagaaatcttttatttttgcttacaaattcatttgtttcaaaagtttccatcatattatttaagagaaagataaaaataaaaacctattcgttaatatactaatcttgcagcgaatccgcaaatgaaggatcccgcggatggaaatttgtatttgttttttgaaaatttttttcattgctcctggagacgggcgtttaggcaaaaacccaaaacaacaactgaccgtcaatgttttggcgtgaccctatgtccggcattgcggccccatggtccaccgtcgactggtgcggcatcagtgccattggagcgcggaagaaatagaagaccgaataatggaccaagttgaagcaagagccggcatacaaatcggcatactgttccagctgaaaagggacaaaaaattttacaaaattttttttttggtaaggatttagtcaatttttgaggaagcatctcctcgctctgattatttttttaaaaaccgtaaattttttaattagttttttcaattaaaatgaattttttttcaatttttttggaggaggggggggggggttgaggcggcggtgaaagtttttttctagataaaaaaaagaaatatctttattaaaaaactaaccataaacaattggaataccaaaaaaaagtagcaaatttattccaacatattgtggaattatcataaaaacccaatgagttggcatggcatcgcgaaccatgggaaaagggcactttttcttttctaattaaatgcaaatgccacggcacatcatccaacaccacccacttgagaggcgaaaaaggaggtgcgcgttccgcttccgaacagagagccgaaaccgccgtactgttgttccattgactgtgtaacttcctgcaattagaatttgttttagaccgactcaatttgtcgtttaaaaagtgatcaaaaacttttataaattgagcccaaaaatgaagaaaatgtcactttttagtagggtaggtcgagaccggggccaagacacggacaattgagtaccgaagtcccggttttgtgccgtaaaataaagataaatttggtgtccccattttgtatttttttcaaatgattaattattgaattgcttttttgtcatagaacaatagtcacttgcctggatggccttgaacacggggtcggtcactgcctcagttggtttgtctcgcttgtgcagctccaccagctcggactccaattgttgcaactgttcgtacagttcacggttgtccgtccacacggccagctcacggctcagctcgggcaccaccaaaaaggtgtgccaacccgtggttttctgaacaaccaaccgatgaattatgggagtgattttttaatacacaatttttttaaaactcgactcgaaagccgattgattctttctcgactcgaaacccagaatcgaaccgttgggccggcccaagcaaacctttttttttctcaacccggcattttttgccggcccgagaactcgaaattgaaccgaactcttgtggccaccccaacacgatgtttttttccatccctgctcatggcccaaaacaatgatatggccagtgtttttttgttttgttttggccgacctttgaacgcaacacatcgccaaagatgtggtcgccaatgtagagcactttgcccttgaagttcaacaaatggcgcaatttctcccatgaacctgtgtgaaaaattgttttaacaacatattggcaaaatttgaaattgccaaacctctcgaataaacggcgcctttttcattcaacggatttgttgggacgccaattttcagtgtatccgtatccgtatcgacctttgaataagcggataaacaagcaaaaaaattttaaattttcgcacatgctaaacaaatgggagcagcgaggtcccccccccccccgagaaaatttttttaaaaaacatttactaacatagaaatttttcaagaaaaaatcttagtttttcataagaaaattctatgaaaaaatttccgagaaatttttatgatgaattattaagatttttcaaaatgttttccgaaaatcgttgaaaatttctcaaaatttttttcttaaaatttgttgtgtgaaaaaatatctatgatttacgggggggggggggggggggggataaagtgcacccaaacaaatattttatttttatatttttttgtacctcggtgccttcgccaaaccacgacggtttgcacgcgtccacaatgatcatgtcgaagaatgaacgccattttggccccaacaaaaatgtcataattccctgtgagacagaggagcaataaatatataaatatatatatatatatatatatatatatatatatatatatatatatatatatatatatatatatatatatatatatatatcttttttttggaaattttcaaaaattttgccgtcaagtttttttcggtaaattttattcctttgtttttttcgctcaatttctctctaaaaagtaaaccaaataaataaaattaaacaattattttgagacacttaatgctggcacaaaaagtctgtatatcgtgccgatgggcgcctgcagggaaacttttttgaatttcagtgctatttgttaactaggtatgaggtataaagatgatctaaattttgctatttttagccgatntttca

SEQ ID NO: 6713 - DNA, 3554 bp, Heterodera glycines
tccttaatactctcgaacattttttccatccaaatttgggttcattttgaatgaactaaaatggacggcacagtaaattaattttggcatcaaaaagactgatcttttgtactcatttgtcagtggcgatggtaaatgaatttcaaattaacctgtgggcatttatgtgagatgaaagggaacagcaggagagagggagagagggtggcaaaggaaaaagaagagagagagagagagaagcggggaaggagacatgaaaacattgatacaacgaagagaataacagagaaaaaaaaggagaaagaaagaaaggagggaaaaaagaatttagggggagagagaagggggagagagaaagagagagagagaaagagatggtgagaaaattggagaaaatgagagggaaagagagcgagaaacagaaaaggagagagatagagagagaaaaggagagaggataaggtttggttagcgaaagagagcgatgctaggatagacacaaagagagggagagagcggcgagacagtgagaaaaaagagatttggacacagaaacagaaagagagacaatgacaaaatgagagataaagggggagagacagggaaggagctagagaaagaggggagagaggcaatcagcaaattaggcaaattgtatttggccactgtttttgtgccaaaatgaactcccacgcattggaatggcgtgtgtgcattcatggaaacaaccaattaagagaatgaataacttgatttctgagaaaatattatcacaccgtaccatgggaaaaagcgtttgtatgaactaattaattttcgtttaatttatttgtgtctgatgaatgacgtttcgccaaattaaaaaaaaaagttgacattttgcgttagccactatttaataattggctcaatgaatgccgtagtgattgatcactgtcttagtgattaggtaaatttcttgtacgaattatcctttttagtaaaaatttttgttgtactaattgccctttttacatgttgccactgacccagatgaacatgaaacggaatcttgcaaaatcttggcaaatgttaaacaaaagatcggtactttacctagcaggtctggattgtaacttatttcagttacggaaatctaatccgtaattacggcgatttcatcaatcacggcaatacataatccgtcattatggggaacaaaaaacgcgttaatttccgtaatccgtaatcggctcgataaataatccaaaatctcagttacggatcaaaattacggaaaaatcactaaaatccgtaagtcgtagtccgtaattatgggatcaaacacgctgttgtttccgtaatccgtaactacgtcctaactgttgcataggcaatgtcccggcccaaacccaccacaccttgagcgtgttcatcatcatcatgttgttgttgctgttggcattgtactgctccacatcgtggatgatccgcctaggcggtgaacgatgcagctgtgtgtgttgctggtactgcctgaccgtgccgatgccgtcctcctccgccgccgccatcaccaccagcttggcaccaccacaattgccgccgccaccacccaacatggcgtcaatggagtgatgatggtatgcggtggtcgcccatgttgtggttgtagtcgttgtgccgaatcctgctgacgccgttgtcggtgccgtgccgggcaatgtcagcccgagggcattccggcttttcggacttcgttcgccgtcctgttgctgttgctggtgttcctgaaccagctccagcctgttgttgttgtttttcgtggtgccaccctcgcagtccgtcgtcgtcatcgatggcactgccagcacggtcaatgtggggggcgctgccctgacgctcatttataattgttgcatataattggaaggcaataaaaatataattattgtatgctaatgatccttaattgatggtagacatgcaaaaatttatccttaactgatgttaaacatgtaaaacacaattgttgtctgctaatgatccttcttgatgttacacatgtaaattgattgcaatttggctaatgaccattaattagtgctggacatttatattttcgttacctaattgcttcggataattgttgttccaagtacgttcttgaaaacaaggacaagactttcaaggacaccaatttaaggcaattaaagaaatttttaaattaattaataagcagaaatttttcgtgccccgaatattaagatgaataatttatatgtacttaatattaacaataaatggtcagaagacgggcttttgaagtcatatccgctttttcatcggatatccaactaattaataggccaatattagcggacaaaggaagtcaattaaattggtgaattttggaaataaatatttattaatttgtctaataaattttgcggatttaatttcctgcgccattcttcttcgcttaatctgaccccgaaatatagtgcttatcatttttcacagtaaattacaccgttgggaaaaattaaaagaatttagtgtttttttcgcaaacgaaatgccaaagaacgaaatttaatgggcaaatttgaggaaggaaaaaatggcgcatgtagtattaagcgttcatgctgttaatggcccgataatgggcaggtagaaatgcagctttaaaaaatcacgacgaacattaatttccggcacggcacggaaaaatgggccccggaggggagggcataaggaatttaaattcggattttggcattatccctgaaaaggaaaagccccgggggaggcggaggaggatgatgatttgattaagctttgagagtaaaaggtacttatgtgagactaaacatggacttatgattaacagacagcgaaaggctattagggcggctccacattcaattccattaaacaattgaactaattgattggtcattatagaacaacatacaattacatctaatattataattaattgtttcagagatggaaaaaagtgggacagattttcggggaatgggccccgtttaatgatatggtaaatcaattagtgattttgccaaaatgccacaaattgtaaaagaaattttaatgattttgccaaaatgccacaaaattataaaattaaaaataattttgtttatatttttttaaaatttctaaaagaatttttatcctggtaaagttaccctcacaatcagctgttaattcctagctcgttcttttcgtacgtgcctggggggataatttggacagattaagaaactggtaataaacacagagaattcccatgtgccattcatccgcccccgaaatgccatccccgcattctttagtttatgataatgaggggacaataaagcacaaaagcaaatttttgcccctaggggggaggggggatggcacagaggaacggaattgaaaaagtgccgtcgccgggggcggggacaacaatttttgctttcatctatgcggtccgcgccgccgcgcgacgcattgacgtaatattaaaaggcggtagcagcagatgttagcggctaatggac

SEQ ID NO: 6714 - DNA, 2296 bp, Heterodera glycines
gaaaacccacctgctgctgttttgttaaattttccgtcgaaaaaaaaaatttaaaaattttttaatatttttaatggtcggatagggagagatcaatcaacacattctctgctgcaataatgccagcagcagaaccaaaggggtggatttaggagaaggaattttttgttttgtacgaaaaacatggcatttttgccggcaatattatgtattttggcatatttttgggtcttaaatgaattttatgaaaaagatttttaaaaattttgtcgataaattttttcctaatttttcatcatttatgagcagttaatttttttttaattttaaaataagaaaaattttgaagtctgtgaatttttgttaaatgattttacggtttagttttaacgggttttttgaaattcttttactagacataaatttcaaaattcagcaggttatgtgctattagaatttatgctattaaaaatgaagtaaaaaaattagattttttaaaccaaaaattcgcttagactgaaccctggggcgaacgcccgcgcgagggtttgacacttttggacccgccgtaccgtcatcatccgtcaatgatgatgtgacgaaagaacacagagacaaaagagcataaaggtggaaaaataatgagcggcgagtgccgtcgtgccaacgaattaggggcgagagatcgcggcatatatgccaaagtgcaaaatttaaatattatgccatcggcgagaggtgggggggggggggtccgggtcgttttggtgccgacgttttggcgccagccctaacttttgtactaaaattgttgactaaatctaactatcttggtataatttgaaagctcttcatacactctattagtcttataaaaacaaagattttctagaatataaaaaatgtttttaataaaaaactcaaatttcgacttttttgcaaatttcatgttataacttatttggtaattgtctaaccgcctagcaacagctaagaaatagcttctaaacatgtcaagcttttgaatgataccaagtttgttgcatttaatcggcgacgaaaaaaagttatcgtccaaaaactcgggctggcaccgaaatgtcggcgccgaaacgacccacacgcgggggcggggaggacagtgccggcggggtggcagaaagcatacattgtgccacacaacgtacaaaaagtatggggcgggggagaatgccgtgccgcgttatatgggggtggtggcatggggattaataataatgaacacaaacacacacacggacggcacaatgcaatgaacgcatcgttctcgcccccgcgccctgcccccttttttttgccgttggcattgccggcggcgtgtgtcggtggaaggaaatgcaaaatgcgctccggcaaaatgggccaaagattcagaatcaaaatgaaacgcccccgccggggcgggcggggaaaaatttttgctgacgacgaacgccacaataataacaaatatgacgacggggttttgtgcttgaagagaaagaagccaatgtgtggggaacggggattagacagaaaacggggattcggagaaaattggttatgggaatggcacatattaaaatgatgagataggtttagacaaaatggtgatggcatcaccctcgctaaatccgggggaatatccccgcgcggaatgcgggatcaataatcctccacgaattcggagacaaaaagcccccggataaattccccgtggtccccgttggatgcggggacaacaaaccaattcactacgaattcggtgataaaaattcctccggataattgaatataatttctcgcgttccccgtggaatgcggggacaaacatcccccatgaattcggagacaaaaaccctcgtggcaatatacgaaaaaatgattgattcccgaaaatctccgattcggggatagtcggttccccgcgaatggcacaaaatgctccaaccaataaatttgatagctgtgattgagaccaatgatacatggcgaggcaaaaatctgatgccataaaaaattgccaactcgggagtcaagactaatatgttggaaacgcagtcagtaattagtgtcaattggtattaattacccaccctcgccgttttgcccatcgcaccacccaattttttgataaataaagcacacccacgcaaatgaatgatgaggatgatgaggatgatgagcgcgtataattattttccgcacgtaatcagtccatcacttatcatcatcaacgatcaaccgactcccccgcaaaatcggaaatgaatttggg

SEQ ID NO: 6715 - DNA, 847 bp, Heterodera glycines
agagagaaagagagagagagagagagcggagggagagagagagagagagagagaggagagagagagaagagtgagagagaggagagagagagagaggagagagagagaggcgagagagagggagagagagagaggagagagagagagaggagagagagagaggagagagagagagaggagagagagagagaggagagagagagagtgtgtgacccgatcagcataatggaagaagtgatcgaatgagttctagtacagatgtccttgagtgccaggaatcgaaggacgactgatgcctacgtccttggaaattgatcacaaatgtcattagtgacagagagtgagtgatctgaccagcctagtaagtgaaaaaaattgtcagatccgaggacgacccgttcccgagtccttggaaagtgtgcgcacccgtacatatgagtcgtccttaaattccaaaaactcaaggacaatctctggacaagagatgtgttccgatgcccaaaaaatttggaaaatgcaattttaaaagcggaattcctggatgaccaaaatctcaaaaatcggaattccgggatcaaaaagaccgagaaatctcgggtggggccataccaatattgaaaaaaaataatcgttaaaatttgtttattttggtttttgatccttaagaagaagcaaaacaaccattaaatctggtgataaatgcccacagactacaaatttttgcatttgaccaaacagcggggggaaaagcagcagattagtgggataggtatgctactgctttaagcttctgttggtcattgagcagagaaaattaattggcaccgagaaagagagagtaattagg

SEQ ID NO: 6716 - DNA, 1404 bp, Heterodera glycines
tgagacttgcatctagcagtgtatgggttacaaaaacagaaattggggcctcaattttgatcaaaatgtttttaaaaatattcgtccattttacatataattgtccaaaagccaaatattcaacttttttcgactgtaggagggcatttttctaatagaatagaaaaactctttcctatagaaattgttgaatgcttcaataagcctttaaaagtgccgacatagtttcagtggcatcaaccccaattggtccttacagaatgtggccaatggctttttcatataaataaagaaaaaagtttcatttccgattatttttattttaatggtaaatgctaaaaatttgtccccattttttaacagggagaagcttaggccttcattgttcattgtttttgcgattgagactttgaatctagcagtgttatgggttaacaaaaacagaaaatttggcctcaattttgatcaaaatgtttttaaaaatattcgtccattttacatataattggtccaaaagccaaatattcaacttttttcgactttaggagggcatttttctaatagaatagaaaaactctttcctatagaaattgttgaatgtttcaataagcctttaaaagtgccgacatagtttcagtggcatcaaccccaattggtccttacagaatgtggccaatggctttttcatataaataaagaaaaaagtttcatttccgattatttttattttaatggtaaatgctaaaaatttgtccccattttttaacagggagaagcttaggccttcattgttcattgtttttgcgattgagactttgaatctagcagtgttatgggttaacaaaaacagaaaatttggcctcaattttgatcaaaatgtttttaaaaatattcgtccattttacatataattggtccaaaagccaaatattcaacttttttcgactttaggagggcatttttctaatagaatagaaaaactctttcctatagaaattgttgaatgcttcaataagcctttaaaagtgccgacatagtttcagtggcatcaaccccaattggtccttacagaatgtggccaatggctttttcatataaataaagaaaaaagtttcatttccgattatttttattttaatggtaaatgctaaaaatttgtccccattttttaacagggagaagcttaggccttcattgttcattgtttttgcgattgagactttgaatctagcagtgttatgggttaacaaaaacagaaaatttggcctcaattttgatcaaaatgtttttaaaaatattcgtccattttacatataattggtccaaaagccaaatattcaactttttttcaactttaggaggggcttttttctaaaaaaataaaaaaattttttcctataaaaa

SEQ ID NO: 6717 - DNA, 3085 bp, Heterodera glycines
tacattcattcttttctctctttctctttcctctctctttcgtcttggcttctctctcaccctctttggcctctgacctttaatcctttcaatttttttcttcctaaatcaatatacctcttgtattcccattctctctaatttatattgtattcctttccttttccttttcgtcttctttgtttcttttctctcacgctctctgccttttccttccgctctcttctctggcgttgtgtctattccatttctcatgccattcaatgaattttaactttcttttggcgccagaaggaaacaaaaatttctccatgcatctgttcatgcttttctttatgtacatttctttacacccttttcactgtttcattttctcccatttcgccccactctttcgcacaataaatttactctgcttcttttcaccttattttcagtgctattttcacaaaagcctttctctcatctcactgcatcaaattcagaccgacctcttaaaaacggatgtaaaattatgccacctccagcgaagcggggcaagcagtacaaccacaacaacatcagcaccagcaacagccaaagacatcaacaaattgcaaatgacagactgcaacatcaacaatattacgaaaatgttggtttatacctttttttagttgaggttttaccttaaatacttaaaaacgcataattttatgtagttatcaaggattttaaattttattattttatttattttttactcatcatggtgattgtttattttagttaaggcacagaaagtaccccgaatatgtacatacaatgacttttgcatgtgcataaatcatggtatttttttatagtgtacaaaagcataccgtgccatggtgtttggtgtcttaaactgcgcacccggaaaatttgaattacaattggacattccgttcttgtacatgtcttacaatattccctccggcatttttcttatttttcaatttccaatgccccccccctcccaaaaaacccattaagatccaattgttttaattgttccaaacccactcatcatcatcatcttcatcattgtccaaacaggtgtcaacaccggccagcgctgtgcgcggcggacgaggccgtggccgtcgtcggggcagacgcgccggcaccggccgaggcggtggcgttgccggctctgctggacgcattctacgtcaaacaaacggcatcatagcacgggctgatggtggcggcattgtcaacaattgggcgcacgaaatgccgacggtcggcggcggtggtcgacggcaacgtgccggcttgcgcggcagacggcgggcgtcacgtgcaatcgccggccggatcagtcggtgaaggacgactcggcgtcggtggccagcagcagcgggtacggtttgcattcttgggattaaatcaaacatttatttagggagaaggggggggggggatttaaattatttgaatttaagtgctatagccaaaataaattgcatattttatgatcaacaacctttaaaatgtgtgtaacatgcttcattatctccaaaaaaaatttttacaaatcaaaggccaccctttggttttgtcgacccctaattagattttgtgtcgaaccttaatctataaaagagcagaaattttcaaaaaaagtcgatgactccatgaaaagtcttttttttcatttagaaatggaggagggttggctgagtctttaaaaatcgaaaactggggccaattttcagttatttgtggaaattatcggattagaatttatttttgcagtagaagaggtggccgtccaccgcgacaacagtcgtcgacttcggcgtcagcagcggggaggccaaaacggccatgggaaggcagcgaggacgaggaggacgagctgagcaaacgctacggattcgggcgcagttttctgttctccgaggaggaggaagacgaggaggaggaggaggaggacgaagggatgggaagtggtcagtttgttcaattattggggcgaatttttttttttttgaaatttgaaagtaaatattccctatacgaaaatcgttttttaaattgtttttgggatgaaaaatggactttgggaacattttagattttaactaacaaaatttgtttactaaaattgctcatttcatatttcccatacaaaaatcgcttttttgggatgtttttgtactgtaaaatttgaatgtgaatggacttttgggaaccctttaaaagattttaactaatttttttttatagaaaattgcccaaaatttttagagatattaaatgagataattaggtacaaatgtttgtttttgggtttttaattactttccattaccccacacagatcagaccgatttggacaccgatgatgacgaccgtggtagtgaagcgaaggcgcttccgtcttctgccgctgttgctccctcggcctcgtctccgtttggcccattttcttcgttggacgacgaggacgacgacatggaggaggaacttttggcccaactaccgcctgaccaaataccaccgctcgttctcagcgactccagcgtggacttgctcatctacaaggaacatttgatggacacgcttgaggtgatgggaagtctgtgatggttactccagaatttcttttgttcttcttcgagttatctcactttttcgccaattctcaaaggcagtttcgaattaattttttcttccatgataatgtaaggcgggacacagttctcgtccacggactgggatggtgattgggtattagaggctcctcaccctcctcccccatcggaacgcccatcccgggaatccccttgtaagcgacggctttcccagccatcgaggtcagtcagtcattcagtcatcactcccatactcaggagccccccgcgggggggggggggaaaggtccccccccccccaagatttacaattagcctcacccaaatttcccaaaaagttcgctaaatttttcaaaaaatccacaattttttgatgaaaagctgctaaaaatggctcaaaatcacaaaatgtgccatttggacaaaagtcgttaacaaatcgcattaaaaatgcaaaaatt

SEQ ID NO: 6718 - DNA, 2894 bp, Heterodera glycines
cgtattggggccaaagtttgcattttttaaaaattagagtttagcgggccgggaattcccggttctccgaggtcccggattggctagtctccttgactttcctttcttttttcccctggttcaatccctctacagaaattaacatattttgaattttctttttgtatactcatggcattcctatcgccaaaatatggttactcatagttttattttaattgacacatttttatcattttttttaaatgaaaatccgtacaaattgttgagcctattaatcccgaaaaccagccttttttattttagtctgagtggtgaaatggcaaaaaaatttttgcttataaaaggaaatttgggtcgtttgactttggcaccatcgacagaacctgatgaagatgatgaagaattgatgaaatttgattttggaaataatcgaggattaaacttcaaatatatttttacaaaatatttgcttgctttaaaatttaagagctttatttttggtttgactttttgaaataaaagaagcaactttataaatttggatttgtattcacaaaaattctcaaaattggtcccggtcccggtcccgaaaaaaaatcgaggtcccggcaagtcccggtcccggttttgcccaaaattcccggtcccgctcaactctattaaaaatcaacagctggcgagtagaattgtaataaatgcttgactcgtatttgtgcgaattcctctggcgcaaaaatgtcaaaaacccgtggcaataattttggcgcgtagctttagaattgtacgcgccctctgttgatttaaaaaaaattcaaactttggccccaaaaacggaaaagtacagagctttttgcttgagctcctctgacttgacttttgccaagctttgtttttctggttcccattacctaaaatttgaaaacttctaattgtttctcaaaaaatttaagtccttatcaaaattgtttttcttaaaaattttcaaaaagaggaaaaaaatgccaacacgaaagaattttgtttttttcccataaattggcgtattgagtcacaaaaaaaaaataaaaataaaacgcaattaacttttttgtaactcgctttaatttttgttacccaattacccactttataattgcatttttattcgttaatcagttttttttttaatttttcaaggtcacttccggcgctggtgggccaaattcgccggtgctcaatttggacatgcttttggccgagttggaggacggcggccaatcggacggagcagtgccagcaacacaacaacaccagcaccagcaacaacagtcccaacacattgtggccatgctggagcgagcgctgcgcgagagagacgaatttgccaacggcatgatggaaatggcacaagaaatggtaggccgaaagtatacggtagtcaagtgaattttgtacggtaccgtatcgttaattattcgaatagcttattaaatgacagtaattttctttgcttgaaattaaatgattaagctatatatattaccaaatttcaaattgttaattaaggatctcttaatagttgttaaaatttattttaaaaaatttttaaaaagttaatccattaatattattttgccaattatttcatttttttaagaatttattgaatttaattccgattttaagaaatttgaataaataaataaattttgaaaattttttgaaaattcatttaataatttaattttcaacaatttgctatgactcacaattttttgaaaaaataaacgaaatatttcattttttgtaatttattcttttttaaatttatgaatttcaaggacaatgatgaaaatggtggcggtggttcgtcagcagctttaacaacgtgttcatcttcatgtaatggggacattgggcctgctgcgggcggcaaatctgtcaagcaacacaatgccattgcgtcaacatttggtccataatttgtgaaattaaaattttttaaaaaatattttattttttaaatttatttgctcctgaaatatgtagccggatttgcccgatatccccgggggtctcaattctcattctcgagcctcataaaactcaattctcggctcgatcaagtctagggtcaattctcgatgttcgatcaactctagggtcatttctcgatgttcgatcaaactctagggtcatttctcgatgttcgatcaactctagggtcatttctcgatgtacgatcaactctagggtcatttctcgatgttcgatcaactctagggtcatttctcgatgttcgatcaactctagggtcatttctcgatgttcgatcaactctagggtcatttctcgatgttcgatcaaccctagggtcatttctcgatgttcgatcaaactctagggtcatttctcgatgttcgatcaactctagggtcatttctcgatgttcgatcaactctagggtcatttctcgatgttcgatcaactctagggtcatttctcgatgttcgatcaactctagggtcatttctcgatgttcgatcaactctagggtcatttctcgatgttcgatcaactctagggtcatttctcgatgttcgatcaactctagggtcatttctcgatgttcgatcaactctagggtcatttctcgatgttcgatcaaactctagggtcatttctcgatgttcgatcaactctagggtcatttctcgatgttcgatcaactctagggtcatttctcgatgttcgatcaactctagggtcatttctcgatgttcgatcaactctagggtcatttctcgatgttcgaccgagtctaaggtcaattctcggtctctattctcgactccgtcgtcgtcaattccatggtgctcgataccccgggcttaatctcaatctctttctct

SEQ ID NO: 6719 - DNA, 2556 bp, Heterodera glycines
atttttttgctatttttccttcaattttattccattcttttgctgaatattttcttcctttttgcttaattttctcttttatcttattgaattttccaattatttctcttcttttctgttcttcgtttcttttttcttcccatttttctccaaatatttcgtcaaatgttttttgttccaattttttattttctgatccgatctgatcagttagggtgatcaaaaatataaataaaaagaataataagcataatttcatattttatttttgcgaaaacaaccttaaaaacaaattaaacaattaatattatttttaaaatgaattttgaaaatagtaaatggttaaatacccacagatatgaattaatattgaaataacgataaaaaataatttgttgatgaaaattacaaaaaaaaaaatgcttttttccttattgactatcattaaatcctaatattttatgtaaaaattcaccccaaaatcaatacaaatgtataaaataaggatatttttaattatttttttttcaaattataatgacaaaatataatctttaattaaaattttggcataattttttaacagaatttgtaatacaaatgttcattttatggatttttaatctaagttttaaaaattctatttttttgcaaaaatcaaatgtttttcacaaagatggaaatttttgaataaaatttttaaaaaaatcgaattttcagtgacgaaaaggaggacatgcttgtggacctgcaggacgagttggagcgccaacgcgtggagatcggcaggcttcaagctgaacggttggagctggtcaaggacgcgcgtgcagcgaaggatttacgtgacgaaatggaatgcatgcagcataaactgaccaggctggaacggttggagaccgaagcggagaaaatgcgcacaaaattgggcgagttggacttctacaagagccgaatgaacgtaaaacaaattaattattttgacacttaattttataaatttattaaaattataaattaaattattatcccaaaatatcacgcttttcagaggagttcttaattatgagagtttcagaaaagccatgaaatttaatgaccctaagacttagggattataaatttgtgagaatttagcgccaatttttataattttttgttgagaaaaaaaggaaattttagaggaaaaaattcatatgattttcttcagattttcattcgagttaactcgtggaacaccaatcttagaagaaaataataatttgatttgaatcaaaatgcctcaaaaatatttccaatattcatttttggtattttaaaatttattcatgaaatttctaattaattagctcataaataaaaaataattattatattaaaatattttatttcttatagagtttgaaagaggacaatcggctggtgcaggagacgtgccgcgtgatggaggaacagcttgaacaatgccaacgcaaactgaccgcccatttggaggtggcaaattttaatatttttaaaaattgaaaatcaattaaattttgttttaaaataattaaaattaatatttgttaggtggagacgaagctgatcgagtcacaggccaacaacaaatcgctacaacttgatctcactaaggtcaattaatttctgtcatttggcaattttatttaataaatatttttattaaattatttaaataattaaaaattattttttttttacaataattaattaaataaacaaaaatttgaacattttgtttcaaaaaacaataaaaaaattaaaaacatattgaatcattttaaaataaataaatatttaaaaatcatttttatatttaataaatattattaaattatttaaataataaaaaataaaaattattttatttacaataattaattaaataaataaaaaattcaacattttatttcaaataacaaaattttaaatgattaaaacaattaaaaattcaaaaacattatgaataaaaatattatattttaatagaaattttgatttgatttttttataaaaaaaatttaaattttttgctaataaaattatccaaaatatatataattctcaaataatgctgaaatagacgcgcgcacatgtggaggacctgctggtagagaatgggcgactggagcgtgaactgaaggccaacttgcagcgacacgcgcaactggagcgtgccatgcagcactgcaatgctgtggaggaagcgcgagcgtgcgcaccatcgccaagcggtggcgacacgctgcatgattcgtcattgcttgcgcaattggacgcatacaatcaatcgcagataaatttttaattaatttttgaatttattttaataaataatcattaattaacatattaatacatttttgtgttttaaattattgaactgcgtctcgagaacagcaaactgaaggcacgcttagcaaatggagaagggtaattgtttaatgtacaaaatatttgccatttacaaatcaaacatactgtatgtatttcaaatcaaacatactgtatgtatttcaaatcaaacatactgta

SEQ ID NO: 6720 - DNA, 3134 bp, Heterodera glycines
  misc_feature (11)..(11): n is a, c, g, or t
  misc_feature (17)..(17): n is a, c, g, or t
  misc_feature (27)..(28): n is a, c, g, or t
  misc_feature (41)..(41): n is a, c, g, or t
  misc_feature (108)..(108): n is a, c, g, or t
taaatatcatnttattnaaaaatattnntagttctaaaatntaaaaacttatattcagtaaaccaataccacagacaaaatacatatacttagaccataacataattntaaaaagggaaatttaaaaatttctttttttaattaaattaaatattttcaaatatgcaaaaagccgttttttccgaatttcgattatcaaaaatcgatgttttagaatatcttcgccctctaatggtttaatcaaatttaaaaacaaatgaaaatttacgtggaaagaagaaatttttatgactgattaaaaaacaaagcattttttctttccacaaatgatttttgcaatgattaattacactaattacactttccttaattgagcagttttgctctctctcctccaaatggacatgaatgaatataattgacaaataaattcccatttttggtgttaatgatgctaaaaatgtgggggaaaaattttatgttatgtgaatgaatgggttgggcgggttctcttctttcatttgtgctttcacattcatattaataaacaattttattacatttggaaattcaataaaaaacaaaaatattttccaaaatccataaataattatttttaaattaacaaatcatctttttgtaaattcaatttattttagcgaagtgatttatgtttaataggattttttttttgttgttgtaaattcgaaataaataaatatttgagaattttaatgctgttttatttatgtttcgtggtttattatgaaaaattctcatttttttttgtcaaaattagttaaaaattgaattaaaaaccaaaaaatgatgttttaaataaatattttagttttattttaggatctaaatacctaatttaaaaaattctttttaatttttaaattagttttttttaaataagtttcaaatacttactgaatttaaatgcttttacaatttcccctttttccagtgcttctaatcctgctgagatgttcgaactgcgcgcggaattgaacgcacacgaaaaattggcggaagaaaaaatcacagaatgccaacatttgcgcgccaatttggaactggcacggaaggaggtcagagaagcggaggagcacgagacagtgctgcgcgcagacatcgacaaattggagagagagttggcggaccagagacgcacgacaatgccaatgcaaacgcaccaattaacggtggacaaattggagagcacagaacggaaggtagagagagagagagaaagagaaagagaagggagagagagagcgggaggaaaagaagagagagaaagataagggggagagagagaagaaagttggcataatggcattggtgccattttgttttttttaattttctgagttttatttttggaaattcagtgaatttttgattttttataatttcttggcgtcagcccaacccttagcttgttagcgctataatttttccataaaattaaactaaatttgagttaaaagtgccaattgaaaattaaaggaaatttcagcaaaaagtgccagtttttaatttcggaattttttgccacaatttttaaattgtttttcttgaaatttataggctaaaaaaggaaaaaattataaaatggagtcattaaaattaatttttaaaaattatttttagagccaacaattggagcaacgtttcaccgctcagttggacacgttacagcgcgaaaagtttgaagcggaagcgcaactccaaactcaggtccaattatttgtgaatgcttcacgtcatgtgacacattttcggttcagaaaagacagcagcgtgactgtcgcgcggagatggacgcgctgcgcgagcgcgccggatgcgacgctgaccaatgggagcggcagcggaaggcactcgaatcagaacgaaatgcgctgcgtgcacggctcgaccttgaggaggcaaatgcacgtgagctccatgctgcaaaatgtgaagcggaaagcgctgcacgcaacgcggccgagtacgagcgtcaagtgcacgaaagagaggagcgcatgcgcaaattggagacagaattggcacaacaacggcagcaggtggccatgagttttttgtaaaagattttcaacaaagatattaatatccatttttgcaagtgctatccttgaaaatcatcatcttgattcttaaaaaccgtggcaattaaacatttttgggcaaaatttaaaaaataaaaatgaatttttactcatttatcatttaaacattttaatttaattaattaattagttaattatcaattaatataattaaattatttaattaatcattaattaattatcaattaataaaattaaattcattaattagtcataattaattacctcaattaatataattaaattaattatcaattaatattattaattaaattaatcattaatttattaaattgatcagcaataaacaataaaacacttcaagactgatgccgaaaagaaaaagtcgcagctctaccgagaggaactgatcacagagcaaaatcggcttagcgatttgcttggtcgcctccgttctggttaacactgtaatctgctttttgtactcacagtaatttgttttacagtatgccttatggcgctgcgttccggcgctgacgaagcggcagacacttcctgttgtttggagccgacctgcatgcaggacgacctgcagctgattgcaatcattgatgatctgctgatgaaggcgttgacggacgcacgccgggaggcggacgcactgcgcgtgcagcaacagaaacaaatccgcgagcttggtcagtttaatacgattactgtacaaataaattcttgttacgatggttcgattacagtaattgtctgaataattttgtgtaattaaccccttaaatatataaattcaaaatactgtgaaaagtaaggtgagattattatgcaagtattgtattttgtattgttacagttttctttaactttaggtgccctaaaaaccgaataagctacaagtctacagtagttctaaattagtgattattaacagaatccaattgctgtacttagcagaagtttccccaaattctgcgccatactgtaataaaaattaatttaatttcaattttaattaat

SEQ ID NO: 6721 - DNA, 1522 bp, Heterodera glycines
tagggatcggatttttagtgataaaaaatcccaaaataattaactaaacacggcgtccggaaactgagctgctgtaccaaaaaagatttgtatgtgtggcgaagtggtttgtgagaaggtcaccaaagggggggtcccaggttcgatacccagtgcatgctattgatgtatttcgatgattttaatgaataaataaaaggaaaagtgaccaaaatgattttaaaattgtttacaaattttttaacatttttatttatatgtgtagtgaaaataaaccatcaatcctcgatcagtcaacgacatcgatgtcggcgtcttgatcactttcttcgttcgttctgtcttccgctgcttgctcccgtcgttcctcctcttgttcagacgcgggtatcgttccacgaattcgccgttgtgcgcaattgtattgttcaccaaattccatcccctaaaggttggcgaagcaaatgcaaaacgggtgaccaaaattcgcttattacgaagcaaattaccagctttggtcgtcgctgccaattaacggcaaatagccgggacaatgcaacgcggcatgatgaccattttctccttgctgtccgtgtgagtgaggcagaaaattttgttggtgatcccattcttgaaaatcttgaaaatttggctaattaaatttgtcaacttttttttagcaaacggagaaaaataataattttttgcacattagacttagacttaagcatggactaagcttaggctagcgctagacctaggcttcatttccacaatttataaaaagaaaaataataaatttcttatgtttttgctgccatttgctcatcccaggtatccaaatagaaattttgtcaaaatttttccatagttatggtattttatccaattttcagttgcctaatgacaatgcaattgacacattagccaataattatgttttaattgctttttatccggtgccattttttaattaattaattataccagtgatccttttgattattaaatgttttccattttgtttttctctccctttttaccttaatgtcaaatcctccttcacgcacagaattgtgctgaatttccaatgaaggttttacatgtccaaagatgagagagatgcctccccgattaaattgtttgatttatggaacggaaaatggaatgtgagaaagcagacatacctatgtgcttgagaaagagattaaatggatgcgataaattttcgccttacagtatttagaaaataaatggaagatcaatgataatgaatagggcgtgtaattattagggccacgacttttagtgacggtaatagtgccgatggtagcccccctttttagaaaaaaaattttaaaaaatttgtaagtcccaaaaacatgtttttaggggttttcagagtcgctgagcacgaatctggcatccatttcgacccatttcgaatcccggacccgaattcgaacaaaaagtcgaaaatacaaaataattttcaaaattcacatttatgcaacaaaatcaa

SEQ ID NO: 6722 - DNA, 3225 bp, Heterodera glycines
  misc_feature (14)..(14): n is a, c, g, or t
ggatcggatttttnagtggcaaaaaatcccaaaataattaactaaatagtgagaaaaaaattccaaaatagtggcaaaaatagtggcgaaaaattccaaatttaggggtgtaattttttaaatagctgttttttaatttgaaaataatttaaaattaaggaaaaagattttattcactgatttcagttacaaaatattttctatttttgaaaatttttaggtcgattcttaggggtgtatttttgaaaattttttaggtcgattcttgggatgtatttttcgtttttattgcattttttgggaaattttccaaaaaatgccaaaatagtggcaaaaataatgacgaaacgccaaaatagtggcaaaaaattattttagtggctaacttccgaaatagttttttttagtggcgaagctccaaaatagtgattcctagtgatgaatagtggcactaaaaatgaaaaattttcgaaaaagaatgtgttttcgtgcatttctcgtcgagttaaagccgcagaaaaaatagttaaaaaactaagaatccgatccctattgatcagactcactgataaactgataatcaaatttatatgttcttttaaaattcttaggaaaacaatatttggctatgtccttaataaaaagatttcttaacttcaccctttttggagtttgtgggtcaacaacactttattatttgcatcaaaacgattattcactttcacacattggcattgttcgatttgcacgtgttggactcactgtaattttttttattttttgttaatcgtttattttcatttattctttccttttgcaggcttcagcaacaattgtcgattacaaattgtctttgttaggtgtggacagcgaatccgcggagtacaaagaacggatttggcaatgccatcaacggggggcagaccgactgctcagtttggcacgaaggaatggcggagtgttcatcaaagttggtcaacacatcgcctcgctgcaataccttttgccggagccgtacacttccacactttccattctccactcgaaagcgccggagagcagtttggacgacatgaagacggtcttctacaggagtttgcacaaaaatgtaaattcattttttttgccgtgtttcactcactcactacaattttacagtttgacgatgttttcgacgagttcgacccccgtccatgtggcgctgtgcgttttactttcatattcctaattgttcatttctatacaattaacaaagattaattttgcattataatggcatttttgttttccgtatctctgagtggtcttcgaattcgtttaggcttctctcgcgcaagtgcacagggccaagctgaagtcaagcgacgaatacgtggcagtcaaaatacaacatttgcatgtgaaagaccgcagttttgttgacatggccacgatggaggttcagttcaaacaaatttttgacaatgcgaatagaataaatcgcttgttagagggctttttctaaatttttcgacatttttactgttattttttttatcgtagtttttcgtcaatgtcgcttcctttgtttttcccgaactcaaattgaaatggttggtccgcgagacaaaattaaaccttccgcaagaattggactttcttcgcgaggccgcaaatgctgacaaagtgcgtcgaatgttctcccacatgcgttttgtcaaggtcactcacttccattgttttccacatttttcattttttagatccccaaaattcattacaattactcttctgacaaagtcttaaccatggaattctgcgaaggtggtcaaatcaacgacttggactatttccaagtccatcagcttgacaggcacaaagtgagtgaacggtggcgcttctcctgactaaccatccccgtttttgcactcaccaaattacccaacccgaaatatctattttaccgatgattttacgaaattgttttttggactctcaacggaattggcccatctctgagctcatgttctcccactcctccctctttttcagatttgtcgtctcttgggcgctttgtacagcgaaatgattttccgccgcggctacgtccacagcgacccgcaccccggcaatgttttggtcagacgaagtgccaacaccgggcgggaggaaattgtgctgttggaccacggcctttactgtgtaaaaagtccgtttggaaatgccaatgtcaaaacgagcgccaattgtcagactcttcccgacgaattgcgcattgattacgcgaaactgtggctggcgctgatgaagccggaccaggacgaaattcggagggtttgcgaacggatgaacatcggacagaactacggactgttcgcctgcattgtcacaatgcgctcttggaagtcagtcactgcgggcattgcgcggacagaaattgacgacagagaggtggggaaacggagacagggttttgaaatgggttcaaattttcaaaaaaataatccaaaattatttttaatttttttggggctctgtctttcatctccctcaaatttgagtacttttgaagcgatcgcacatcaaagagtacgccaccggtcttatccctcaaatttccgtggtcctcgattccatcccacgccaaatgttgctgattctgaagacaaacgatctgctccgaagcattgcattcaaattaaaaacggaacaccgactggacagtttttcagaggtgaattcggccggaaatgtcttctctttccccgttaattaatttttgttccgtcagatgaccaaacattgcactcgcgccgtttaccaccactcaatcgccgccacccaatctttgctgagcaaattgcgactttacttggccatgtacgtccttttggtcaaaataaacatcttcgaggtctttctgattgtgaatggactgctcacagcgaggcaaaggcatttgacactttaacaaatgcttttccttttgcatttgacttcccttttgttagcccactttctttctaatcattgcttgtcaaatacacaaggagagagtacggtaatcgttgtaaaaaacggattcaaacaaaaacagcaaaaccctgagttttgttttaaataattagaaaatgccaaataatagtgaattattggcagataagcagtcaaaaaatgaagaaaacgaagggagaggttttttgtgtatgaagtgaaaatggcaaaatgaaagaacgaattggcagt

SEQ ID NO: 6723 - DNA, 1479 bp, Heterodera glycines
  misc_feature (19)..(19): n is a, c, g, or t
  misc_feature (22)..(22): n is a, c, g, or t
cagtgccatttgcctaaantgnatggcattttcgaaatgctaactgtgcggtgccctcctcctgctatcgttaccataatccatccttcgtccgcgatgcatttggtcttctcccccttgcttaaattgtcagtcattagcatggctttccctcctaattaccccctcctacccaatttccgtttcttcctcttctccgtagcccgcaggaggccacaatcggcctgtgtttgggtcgggcccaatccgtcccggctggtagaccgtcttctgtacgtggtgttccacctgttgggggtgttattatttccccctgcccttgtcttccccttcccctctttttacgtcatgttccggcacccattcctgcgctttgactttcggcaccgattggcgctcctcaaattatgtttttgctttcttttttgcttctcatgccccgcttctctcactttctcttcctcttctgggaattcgttccattttgtcttcgaatagcccaccgcctcgggcacaatcgatttctgacaccaaattaattaattaaccgataaatgataagtttaattggtctcgacctttgcctcactctccaccaaaaagtcgccagtcgcatttaatttggcgggttggacctgcaaaaacaaaggccaaatggtctccgataagccaatgagcatttccttcgctcgtcttcttcttccctcgccaattcgttcactcaccggctgatattcgggctgcacacgccgctgcacttgccacgcattgtcctcctaaattttgacagactttcaaccgatccgattttatagggaattgaaaagggctttatccccccccccttcattttattcattccccctttggtcggtttgcgcggaaagatcgctgctatccgcaaatgattgggactcccgccgagatccccccccttagcatattccgtctccccccccccctccgcttcgtttgttttcgtccgtctaacttacaatgatcggatttcggggcactgcgctcgcctccaattgttcctcatccggctcttgccctggcggcagtttgttgacagatgcgtccaccaatttcggcgtgtattctgcgtgtcgtaagatgggttgggtcggcgcttcgggcagttgcacttcgcgcacaacgggcggaggcgcgcgcttttgaggcgccaccgcgggaggggcggtgggcttcggcggcgcagcgacggcagtcgctttgggctgttgcggggccgcggcggcctttggcggtggaggggcagccgctttgggctgttgttgttgctgtgccggggcaaccgctgcttttggcgcttggggctgctgcggtgctttggccggcagttgagcggagggagcctaaaaagtcacgaaaattgcgcaaatccaaaaatgagcatggcttttcattcccctccccaattcaaattttttttttttaatttgagaagggaatgga

SEQ ID NO: 6724 - DNA, 1761 bp, Heterodera glycines
aattttcccctacatttgcccttgaacaggcgatcattcatgccgtttcgccgtcaccattctgcagattgatgtcggcaccattctcgatgagaaatgcgactgttgtggaaaaaatgacggaaaaaattacgcatttttcaattttttgtctaccaatttccatttgcgatcttttgcaagccatcatcagcggcgttgttgcaaagtccgatcccaagtccacgttggcaccacggtcgacgagcacacggcacagcggaaaatgtgcatggagggcagcaacgaaaagaggcgtcatgtctgcacacaaatggggaaacaacattatgtccaagacagacaaacatataattaatctctggcatccgtattttgaccaattccgacccgaattctaacaaaaagtcgaaagttcaaattcttgaaaagggttaaatacacagtaacaaactgaaagtcaccatccagcaacaaaagatcatttaatttttttagacgaaatttgtgaaattcgaaaatttgaactttcgactttttgttcgaattcgtgttccggaattgttcaaaaatagatgtcagatttgtgataagaggtgccaaaatattactctccggcatccgaatttcgaccaattccgattcgaacactggacccgaatttcgaagaaaaaatccaatttttattatcagataacgaagttcggagctggtcgaaatggtgccgccggattcgtgctcactgatcagtgaatgacaccaaaaaactgcatggtaaaaaagatttcatcaacaacaccacccactcgtgttaatgtcgttctcacggccaaccaccggctcattcggatcggcgcccttctccaactgaaaatgccatacaaaattagtgccgactgataaatttgtttgatcactaccaagagatcaacaatgtcgatgtgttgtcgaaaaaaggcactccaaagtgctgatcgtgatcgggtgtagtcgcgctccactggatcaaccatccaccgcagcaaaatgttcagctcgtcggcgtccagcgcatcgatcagcacacgaagttgttggatgttgccgtcgttgatcaggtcgaagaagcggcgagcgcgcgtctcgaagttgtccacaacagcagcatcagtgggatgttcagcatcagccttaaatgtgggggaaaatcagttattgaaaaaggattctgagttgaaaccgtgcaaaacatttattcaggggggggggggtcatttcactgatcagtgaccccgaaaatccccgtggaaagatgactttcagtttttgaaaacggattttcagttgaaatcgtacaaaacattttctagaaggggaagaggttcgtgatcactgatcagcgccttgaaaatccccagtggaaagatcatttttaaaaacaaaaattcgtaaatgggagggggatttaaattttatacgatgatgaaattacaaccaaaaaaatcactgtaaaatgatttcatgaaaaaaactttaccatgcgaatcagcgcagttgaacaatgacgacgaatatgcaatggaaataatagtgaaaatggaagacgaagacggaatgaaatggcggaaaatgaaagtacgcaacgcttttatatgcccatcactgtgggtcgagttagacaaaatgaattgaaacgccaaaaattatataatttacgcgctaattcaaaatttactctgatcactgcatttttaggattgtttatttagatcagccataact

SEQ ID NO: 6725 - DNA, 3569 bp, Heterodera glycines
aaaatatcagcgaaataaatcattaaacaaaaaaatataaagtttaaagggaagcctggaaataagaaaaattttagaaataaggacattttttatttctaagatctggcccttcaaaataaggacaaatcttagaaataaggacacttgggaaccctggttttacgacctttttcacgtcgacttccttttttcaattttcagatgcaagtggactcattcatgacgaaggtgccattggaaacgccgaggcggagaatcagcaattgactttgtcacgaatgcaaagtgtcaacggcagtttcgaaaaaattggcgatgagccgaacgaattcggttggcacatattccgaattttgatttaccgaaccaaataaaaattgctacaattttagaagccattggagtggccgatgttctctcaccagtggaccatatgcaatttgtatgttcaaccatccatccattgctgagagacaaataaatattggtttgttctctcaaaagggtcaacagaattcggtacaatttgacaatccatcggcgaagaagacaaaaagttatgccgaagccgtgcgattcgaattggctgacggaggaaacagtgacgaaccaatgatggaatgggaggggccgcagaatcagcgggaggactcaacgcatgacgacggcactctatcggacaatggtaagaaaaaatggggtatttatctgtcaccagacttcaaaaaaatttatacgggtaaactggtttggggtttttagggtcgggaaaacgattctttcggatcctgaacccaaactcgaacaaaaagtcgaaattaccccatttggtttatgctgacaataattagttttagtgcattctttgcaacccgttgcgccccccgtcactgaatttggaattgatttgtttccgattgtttctgcaaaacaaactggagacgattttggtgcgcggaatgttcagcagcaggtaattcagtggccaattgttccagtttctaattaaactaaacgtttcaggaccaaagtcgtcgcaacgacggatcagacattggactatttgaaaaaaagaaatgtgttgcctcattggaaatccatcggatggacaatccaaacgaacgttgtgtagtcaaaaagtacgaattcttcatggtgacggacaatgagcagcatcaaatgaattccgctgcttttgcaacttctgagcgttgtaacccaacggttggccaaatgacacagaagattttgtcggagcattttgaaacaccaattgacaaattaattgcacaattcgacatgcaaatgcaaatttttgatacggattttgctgacggacgttttgtcgacatggaaaaaaattggtcagctgaacttgttcaaaacaatggtgcctacaaagtgctgctccattcaaaaatggacgccagaagtggacgtggatatgaagatgtatccaccagccaaatggccaaccgtggaccacgtcagcaacgtgaaatgtttggcaatcaaacgtacaatgaatatgagtccgacatgtttgatcaacaaactgttggaaatcgtagtaaatgtgggcggcccattggtgatccatcgttttgtgactccaacttggaacaaatgtaagttgaaaacattattcatatggatattccgagtattctcttcatacatttttagtggggggtcgagcccccctgacttcgttcgtatgaggggccgaaagaggggggggggggggactttgtattggttgggacaaaaatctgaaaaaaaatgtggggaaaggtcggagacgaaggattaagatagatgcgacttcgtaaaggcgaagagaatttaaataatttaacatacaaaaaaatttacgaaaccgagtaatatttcgtattttttttatcaaataggtatgatttttaacaaattgcacttcgcgaaattgtttctggttacgggcctgaaggacttcgtaaattttcgtccgacccccccccccccactatttaatgtatgatttaaagtaattgtcttttaaattcttatatgtttgttgttgcttctttttttctctaaaatccattttatcggatatttagcggtcgctttcttctctccgaggtgaaggcgcctctcgccaatctttacgatgtttcaacggacaatttcgtcactttgaatgatcatggatttgtcaacaaaatggccaaaaacgacgaaaatttgacaatgcaggacaggccaaatatgcgcgaacaactcattgaaattgaaagttttgacgatttgaaagaacgcaccaaaatattggactttgatcagaaagttgctaatacaattttaacaaaagctatttacgcttttgttatagttgagtgtgatcagccaacttgcgcattttgacgatgccaatccccttggccagtttctgcagaaagcggcagctcaaaccgaacgtggcaactcatttggcttcattaaaattgtgccaaaaacggtagaaatcggcactcactttttactctcatgaaacttgtctatgttttgcagacaatttcactgaaattggtcctcccaaaaatgcgtgacatcattctgcagcagttgcctgtaaacaatgccacacattttgtcatgtcggcatgctatgggtcaattgtggcagggatcgtgacttttaatgagcgcagtgccgccaataaaaccgacatttcaaatgcgaaaagggtcttgaaaagggcataatatttttcaaatctgtgtaaattcgttcaagattgttcgtaagtttctggctgggcctggactgagtccttcggacaaatcattcgtctctcatctgaataaatcaatttcgtgcagtgttttcgttgacccttcggttggaaattgcttgactgatttggttcgtttgaagcgaattgtcttcattttaaaaaattccaatcggatttcgttcaggattttttcaaagggctcaattcttttgccgataagtgggcggctgctaaagacacaaaacattcgactccgatcagtttttcgttggtcccactgtcttctattatcgacaaaacccgattcaatcccgtctctactcatatgatcggtgatttatttatagttttgattagtcttaattatcccaatgatcagcagatgaacatcagtttgattggttctgtcgtcgtgtgcaaactgtgaatgattatgaatggcggttgcggaaaatccgtcaatcattcaatgaatgttctcccatgttaacgttagattttggcgctttgtttattttcaaaaattgttttagtaatgggcagttggacgacgcccaacaaatttttgaacagttggaagcgaagaaaaacattttttacgactcactaaaagatttcatcgtggatttgcgagtgtgcaaagatgaacgtccgaaggaggccatggtgcaaagggcggtcgagaattacgtgcagttctgtcaatgcgtagttggtcattatgaagcgttggtgaaagagaagaaggaaatggtcaacgaattgaagcaaaaagggaaattcttt

SEQ ID NO: 6726 - DNA, 2961 bp, Heterodera glycines
gggagacaattgactaattatataagataatcatgcgcatattgaatgaatgaatgcttaacgcttgcgatgatcaatcaccccactgatcagagagtgattaggaattgatagatgtttttgaattgaactgctagcaaatagtgctgatgatttatttaatgatagactagcagttttcaaacaaaaatcgtgataaacaattaaaataaagaaaaatacgagaaaaataatgaaaattgaaacgtaaaaaacaattaaatgtattagataaacaattaaagaaaaacccaaacaagagaatcaaataaataaccaattcataataaaatggaaaaaataaattaataattatgataaaaagtttaaagcaataaacagggcccaaaatttctggcaaaatttgcgaacaaaaaaattttcattttaaatttaattattagaaattaataaaatttaattttcgcatatttcttttcttaaaatctgagccctgcttgataactagagaccgacttttgaggcatatgctatattaagcataaaacgcattttccgcttggtttgaggcttctatgtacgttgacttttattatgctttttttgcctttttcgggattttcgtgttttaaatgatgcctttttggcattttgctgttttgaagatcgactttttagaaattttttaaaaatacacccccaaaaatatgaaaaatttgagttttcatcggtcattttggcattttaataaataattttgccattttttgcgaacttttctttttatttaatgagaattttttttcgaaattttgacaaacttggaagtattttatatacaatggacgacaataaaaatttgcatttttaagttttaaatccattttttggttgtttattgtactttttataatttggcagtttttagtccatattttggtccatatttggccatttttgtagctttcttcatatttcgggcatttttagtccatattttatgtcatatttgacgttttttagtccatataatttcgagccctagttatggcaattcccatttgaaattgtacgaactgccatcgaccccattttaccaaccgattggcgcccagaaatttttcggattccgaaaatttgcttttttaaatcgacgacgactgaatagcttcaattaaaaacacaaaggctggcagatttaaatcaaaatgttacaaaaattccgagtttttctcaaattcattcgacatttatacagcgactcacaaattatatgtacaatcagagatatttggaacatattacagacaaatcggatcaaatagaaatggtgggcataataagatacaatacattagtgatcaattaatgtcttccgaataaatccatccgccgcttttggccagcgattcgctctctctgtgctgctgtcacatctgttgctgatcattttgctgtctgaaaaatgggaaaaaacatttatttttgatcaaaaataacaatttttctttacccatcggtgccttccgcgtgttgcccattgtccgtcgccgtagtacgaaaaatggccatcatttcggcatgtccggtcagtaccgctatatcctgcgctcgattgcctgaaatgggggaacaaagtgaactaaacgcttcaatttggccacttccgctgctgctcaccggccgtgtcccgttggttaatgtccgcgccgatggccaccaaatgccgtgccatttcagtcttcccactgatcactgcccacatcaaagcgttgtttccaaccacgtcaacatgttgaaggtcggcgccatgttcgatgaggaaattcactgaaaattagggagattacatttttggcactttgccacaattctctcccaccgatggccaaatgtcctttactggcagcgcaaatcactggagtgtatcgctcttggatggtttgttggttgacatctgcggcccactcctccaccagcagacggcacacctccaaactgccgccaatggcagcgctcttaagtgcgaaatggaatcctgaaattaggacaacatttgtggtatggtatttttgggtactgtaacagtaatcccccaccttcgaaatccatttgctcgacatttgcaccatgtgtcagcaacaagcgcacaatgtccacctaaattcaaatggaaatgttggaaaacatttcgccaatggaaatttttccctagatttcccttgtaacacgcgtacatcagtgctgttgccccatcaccattctgcagattgatgttggcaccattctcgacaagaaatgtgactgtggggggaaaaaagacgggaaaaaattacacattttttcaaaatttcgtctctctaccaatttccgtttgcgatcttttgcaagcgtgcatcagcggcgttgtggcaaagtccgtgcccaagtcaatgttggcaccacgcgcgaccagcacacggcacagcggcaaattggcatggcggacagcaaggaaaagaggcgtcatatctgcacaaatggggaaacaccattattttcagggaaagcaaaaatataattattttccggtatccgtttcgaccaattccgcgccgaatccagggacccgaattcgatgcatggtaacaacgatttcatcatcaacaccacccactcactcgtgtttatgttgttcacttggtcagccactggctcatccggatcggcgcccttctccaactgaaactgccatacaaaattagtgccgacggataaaattgttcatttcactaccaagagatcaacaatttcggtgtgttgtcgtaagaaggcagtccaaagagctgatcgtgatcgggtgttgtcgcgctccactgtatcaaccgtccaccgcagcaaaatgttcagttcgtcggcgttcagcgtatcgatcagcacaagaagttgttggatgttgccattgttgatcaagtcgcagaa

SEQ ID NO: 6727 - DNA, 1029 bp, Heterodera glycines
ggaatttcgctttaacaaaagtttttagccctgggaatccagagttatgaagaattttttggcctctgaattgcgatttgtgaaaaatttcggcgttcggtattccgtagttccaaaaaaaaaaaaaattttgtgcctcggaatattgtcgttatttattgggtttactttttagtgatgttttgtgcataattgaatgggaacagcaccgcatgtgctctgtttgcagccatcacaacgtaatgcaaacgaatacaaataacaccgtaattctggcaaataaatgcaatctttgcaacaatatccaacacaacatttggaattataaaacccgttgatgggaaggaaatgatttttgataaaaagaacaatattccgggaaagagctaaacagagaaacatggaaattcaattttaatataaaaaacccgattcattttttggaccaaaactttttttcataactgttaaccaaaatagaccataacttttttacattctatagctcctaagaatcctttataagaattataaaatttcaaaaaatttaatccgtttcagaaaagcaatgacgaaaaaaattgaaacattcactttttcccactttttgacatctgaatcattggtgaaattttttttttaacttcgtatacgaatggatgacactttgagctatcgaatgatactaataatgtttaatttaggtgtgtctagaaaattcttttctcacggttttctttactcaatatacaacatttcacaggttgagtgataaaacccgcgtgatcaagatcgcttctgatcgcgtccattctgattataccataccttgctgatcaccatgtacaatgtcaggcgttctcgagccaacctgtacattggaaaagcgcacaaaatcataaatgctatacaaatcagcaaatttgtgatccgaaaggcgtcgcgcactttcgacagagtcgtcaacttatttatgacagtgcaattcatttgctgttttgacaaaaatcaggtaaataaatttatttg

SEQ ID NO: 6728 - DNA, 2479 bp, Heterodera glycines
taaataaatttatttggaatttttcggtggcgcaaaacataacattaaatttcattgaatttcacaaaatgagatgttgaaaaattgaacaattttgggattagaaatatttctttgttttttacacgcaatcagtgcccattcttttttttataatcaaataccaccaatttatttaaaatttttggctactgtaattcatactaaatcggtcaaataaaataaagacatatgaatttaaaaatcagattattttatatagcatatataaatgggatttatattctcttcacaattgtggggggggggggaattattaaaacaaaatgtttatacttattgagatgagcattgtgtgtgtgtggccaatttgcgtgattattaaaacaaatatttatacttaatgagcattgtgtgtgtggccaatttgcgtgattattaaaacaaatatttatacttaatgagcattgggtgtgtggccaatttgagtgatggctttattttttaaactttacaaacttgtcgtgaaattttaatgagttttaatgagatatgattgcaaaaaatagatgtaaaaattctcattaaaaatttataaacaaatttttgctccaaaatgtagtattagaagaaaaaaaattattaaaatcaatggaaatctcaattatttccaaaatatgatgctattgtccactcggattttgccaaaaatctgtttatagccgatggtggtgagtttcatgaaagtgtttattatgagttcaatggtaaatgtttttattagggttaggtcgggaccgggaccaaaacacggacaactgagtaccaaggtcccggtttgactagttttgaccggaaccgggaaattcctggcttttttcccggttttccccgccaaaaagtcccggtttttcaacccgtaaagtcacggtcccggttttgcccaatattccggtcccgacctaccctaattttatcaccagttaaaatcaaaactgaatatttataaaatgcatatttaaaaacattttaaatgcacatcgcccatctgttctctttaaatctttttttaagaaaattttggcgcaaatttcaaaatttatgaaaaaaaccttaattaatttattgaattaactaattaataagttactcaattttcttattatttcaatcattaattaatattcagttacccattttactggaaaagaaaacaattttggcttgaatttatttgtcgatcaatgagagtaagtagcagctccctccgtagtaaactacctaattaattgcttgcaaatagaaccttaattcttttaaaaacggagcttaattgaaccaataaaagtatcaataacgttaatatatacaaaaaatcattcttttatctttttttaaatatttatacaaaaataaattaatttaaagccggcaattttaaaataattaaaaaatttgttacagattaacactaaattaaaaattctattttgaagttatttttggttaaagttgaccaaaacgtttaccttctgatagagctctttaaataagaaaactcataaatttaaaattgatttttttttaagtgcttgccatcaattgattaatgtggcatttttcgattggcattgctgtcatttttggtacgctctgttgctcaaacggaaacggttcgttcagtatatatagttaacaactatgatttttaaactatttataccattttcaataaattgcactaaccaaaattgagaatgatttttctaattttttttcgaaatatatgaaatttccttgtccacgagtcaatcatgttcattcccggcaattaaatggacaattgttccttttttaagtgttcaatgacgtcgaaggtttcgtgtccgagttcgcctcaatgacggatgcgggggcagatgtgctcgaaaaactcggccacattggaaaggggacattcagtctcttaaaattcgccggctgttaaaattttttcagatatttgcaccaagtggttgtttgtcctgcttggcaacaaaataaattttttcttatgaaatgcttcgacagcgcatcatgcgccgccatttttgccgaagggagttcacattgtcgtgacaaggatcgatgaaatggagcattcccttggagagcgttttagatccgcgcatgaacaagtcgacatttatagggcaaaacttcaaaaagaaatcatggttcgttttggctgaaatttattttcttttagtatttttggcatttattctgtctgcaaaataattctctaaaaattggcttaataatttcaaaaatatactcccaataatgggagagttttctaagctgcagaaaatttttgttttcctatgccaaacttttaaaatattttaaaaatccttaagaaatatcaaaatttcatgcctattttggcatttttatgtgtttctagcgattttcaaaaatgaactcacattaaatt

SEQ ID NO: 6729 - DNA, 1418 bp, Heterodera glycines
atctttgcacaatttgtcattccttttagcaatgcacagtgtaaccggaattgccggtccaatcattcatggattatacgcctataacaatcaaacggaagctgttgatgacccattttattccgttgccaataaatacaaaattattttcctgttatgattcaaagtgggcaaaaagccttgtaagcaatgtgtttattataagtgtgttcacatttttccctaaaaattgtagatttagacaaacaatattaatcaatcagtttcatattgttattttagtataattgaaaggataaaatatcttataaaatttctaatacaaattaatgcttttgatttatatttaaaaattataacaaagaagaataattgggagatgaaacttagtcttcgtttttgtcatgccaaggcattaatcacatgaacacagttttattttatctgcttccaactttgccgtcccgctcaatgctgttgggcttcttcgtccaccgttttaccgtgcacataaaatttgtttgaataaaatccgagcacaccaccaacagcagcacagtctgtaccactgcttaaactgttggttgtgatgttgttgatgttgggcatctgcagcatgtccaggaccttgtcgaactgctcggcttcacttaaaatatgaaaaatgtttttataatttaaatgcatgtctttgtcgaattatttttaaaatgaataataaaaaaggattttatttaaaaaacaaatgatcaattttttgaatatttgttttgatattcaatttgtcttgccttgaactgatcagctttaaaaaatttaccttaaaatttattattcatttctgatttaaattgaaaaaaattattttaataatgaaaaaatttgccacctaattagtgtacacacaccaacaatcattttagacaatgttggcattcggcttgtgtttgtagtacacagacggcactgaatccaatgccaaccgccacgaccattcaacaatcggagaaaagcactgagtgcttggcctcctcgtaaggcttaattttttttttgaaaaatttgtcaatttgccaaccctgagtcctcaattacggtgggggttaacttggcctcaatcaaataggccaaggcgctatttttgggggtgtattccagggatgggccaaattaaaagataaaaagcgaaatgcgaaaagcgaaatttgcgaaactgaaaaatgcgaaatgaaaaaaaagcgaaatgcgaaaagccaaaatatgcgaaaatgcgaaatgcgaaaagcgaaattttttctacaactttttaatagttaaaatcataaagcaaaaatcattttttaaaattttattccaaattaaaaaatcaataaaacgcttttttgaggcgcgctttttccaaaaaaactttttgggaa

SEQ ID NO: 6730 - DNA, 2608 bp, Heterodera glycines
gagaacagtttttcatcaaaataccaaaattttgcattttgggccattttctaagaaaaaataggtgttttgggggcgcggcggtgccgataggcgccccccggggggggaaaaatggaaattttgatcatttataaacaggtttttactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaatgcgaataatgcgaaatgcgaaaagcgaaacctaggcacatccctggtgtattccttttatgattaaccgaatagaaaaaaaaattgatttattcggtagccctaagttctttgcattttcctggtaaattttaataaatttcatcaaggtatgttcagaaatttttttttaatatttttgaccaatcttttagacataatcaaaattgtccaattggaataaaaataaagtacaatatggctatcgaggccaatcattttttcaattcggtccactatgaaagaagttctacccctaaaactggcccggggcccaattggtcgggacccagtcgagtcggtccgaacaattaccatgttatccttatgcaggccctccctattcgacagtggaatttacaaatttgagaattcaaattcaccctaagaacagagaaatccaagaaaattataatccaaaattgagacaatcagcggtacttgaactaactaacctgtctgctggacctgaattttatttatgcactattatcttttttttaaatttttgtttaaacttcgctcaattgttgcacatcggccggatggatgaaggaaaacagtgattggttcagcaaaaaattcggcattaattcagtcacttcagtgaaactgaaaaaataaaaattttttttttagttatttttaatttgaaaattaccgattgtcaacaaaaattaattggagtgctggggtagcacgaaacatgaacattgatgaactgtaaaaaattttttttttaaatcgaatattttttagcctaaccaaagtcgaagttcgttgagaccgtatggcactgatggttgaccgtaacccttcaacaaactaggtttttacgttcaaccaaaagatatgataaaattattttacgaattgtttttaaattaaaaatttattttatattccataggtttttatacaaatttttaatttcaaaaaatttgtaattaacccatataacaaattaaaaaataattaaaaaaggtttatcataatattgatgtactcactctctcacttaattttagaattaaaaatcactcaaaaaaatttggaaaaaatttcatttcggaatttggattaaaaaaacgtaaaaaacaacaaacttgaaattaaataaaaatatatggcttataaaaattttccaaagctttctcttttgaattatatatgaaaattaacgcacaattaattgagagatttaaaaacagcaaacaaaaaattttcaacaccctacttttgagaacattttttttccttcctagtacggtaggtctcttttccataattaccatgcctttaccaagaatctcccatcatcgtcagcgtgcagcgtgccgacaaagtgaattggcttatagccgggctgcatgccaatgccattgcatcccatcattgcgcgccggcctggcgtacagcggaagcgcagtgtgaagcgcagctcgggttgcaggacaagcaacgcgcttgcaggcaaatttagtgcaagctgattatgcagcaaggtcgcgtcatccggatgcacgaactcggcaagcgaaatgccggcaagttccacctatcaattgcatcattagtactaattatacctgattaatctctataagaacactcaaaaaattttttgtattagttcgtctcataattatttgcagctccttaatataattggcagaatttttgaattcttctctcacttttctgaatattattggtgtcattctatttaaaattaattggtcagtaaactctgatcacgcgacgcgtttttcggaaaatttatttatgaaaatttttatcaaaattttatttaaattaagtgatattttagggagatgtaaataatttttagaagatctaataaaaatttaaaaaggtaagattttattttttcgacaaaataataacttactaaaggaaaaaatgtaataaaatttaattccaaaatttattattgcgttttcatcatcatttaataaatatgtttgctgcttgcctgagctaagccaagatgtacagcaacagtttcgcttgtgtaaatcactttgccttcacagtcaagaacgatcacaaaaccgtccattgcctttttttaaatgagtgattgatattagaatcatctgctgatctacccattttctattatttaattgtgaatctaattaattatatatttaattatggaatagggtccaaaatgcagaaaattaatttattctgtattaaattttttagcatacagtaacagggttgttccgggtcacccgaatccagaaacccgaatcccga

SEQ ID NO: 6731 - DNA, 1308 bp, Heterodera glycines
ttttaacccggtacacaacttacgcggacgtccgccgtttgctcgtgtcgcgtttgccgtgcgtttgcgactcgagcaactcgccgcgagctttgtcttcttcgtgagtttttgtcattccctcagcctttcttcattcgaacaattcctgtgattttcagttccgccgtcgtttcgggaatcaatagaggcacaaacaacgaagaaacacccgttgatattggcacatcatacacacagacatttttgaaaatgaataaaatttgattatttcgctttttttgcttccgccctccctcccccccccccacttttcaacacaaacgttaagaaacaattttaagggaggacaattctccactattaccgagttagcaaccccaattttggtaatagttaggatttggctccctttttcaaaaaatttttcgacataagcacactaaatctaatggaagttttcaataaacccggtgggaagcaatcaatcgatcatttttcacaatttgattgtagcctcttttcctttattttgacatttttttctacacaaatgtgccatggattaagtttatacagtcgttgaatcatacacatacacagtaatcgatgatagatgaatgaatgatacagtatcatcatgatacatacacatcattttttgaatctttctcatttctgctgatcaataatcaatcgaaggcgcgaagagatacgaggaaaaaaagaatttggaaagaagaaaaagtgaatgaagagacttttcgctaaaatagacaaatgaaagtcagacaaagaaatcaatgcaaaagcatactgtacatttgtgtatggtatatgggcatggtatatatgaagaacactgtattggttaaactacggtacacacgaacacacataaaataatatataatacatacatatataataataatattgtaatattcagccaaaaaatgcgacaaaaaaaaagaaaataaagcgaacttaaaacgatggcgcgggtagaacacaaaaatacaccaatttttttaagagaaaatagcattttgtgctgaaaatattccaaaaattaagcgaaatttttactaaaatccacaaaacaatttttatgtgaaaagctagggaaaatctacaaaaaagattttccgaaccaataaaaaattttatgcaaaatccgaattttggtcatttttcgttttttttaattatgttctacccgtacgaagcgatagatttgctgcaaacgaatcagctataagtctatgttctgttttttgatgggttggtgttttttgtgacaaaatg

SEQ ID NO: 6732 - DNA, 3883 bp, Heterodera glycines
ggggggggggggggggcgaaaaaccaacgggcacgagtgctcaaaactcataaacaccctgctggacccaggccattttcggcaacctctggatttttcctgggcctggaatttcacggttttatacggaaaatccaagtgcagatgaggaccaacataaaattcaaccagacacgtccagacttttctccaaataatttttctttcgttgtccaattctcgtttccttctcctctctgaaaagtttccaaatccttttttttaaagtttttcggagatgggcgcacttttagcaaagtgtaaccgaaatttaccaccaatatttttatttatttaaaaatccaaaaacaaaaacaaatgcacacacccaacacgagggaggtcgctttgctggcgatgacaaacggtttgattgctgacggagtcatgtgccgcagcacgcccatgcccagcccgccgagtgcccggtcttcagcagcggccgcctgcagtgtttgtgccgtgtccaaaacgccctttaaaataaattaaattttttttttaaattttcggatttgggcaagacttaggcggtggatttaggcgtccaaaaacgggataaacaacaatttgaacaccacccacctctctgacggcgttgtaggccaacgaaaagccttcacggaggtcgccggccacttggacacgctgcggaccgctgaggaggcgccggtggcgttggaagttcgggttgacaatgtcaaaggccaactccgcaacattctgcaaatgattattatgaatgatttaattaataactaataatatttaataaaatacaaaaataaataaagaaatcatttaagacaacaataaaaaataaattgaaaatttttattgccttaacaattttaaacaaattaaacatattttgtgggaaagtaaaattggcaaatttgcctcttttcatttcagtgactataaatggcgcacaaatatgttcagaaaattcgataaaaatggtttatcaaagttaatgagtttttcccctcatttgttttactagtaaaatcgacatttgtctcattataactaattttccattttttttttaaattgactttattcttgacatgggttcggatccacccgacggaaagtgaaattttttcactggacattgttttttttttaatttttgaaatttaaaaaccaaatcacaaattattttaattatgctattgccatcaaagaggtaattaagcaacaaaatgtgccgcaaaacacttgcctggaccagtccgaccacccgttgggtggcgtcaatggccgccgtggcggcgttcagcccaaaactggtggtgccccgttgaatgccgcggatcagctggccattctcttttctcagctcatcatagggcagggcgaacagatcgtgaaagccttgcgcttaaagcgttaaaatgtcataaaaataattaattaattaccctaattagataaaataatttgtttatttacccaattggacgagcgcattaattggcgccaaactgccgaccacatttgggaattgtttgttcattatgtccttcacccattcattgatgacaaactgtaaataagagaaagaaggctaaaatgggtgcatgacgtttctcccccgcgttgaaattttttttttcaaattttgaaatttaagaaaaaaaattttttttggaattttttttaatgattttttcaatttttaagatgaaatctaagttttttcaaaaatcttttttttatttaaatgattttttgaaaattttaaaaatttgaaaaaaaattcgggaaaagtgatttttcgaaactttttataacatagttttttatgtgtttttttttaattaatttaaaacaatggtttttctttaaaaattatatttaaacaacagaattttgtgcttcagcttcatttttgtcgtctcttcacattctttttgttttacctgtgcacatttttcaatgccaagaaagccccgttcaatgcgcatttccttcagcgtcagttccgttttgttcaaatttgccattccgatcaaaaagccgatcagcgcgccctgctgatcagttttcacgcgttttgcctcgtagtcaatgcgcaacaaacaggcgggggagaaggagaaatccctgtggcaaattaattaattgactgattaaacaacaaaaataggtagcatgaatactaattagtgccctaaaattttcgagaaaatttttcgatttcttaaatttgtaattgccggagagagcgaaagggagatttcgtcagctttctttagggtccgttttcgttcaatttttgattgcaggcccatccataaccatggagaaagggcgaatgcaaaaaaaaaaaattgaaataaattaaatgcttaaacaaaatgacaatgaaatactcatttttttgggggggggaagactttcaattcccaggcctatcaaaaaaaaaatttcgtttttctagttagggctgggcccgtcgaattttttctttgtattttgatggcccaagagatacacattcttcttcatttcgttggggtctaacatgaatatgaacaaatagggattatgaatgaatgatgcccacttgatgaatgtgtctttggccgcaagtccgcccgtggatgggcccgcttttgcggtgctgtcgctggtgtccgattcgtcatcctcctcttcaccctcctcatcctcctcctgctgctgctgctgtttctgttgctgttcgttggcatcggccaaattcagttttgcacaaaacgaatcgctaaagtgcacgtcgtcttcagagaagagacgtgctgcaaaatttggaaacaatccgtaaaatgtacaaaaagtgtaaatgggttgtgttaaagattttttaaattgtattccgcaaactatcaaatcatttaaaattaatgaaaacaataattagcagtaaaaatttcaaaatattttattaattaattttgggatgaattttttgattcttttttgtgtaaacaacaaaatttttgaaaaaaaaatttcctttctcgactcgcgagtcgaaaaatttctccggttttttttgagctcgcgcaactctcagtggtgggtcaattcccggtctcggttctcgagtcacagaaaatttcgactctcgagcaaccatttcaattttctctccaagaaatttttttttaaaaaatagccaataaaacaatatgtccttcgtgttgcttaattatcccctaattcttgatcccgacattttattcataaattcctgtccttttaattgttcatcccaaccgaacctacccaatgtgtttgtgtcctcctcctcttcttcatgctcctcgtccaccaacagttcgtccctcgttttgagcactttgaatgacacgcacagctcgcctctgtccggcgacgacttattgttagcagcagcagccaatttgggataaagcccatccggcgacgaagagccgctcaaattttttgccccttttgtcgtcgtcttcgtttttctgccgccatttttctgctccggtgcccccgccgtttttggcattttgttgttgttggttgctgcattgttggcattttccattcccggacccctgcctttggccacttccatcaatgggatgtcgtccgaaatggtgccaatgccgccgacgccacaaccgctgccaatgccggcaccgttttttggacttcgcgtcaccgggaagtcaaaggtggcacgcagactttgcatcacatcagttttgaagtccatcaaaaattcgatggtgtcctggtcaatgttcatccgaatgggggccaacgacaggcgcagaattgcctcgcgtaaagggtcttcaatcagatagccgga

SEQ ID NO: 6733 - DNA, 2908 bp, Heterodera glycines
tgcaatgtctccgattcgttgtccatccattccaaaacttcctttgcacttttcgatacatttgtgccgctcctcgtcgctctctttgcccttggctagctgttcaccctccattgtgtgctgggttttaaagcagtactcctcgaaagcgttcttcgcatccgatcgttgtttgtcgcgtaggtcggccgtctgcatttcttgctgaacagccaaatgcacgagacaaaaaaaaaattggactcacttcggctctgatctcctcttttaacttctcttcgtccgaaagtgccgatgggtcgattggcatttcgtagcgatcgatcacaatgaatttcttcacctgataagccgggtaaagcatggccgaacgaagagcacatccgcgggcctaagagaagttccgttcgttttttgagtccaaggccactcaccaaagcatcgtcctgattcattgtcgtttttggcaccttcttgaaaaactcttaaaatagccgacttttattcatccttttaatgattttccaaatttactacctgccacaatttgtttgatgcgcggaattcgcgacgaccccccgaccaattcgacgtcgaaaatatcgccgacctaaaaacttgttatttttaattgactgtttttgtttaccttcacattcgcgtcactaatgagctgttggagcagtgcctgcactttttggaagagtttctccgccaattgttcgaattggtccctaatttgtaattatttgatgactatttttgtttcaaaattcagcagagggggaaaacgcttacgcgtcccatggactttcatacatcctaaaacaactcaggtactgtcccaccacccacctttgcatcactccgttgacgtcggtgtctttcacaaagcattcgattgcaaagggaatgggctgactgtttgccgacatttgctttttgatctgaaagttctaattcgtttgtgcctttcattgtcaatgccttttcgcattcatccaacaaacggagccacgcccgcggggttttcctcgcgtcgattttgaagcgtttgccaaagtcctcattgaaatagtcgcgcaacaacgcatcgaaatggacgcccccaacggtcaaatcgaaagaggcggcgagcacctaaaatggaaataattaaggagtttacaacattcgcctgctgacctccgctttgccggcgctgaatgcaataagactggcttgaacagacgaatggccgacatcgacaaacgcaacaagccgagcgggctgttcaggtggaggaagactgaaagaggagaatgaaaaatgcgtgttaaaaagagggttttacaattggaaaagttggaaaaataatcaaatttatataatacaaggtaagttttaaatttcattttcttatgtttatcaaagccaaaaaagaattaatgccgataaaaaaagttgccaggtcccactccaacttttttggtgatgggcctgtccctcactcactttgccccgttatacatgccgtaacaataggccaacgcggccgggtccgtgatcaggcgaagtgaaaggccagcaattcgacccgcattcagcaaagcgcggcgttggttttcctcgtagaaaaacgggacctgaaggagaacaaactgttgggttattgaagagcatttttaacacccaaaactattcctatccgcccatcctttttggtaccgaaaagaaagatctcacattaatgacgcattcagtggcatccgtcccgagagaacggctgagctgaacccgcaaatgtgtcaacagacaggcgaccacctgttccggggaaagcactcgcgtcgtgcccaaatgagtgacctaagaaaacacatttcctaattacaaaatgatttgtgacgttttggcacacttttatctcaatttggtcatcggtgaacttccccataagtccgcagggaatgtgctgacgaaatgtctgcacgactttgtcattgaaagtgcgtccgaggatgtgcttgaaattcacgacactgttcccgtaattgacgttcagctgctgcttggccccgaaacccatcatccgagcgaattgtccaaaggaaacgcacgaactgaaaacaaaagacattcggacaaatgcaaaaatggaaaatgggagacggaacttacggcgtggcatgcaaagagtaatcattctcaacaatttctaaaacatttaagaattgtcagaaatgttttgtatattttcccaccgattcctttgttccgcgccacagccatgtaacaagtcaaattcccaaagtcaatcccagccattaaaatgagtattaagctttaaagaagggggataagtgacagtaagcagaaaaagtctgattaataaggggtggaggatctactgcagtcttacacgactataaaataacatgacgactttaaggctatccaaaaagacgggtacattcgataatcggtaactctaaaattctctattaggttacctacctatctataatttcagtttcatttggtttcagaaaaaatgggtaataaatagggttctagtcggttttaagttgagactttatttttgtatttctttttaacacttttctaggggtgttttgaggcgctgagaacgaatccggcttccatttcgaccaattccgaatccctaccccgaacatttttcgagaattaaattttaaattttttaaaaatttctcttaaaacatgtttcttagtgttttcattagtcaaaaaccatttcaaaaccaaaaaatggtcattctgtaaagatacgaacataaaagtgaattttgataattttgaattttcggttttttgtccgagttcgggtccggtatttgaaattagtcaaaatgaatatcagattcgtgatcagcaaccccgaaaa

SEQ ID NO: 6734 - DNA, 2734 bp, Heterodera glycines
  misc_feature (2657)..(2657): n is a, c, g, or t
gtcccatcccttaacatttatgaacttcttcgttaggatttttattgtctttttgctaacagtcggaacgaaatgcggtctctttccacaatataagcgggagcagtgaatggtagtgagaaaatgcggtgagcaatgtatttgtgcaaaagttgtgtgttcaggtcgtcgttagccgaagtgtaaatataaaatggaataattaatttggggtttcttccattttcctaccaatgcggcgccatgttgaagacaaaacttgcgcacatggtattggagccggtcgagctgttctgcgcttaggtccatttgcatgtcgctttgttgattgccacgatgagaatgacaccgcaattctcctctaaaatccctttctccggcggcaacaaaagtggcgacgaatccaagtcattggcagtgccattcatcccaaccccgcccaaaatagaaatattcgctccccttttcttacgtgcttgtcgcgcctggacaatttcctccggctggtagtgtaatcggatttgctcgtcaagtagccgataccatttggacaatgccggcattatgttgcccggctgttccatggacgcgcaaaggcacaccacacacttggacagagacggcgggaaggtaaagcgaagcagcggagcgcactcgtccttcccgtcaagtatccaaagcggaaggtctgtcgagtcggtcggaccaaggaggccattcgcggcaccacctccaaaacgacaaaaattacagcgatacgccaaatactttcgtagtttctttttgtcttctcaacctcccagctgatatgcatagctggcgtctgtatccgcttgaatttgcaggtaattgtactccagcactgagctctgtccggatcgttcacctcgcgtcagacgattcgccaacagactttttccacaacgctcattccctggaaaaattacctattaaatcacaacataaaagcgttttttttatatttttataaaagttggcttagaaaaaattaagttatttttaaaaaagttaaatttttaaatgagtagatcaatgaatttgtttatcatggttcatatgaggtcattagcatatactgttagaacaattacaaaacaccgaccgagcagcacaacgctagctcgtacgacagtgttactcttggaactgacttcctgaagagttcgcaaccttaaaattttaaattcttcattcattgtatattccaattatggtaatacttgagaattgcggtcggggtcgttttcgcgtggccgttttcgcgtggccattttcgcgtgagggccattttcgcgtggccgttttcgcgtggttgcatataagcgaattttttatttttattttttatattttgaaaaaatttttcactcccgttttacttcgggtgcttaattcaatctatatttaagtgaattttataaactaaattaatactgacaaattattatacagtctaataattttttcacggtctaatgctctgctggtattagtgtaaactaaccatcccaaatgaatttggtataaaaattttctctttctggcaggcttatttatcataatttaaaaaaaatttccaaaccctattacagaattttttctatataaaattgagttatttgtgcgtaaaatgtttggggcattacttttgtacggcaaaaaattgaacaaaacaattaagactttccaatgggttaatctcttggatatttatgtgaaaagaagagtcctccgccccggaaaaagaaaaaaattaaagaaatgtcgtgatgccgatggtcgaattctgtgtctcattcacgctgtcaatacttgaagttgttaatctttgcaagcataaaaatgaggacgcttttgagtaaataaaagcaaaaaattgtttgaaatcgggtttgggattcgaaataggtcgaaatgtatgttcggcacacatccgaccaatttcagtcctaataggcactcacgcgaaaacgtaccccacgcgaaaacgggccacgcgaaaacgtcctgcccccccccccactaattaggctatggagaagccaggaaaaaaacatgtatttacataaaattagcagccctacttatgaataattatatttatttgtgtcatttattatttgacatttctttctctcttcttctttcatcaccattttgttgttattggcaatggttttgaataagttggcaaattagtgtgtttgactgtctttgcgtgcaatggcaccacttgttgaatgttcgtagtagccatagaattggtggacgacagaaaacggatttccttctggatttctcttcgatattcagtgctaaatgagtatacacaaaataataatgtgtaaaaattgacaaatagaacaaaacttcaaaataataaattaatcaaaaatgccgaatttcaaaaatttttacaaaaataaaaacaaaagttgttgattttttggtgttttaagaaaatttcatttttctttgtttttttttgtaagtcctagaaaagaatgaaaaatatcttttacaaaactccaaaaatggatacattttttgattttgggattatttttgaaaatttgaaggaccatttgtgcaacttcctacaaaaattcttaaaaatatgataatttttggattanatggataaaaatgcacaattctccaccctgatatgtacagaatcggcgtggtcgctgccgccccatgttcaccaaaa

SEQ ID NO: 6735 - DNA, 1527 bp, Heterodera glycines
ttttatgccaacatatggtccacctagaaatgggggccaccacgcagttcaactaacacccaaccagtaacagctgacacttttcttcaagtttggtatcattggaaagcccactaaaaatgctacagaattgcttttgacttttacccaatttgggcctttcaaattaatttcaaaaaaaaaattatgctaaactaaagaaacacataataatttaaacatggaaattaacaaaatgaactcatatccctcattttaaatacgctgaatatttcaataaattaaaaatagtttgaaaaggttattactacataattatttcaataaacaattaaataattttagatatgcaaaaatttaattataattacttttttaaatttatgtgaatcgatgtgcttaaataaaacattttatgaataaaataaactaatgaatcaaatgaaatttaaagatatgtgttaaaaattgaaagaaaaaatgtaaaataacatagaatgtatttatataatgaaaaacaaagtataatatgttaacgaaaataacaaatgaaaaaatgcacaaactgtcaaaccaaattattttatttaaaattaaatgattatcgactttattttgtaaattatgtttaaataaaggcatattagagaaaagaattgagaactttttttgttcgaaaacaagagaataaataattaggtatctttaatttaaataaaaaacaagaattcttaattttagcgaattgtaaagaaataattatatattttttattataaaaaatcaaatattgtaataaattacttaataactaaatgaaaaattaataatttataaaaactcaaaatttgtattataataattcaacagacaaacccaaaaccataaattagaaataattttaattaattattcaactattaaataatctttaaaatttgtaatgtaatattagggatggatattacgcaaaacgatgaatcgaatgagcaaaaaaccattgtttgcacttgagtaaatattgcaaatatcctataaaaaataataaacgaattcatgcataataataaataaataaataaataattcataaaagttttaaattttatttattatggcggttttcttcttttaatggttatcaattctgaatgtgtcgcagtgacaagcaaagggatggtttattacgtgtatttaataaagtttttatgaatacaaaacggacttatcatataattggataaaaattaatttgacttaaactgtttgacgacgcctttaataaaatttaaatacattatttatataatcaatttggcaggaagaagaaaaaaaataagttcatataaaagcatatttttggggttttcgagaataaatgcatattttgccatttttgaatttttagagcatattttggtcattttttggaaattttcacaagaaaaatgcgaaatagcgaaaaatacaccccctaaggatcgactttttgaaattaaaaaaaatatacccttaaaaaccgaaaaa

SEQ ID NO: 6736 - DNA, 6047 bp, Heterodera glycines
atgataataagtataagttttaaaattagaaaaataaataatttattttatttaaacctagataaacgatccaataaaattcttaaataataatagttaagcttaatgtatacgctaatttaaggccgatgacttcaaaatcatttacgaagaatattacccattttaaacaatcaacagacaaattatctattcaatacaatgaaatttgttaatattggtaattaaaagtactggaaattatacaattgacaaatattaaattctttttatttacatttttgttatgtatctaaaattttggccatttatttatatgtaaacattaatctaatagaaaccttaacaattactaattagcaataatattttaaaaatatctataaaaaattaaaaagtgtaaatttaacggaattaaacaaccttgtttaaaaaataaaaaggagcagtctgcactccaaaatataaatatttaaaagttcaaaaaaataattataaatactaaaataaaaagaatgtatgtgtaaatgaaatattttctatagaaattaattaataaaatttttaaatcatataaaaaaccgacagtttaaacaaaatagtaaatgacatcttaagtacaaaaatattatttttccaatttatattctatggaagataaaaataaacataagaatttaataaaacaaaataagtaaatttaatgacatttttaaaattaaaagtggagaatcttcttttaatatattagtcaaaatcagataaaaaattctgttaatttgtaataatttttgtatatagaaataaaagcaaaggtaagaaatttaaaattaatgtttacaagcaaattgacaattaaaatatgtaatttcaaaaaggaataacaatatatcggcgagctagttatcgaaaaattaataattcaagttagtaaattatttaattttgctaataaatagcatatttaatttcataataataacagaaaatatttttttataaatttacaaaaaaaaattaaatacttgaaaaacaatatgatctgaatttcttgattaattctgaaatatcacaaagaggacccaagttcattggttaaacgacataagaaacctgggtagactaaattatgataattatcatttatagccttttagtttatcattttgagttttgaatttttcatagttttttttctttatatattttaaaggtgattaatttatgtcatagagggattaggtgcattgatgatttatattgtattattttcaattgtaattcacttattttctttaagcctatttagatttttattttatttatctatgtgttaaaagtttgttttttggtttaccgtcctttgttatattaataaacattttatactatttattttggctattttaacattaagaaagatcgatggcccatataatgttttattttattgattaatatttaaaatcctgatattccagtaaattttctttaaatataattatgcttttattttactgaatttataatatattttataaataaaaatgttttactattcttgtttctcagtacctcattgaaccaatcaatggagaattgtcttggtttcattataggattaacggtgatcaatattaaaaaataacaaaaataataattaaatgattttattaatgccaatgacttcatatcttaaagctttttcgtacgcccttgcttatctcctacaaaaacgtgaaaaaacataaaatttaaataaaacaaaacataattcataatttatgtatatattcattatatttcttaccttgatgatttacctattcaatttatataatgataataatattcacttttatactattatttcaatacttcttcatcatttaaattatatacaattttattgtgattcccatttaaggaattcgtattaaaaaatttatgtatgtattttaaaaggtttcgtttgtacagggcccggatttacatgtcaaagtgaataataaatatataatgaaaaaataattatttataaatatttttgataataaaattattatgaaatacttttttattttaactggtgcctgcctattcttggcggttagccgacttttgcgccgcagacatttgcgccgcgccatttgcgccgcgacacttgcgccgatcagcaaaaaagactcttgcgccgcggacatttgcgccgcgacacttgcgccgcctggcaaaaacgacatttgcgccgcgacatttgcgccgtacagcgaaaaaagacatttgcgctctgattaaaataaagttatgtggtttatagaataagaattgattgatattcattattaattcctttttcgaagcctttcatgtcaattccatttgaagtgcacgtaatgattgatcattttggttttcattgggaccatatgcgataacaagccttcgtattgcctgatcattaagcggcggattttaaacgaaaaaaataggtaaataaataagggcataaaaattgcgaaataatgcgaaaaatggtaaaataggagcgaaaatttgaaaatcagtgcgttttttcaatgaaattaaattaaaatcgatgaaaataacttattgagaaaattaattacaaaggaattgaatttcattcctttttcgaagcaaaaaaataattggggtttctacagaaaattctttttttcagttttttgttagtttgtattcttaatcattttttcatatctttgatgaacctattcaatgttaagattttaatggttaaaaaattgaatgtcaatctttgtgactagtaattttttcgaattttcaattagttatttttgtcgatggcttatagttttagtaaaacttattgataatagtggaatttttatgaatataatatttttgacagcgcggcgcaaaagtccatttttgctgggcggcgcaaatgtcgcggcgcaaatggagcggcgcaaatggcgcggcgcaagtgtcgactttgctgagcggcgcaagtgtccacttttgctgtgcggcgcaaatggcgcggcgcaaatgtctcatcacgcgccgagtcgtaagccgaagcgggaaaagaatttaattaaataaaaataacatttaatagaagaaaaataaatcatttagaaaacattcttccaaaatttgaactaatgattattctattgattttttaaatcgctttttaattgtgcgcgaataaataataaaagtgatttgaaaataaaatgaattttgtatcccgaaattgcaataaataaaatttctatttttgttttattttcttccaattataattaaaataaactaaaaaaatttacttttattttacatatgaattcttgtcgaaggttaaatgcctcaacttatttaaattatatttttcttataaatttaatgaccaactcataaaaaaaggaatatttttgtgagatcagtgtgcaagagaagattaaaaaataaaaacaaaataactacacaacattgccattaaattaaatcattttaaattaaaattaaaatgtttttatttgcccaaacattgaaaacgttgtcaaataatatttaaaataatagcacaaaatcaaagaacatcgaaaataaaactaataaattttaatattaaaataaatttaacaaaaaaggaaaaatttataaattaacataaaaagaaatacaagccaatttgtaaaaagaaatactgtcgacatgagaagattaaataaaaaataaaataaaataattaattccagcaaaattctggggaaaaccattgtcatcttttatcatataaactagagttgcacgggaccgggaattttgacaaaaaccgggaccgagaccctaaaagtcgggaccgggacaatcttttttcgtctaattaaaaataataaacacataaataagaaattaacatataatttaatcaaagatgaaaagccaatttaggaattcaattaattaaaacaaataaaacatatttgtatgtatttgaaaatgaaaataattatatttctttgttgatgaattatttgtataagataaaaaaattaatgctaaaaaggagaaaattattttcaatattccatttaaaacattgtaaaatattcatttatcataaatttacatcaacataactcaactaacttattaatttgaaaaatgtttcggctttcgaaatttttcggaaaaaagaaagatatttattttaaagcattaatcgcctaattatatataaaagcaaagaaatgtgataattcgtttttttctatgggctacaatcggtatgaaatgaatgaaaaaatatattgattgcttttgtgcaatttttgtgagaaaattatgtattattttaaagtatttattttttaggctctaaacccctaaatgatgaaatttggattttgcaggaaattccttagaaaaaaagattcgacctaaaagttcactaaattacttactatttttttcaaaataaggcctaattaatctctttttcaaatgaaaaaaatgtttttgcatcattagcatcgaaaaataaaagaaattgggttttcctatacaaaataataattacagaggtgaacaaaaatatcactatttaaaaatatatgtgaaatctaaaaacataaaaaaatagtaaatattattaaaaaatatttctcataaaattttaattgcaaatattacgtgaaatgcagcattgcctaataaaataaataaataaaaattttcaaaagatattaaatgaagctatttaaaaattcaataagtaaagatgagcaaataaatatgaaatcaaagcaaaattcactttttcaataagaaaatttaaaatcgagttgacaaaaatgcgatttaaaagaataaaataaaagtaaggtcaataggaaaagaaacaagaaaaggtaaaaaataattatagcataagaaacacaataaatattatagtgatgttattttgcattaagaattaattatttatcaaaaagagtgagtaaaaaaagttaataaattaaactttttaattttcaaattgaaatataaaaaaaggaataaaaaagcaaaaaaattaaagaaaattatgttcttggtgttaatgaaacggcaggtttaaaaaattactgcgataaattaaccaatttccatttaaattttctgctttaaaacaaaatcaatttaaatgaaacaatgtttaattttataatgtccatttgtaatatgaaatgtaaaaataaattaaatgaacaaaaacaataaatgatagagaaaattaaagagataaatttgctgtaaaaatctaaatatttatcaaaaataacgtcacgactactacaatatgatttgttctacgaggataagcataaattaaataaaagaaaaaaagaaaaaaacaatcaaacaattaaaaaacatattttttactaaaatactaatattgattcgttctaattttataacgaacatttaacaaaagtttttgacgagtaatataaaattgcgagataataaaaaattaaatattaatacaatcaggtgcaaaagcttatgctcaacagatttttgtttaaaaatccgtttttctataaaatgaatggatataaaaaagccttacttgtacaaaaattaagggcaacaatttggctataaaaatgaaaaaagggacaagattaaccaacattaaaaaagttataggttcgtaaccaatttacccaaattttgatggtgcaaagtatattctcaaaaagttaatcgaaaaatctcagttccaagttggcagaagccaattttattctaattttgcgattttttagccagccgacgacttttttttaatttttaaaaaacattttctgcggcgtggttttttttaaaaaacttttgggagacagggggatttcggcggcgccgatattcgccgcaggaaatttttaaaaattgatttcaatatcttacagatttacaccaaaaaatgattaaatttatgatttttaaccaatttaatgaatttttttgacatattt

SEQ ID NO: 6737 - DNA, 6763 bp, Heterodera glycines
  misc_feature (6717)..(6718): n is a, c, g, or t
  misc_feature (6747)..(6747): n is a, c, g, or t
  misc_feature (6750)..(6750): n is a, c, g, or t
acgggtttttagcccgtgagcccgtaacccgtgtcggtgccaagcccgtgtattgtgaaaattccgatctctacttttgacacttgggctcaccacggatatgtataagttagtgaaaattaccggtgccgttctattctggaattaaccaaaaaattaaatttatatataatatttattatcataatgggcaaatctgagaaaaatgtccgggacgacaaagaagtgaacgaacaataaaaacaaacattgaaaagggataagcaaatggtccgacatcacaaaaaataataaaaatcaaatttaggtcaacgatttgggggattaacttaaaaatttgcgaagattcatcagtttaagccaacaaaaggtaataaatgatggcaacaatgacagcaaagagcaacgcatacaccagcatttccacggggctgttcctaaagaacggagggaaaattaaattgataaaacaaaggagaagcacaattggaggcattttccttctttttttgaatggagtttgtggaacacacaatgagtgcttttcattttacaccaaattttatattctggtcattaccttttttccgattggtccatcgttttgtctgcgcccgtctctcttttgtcgtaactgtacttccaatgttcggactgaattaacaatatttcctatttttaattaaactttttcctaacctcgacaatttctcccactagaaaatcttctttcatttgcctggcgtccgtagaatggcctaaattttgaataattccattatattttattaaaacattgtcatttaccgatgtcttcgaatgcctcggttcgatcttcgcccgctttttccattaaaacttccattccgccggggtgttcgtccagaaatttggtcacatcgtaaacctaaataaaatatggcataattttatggggataaacttatgaatttgtattgttttttctcatcctttgaaggaataaatccgtttgagaaattgacaattagctcgcattttacgcccacaaaacagtaaaattgtagtcaaagataagtgcttttttttcgtttacaaatctaactttgttgccaataattatccatgcatcgctactgttattgtgttccgccacttccgcgcgagtcaatcttcgactagcagtcatttttgggttgttgggacaggctgaaatatgttgaaagtatttatgaagaaaattgtgtgagtccaactcaaaacaaattcggaaattaggtaccaataaaggagcgcaccttcggtatgccgttgaaattcggaggagaagtcacgaaatgaagtgaacaaaagtgcggaggagaaagaaacggaaggaagagaaggatgaggagagattgaacgagataacagcgaaacgatcggtcgatacaatgacataaatgaaatgttaagtgaatgacgagggggggggggggggaaggacggacgatggggcgactgaaaagagcagggaaaagagggaggaaagagagaaagacccaaattggatgatcggattggagaggaaaattggaagggagttgctgattagaaggtaaactcagaaaaaagggaggacaaaatcggaagagttggagggagcgacaaattaagacacgaacaaatacaaaacataaaagtgttcgggttggggtgtttgcgttcagcaacttttgcattgagcggtggagagatgttgtttcagtacaaagaatgggccgatatatttaaagtacatgaaacatatacatacaacagaaactaatgaaagacacaaaatgttccgattttttaatttaaaatattttaaaatggcaattttttgtctatgcgtcgtatttttctcagagatggcaaatttgaaatttgtaattcaatagttttgtttttaatgcttttcagctctttcttttggccgtcctttcaaatgtcccgagtgattgtctcctattttcgtcagtattcgctcaaggattggcgcaattattttctgtccacccatttttggggtccggtggccaattggggccttcccctcgcggcgatcgttgacttccgaaaggttttttgacagtttgccaattccgaagtaaatgcatttttcaggacccagagatggtgaatacttttttctgataaacaaaataaatgctgaaaatgctctcttattgtaagatcagtgggccaatgtcctgcgcactgacaatttactcgtccgtttttatgcgatttgcttggcaagttcaggtgaaaaggaaggaatttgggaagggaagcgaaagaaatgacgccaaaagtatttttagccgaggaatatgctccttttcgcctgccatttgacaaatttcgtagctcaacaaattcaggtccgtccctttcctctttttggcttcctttcctctcaatgcattcacttttctcagatcgttcgcttctccaattaccatttcctccatttgtacaccgaccctttcgccaaaacggttaagaaattgtaaaggggacaaaatacgaaagtcgagcaaaggcattgtgcattcatccattgtttgtttattgtaacctttttaccataaaattagttgattaaaaacagtgttacccattcggattttaaatgcggattttttttgacaaatttcactgttttgtacaaaaaccatggcacaccaagaaaaaatggaatgctaattctaaaagtgacttgcccagtgaattaattaggcgaattttaaaccgtgtgttagtttgtacatttagttttattaaatcagtggaactttatataatacaaaactttcttttccgaatgcgaaaatggcgaatattagcacaatgagtatcatcacgtgtcttcattcatcgtcctccccattttgttggcagtgggtgcgttttgtccaccgttttattcgcttccagcgaagtccggccctggaaaactgtttttgatcaaatgccttaattattgacgaaaacggccatggatgagtcacagactcattgtcccgtcttccccaattgccctttctccccctgcctttgtcacttacgcactttttctgttcggcgttgtccgtccttttcaccttccttctctttagccaatgaatgggtgttgaatcgaccttcagacgacctgaataccttttatttctgataccttcaaatttccttccacacgtgcgcccctttttcacacctttcaatttggtgactccttctctttgaagttgtttcaactcgtcaatttgctcaaccaaagtttccatttctaaaatatttacaataaacaaaaccatacattaaaaaggggggtgggtcggtaaaaatttttgcgaaggggggtcggccgccgatgacctcttttttttttgcttttcaaaaaccgtttttttcggcgcgctttttccaaaaaacttttcgggaacagggggtccggcggtgccgttatgcgccgccggggaaaattttggagttttgggtgtgctttgttaacagattttcacaaaaaaagaaaaactataataatgggggaggagtgctttgcatttttcgctttgtttatttttacctccgatattactggcgagttggtttaatgtatcctgaacttttttcgatcattacccattaatttttgaaaaaaaaccttttctgaaatttgtcgcaactgtgcaaataacggacgaaacgaattttctgccgtttttgaggtaaagtaacgttctacaaaatgactaataagctttttatttaaaatagaatactttttacttgccttcaaaaacggcgtactttcccttttctgacatatttgtctgaaaaagaatcaatttatactttgcttgaataaccgctcatcaccttaacaatgtttaagtattcgttcaacaaattgtgctcgcggatgatcgcttttttggtggtcctaattcgcattattcggttgtaccgatcgaacctggcataaatgacctctgaaaacagatacaataatggcaaacagatgaaattggattagtacattaagggattggagggccgagtcaatccgaaaaaagaattagggtgttttgccgaaaggggaatttattgtcatacaaaaagccattactcgaaactttgtagatacattttatggactaatgcacttgagaatgagaaggtgtggaaactcaccattgatgaatttgtcgacttctcccaaatcggctccttctcgtgggaatacaattcggctgatcagctgctcagcatcatttttgtactcctattcaaaaaataaataaacaccaaaaagcaaaaggttggttgaacattttcgaattcgtcacggaatggcaaataagtgagcaattggaggtcctcctcgtcaaatttggccaccgtttggggtttcatcagcggcacttttgcattgtaaaagtacggactgcaagcagaagaggcgtaaagttcggccaatttctcgtcacaaatcgctgaattattgtgtacaccgtcacatgagactgaaaagaataatccaaaaatctgaccaagaataagaaagtgaattcaaaaaggaactccaaattctgcgtttgccctccgacaagcatggattttttgcgtttctttactcctatttaacccattttgttaaatttcgggaagggaagtcgtttccctggtaacatgggtcactttggccttacctttcccagcattttccactgaattcattgcctcagacaattcgagcgatgtctttctttgtccacggaatgcctccaccgccgcatttttagccacagccagcaattgttcttttcgcgttgccttctcaaaaataataattttaaaaaacaaaaaatatttaaaacgcaacccgccgattttccgtcaaattcgaagtttctccgacagaacgcgggggcaatcgaagctcgtcaattgccacggagtcggaactgttctgtttggaaatggcactgtcgctgtccgagtcgtcctaacaaaattttcattattagtataaaaacagaaataattgttgcctcttcgtcaaaaaatgttgcacttcgtttttgggtgggtgcagcggaaaaactcagtgaagcgacatccaaaggaggaggatggtcttcgtggtttgtctgaacatttcaaagggaattaattagcggaatatattaaaaagaatgaataagaggggggggggggggggtaaaaagtcaaaattcgggattgaactataaactgcaaataattagacaacaaaaagaattggacttcattcaattaaacttttaattaataaccaattatctatgcacccaaattgaacaaatatccaatggcatactttgaattcactttggtacccattgcaactgaattctaaaaagaagtgaaacaaaattgtgaatttcacccaaccattcgcattttcttccttaacatcgctgtcatcgccacaaatgttcacaatgccactggaaatgaaaaaccaaaatttacctaaattcgatgttttcgttggtccccaatttaccggtttttagtggccaagacgcatttgccaatttcgttgcgcagaaaacagcggtccaatcgttcaagtgcttccatgagaggttttttcctgccaaagtctttactcagctcggcccattggtccaaatgcgctttgattagcgagttgagcaaatgaatgtcctcttgagcaccccacgcgttcggatcgtcgtcaaaaaagttagggccaatattgtcgacaaaaatgtaccggtgaccacgcttatgcggaggagactcaacacccatgcgaaggcactgaaaaacaattggcaaagtcttcttgcataaaagtcgtcccatgtttcatgaaaattggtgtgaaagccaatggcattttcaaaatttttaaagtaaattaatggatttgctaaagccataattattgccccgcttttttttgttccccatggaaatgaatgcacctcaatacaaattaacacttcgccctgctgacaatccaaacattttgtgtaagttgaaaccgcgtcaaaatttactaagcaaaatgagcattctttgtggtcagcctcggacagtgatggtagcgattgaagctaaaaaatcattgatttgattaatttattagacaatgatgagactcatgtcaacatacccgcttcatttcgtaccatgcagacaaagtaatcggttccaatgggattttcacgcgggaaattttaggaatagaagagccctaaaatcgaagtaagcattaaatggggataaaatcaatgtccactgatggtcaacctgaagatcagactcggtgctttgcattaattgatgtatttgtcatggtttattttggggttccatttttcaagtttcaacgtttttaacatgctaattttgcatgcagctgaccgaaaaattgaagccgatagatgggaaagaaatcgatggatgctttgatgaagggattgaatgggcggggggaacaacggtaaagggaaagatggaaaatggggttgggtggtaaacgaacgaatgaaatgtgtgagggtggcaaggcacgcgggaagggcatccatcgccttcccttcccctcgcagaaaccattagaaagaaaacgctgccccctctcccaaactgcgcactcaaagcccaacattccccctccccccttagttnncggtgacccgccctcaacaaatccattgnttncatcattacttac

SEQ ID NO: 6738 - DNA, 1307 bp, Heterodera glycines
ttcttttgattctagaggctcctttgtgctttttactaccaccgattttaagcatacctatgcttttaacttgcattttatcttcttttcttaaaaaaaatttttgtcacaaaaatgcttctttttttgtttttaatttgtgtgttttcccctttttattttcgaaaatttcttggttaattaactaaatctcgaaattttatattaactgtctctaatatggtggaccaatgcttttcgaagccaaaacgtgaaattttgggcattggtgatgtttccaaatggctgaactcagaggctcatcacaaatatatgggattcttacgccgtcttaattctgccgttaaaactgtgccgactacttcatcagatattataatcggagaaactgcccgtaaaataatttccattttggacttacttgaggtgaacacataagctttttttcatttcatataattagaaagtgtcctgtacttgtatttgtatcccgaaaatccaggtccaaataaataggtccaggcttttcagtttgtcgaattctacatttttttttgctaaggcctggataaacgaattccctcctgaagatatgggattgcaacgctttggcaacaaatctttcaagaaatgtttcgagcgcctcatgtcggtttgtttttcttttcttttgacgtcccaaaaatatattaaatgccgatcaatgtaatttaatttttaatctttttaaggatggacaaagtttgctgagcgatttgtttcccgaaaatttaaagtcagctgttcttgaaatctggccttatttgatggattcgtttggaaattccactcggattgattatggatcaggtttgtcagtgaaattgacaattaatccttgaaatattaggtcacgaaacttcttttctcattttcctcttctgtctgtacgaaattggcgtgctccattcgcccgacgatgaccgagcttccatcttaagggttttccatcggttattttttgcccaaataacaaataaaaatttgtgatttcgattcgtatatatcacatctttccggttcactgtttttaaccgttaaatttgtttagatatctgaaattagctagacgacttcagtgtgagtatcgaatggaacccgctggttccagaggagttcatgccattgatgactttcagtttttgccttttttgtttgggagcgctcagttaattggtaggattctatgtataatatatttttaaatgaatttcaaatcagacaataaacagagacttatccccgattattatttgcgccccgacatg

SEQ ID NO: 6739 - DNA, 7366 bp, Heterodera glycines
acttttgcgtagagaaacattttttcatggcaaaacaggtggctgataatctaaactaatataaacatttgttggtttgatatttttatctcattgacacattcatttagactaaaatcggtcctttccatgaacattcaaatcaactttacaacatcagtgctgtgaatacttggttcttttgccctcttttattattatttttgtttgtttgtagggatcggatcaatgaaggaatgttcaaaatgtatgagggcgaagtatgtcagataaattagttttttctttattttttgtctatttattattacttataggtgctgaagaagtttcctgtcgtacagcactttctttttggtagtctcttttccattacggagcgtaaggatggaaagaagaccgactcgtcaggattggataaaatttcccatggattgcatcccgcgaaactcggaattattccagaatagatttaaggtttcaaacttttttatatggaatgcactcaaatatcaagtaaaatctgtttctcttctgatggttctagggtatcttgtatggatttactggttattattttggtttttctgttgctcttttgttgcataatttacttttattgtgtcttatggtcaatggaagaagataaaaaagcggctaacaacacttgcagcagcaacaacaataatagtctatcggatgtcaaacagaatgatgacgtctcatcgcttgactcacttggcgtttttctaaaccggtgaattttttaacatactttttgttttgtgtaaatgctgattttgagttgtaagaaatgaaattaattaaaaatattcacaattaaataattgaagttttcgtcaaatggacacaaaaaagttgcaacaattggcttcaaatccgacggtggtggcgcaatccaacggaccaaacgaaggcaccgcaaaagacacaaacaatgataacacttcgatcacatcaactcgggagaaaatgctcgaagtcgtttatgggaataagctaatgggaaaggagaagcagccgaaatttatgtgttttgttgtggatgcgcaggaaagaaaaattaggataatgagcagagaggagcagaaaaaacaggtaaaaaaagaccggtcgtgagttttttaaatatgggcaaaataatattttattaaacgcgttttaatttattttaggagagttccgccatcattttggaagaccttacggatgaccaattttctcggtttggcaaatccgtcaaggacaaagaggctgataactccgacgcattcgtccattgtgaaaaatgttctctgttctacgaattctgttgccttgatcatccgctttatcagtgcaaagatcgggtgccttcgtcttctcccacagaaattgaggacagagcggcggccactcttcctgcctttctttttattcagaattcttcaattccctccgctgggaaaggtgagaattaattaccttcatttattttaaatattctcgtgaattgttttaaggagtgttcaccaaagttgatattccaattggaattgtgtttggtgcgttgtttgttttgttggctgtcgtttttgttctttcgacattaaaagtttccattttcaggtccctacgagggcattctcacacaaaatttgtcggaaatggaattcggtgcttacacatgggaattacgtgtaggatatggaaaaccttcctattacattgatggttagggaccgtcctaattattcttttatttttcctttttcagccaaagaccctcgttattccaattggatggtaaagtttattaggtaattaatttgtctacttttctctttcgtacagcgctacatcaattctccgaggaatgagtcggaacagaatctgatcgccttccaataccagggcagtgtgtattaccgcgtctttaagcccattgaccgatcttcggaactattggtttggtaaaatatgcaacttcgggaggaaggcaattaaataatagtaaaactacgcatttaggccattttcagtatttgtttcttctgattatagtatgttgttacaaatgaatggattctgctgggtattgtatcattggatggagcagaaacgtttctatctaatgacactcctttagaagaatcttttcatttttggaaaacttatgaccaatttagaatgttctgaagacttttaaggtcacaatttttaatgttttatcagaaccataaaaatgaatacacaaaagtctgtgctctaacctttggttttctgcaaatcttggcccatggctgaggaagttaattagcttcttaaatagtgaaggtggcttgtttattaattatgactcatattgtgaaattttaatatattttatttgggactttcttctcttcttcctcccctttttctgcttttttatgattctgttcatttttaggtacggaaaaaaatatggaaaagagttgggaatcattgacacttcggtgaagagagtaccgcgttcattcttttattataccggcaagagcccttttattctttgacttgctgtgttttgtttttcatattgaatttcctttttcactattttcacgacgctattcatattaatttggtatttattaattcatcgtattattattttataaattcatccactgcgatactttcttttccttattaaaaatgttttaccaattaaatatttttacctgaaaagtattttctactaattgtaagtttcgacagataaataaatgtcctttttgcaacgacctccttcgtccgtgaaagaccatcgacggacttgggacaggacggaatatgaagtcaaggcgcaggagagactgactaccgaaagggaggcgttggaaatcaaaaaaggaaacatacggccaccgccgaagggtccgaagattaaacgggaaatgctgaagccgagggaattcaaagtgggtgctttcgcggcactataatttttgctttctccatcggcgtaataaatcaatttattgctcaggtagacctcgagtcgaaagtgggcaggcaagtggtgatcaacaaaaccacgccttcctccgagacaggcggttattactgcaatatttgtgactgtgtggtgaaggactcaatcaactttttggatcacattaatggtcagagagcgactcactcattagacaaattatccctgaatttgtaggtaaaaatcaccaaaggaatttggggttttcaatgaaagtgaagaaaagcactgtcgaggaggtccgagagcgtttttcaatgaaaaaggcacaaagtgagcagaaaaaaccgaataaaagattaaaattttgtaatgtccttaagaggaaacactgcgcaatgaggacgtagaggagaaacaacgcgatttgaaggaggaagaggccaaaatggcggatctgaaacggatgcaaagggaacggcaaaaggagaccagtcggaagaggacggcagcggcggtgacggcaccgcccacggacgaagaggcggacgcggaactgatgaaagtgatggggatcggcacatttggcagtaataaacggaagaaatgaaaaagggtggactatctaccaaaactacacattgtccgatgtcggtcgagtcgatggaatggctgtcttatggccattggtttatcgtcggtttcccagttttgctgtatattccataccgacactcagtttttaaatgcttatttacatttttttaagtataaaaacaggatgaatcgtaaataatgttattttcacttgctattagacaaactggaaaaattttcctacgaatgttcgcctttctttatgtattttttatttgtcgctaagtttttagtttatagagattaaaccgactttatgacgaacattatctactgtattattttatttttctgtgttgtcgtccatggagcggaacggggagttacggtggaagaaaaggtggggtttactagggtaacccgtaaatttgttcgggagtacgtaaataaccaacattttgtgttttcttgtgttaggtgcgcactttgcaagaatcgatgctgaagcgtccgctgatcaatctcaatcttgagaaatggaaaacttacgtacaggttccttgcttttgttgtcatgttggtgtggctggtcagatttgtatctgcatattgacccttggcattttcctaaaactgggaaacggaaaaactttttggtgccttttgtcggtaccaggagttcccccccccctctactagtacatttttatggtttttagtcgtcgccacgcaattattcgatgattgtcatgttcactgtgctttctgcgagcatgaattgccccatttgcaagttcgctttccgcagttttctatttcatttttggattaaggccagcttatgaagagtatctgatactggccaattcctaccgttacacctttctcaactcgaaatcgctttattttgcactggtcgattatgaggaagcgccgcaggttttcaatttggtgagcattttggtagattgaataaaaaacgcgatatttaaatgcttgaattcagctcaatttgaacacggctcctgcaatttatcattttccagcaaagggagcgcgacgcaatcaggtgcaaatatattctaattttgaacattttcaatctgatttggaaaggatacaatggacttccaacggatgggcattgacgcggacgcaatggccaagtttgttcaggacagaacggacatccaagtgggcaccccccccccttttctggcattcctttggcttcaatagattcgagtccttcgtcctccgaattatgctgcgcctgtggttgtgctgctgctcgtcatgttggtgcttggcctcctctacatgcgtcgtaataacctcgagtttctcttcaatcgcactttttgggccttggtttgcgtggtaccgtctctttttatgtgtccctcttgcattttccctgttcttctgtaagggcatcgtattcgcgttcatgagtggtcagatgtggaaccacatccgtggcccgccctttgtgatgactcacccccaaacgcgtgaaacttcgctggtccacggcagcactcagtaccaactcattgccgagacgtacatcgttctctcattgtacgccgccgtcacccttggcgtcgtcgtgttaaatgatgctgcctccagcaaaacggaccccgggaaaagaaagcgtggggatctttcaccatttggcaccgttttttattgattcaattcagttatggcatgcatcggaataggactggttgtggtcttcttcagccttttgctttcagtgtttcgcagcaaacatcacggatatccgtaccattttctgtttagttagaaagacgtgggaccgatgttatgtgaattttgttgggttacctaatcttgtcttatttattgtaaaattttaattttattcatttgtttatttgggcctaataaatcactttctgtctattcatttttgtccgtggcaaatttctgattattcgtgtcaatttatttttcattttttttatctacccaattcttgttaatcatttcgatggatgtgcaactcaattttctgcaacacgaaccgaccgccaattggcttgattattttttggagcggaaaaagctttcagagctactcagacgaaacccaattggtcttacattattgcatttcactttaatttggcttttttcagaccgaattgcagcgatttcgttttgtgaccaattcgttgaacaggctttggtcggtgaaagagatttggcgacgatggagagaaacaatgcaatagagaaaggtgggggagggacatatgggggcggggacgtcttggcaaaatgtacaaagtccaacatgtatcgtatgttttgccattgccctgagatgggaattatgtgttttacacatatcgactgcgtttaagatgatttcatgagcacacattacaaaatcgaagacctttggctgtgtgctctcagttgttttgcagcgtgtgattgggacttgtcgttgctgatcaaaaagtcagtcggagagagggattggttgggatttgaccttttcaataccaatagcagcagattatcccttttcagttcgaatgccatccgagtgggcgctttgttaagccgtctcatccgatgggcttttgaatccgatttgagttcacagagcagaactctctttgcggaagagcctttcaaatttctgaattctttcgaccgagttggcgcctcgagacttttctccggatggctttacgctcgttgggttctcaaaactgatttggatggccgattccctgtctgttcatttatttattttgttctaactcattttaaaggttcctcccgcacggccaacagtcagcaacccgtaagtttcaagagcagcttaacaaacatgaagataagatagctacgcaatataactaaactaacaatttaacggcccctaaaaaattcacatgaaatgcaatttgcccggcaccgaaactgatcagaaaataaggattctttgagttaatatttctttggcttcccccccccccccgcccgttacggtcattcgttatttgtcacctgcttgtttctttcagttatttttctgttgatcagtcacttcttcaagccgaacggttgtcccaagtgactttggaagtgcgcagtcgaatgggcgaagcagtgaactttttgagacgaattgtcaacgaccggcgacttggagacgacgacaaagtggaagtgcccggaatgatgtgttttttccaaaactttgacatcacaacgaaagtgcgttttaattacgttttttgtttttaattgccttttcattcagaagctttttcttcctaaagctaattttgacgcagaaacacataaaatttcctggtgcacttttcgtcgaaaaacgatgttcgatttaatgacggcacatttttccgccaaacatttccaaagggccaagcatttcttgagtaaagtacgttttaattatttgtggctgtggatttgttattcgactgtcagacattgtcctgcaaaactgaaaacgaagacttacaaatattttcgggcgatttattgcacatcgacgagaatgagttgcaaatttatcggcatattttcaaaattggcgacgcttatccgttgcacaaacgatgccccacaatcgccatttgcccttcggatccgttactcgattttgtgcgacagaaagcgaaaatagacaaaaacagtgccaaatacatcgtcaagttgctgttctcttcaggaaaggccgaatatccaagcaccaactgaacagacttcggg

SEQ ID NO: 6740 - DNA, 1369 bp, Heterodera glycines
aaaatttttaattgtagtgttttaaattataaaattgaattttctttgtcttttgatttttaaatctaataacaataataatttgattctaaattttgttagccatttgctttattaacaatgtattaaactgaagaaaatataattgtctcaatttttaaattatgttttaaagttttaagttttaggtaaatattgatcataggccccaaactcaaaaatgcttaaaaacggtcagaatagatgtaaaaaggttcgaaatgggttggaaaaatagaattaggggcgcacttgccctttttcaggctgaaattgatccaaatggatgtcataaccgtgttcagcaacctcaaaaccccctataatatgttttcgtttaatttaaaaattttgagtttttgttcgaatttgggttcggggttcggaattttgcaaaataaaggtcatattagtccatagaaaaattattcaaaatgtattttgagtgctttttatagtgcggtcacttgagtcccagctgagtttggcacttcaattccggcactttttcagcctgcaaaaagggcaaacgcgcccctaattctatttttccaacccatttcgaacctttttacatctattctgaccgtttttaagcatttttgagtttggggcctatgatcaatattttccaagttttattctatttattaagtttattcttaaatttatgctaaagttcacttgactatctttttatggaatttaattaaaagccatagtgtgggatctcaaccgtggttaattaaatcctgaattgtgattttggaaaatatattattgaaattaatagataattgtaatattaatattaagattatgaggaatcaaataattaaacccaattatttttgttcgattttgcttttctgcattttataaatggcgtttcatccaagtagatgatgatggaaattaccatccttgtgttgttttgtatgcttttgtaatcaaagtggaaagggacatagttttgtcccaaagtagctatagaaggtctatagatataaatcatttgtaaatttctattatttttttaaattatatttttgaacattaaataaaagattataatgaaacattttatttttaaaaataaaatatttaaattacgctttcttatttttaaaagttttgtttattctttatttttatttaacttcttttcgttaattaatactttaattttatggttttattattttatctttcccctgtaattacaatatttcctaagtaagctattgcaattattgttaatctcatttttaaacatagacaatttatatacattaattaatttattattaaaataactatgttgtgttac

SEQ ID NO: 6741 - DNA, 2061 bp, Heterodera glycines
  misc_feature (23)..(23): n is a, c, g, or t
  misc_feature (78)..(78): n is a, c, g, or t
gggggaagggtcaacgaaaattnttgcaaaagagtcaggccatataaaattgtgcaattttgaactcccgagggattnggcgaaacggtcggttcattaatgaggaaagggatgactgtattttttcatagttaagcttccggagccgcatattacctttaaatcggcacaatagacacatagtttgtcagtttttcagatcaattgcttcctcaatattacaatattgattttgtatttctttgtgcgaattatataacttgttaatttttataaatgtttcaaattaattattttcgtttttttattattttaattaaattgtcatttattagtaataatattttattaaaatttaaaaaaaaatgcagtttcaattacaatattgggtcaaaacatatttttatctctatctttgaattctctaatgatagtatataattattatgtagcaatattccctaatctgttaatcttttatatgaagcttttagtaataattaatttcttctcttacagcaaaaagtattaattttacaataatattttttcacatatttctgtcgaaagaatttaatttaagttctatgcatacatttaaaaataatttgtttttttattgcattgtattgattcagattaaatgataaaaatatagttttctttgtaattgttttaaatttataaatgtggaaattacttcaggttgttacaaggatctcgaattattttctttttatttttcctacttttatcttatttccttttaacattttatatatttttaaaacattaatttattatttttatttaattgctctcctctttgaatcaacattttcaataagcgttaatataataatttttagattcttaagatttgggctaacacctttgaatctgcaataatgctgcagaaaatattttatatttgccgaattaatattttattttgaccattcgaagctctacaaagtattaacatttctcgataatataatcgagcctttattaagtttttgactttgcattattaagatctttaaatccatttattaatacatccaaaatttttacttcggttttttttgccttctataaattcaaggattgaaaaatataataaattttgtagataatttactataatagaaattttaaattaaatatcgttattagtttaaagctgccatgtttacttctcgccaaatatatccaatcggccttctcggattattgcgcttgtaacatttcttaatttgcagcttaagataagataaaatattatacaaaacctcgacaaatttgttaaaagtttcacatttaatacaataagcaaagataatatttgaattttcgttagattgaccaacaaaatttattgcatttatattttttgcgatttaaaaagcggattaattaaataacattttttatttatctatattaaggaaaatacaaattaataaataattagattaaaacaatcacgtcctcaattttttttactaaagtttaaattacgcatcttgaaatgtgatcacgttttttgttgcccccaatgttctatctcatctatttattaaatggggtgcctgagcacttttcggtaaatttagctttttttatttaaaaaagtatttgttagatattatctaactttttacttaagttaaaatattatgtagattcatttcaatttcttaaacaaagttaaatttaatattggttaaattttctaattgattccaaaagcaattttttttataatattgcattagccgtttacacaattaatgtttatgactttagactatttatattattaaataaatttcaaacattactattataaaagttatttaatctttttgccatgtacaatatataaagtgttttgttcgtttaatagacaatgatttaaatcgacctttattgcttccggcacttgatttcatatttctttatttcattttattcatgggagtgaatttaagcatacacactataggggtatacttttacgattcttttaaatgaaaaattgtcttttaaatactg

SEQ ID NO: 6742 - DNA, 1539 bp, Heterodera glycines
cctcccggacccccttccccctcctctgacgacgctcccggctctcccacaggcacgggcttgtgcgcgaaaaacaggcggcgcgcgaaagcaggcggcaacatcaaagacccgcaccgcccccacaggctcacgcctgacgacggtgcgggtgggtaaactactatgaatttctatatttctcttcatattatgacataaaataaaaatttcttaatttttcagttattattttttgcaatttattttttcctttatttgttcaaacaattatattttcgtccatggattggaaccaattccaatgcttacaacactttatttatgaagatcaaatttttttaaagatatcttaacatgtaccataatggcgaccattccctcttattatcatctttccaaaagcaaagatgcttagaatataaatatttaattatttatcagagaaaattgcgaaaaaaaagataattaaattttaatcatgacaataaattaaagcgtatttggcagcaatttcatattttttattttcaaagttttttttacaacgattaaaatttatttttgtatcttaattctatattaaaaatgaaacattttgttgttgttttttggcgtgaccggaaaattcgtcagtggaaaatatgttagtagaaaatgcgtcagtgataaaaatattctaaaatatagttcttaccaaaataaaattctataacaaaatcgttctgaattccgaagcccggacccgaactcgaacaaaaggtctaaattcacaatttttgaaattatgctttttgttcaaaattggtttaaatacactgaaacaaactgaaatgcatcaatcatccaaaaagcgatcatttacgccatttttgaatcaaaaatgctaaattcgaaaatgaggactttcgactttatgttcgaattcagtcaggtccagagtttggaattggccgaaatggataccgatttgtgatcagtgagctcgaaaacccaaggaacttgtttttataaaacaataaaattttctactgacgcattttccgggcgccgatttttggtgatacataattaaattgttcatcaatttattgtatgtttcaacttccgattaaatctgatttaaaattggttgagctgttgcttatgttgaattttttttttgcctgttatatttataacactttattgtattatttattgctatggaagtttgataataaaaattctcgacataagcaccttaatggtcttcactgttgaaaaaggtagtgttatcaaatagaatattaatttttaaatttctaattattttctcaatttatttttgattttataaaaatgttgctcatttattttggtgcatttggttatgtttccttcttgacgatttgtttttattttgcttagttgtcctagaaaatattttttattaaacttatctcagaattcgtttaatgcaaatttaattgagttttctttttataacattttggtccttcatttaattagcgtcttgaattttcttatcttatacag

SEQ ID NO: 6743 - DNA, 4328 bp, Heterodera glycines
atttaaccaaaaatctatttatgtagagaaaaaaaatttcctctaatttgtaagctaacttttgatgctgaaaaaatctttaggaccaacatacacagtccttcatgacgatctgaacaccccaaaagatactgaaagtcgggaaaattttagaaaaaattcttagagggttgggaaaattttctgaaaattttgattaggcctgtcgttttaaatttaagcgacggaaagaaaaaatagggtttttagcagtttatatgccaaaaatggtaatttttctgccatttggggtcaaaatttcaaaaatacggtaaaatgggggtccgtctgccggtggtgccgacaggcgccgccgggaaaaattttgaaattttgagtgaatttgttaacagattttgtccaaaatatgtccaatgattggttaatttattggtatatgaacgttttaaaaaataaagaaaaataattttcaatgttatgaaatttcttgttaattaaatttcaattaaaattatcaaaacaaaaacatataaatagtcctatcccaatggggaattgaacccaagagacagacaacgaaagacagaaggcttaaccaccagactacatatatatgtttacattctaatttgtaagcagaaaagaatttatttatttttctcaaaaatttcttcacaccgctttcctattttcgtctcattaaaaattccctatataaaatgccaatcacggatcaaaatcacggaaaatttgaaaaaatccgtgaccagtgatccgagatcacggcaccccaaaaaccccgtgatttccgtgatccgtgatccgtgatctatgagaaatgatagaaaatgaaacatttttattaaatactcggttagcactttccccattccccggtttgatgggtgatcgccctccgcccccaccattcataccagggatggcattcagaggcacccaaaaattttcggaaatcgtaaatcggaattccgtgccatccctgattcatatatgctctacttataaaaataatagagaaacacttcgtgttcgccctttatgccgaacaatctgctgtttggagagcaattggacgaaaaaatgagatgccaggcaagttattcaacggtcgtagaggacggaatgagtccgatggctgctactggtcacattaaatatcacgggtcggtgcgggacggacaactcaaaacagtgacaaggcgcgagtgcagcagaaggcacgaggcgcagaaggagtcgaccggtaccgataatcctttttcagaatgccggaaaagtcctgagaacccaaaatttggcacgattttgtgatcaaaatatttattggagatgcactcaaacatggtaattacagctccattctcgaatatatttttgaactgattaattaattatcccaatttgtcaatttaattttttctttgtattcaatatttcttatttttcatttttgctttgtaattgggcaaaggaaaaagaattttttataaagggtggacaagaaaagtgcaagaaatgttgggtgaccgctgacattaaatttggaatcaaatctcattttggaattcgtaaaatgtgaaaaagccggaaatttgaatgaaggcacagcgctgaaaacctataaaactttgagcattttcagattttttctttggattttgttgagtcagttacaattaaatttcaaaataagtaccatgaaccggaaaaattccgtcactccctgccacacaaaattgacgagtcaatcccgaaaaaccgtatcattcaaaactcttaatgagtctcgaaaaaagaccaaaatcactgtaattcccttcaatggtgtaaaagtataaggaatgattattaattagaaattaatttaaggttaatttgacagaattcagaatttattgtacaattaattaattattggttgtcaaaagtgaattgatatcatttgcacgcagtttttgaaaaaaggggtaaataaaatccattttttatttaattggtcgcttatcaataaattccaattcttcgtcgtttgcatgttggccatggtgaggacgacgtcttgaactctggccaaagtcaaactcttgaggcggatgaatgccctgacgaaatttctgaatgtttaaaggtcaataaatggaccaagtcaaaaaatgtgatgaactatgaacattaaaaattataattgggatttctaaaaattattgcttaattaagtgtagagagagagagagagcgagaatgagacagagagtgagagagaaagaaagaaagagagagtgagagagaagagagagggagtgagagagagaaagaaagaaagaaagagagagcgcgagaatgagagagagagagagagaatgagagagagagagagagaatgagagagagagcgaatgagagagagaatgagagagagagagaatgtgaggaaattttgaattttttttttaattcttaatgacttgtaatgggctgagacgacggtccccgtcttggccagcacagcacatgtagtagagggcgtagccgggaatcaccaccatggagcaggcggacaagaagaagccgaacgcctcggcccaaaaggggtagtcgacacccgtggggtagcggagaggctcatacatcaccaagcagcaaatgaacaaaatctgagcaatttttgtttaattaatagtttctttttgttgaatgcgttctttacatttaaattcaagcaacaaaaattcgacttttgaagcccattacaatttaatttgtgcctggaccccaatttggggttgaggcataaggtttgaagcgtggagaattcgccgaaaaatggcaaaaaatttcattcaattcataaattaggcaaacatcttcacagccaaattttggctttttcactcgagccgttaaaactttgtgatggccgaaactcggctttgtccttgtcacaaacaatggtaaatcggcaataaaagttaattattactagagctcggcctggacctggacccaggcctggattttcctggacctggattttcctggatttttgtccaggaaacccatgtccaggtccaggcaaaacaggaaaacacctggatttcctggacaaaattttagaatttattattttaagtgaccgatgttttttccaagttttcaaaaaatgtttaatagatttaaaaacagattattagtgtaaattagatatttttagatgttcccaagcaattaattgattttttcaaacttttgcttgctttttagaacaaatttcaaaaaatccaggtccaggcctggatccaggtctcgaagagcctggatttttcctggacctggaatttgtccaggaaatccaggtccaggtccaggcttttttcaaaataccgagctctaattattaccaatgcactcagtggggctgtgtatttccagagtaaggtaaaaaaggatagcggataaatgccaatcatttccttcagagcagcgcggacacgccgtgcgcctgttaattcattaaacatttgtcaattaattaattaattcgatgggatcggaaatgaaatcaattttagtaaattcgaaaaaaactaaccgaatccccacgccaggccaaccacttcgaaaaacaccacaaatagaagtgcaatgcccgatgctccataggcatccacctgaattacatattttgtttggttcgagggcatacgttaaaaaaggggggagagggcgaagcctaattttacgaagggactcaagacatataaaatatccaaatccattttttttttgcagatttgccaaacagaatttttcttacaaaactataatattttcaagagttgaagtgaggatgcaaaaaaagaaaaaagacttcaacaccaaaatacatattaaattaaattttggaattttgatatttaattaaattcaccagcgtaagccaatgtgcaccggcataagtgaccattggaatgccaataatgaagaagaatatgcaagtaacgagaagagaaatctaattaaaaaaataaaaatcacaaaataaatattttcaatgtttttaaacttttttgtatttgcgtaaaagtgttggaaaagtgtcctcaagagcggtgaatagtccttccatcatgcaaacctgtgaaatttcagaaaaataacatcaaaaattgtttttaaatgcctggctgtccagcccgagaattgtgatcatcagaaaaaacagaaatgcccaaagctgcttcagcggtaaattactggcaacctcagggtatgccaaaaaggcaagtccaaccccttaaaattaaaaa

SEQ ID NO: 6744 - DNA, 2588 bp, Heterodera glycines
aggcaaagttagaccacggatcagcaaaacgatgatcagaaagtatggaaacagagcacagaaatagacaaactttaaaagtgaaaaaataataaagtaatttcattttctttttttttgaattataaattttttttgtaaaatggaaaaattgtagtttgtgcccaaccaagcaccataattattaaggcgtgttattataagtgcatgcatatttttgttgctagaccgtgggaggctattatatatatattttttttattgttttgcatatttgtgtatatttcaagttttaggtgcatatgggcattttttcaaaaaattctattaaaatggccctctctgttaaaccggttgtttttacctcgatggatcgaaaatttttctaaaatttgattttttgctattttctcgaaaatattaataaaaatataaatttaaaaaaagaggaaatttatgacaaaaatatgtccataggaaaattttgatttactcaatttcttcaaaattaataggttttaggtacgttcgacatttttagcctaaatttagattataaatcaatggcatgtgcaaagaaacggcacctttctcgcctgggtgatgcccttccacaaagcgaaatacacgacaacccatgccaaaaacatcaatccgagcaattcccattggatgccgccaatgtcgtcaattgacggcgtttgctttagcacacgtcgcctgaagaaaaaaaacaattggatttaatggagaaaaaatggcagtgttttggtacattttgcgtgaaattggttgggaaaggctttgaataaaaataaaaaaattaatttaacaaaaatttaagatgttgttgtgccggctcaattgatgtaaaaaataaacaaaaatttcagcgtttaaaaaaatattcaaaagcccttttatggtgatcacgaaatatcatttatttaaaaaaatatgtttccttccgccgcttactcccaaaattgttccacggatgactcaatggacatcccatagcgggacaaatttgacgcaattcgcataatctccgagtgcgtttccttccccgtcacacattggccattgttccaccaattgtggcacgtctccccttaaatacaaaaaaaaaaagttaattaataattgtaaaaaatgataacgaacacggaaatgttgaattgaaggagctgatcatgtaaaaaacggcccaagaaacaatcacacaaaaataggaaatgcacataaaagcgatcatcacattgccaatgccaacacctgaaaaaggcaaaaatgtataaataatatattttaggaaaaaaatttaaaattcaatgaaatttttatctttgaaaattgggcacattttccacatttccattgctcctgaaagtaatttaacaaaaaatgtttcaccaaggcataccgtaatttacctctctgtaggtactgaccgaccgtaacttccatgaggaaaattggaacagcgccaaaagtgaagaaaagtgcataaacaacgaggaacgagcctatgagcattttcaaatgtgattaaataatttttagagttaaattaattattccgagtaattaattaacctccgccatttttgaagcaaaggtacggaaagcgccaaacatttccttaaaataataatttattataccggaaaaaaataaaacaatgaattaaccgaggccaactgcgtacgcaatcatactcatcagaaagtcaaattgtcctataaaaaagagaaaaggatgatcacaatcagtaacaaaattaattcagaagaagattaaaaatttattttttatcataattttgaaattttgatctttcgttgggattttttttcataaaatttcagaagagtggattgagttttttcttaatatccgaaatgagttgtgctatgtgaatgaaaatttcaatgtattgcgtcagaaattaatgaattaaaattttatttatttttattttttaaattagtttttctgttatattccaagtagattaaacaacaaggcatgaaaacttcaaaagttacgtttactttttcagttcattcatttttgaaagcttaagaggtaaaacaaattatatttccaaaaatatttttgttatgccatttttaattattttcattttccgagtttttagtggcaattaattcattcacttaataggcataattatgtaataaatttgccactatagaagttcgagttatcagatttacccgtccattggccccggtcaaccgattcagcgccaagcacagagattttcctggccgacggcggatccgtcgggtgttcaatttcgggaatgttcacacctttttaaatttggcaataattaagcatgttttgcgtttcaataattaattccccatatagtttgtttgttcttccctttttcacctttatcatgctttccttccaacgcagcagtgttttccttcccatcagttgaagaaatttcttcgttaattgccttccggtttttcgtaaaccattttattggcattatgaaaaaatttctgaaaaaattattattattattattatttaattcatttttt

SEQ ID NO: 6745 - DNA, 997 bp, Heterodera glycines
taataataatattattctaaaataatttcttaatttttttctttttatattgcattttctctctttttatcccaaaatgttctgaccattttatgtcccatgttcaaaaaccccgtccatttaattttttgttcatatttccccaccaaaaagtgaatgtataatgaatatttaatgatatcctttaaattgtggtcatcactcacacaaagtgaattaaaaataataaaataaataaataaatgcttttgggtttgaaaattccgtaggcattgcaaaatttgaaagtcagtccatccattaaattattcgaattttctaaatccgaatcctcttgctgactttttaaatgatcaaaagcgttcaaatttaatgccttaaaaacacgacttttcttgaagagttgtggcgaaaaacttcgccatgtccaagctgaatcgaaccatcttctttctgcccatccctcattaaattccaattttgtcgatcatttgaaaatgtaaatttcgctgcttcgctgtagcacaggagaaaaattatgaattaaaatacatttcttttaattaattaattaattaatagtcagacaaatgcatccgttggatgttttcattatttgatttaagcaattggaaatgaaattaacgaaaataggaaatgaaaaattaaaattttataaacttaagactgaaagtaaagggagaaacgaaaattgagcggcgctgagctcgaaagtcaagcaaattaaatttcttttgcaagcatattacaacatatatgaaattctgaaatatttaaaatttattttttaatttttgtgaaatatatgtacttttcggctttggggcctagatatgaattttttaaaaaatttatgcgagttcctctggcgctaagatgccaaaaaagatggcgcatattcacttgaagaaatcttagctcaaattgtggcatttatacccccaatataattttggcccgtagtttttgcaattct

SEQ ID NO: 6746 - DNA, 2153 bp, Heterodera glycines
ccggaaagccaaaccgaagacggtgtgggaagggggggggaacaggttgaccagcagcagacaaacgacagaacagaggaggtgatcagcaatcaacgcgaaggtggaggaacaatcagcagatgatcaatcagcacgacacgtcggagacggcggcggcgacggcgacggaactgttgcgcaagcaaaatgtgaccccagggcatggaatttggcgcaattttcttttttggcaatagaaacagaaaaacagcaacaatgtttgaatattgctttggggaaggaggctaaagcaaaaaagaaaagaaaaaaaggaaatccagtttaatttggcagacgaacgaatggagcgaaagggggggggaggaaaagcggacagaccaacgaacaaacagacaaatgaacaaatagacaaatgaacagacagacaaatgagcagacagacaaattaacagacatatatcaattagtcaaaatccgagtcattaactttttattgcctattaattgatttgtaaaagacgaattattattatttttttattttgaacaaaaataaatttcttttatttaatttattgttttttgcctttgaccaaaacaacggaggcgttttcgccgaaatctgtgctttccgtccgccacattttctgttcgcgccggtcgagtagaaaaacaaacagaaaaatgaggacgagttgaaacacgaagagagacagagagccgacgaaaagccatttccaaacggcataacccctgaaaatgtggtgggcgttgaaaatgccaaaaaacccctaaatttatttaatttttggcaccgttcgcatggccttggacaatcgaagcggagaaaaggcggcggttcgttcagttttccgtttccattgctgtaatagtggtgcagtttgttcaccaatcgccccacactgtccataatcgccggcgaaatttgctcaaaaacgaatgacgcctttttctaaattttttcatttttaaactttttcaaattttataaaatgccaacccaatcatttttatctgccacaatttgcctccgaggcaattgtaaaaaccggcggaaggaatcgctggtaagtctctcgtaattgacccccaccgaaccgtgtcggtggtcattttggccggtcatccataaaattcggttggtctgagggaaagtgttttgattttaaatgcctaaaattcgtccccaaattcacccactcacttcaaccaaaatgacacgtcttaacactcgaaaaagcgtttgctcataaaatgccaaagtttcgttccttaccttctgtcttataccggtaattaattagagttttcattgataggattcaaaataaccaccagcatttttcggcattggggtcgctgattgaacagtcgtgccgacatttctttgccattcttcccgaatgtgccaacagttcaagctgatcactgtaacccaatggtcctctgacattattattattattattattattgtcatgttgttgaagaaacggagaatgtaacattttcggcacattttgccgtgggaaaagcgaaagtgccattgtcaggggaggagaaatagcaaaaagggaaaggaaccagaaaagtgaaattggcacgagaagggagcaaagatgacatggccaactgctgttcctccgttttcgcatgctgaaaaaataaaattcataaaataaatttcaaaaaattatttttcctaaatttatgtataaataaagtaatattttattgaaaaatgggcaggcagtaaattataataaaagaatgactgttttcgttcttttcactattccgtccgtcccttttaattttaatcactctcgacaaaagagagacgaacgatcatcaggcggaagaggaaaaaggatttaaaaaataataaaagtaaaacataaaaataaaaagtaatggagtgatttaattaattgattgaaaaagcaaataattgtggaaaaatcgaaattaaaatatgaacaaaattatcaataaaataaggtgaaggagaagaatgaatgttggattatttcctagttaatcgagaaaacattaagtaattatcatttctgataagaaaaacaattagaaatcaacatttgttattttgtaataaaaatttaaaattt

SEQ ID NO: 6747 - DNA, 2170 bp, Heterodera glycines
  misc_feature (96)..(96): n is a, c, g, or t
attttctgaacgccttttttcgccacattttttttgcgtcgagttttttccaaggaatttttgcggaacagggctgcggggggggggggggtctgnccgtaattccgatttcctattttttttggaggttctctgttaccgctttggccttgcctgtttaatgatcagactaatgatcagattaatggtaatatcgctttgtaatgacggcttaaagaatcaaaaacaatgtcaaatgatcaggcccatgagaaaggtttggattgaagtgatcgacattgttcacattggtttatgtctctcccggccactgactggtctgatcagcttttactcaccgttttggtgcagttcgtccatcgcttgtctgatcattgttttgatttgctccagcgatggttccttccattctgtcgctttccccccgctttttcgtttcatctcctccaagaaatgctccacgtcggagctgcccaattcttccaccaatacaacctcgttgcaattgttgccaattgcgccgcttccgttctcgtcgatgttcgcattttccgctttaaattggcaaaatgtgtcattgcaaaaaggaatttttttagtgccagttttggccaaagaaagaaaaaagtaatggcatcattagggttttactcatttcatattatgaaaattcttttttttatgataaatccgattgccttttttatatggtaaaattcatttttctttttccataatattaattctttttttctcactctcttcgccaacgtttcgcctttttctgcgcttttcgctcccaattagaactgttctgataaaatcggacatcactgctccctccgtgcacggttggccactctttgtctcactgtaaatagtatttttcattaattttaatatttttcttaattattgtaattatccgctcccccccccccccccgaaactcactaattttcgagtcgcacaatgtgtggtgccatgtcgcgcatccgctccaacactttcagctcccgcgtgcatttgctcaaccgcgttgggtcctccgtgcaagttttgatcgccacacaacggccaagcgactgggaaaaggcgtgttcaacctgaaaagtgggcaaataattgagaaaaatggggaaatcaaatttaaaacccaaaacaaaaagaggaatgcaaattgaatggcctttttccttataatttcgttaatttttttgattttcctcccatttttctcctatttttggtaattttttcccatttccgacctttccgtccattccatcgcccaatggcaccaaagtgtcgtacgttttgccagcaatcattcgtgttgtcgttaaattacgaaaatgtttaccgcattggcatttttgttgaacttttgtcgaacacgacgaattgtgatgagagtctgagaaagtttatttattttgcgtttttattcaaaatttaattccaaattaaattaattaattaattaccttctccaattttatttgcgagtgatgcggaagaaatgaaagggaaaatattcaaagagaaaaaagaaaaaagacaaaggaaaggccaaagaaggcttttcatttctaaactcaaaattaacactcgattaaaattgaaattgaaaagtgttcatcaaatgcctatttctgttctgaggatgaaatgccttcgctttaaggtcaccgccccctccaatttggtcggttcgatcacgcgcattacaataaatttgccctcctccattttggtcatccattaatgcaaaaatgacagattaagtaagttatcaattgacacaaacgttgaaattagtgattgattgttcgttgtttgtgctttggatcattcgccgaatttgaacatcaatctgttgattaatgtaaactttaacaattttatgaaaaaacaatttttttttctttttgttatcggtcggtccattcaaatgaaacatttgctgatcagtgatcgaagtgtattaattacgtcaatctctgtttgtttcttctccatgctccgttcccgcaaaatgattcttttaattgtgttgcaattgcttttttcgacattaaccgtatttcctaaaatagagccccgggggttttgtttatcaacccccctcaaaagggaaggggagggagttttaatttggggggggggg

SEQ ID NO: 6748 - DNA, 1904 bp, Heterodera glycines
  misc_feature (1892)..(1893): n is a, c, g, or t
ccccccccccccccctcttcccacctcatcctcaaaattgccacttcaattcgctttttgcgcctttctgtcgtgtccatgtcgaggtaatcaatcagttcttgttcatttttggccaattttgacttcaattgttcaattctttcttcagcaatttccgagaggcgttcgccgtcaaaaaggcgcgaaaaaaggcgcaaaagaggacgaacggaagaggaagaggaggaggaggaagatgaggatgagatggatgaaaaggaagggaaggaaaaggaagaagaggatgaagacgaggaaggggatgagaaggaaggggaagaagaagggaaggaaaaggaagaagaggatgaggaagaagaagaggaaggggaggagaaggaaggggaagaagaagggaaggaaaaggaagaagaggatgaggaagaagaagaggatgaggaggagggggagggaacatatgatgaataggaagaagacgagggaaaacggagtaaagaagaggatgaggatgaagaagaggacgatgcaaccctcaccaaaactgaagtgaaaaaaatagaaataatttgtgaaagagttgtgccgatttgcgaagctctttcaaatttacaagtcatcaaaaaataaataaaataataaatttaataaaaataaattaaaaatgaattaagttgattatgtaataattcaataagtaaaatatttaaattgtaaagaatggtttaatgcattaattgctgaaatattattgatttttaattgatttttttgcaacatttcttaagattctagcattttaaaagaattttcatctagaaaaacagaaaacaggaaaggtcgcgacacctttttgtcgcttgtcgcaattttcaacaataaatgccaaacaacatcagtcttattgtggtgtccattattctggatataatgggcgacccccaacccgactcggtctcggggacgggagcccagggcaagactgagagagagaataggcagatgagcacttaatgagtctcgattagtgaaaggaatggccgccccgggatgacattgatgggcgaataattaattatcagaggatgagagatagataaagagaaataagaaattaactatataagtgctaaaaaatcaggctttttttgaattagccatggcacagaaactgattcaacaaacaaaaaacatttcaagaaattgtgatgactttactcattgtcagaagcaaatgagatagagaagaagaagcttccccgagaggaagattaatggatcaattgaggcaacaattgatcctatatgatcgagcaaagtggggagctggagagggcagggtcggtagttcagctggtagaacactggtccggaaagccagagacgccggttcaaagccggcccgccccatagtttttccctcaaaggcttccccgctcgttcatatatttcacaaacaacttaatttcctgctttcatttttctaaccctttgacaactttcactaaattaaaaaaaagtcattttgaaaatagcaaaacattgcaatatttgaaaatacgttgaaaggaaataaaaattcaatagcagaagaaaagccacgaaaatcgagcaaagaaaaagcgaatattaaataaaaaaatgtttaattctttcaaaaatttttaattaataatgcaatattttagtaaataaattattcttattttataattttcaatttttgaggtttttacacacatttcaagtgggtcttattaagccagtccaaattatttgttatttgccgtcttgtgacctccaacacattacaattattattatgatgttcaaaattctaataattttatgtttaaaatttgtcgctcccaatcgaaagcgtttcccgccgnngagaagactct

SEQ ID NO: 6749 - DNA, 1478 bp, Heterodera glycines
  misc_feature (81)..(81): n is a, c, g, or t
aaatcaaatgaaagaaattcggcaaaaatttgagaatttaattggcgtttcgggatttcaattaatttacaaaacattttnggaaaaaatgcaatggcaaagtgagtttaaaaatacttctaatttttatcatttcagaaaaacattcaaaatttaacctttaatgaaagtttaaatgaatataattttaatgattttattgtcattataaaaaatttcttcagttcgcgaccccaaaattccttatcaaattttatacaatgaatttttgtttggcgccgatacaaaattaagaaaatggagggcaaaaattattcttgaaaagtttctttacgacgaatcggcacaaaaattgttcgaagacgaaaaagcaaaagcaattagaaaaggcaaaagaataattaatttttaaattcattttaaattaaataaataaatgtaaatttattttagagaaaaatttaactgtttttcatgagagaattaaatttattggagaaatgaaacaaatttggacaatttattcggagaatttttggtttaacgaaaaaacaattcgggcaaaaattgagcatttggtgaggagaaacaaaggcaaaaatttggaaatggtaaaagaaactcttttggcacatcacaaagaaatgagtgaaattgaacacaacgaaaaggcaaaaaactttttaaattggatttaaataataacaaattgacaattaaggacattgacatgctttggggaaatgggcccgaagacacggcacttttcagggcacttttcatttgcatcggcgaatcattcacggaatgtgccgaaaaaggtggacaaaagtctgccgaacatttggaagaattttcggcgacagagcaattaaaagcgattaattgtgtggccaaaatagtgaaaaggaaggcgcggaaggacgaaattgtggccaaattgcatttagagaaaatggaggaaataattggcggcgaattcaaagagaaactgaagaaaaatagtgggcaatcaaaaacaaaaattaatttaattaattaattaatggaaatgattaagttacattttttagctaaggaattggcaaaacttttggatggaaatggcattaacaaaatgaaagaattactgacagaggcatattaatttttattattatatgagaccgtgataaataatattaattgaattaatacatttttatttgtttaacttgttatttccgttattttaagagtgaatatttctcaacaaatgaatcggtcgctttgtcttcttccgacaattcatccccagcagaaagtgacgaaacttacgaagatgcaaattctgaggaaaaatttggagaagaaaacatagaaaaaagcgatggaaattcagaagcaaataattggcaaaatgccatcgccaaaaacaaaatgccaaaagtagaaaaaagcaaaacaaaaagttattatgggagaaaagagaagaaaaa

SEQ ID NO: 6750 - DNA, 2520 bp, Heterodera glycines
tttgttgttataaacggatttaggcaagttgaatgagaggtccttcgtgccgctcctttgcgaaacaatttggagctttgccgaagatttgcaactccaatttgggtcttaattagtgcaaatccgataaattattcaaaatttctatttgttttcaccttcttcagaagcggtgcacaaaaggtaaaagcccaggcatttctcagtgctgtctttcttcgtgtttacttttgccaaaattttccatagcactccgtttctgtacacagtttcactgtatcgtttgctgccctcattctctccagcaaatgccgacaattgttcaatgtccaacacaagttggcgacaagaggcacgattcttggcggaaaatttcaatgggtacagctcggaaatcgcgcgcaaattcggatggcaattgaattggtaaatgccgaacatttcctcaacagtcagaaggccggaaggaactgaaaaacgtgaaaaatggaaaaacaattcttaatttggctaaaagcaacaaaattgttgcagcatgcttggaagcattttatggattaaaaacgccaaatatcgacaaaaacccaaaaaatgctaaatatggaccaaaaaatagactaaaaagggccaaaaatgttttaaatacttcaacattaattttagtaacaagataaaacgttgtagttgaaaactttatttcggatttttcatttgaatccctaccaatttccttcgcaaatgtttccattgtgatgagtgggaaacgaattttgaagagtgccgggccaagcgcagaacgacgatttttaggcgaacattcgatggcattttgacggcatttttcgtcggcccaacggagtgcctaatgaataattaatgagataattgggattatttaaacataataattattacagctttccaaagtgcgatttcgccactgattttcaattggtcactcgcaaaaattttagacaacaaattttggccgatttgaaggaattcttctgaaccaaacaaagtttccgcctttcgattaatgtaatccaagcaacgaattgcgaaatcctaaaaaagcgaagccaaattaaaaaacaaaatcaaaaactaattaaatataaaaagctctgaaattttatggccttaaattaattactttctcatcgagaagctgagcctggtcaaaagcgaggaaaacattgggcaattcattttccagtggaaagtccgcgcaagccttggccagcaaagaaatgtggtacttcttagctaaaaagtaatcatttgtaaacaaaaaattataaaaaaatatatgatagatttgagtcccaccaattttcaggtaatttaatgaaaatttttgtggctcaattccttttttaatagaaatttttaaaaaatgatctttttggggcttttgaaactttgatcactttttcctgatcatttttggcgccgtagcaaaaaggccgaaaattcacaattgcaaatggatcttgctttctcaatacgataaaagtgttttgagtctgcttttttggcgccgaaacgatacagactcttccgagcgacggccttttcctttttttcttgctcttaggcctcttatgttttcgtcacattttccaaacaatttctgaagagttagggtacggtcggcaccgtcggagaaattttgaaaaatttttcgttcgattttaatgactttcctaatccactagactgttgaaaattttactgctggtctctaattatggctaaaatttcaataaaaaaaattcccacccgcgtaaagcacagcgatgagattgtctccggtcaatccgcttgaatcttccgcgtagataaagctcagcatcactttgaacacattggcgtcgatgtcagtgatctccacggattgtaactgttcagcggaagaggaggctaaaaatttttaaaattttttaattttttgtttttcattttttactttttgtctttgcgttttgagcgtcgaaacggaacattgctttgaacacgtcagaagcagccatcaaaatgagtttgtgtgcttttagaaccttaaaaacaacaatgtttacgatttgagaaacttttgatggtcgaataaaagaaaagttcaaaaaatttaatgaatttcttgatttttttccaatacgtgcctccttttcctctccttggccaaccaaaaattgaatgtccgccccatcgccattggtcaacaaaagcttcatccgatcagccaaactgatggacatttgaattttattagccgatgattgaaggaaaataaaacttagaaaataatagcaaacattaataatgttaaagcgaagagagtgtgcttttttggaaaaaactttatatttatgggcgaagagtaatcattgcctttactgttcccataaaaaggatgaaaaagatggttttgagcagaacaaaggtcattcgtgatcagccccacaaattaccctcgaaatgaattgaaaatttcatgggggttacaaaactgcaaag

SEQ ID NO: 6751 - DNA, 1375 bp, Heterodera glycines
ttatttgcctattttcttgatatcggcacaatcggcccccttcgatacggcattttcttatcttttagtgtatttactgtcggattgtcctcactgacggattgtccactgtcggattgtccaaatgtccagtcacgcaaatacctgtttcttacggttgtttaaaggtagagttaatgtactagtttctgtttggacttagaccggaatactggcttagttgggtccgaaataacaagagacccgtctaattatatttaaacttataaaattttaagtcttgaacatactgagcttgtaatgatacaaataatacatacatatgtatggaattgatatataatgaatgctaatgagtttagcaaaatctctggtgcgtgcccaaacttcccgatgccgaaatttctggtgcccaaacttcccggtgcccaaatttccgccccccccccttaaatttttgtcctactgtatccaaagtcgcacaatcagtagcacttttgtttttttttagaatttttcaaaattgttccttatttccacaataaatgcatcggtcttgaatctcgggaaatttttgggctcgagaatcatactttattttacgggagcggaaaaaacccgggaatcccgtcgccgtcaatttttgtcaaaaaacgggaataaaaatgcactggtaagaatgggagtctgagtgaaaaatctgagaaggaaattattggaaagagtaattttgaaaaaaaaattgtttgtcttttgatcaattgatgctataggtaaagaaatatgtggcctagtggctaaaccttctgcctttcactatttgtcgcttgagcaatgttcccaaaaagcttttttagaaaaaatcgcttctcaaaaaaaggtcttaaaagcaaaaaatgtaagattgtcattaaaaacctagaaaaattctcagaacaagtttttgccgataccgtacagatgaaaaggttggtacctggagtgaatgaagtgaaacgaaaaaatttcacgtataattaaataataaaaaataatgaaaaataattaactaattttcttgctttcgcgaagcctttttcgggttaattaattttaggaaccttttttttggtagggtgccgtgatgtgccgcgcttctgctgcttcgctgctttggcttgtcgcgaaaaatgcagtgcttcacaccaagcacatttctaatgagcgtatcttattcttaatctatttttaaacttttaaattttaatcaattaattaattaatttcttttcccatttttgaaaattattttttatttttgggtttttgtcgtttggcggcctccgcctttttcaggaaattttttgtttttaaaaactattttaaaaatattttt

SEQ ID NO: 6752 - DNA, 758 bp, Heterodera glycines
aatcagggctcggatctgttctgatttatcagaaatgttctgatttggagggtccaaatctgataaaataaaaaagttctgatttgtcagaaatgttctgattttgggctattgttcttattttgttctgatttgtcgcttctccgaaaaatctgtcaatgtttctttataaatttggattggcatactgtttaagaaaaatattttcaattttggccttataatttatttcttgctgttaatttggctaattatttttgtatttattgctttattgtatttctcttttctttttaatttagcacctgcactattactaacaaatggcaccgcctaagcgcaaaaatgtttttaaaagtgaatatgccaatgaatttcagggtatcacaaaaagcaaaacaggagatgaattcgcgcactgtatcccatgcaattttaagccttttgaatgtaaaaatggtcgccaattgtctcaaaatcgcaaaaattgataatttttgatgaaaatctgttaacaaatcaaagaaataagaaaaaatttttccggcggcgcctatcggcaccgccggacccacttccctccctcgttctccaaaatttcttggaaaaatgcaccgtaaaaaatttattaaaaattatatttttttagataaaaattacactaaatttgctatttttctcaccaaaattgttaaaaatgatcatgggaggtggaaaatataatatttaatgcatttcgatcgaataaatgtaaaaat

SEQ ID NO: 6753 - DNA, 1923 bp, Heterodera glycines
  misc_feature (76)..(76): n is a, c, g, or t
acttgactttcgtatgaaatctaatcgtttggcattcctctccccgcactttaccagctgtctttccattggcatncatcatattatcgtctggataacactcactgcatgcatgccaaacacatccattaacttctattgcctttctctctgcttccacccatccatccacagaatattgaccaaactttttctctcctctgggtgaattagccatcctcacttccacattatgttcttccgtgtaccactgtaagaaacggcgggccagtctactttgattttgtgcattgtcatagcctcgttccgggacaattgccaagtgttcagctggaaggtggttgatccggaaatgcttcatacaggcgccggcgatcgtcatacactccctcaatacatcaattccttcgtgtgccctttccgctacaaagccttcttccctccgagacacatcaaagaattccatccgaaacgctaccagcgctgccgttaaaatttcaacgtcgtttgtgcagtagctggccaatgcttcgtcaaggaggaagggtttatgctgatgttgttcataccagacgttgaatttttgtcgtttatccggcatcatcccatcggccaagtagtcttcaggcgtggggtatatctgctttccgtagttatccggttggtttgccatgtgcggaaagaatggtttgtcctccacatccaagccgaaggatggaacaagttcagccaaagcgcagggcatcaaattatacgagtctcggaacaccacgtttggattgcgtttcttctgattgcccactttcatttcatacagcttattgcccttcctcaacatgctcggattgaatcctcgccggaaaagttcacgaaaaaccaacaccatatcgaagcggccaccaaagtgcgaataaacataagtgtcatacttcagcgggagttggaagactaaccaatcgacaaattcctccaaaggattgtctgcgaccacttgcttgtcgactgttgtttctgtgaagcgttggcaaaaggcgaccgttctgtttggcccgcacacctcacacccttttgttcctctttgccagtctccattctcgatgcatcccgggcatattaatttcgcagcaataaaattaggcaaatggttccgttgttcagattccccaatgaacatatgctgcattgtctccacgtcaaacgcaacaatacgatagggagtatgttgtttcggctcaatgggttgaatgtagcatccccgctcagtgttgtggtagttgttgcatagcccacaataattctcgccacacacatgcccctttctgtcatttcttttgttatctgctacatcccaaacagcaccgcaatctttgcacatctttgaccgcatacaaaagttggaatgaagatgatgttggtagcagtcgtagtttcggaaccttttatagcatttagagcactccttgacgaatccatctgttggctgacacggaaattgcggtccaacacgtgagcacatcacacaatgtgccttacaagatttgttgtgccttgacattttgtcgtatggccgttcacactccaaacagtacggttgaccgaacagaccgccctgcttctgcacaccatcgaaatggtcctcattgaaatatagcagcaatggtgtgtcgtaggtgttgtcaatgtacttgtagagtggcttatactgtcccaacgagccaaaaatcaacacagcaaagcgatgttgtcgcagtgtgttgttccagtagtcaacgacgtgaggcacaaatgtgtccgcgtcgtagccgagccaaatccattggtgctttcacctgctgcattagcttaacagtatccatgatggagttgtccctgctgtccttttctgtcggtcacatagtcgaaaaacttccagcgaggccaatt

SEQ ID NO: 6754 - DNA, 2906 bp, Heterodera glycines
attttatcgtaaggtcgttcacactccaagcagtacggttgaccgaacagaccgccctgcttctgcacaccatcgaaatggtcctcattgaaatatagcagcaatggtgtgtcgtaggtgttgtcaatgtacttgtacagcggcttatactgtcccaacgagccaaagatgaacacagcaaagcggtgttgtcgctgcgcgttgttccagtagtcaacgacgtgaggcacaaatgtatccgcgtcgtaaccgtccaagtccatcggagctttcacctgctgcatgagctcaaccgcatcatgatgaagttgtccctgttgtccgtgtctgtcgttcacatagtcgaaaaacttccagcgaggccaattgcatgttttgtcgaccattgttgcctggagcgcgtagaaaaggcagaagtggttgtcgttattacgaattttaatcaggcactggtcattaattcggtgatggacagcagctatttttcggcgtgttcctcctttgacacgtcgtttaaattgaagtccggagcgatcgactgttgttattgtcaccgtgaacggatcaccccacagtgaaacgtttttctgttgtttggactgcgccaccttcagaaacaaattgaggatggtatcgatagtgttgtcggagatttttcgagtaggaattgttatagctccttccgacaaaagaggactgcttatcaaacatccaaggtgagttggctcgatcccacgttcacggctgtcttttgtagcactatcaatacaatgttgaaatattccagccaaaagcctctcggggttagaaggaacatccgaaatactgaagcgagatttcattttggtgtagtggaatttggcgacatgttcaacagagctacccaatttctgcacgtaatcctttggagcttcttttgaaggtgatgtctctcctcctccttgttggacaacacccaaaatttgattgatgactaagtcttggcggggttttttgggaagaagttcaacgaatggagaattcgaaggacgtttaggtgaacggttttccattgatatcgaattatattttaaaatttgctatggtgtgatggatggatttatatatttttataatgaaaatatatggggagcaatagaaattttcgttaaaaacacaataatagtcagagaaactgaaaagaagaaagaaaatagtgcataaattagagataattgtggggtaaatatgcgagagtaattaaataataatcagtgtaattattgatgtggttttaaataaattatttttttttaatttatcaaatgaatggctaattttactaggtgaagaaatgacggctatttatattaattgtgacaaactttcgtttcaatacatacttttggcgctaaaaattaaattcaaattaagaccatagccgaacaataatttgtttaacacgcaacgccagcttattttggtgccaaaattaaattcaaattactataaattgtcttacaatacgctatacacaacgccaatttcgtttcaataacagggtttttggcgctaaaattcaattcgagttttgcgctaaattttaaacagagccaaaaactcatataaaattagtttcgcaatgatattccatgagtggcgattaaattcaaactggtacaaaaaagttagacaaataaatttacagaacgccattttttatggaaagccaaaaatggcggaatcttaaatttaaaccgagtcaacatgcttgcgccaaaagtaaatttacataacgtcagtttcgcatgatactctatgagtgacgattaaattcaaactggtacaaaaacgcttaggccaaaataaaatttacagaacgtatattttttgtaaaactttaagtatggtgggaagtttaaattctaaccaagagaacaggcttaaaccaaaaagaaacaaatacatgttaaatggtatctcgaaccaaagctaaaggcttaggccaaaagtaaaagcctcctttatttcggtgtaaaatgaaaattgcatttaaaatagttcaagattaaactaaataaatttattaatcaaggcacaacgcttggaattttaaatttatatcagatatcgaagctagtcaaattacgacccctgtacgaaaacagtctggcccgcaaataaaatattagtgacggtttttaaatgattctttcttaaaaactttgattataaaaaaagcttggtcaataataagaaattataaatccaaataaaatatttcgtttatattctcatatagagaaaaatgattggactcaaatgttgtgctgatctactcggagaaaactcggcaatagacattagagtcacagaactgtttgattatggtgaagctagtcagagataattcgtccatacacaacgaacaataacttcaactgatcgcttcttacatacaaaataatttgaattagagggagaacaaccgatagaagcgagagttagagaaaagggaaggaaataaagtgaaagcatagagggatatagagagtgagtgagaaaatgaagaacaaaaaaatgcatgcgaagaatatagaaggggaatacatttgaagaaacataaaaagaaccaagcagagggagctaaacgaagctgagattggtgaaaaagtgcttgagtttgtgattctgacttgtagattaatcgggataaataattttgagttacggactatcccacgacaggatattttgggggaaaattcttctagttgtgttggtgttttatccatttcttcaccacctaataggtcattaagtggtactacaactcaaaaaaatgaatttccctcagctgtcagtttggtgatctatcaaaatacaactcacagcaaaatttaaattttccccgcaaatgtcacttt

SEQ ID NO: 6755 - DNA, 2502 bp, Heterodera glycines
  misc_feature (2191)..(2191): n is a, c, g, or t
  misc_feature (2304)..(2304): n is a, c, g, or t
agagaggggagagagagagaggagagagagagaaggggaaaggtgaaagagagagagagagagaggggagagagagagatagagaagagagagagagagggtagagagagaaggggaaaggtgaaagagagagagagagggagggagagagagagccaaaagagaagaatatttctctctatctgttagttcatttctctttttttgaatcggtgttgtgtaagttggaaattctatggccaattatgaataattaaatttttttttaaactaattaagaggtggtgacaaaataaattgaaatacaattgtaaaaatgatggaccatttgtaataaaaatacaaatgttgacaacaaaatcacattccgaagcttcgcttggactgcgctcgggtggacgaaacactgtgcttccccgcctccgcaatttgagtgccgccgactcgtcgttgcgccctctccgtttggatttttcgttcggatagctgtttctgcgcctcctccatttctcgttccattgcggcagtggtccgttcagtgtccttaaataacaaaaattttagtcagaatttcgatttccgaaaaatttttgggcctcggaatgccaatccaggagaaaaattaacggattggtcgtttgggctacaattccggtttactaacctaaagttgaaaaaataagttgaaaaaaatcataaaacggaagcaaaggtcatcacagttaacagaatgattttgtacaaaaaaaaaaaactgcaaaactctctaaatttacgattttttatacacattttagaaacaaatgaatgaaacaagtttgaccacactacatattattattttcacacaagcattggtcagagaaacttcaagaaataacgatggagggggggggatgagatgaatatgagaaatagtatgggggacatacacatttcaaagaaaaagagttgtcgtcaaacacaaacattatttatttttctctgatgatgaaactgatgtgactgatggcaatgtcaaaacaataattccatgaaaattcctcaaatccggtccgggtgtggttttcgggatcttttgcattttaagcgtccaattgacttttgcaaatcaccgaattgctccccctctttgtttttaccattttttgcacatttttttaatgtacaacaaatcttgttttctacaatggtaattgattctcagatcaacaagcatataatgtctgaccagaaacaactgtttttattcggtcaaactcttcccggcaatcagagtggacttcttgaaaggttttttgggtttttacttgagagttatcatgagaaagcagaaaaattaaaacgaattggtcgtttggcgctaaattccggtttactaacctaaagttgaaaaaaaatcataaaacggaaaatctgaacattcaaaagggttggagttcgggtcaaatgggtccatcccccctttggttaaaaattaacgatttaacacttgcttggttcatttggacaacgattttgactcataaaatgtcgacaaacccaaaaaacaatgccaatgtttcaaccgccaaaaaattgacaaaaatttaggatgaaagaatgtgcggacaaacggaacaaaaaaaaaagaggatcgacagaaagtgaacaaattgcggtcggctcaacatcgcttttctgttcacggtttgcttttggactttaccatgggcacttggcatttgccggggttcggaactttttcggattatttccatgaaatgaaatgtgagcgatgggtcggaatttgacgaaatttgcattgctgtgaggggcggggggagggtcatgtcaccgccgatcgtagggggctgcgatcatctgatcccgaacctaaatttggacaaaatccaaaatgtaattctcgacttcgttcgagttcatgttagggactagaaattggcgaaaattgctatcagattcgtgttcatgttcagcgactccggaagcccctaaaaatgtgttttaatgacttaatattttgaatttttttcgaaaagggagcgacccttgagggtcaatgggcgccagctcagtttttggggtataactcttcgtaacttacctatttaatgaatttgatacagggatgggatcgcccaatgtcggtttccaaggacgggtatgccgatttgcaaggacatagtgnggaaaattcatgaaatccaaggacatttaaaatttttattttatgcaatgaaaaatggttaaaatttattcaaatggcttgtatttttcaccggaatgaatttttttcaattnttttgttttcactacgggtgggtcgggaacgggtctgggcgagaattaccggtcacggtttttcccaaattcccggtcccgtaccactctagttttcactgatcattttcctaatttgcgactcctttttttctgctttaaaacgcttttttttgcgggcgctttttccaaaattttgggaaaagggggggggggggg

SEQ ID NO: 6756 - DNA, 4945 bp, Heterodera glycines
  misc_feature (10)..(10): n is a, c, g, or t
tttcaatttntggcctcccagttccaaaaaaatttgcatgtttggcgaagtggtttttgtaagatagtaaaggaacaaagggtggtggttcgagtccgttgtgcaacatgaatatttttatttatttttgtccaaaaaattaaaaaatgacgatttttaaaaattatttttggaagtttttaccaaccaaactggacaatcttgtaatcattcgaaagcccttgattaggagaagccttttctaagcaaatgctaaacgatttgatgaattcgaaaaaagatatgaacgtttgaaaatttgtttttcttataactcatgaaatataatgtataagccaaaaaatggctgtattactgaatgcgttatatttttctctatcgatatgcaaaatttggtgcggatttaacgtgcaggaaaaaagttaaacgtcacgaagtaaatccggtttttctctattaacagagataaaaaaatagtacgccaaaaagagaaatgtttttttctctgcactctctatttattggtccatgtctcattttttgaaacggtgtgtaaaatgggtaatacagagaatacatgtcaagagggtcccaggtatgtgaatttccgacatttctgggcccgaaattccgatttcgaaattttttgggccgccggaattccgattgacgctgccgaattttttggtaaagacaccaaattttcggcaatttgttggagaatcggcaatttatttttggaaactaaaaaaatggatttcgcctatagagttggggaaaaaaattaatccgggaatggggttctcgcctttttcccgttcccgtaaaagtcccatccgggcaaaaaagatgggaaggttatttccggttttcccacggaaatcccgttcctgcccaactctactttattctcagaaggcggccttatctgttccggtttgacctaactgtgaggctttagcctcttattttttcccgataaggctaaataaaaacgaggctttttatggctttttgaaaattttgaagctttttatggctttttggggaaaatctcaaaaattgtcattatttgccaaaatatgttaacaatcattccaaagatttctaattttattttggcagccaaatttaaatttttcactacctaatttttttttcttcttttcttcaacttatccgaattacatctttataaaatgcaaaaataataaacaagaccaaacgagataaattggtaaattaagaaatgaattatcaacaacaacaacctcaatttttttcttcctatcctacagaaaatagcggagatagtaagtaaattagtaaattagccaaatatgaaggaatacaaaagaggagatagaaaaggacgattaaatttagaatcaaaataaataatttcagtaaattgggctcaacttgctcaaagatggattcagacgcaacattcgcagcagcaatcgtttccgccccaaccgccgcctcctcccccgccccctccgtcgcgtttgccttattctcaaggtttggaaaaccagcaatttgttgtttatccacatcgggtctatcctcttaaggagtttcttctgcacctgtgtttcttggaatgccattgtccacacctcccccaaatcgaacacctgggcctggattgtttccaacaccactttcccatgtgtctgttggaccaccaaactggcgacctctgcagaattgtgcccatccatcatttaacattggctaccgatctcatgggatcgcttcggctgctaattattcatatttttctcaatcacagggaccgagtgaaaggcatgatgatgaagaggttttctacagtttactttctaaagcgatactaaaattctcatttgaatttcagtatcaggctcattatgacccgtccctcgagcaagaagaatccacggaccaaaggcctccagaaatgtgttctcctcagggggccatgactcaatggatggctaatccttggaatgcggcgatgtatcctccaaattacatgccaataattggttttcacttttttttttgaaaattttaaaccttcgcttttagacactcaaatgaggaagaaacttcccgcgtggattttggagggattagaaaaagctgagagagaaaaacaaaagaagatagaaaaggaagaatatgagaaaaaacgcaaagaaatggaggaggaaaaacaaaagcaaagggaggccaaaggaatcggaaaatttgtatatttttatttaaaagacataccctcgggtggaatatttttgtacccgtttatggaatattgaatttgcaacatttaggatgacgacagtaacgatgaagaagacgaatgcggagataatggaattgttacaccgaataatgatgatcatcaactcttaccaatacgaaaatttcgcgaatttgttgaccaaaacaaaaaggatgaagcaaaaatttacgaggaaccccggacggatgagcaacggacgcaggaagcggtgatcattttatgaatgtttttattttcccaaacaggttcaaaagtggcaaaattaagatttacatagacacaaaaataaatatgattcaaaataaatttaactaactaaattttcttaatcaaaaagcttaatttttgctatgtatttttttaataattaagcaaggagaagctgtcgctgggaaaatttttgaatatttttttaagaaaaattatttttattttctcagggatacgattcttcagtaataattccaatggctttaaaaatcattttttcttttcatttaagtgcgtttggaaataattcttgacttttttgaacaattttatttgagcattatgcttatgttttccttaattaagctgatagtggtacggcgtttgatgaccactgtgctgctagaaacaacggatagggagattaaacggattgccaacaatatgctgactaggagaaaaaacaaaggtaatcttatggatctgggattggctactttcaattacttatgggacaacccccctccggactcttgtctttggcctttatattttgctaggagtgcccgtcccttctaccttttatttagctcaaccaaagattctcgctcaaagcacagcccttgccgcattgacttcgcttgttggtatttgttgttgcattaactccgtccattatttattctttgcagacagtagggataaaaggcgttcagcacttggaattgacgcagcttcttcgtcctcaactgaaagcagttcagaggaggagaggactaatcgcaaaagaaaaagcaagagaaaacgcagtgaagaaacaaaggtcaaaaaggaatcgactgaaacgccagtaggaaagagaagtcgcaaatgaaaaggagaaaaatagaaatgtattttcaaacatttcaatgataaattatggtttacatattaggttctaacatagctaatatccattaaatgattatttgttatgtcggcttatcgagttggtcgttcatttgatttaataatacgtgttacgcattattaggcaaccggatatcggcgaccaccattttctcatttactgtgaaaattccgtttcaataatttgcattattcgaacgatggtacttttaaagttttatatttaagaagttttgagaattattttcgaggtgaatttcgattccctctaaacttcaccctttttgaaaaaagttttttctgttctaaaaagtcgtgaccacatgtttcatggggtttttagggccgctgatcacgaatctgacattcggcagtattaccgaactacatgctcatatacgaatgattagtgtacgactgtctgacatccaacagtttttcaaccaaaattttgtcataacaaacagcaacaatgaatagggtggtcaaataagggtctctcaaaacttgtcgaacgccttcttcgcccccgatgctttgatcaccttgagcacattgaaccggaccgtcttactcagcggacgacattcgccaattgtgacgatgtcaccaatggacacatccctggaaaataggtcaaaccttaagacaactctttagttaattcttgccggaaacacggagaacaatgcacagacatgttcttgtggcgcttttcataacgacggtactttggcacgaaatggagatagtcgcgacggataacaatcgttcgctgcattttgtttttgatgactactccggtgagaattcggcctcggattgaaacatttccagtgaaagggcatttcttgtcaatgtatatgccctcaatagcctaaaaacattcttaaaatatgtactttaataagaattggaacaaaaactgttctttaggcaaatcagtaccccaaaccaagcaaatgaaaattcaaacctcacggggagttttaaagccaagcccaacattcttccaataacggtctttgttggccgccttctttccaattccttgagttctgaacttgtcgttcaagaacacggtcggctgtctttggtatgcgcgctcagtttgttcggtcattttcaatagaaaaagcaatgaaacttaaagttaaggtaaattagtcgtaaattaaatggagaaagtgcgagagtgctgaaagcactaagattttattttcctataaattttacaagggataaatagggcatctaaatctaaacatggattaaatgaaaagattatgttatggaaaggaatcgaactcaaactgatctccaaaaacataaattgtgagggacatacatttttgggcgctatatggaaagtgggcctttttgaaaattttttaaaaaggggggacccttttgttttgcaaaattttttttgtgatagtcataaaaatttgttctctggggtttttggggtccccgatcacgaatccagaaattattttgatcaattccgatttcctaatctaaatt

SEQ ID NO: 6757 - DNA, 1309 bp, Heterodera glycines
  misc_feature (1189)..(1189): n is a, c, g, or t
  misc_feature (1223)..(1223): n is a, c, g, or t
  misc_feature (1274)..(1274): n is a, c, g, or t
  misc_feature (1293)..(1293): n is a, c, g, or t
cccagcttcgtgttcttgataatgcaacatataattgtccatgtgaaaaaacgtctcttgttaaatcaattccaactttttcaaatgtttgtccttgcgcaccattaatagtcatacaaaatgctaattttaaaggatattgatggcgcttaagcacatagggaagttttttatcctcaatcaaagttattcttgggataaaatcgatttcacctgttctatcacccgtcaaaatcataacccttaacacattcttttcaatatcaagtatttgtaaacgtgttccattacataatcccatatttacatttaaatttcttattaattttgtaacacaatttattttaagcttaagctcatgatcaggaaggctatttgtttggagtttattgagtatttcaggaagaataggggcttccttgctttcggcttcatcaatacttttaaatacatattcctctccttgaaatttttctaaaatttgttcgttataaatgttaatttctctgttatacggtgctaaaatacaatgactacataatttagaaaattcttttgtattaattatttcgccaaagatctcttcaattaaatctttttctttgatatcacagacttctggaagaaaaatataattttgttcatttcttttaccatttcctatttctaaaagttgctcagaaaaatttagtgcttcagaatttgttcgtatattttgatttaaatgaaatactttaaaatgaatccataaatcacttttttgcaaacacaaatctaaaatttcttctttcgttgctttattttttataggtaagcattggcgaaagtctccacttaaaatcaaaatttttcctccaaaaataatatcattattatgtaattctcttaattttttgtcaattatttcaataacatatttaggtgccataggggcttcatcaaaaatgaacacatcagtatttcgaatttcaattgcttcattagaaccattttcaattgatgaataagaattgctatttaaatctaatggtaatttaaaacggttatgcacagttcgtccatttttaatagtgttgctgcaattccactaaaagccatgttcgtaacttttttaccaaaaccacgggctaagtgaaataaagcaatttgaacaaaagattttcccgtcccacctggtccatcaatgtanaaacaatttcctttatttttttcaggatggtcanaaacatttttaacgcaatcaaaaatttcttttttgttcctcattcattaangaatatttgtttaatgcanaagtgagttccttttt

SEQ ID NO: 6758 - DNA, 4889 bp, Heterodera glycines
  misc_feature (6)..(6): n is a, c, g, or t
  misc_feature (20)..(20): n is a, c, g, or t
  misc_feature (43)..(43): n is a, c, g, or t
  misc_feature (134)..(134): n is a, c, g, or t
tcattnaaggaatatttgtntaatgcaaaagtgagttcctttntagggttaattatttgttcttctgaaatatttcctattttttctgttatttttggcatatccgtaaagtcaagtaaacattttccatgatntaaaaggtttttatcaataagtgacaaagccatttgataagcagtattttcagaatgtaattttttaaggtcataacttaatgcgtctttatatttatcccataataagcctggtttttttggttcacagttaatgagaatatttgcaaaaagtgagcgaaggcctcttggaaatttaaattggctcgcttcgtttaaacatttatcccattctaagtcatctctagttaagcccaaagccaagcaggcatctgaatatgatgtgtattcagtttttaaatcttcaaagcctgtcgcatgtttatgaattaataaataacgtaaataatataattctttgttttttggatttatcgtatagattctcccaatcactttgtgtggaccttttcttggccacttccattttctatttttttttgtcaaaagtgcaatatgttggcatttcaatgtatttgaattttggagcagttggattttctttaaaaaaataaaataagcagttaatttactatctttttccatcgcttcttctatattatcgttgtttgcatcatggtcaaaataaattgtttgttcgttttctaaatgaacctcaagcctttctattgaatgagatttaccctgtaattcaaattttaacaaccgaaaacatgcttcaacagggcttaaataacgggcttccaagtattgaccaacttcatcatatttcaaaaatgttttttcaccgtttggctcttcttttacacattctactgttgctgcatcgtatcctttgtaaatatatttatagagatatttaacagcatttatttcagaacagatttcaacattaatatgtgattgaaaacgcaataataaatacggattgtaaggggctacattttgattagttaatcgttggcctttaacaaattcaaaatcaccattgttcgggcgtttatataaagcatacccatcttctcctaattgggtttcttctctaaattttttcggatatttaaatcgacatttttcattcctcatacatggagcatttttatttgattctccacacggcccatgcaacataaattttcttactaatgaccgcaaaataggttcttgttctttattcggaagatcagcacgtataaattgatcaatatcatttgtatttttaaatttgtcttttggatgtaaagtaattaagaaatgtaaatgcggtaaacctcttttttgaaattctataacccaagaataagcaacaactttaccaaaaatttcaccttttacaacttcctcaattaatttgtcagattttaacttaaaaattcttgctactatatccggcctgtcttctgctttttgattttttaataaacatttttttatatctgagtcttcgggattaattgtatatgttaaaaacaaatccggtttgccattttctccaacaattgccatagaatcaatgtaattttggtctttattccttggtccacccaaaaaagaagaaggtaaaatgacttgttttccaataactgctcctgtttgttcggatttgttaaaaaggtaatcttctaatcctttatagctacatgctcttaactctttttggtgtgttttaatgaaatttaatctatcccattcaacacgggccgcttggtctacgacccactgttgaaaaagcctctttgcaaaatgatgaggtaaaaaaaaattttccctgtaaaataatttaaattttataaaatcacaaaatgaaatttttttgcctttttgatcttttatatcgaaattccatcctttcgttcccaaaggatataacaaaggataaattaatggttcgacattggggtctaatgggtagatatttttcatttgcttactccccttttcgacaacaattatatttgctgctggtatctcatcgcttgcattggctactataattgcggccacttcgtttgattgttgaacattgtatcggtttggatcgaaaccgtttcgcaaactcattaacatttttacttcctgtttttcatttttatttctcactgttgacttgttttgttcatcgattacatttttcatcatttcgtaggctttagcgaacgggtatatttttctaagaattaattcgattttatctaatatatttatatttaaattatgcgaatgtaatcgaatgttttgtgcgtcatcattatccaaaaaatacaattgtccatttgtcggcaaaaatttttgttctgttggttgtgctactgcattatatttatgatagacttgccctgatattttaaaacaacttgggcctggagttgtaaaaccaaatctattgcaagctaaagaagcgcaagcgaatgaattattgtattttcttatattattcgtaaaatttttcgaagtttcattttcttctgtaaacaactgttttaattcaaatggatattcatcaaataattccaacaaattttttgattttccaaaattgcaacatgaatggaattcattcacttttgaatttttgattgattgctcttctataaaatgcactgccttgcaaaatatacattcaatgttaaactcttgtaaagagaatttttttacattgtttagttctgctgcacttttaaacaaaaaacccgtcggtatacgtttggtatttggttgagatttttgtgtttgagtggtttcgtttactccatctaaatcaatcatatccaggtttataacgctttccaggttcatatcttttccaattttctttctttttctttctatttcatcgctttctttaacttcttcaaaatcaatcatatccaaatttataacattttccaaattcatttcattcccaatgttctttttctcattcatatgcattctttcaaaagaatcaaacattgttcttgtccgcttttttccggagctttgaaccggtttaaccgcttttttagacgggagcttggaacccgtttggttttcagagatttctgaggaattattttgtaaagaagatgaagaacattgaagctcagagggaaataattgtttagttcgaaccattgcaaatctaaaaaataatttttgaatatatttttatagctattgagagcatttcataaaagattaaaaacaccttaaaaaattatgaaattcaaaaaaaattatatcaaaaaacgattaaaacaaaaataataatgaattattagaaaaaaatggacattcacaaaaatgtgataataatttaaaagaaaaatattaatgataaaaagttcctttaaaatgaaggacacacaaaggaaaagaaatccattcggaaggggaaacgaaaaaacaaatgatgaaatcaaaaacgtaaataacaaaataatgaagtgttctcttcccttcatacataatcttttattttatttttctcttcctttaaaacataacgccaaacaaactcaaaaacacaaaaaggggcggagcttcctctcacttagtatagagtaagggatactttcaaaaaacaaaatagaattcgacagatggtgccaaaaaactagcctaggcaaaatttcaagaaaagttacccacaggaaaaattttttcccagggcaaacatttcaataattttaattcttttttagccaagtccacaatttaaggccaaaccaaataaaatttacaatattctccagaattttctattaatgaaaaaataattctgccttcttctttaaaagaagaaattgaaattaacacacaacatagggaggacttgaacctgggaccccccttttggtgactaactcacagaccactaagacgaaaagaccaacttaattgtacttggagcccaaaattgaatcgccgtgtcgaatgttcctatgtacatacgttttcgatgttgctctgactcactattagttgagcagcaagctcaagctgaacatgcaaagaaattttataatattttaccaactatgctaaccaacagatatttttaagaatattccaggcttatgcgaggcgcctattaaaagttgttcaggtgcaaaattctttccaataattcacttaggaacgttttcatctcgttttcatgagtaagtacaagttttgatgctaattaatgaaggcatttttgaatttctaaaaaaggcaagatagtgataactttctcgcgggatatcatggtctttaatcacaatccaacatcaattttaccaattccaaatccttaactcaataaaaagttgaaataaatgcaagattcatgatcagcgaccccgaaagtccagggaccaaatttacataactaggcaacatcttacaatgcaaataaaagggtccatttttaaataaaattcaaaaagtgccttttttcatgacgttcaaatttttcttttatttaaattaagtttgtgataatttggctgagggcagagaaggtaaaacatgtgaaaatgagtaaattaaatgtaaaatttaggcgttgacattccagtgataaacaccgtcgatgacacagacataccttttgcatttcattacattgccaaaaacattgacaaagacccgcggaaaacagtataaacatttttatatgagagtccaaaattaattctgcacattgatttaggagggctgtaaatgtgtgggcgtatgtaagccgaaaacatgcgaatgtatgcagagaagcagcatcaaaataacgaaggtgcttccactatttttagttttcaaaattcatataaaggtaaagaagaccaaaagtat

SEQ ID NO: 6759 - DNA, 8473 bp, Heterodera glycines
aatcaccgattgatccacgacttcgccagcatttcctcgctcgtcagacggctgaagacgcaaaatcgagcaaaacagcaaaattattcgatgccattgtcgatgatttaaatacgctgttaaagacggaggctgaagcgaaaatcttggagcggccaaatttcaaaatcaatgctgttcaaacagtgacggccaatcatctccaaaaaacgcagcaaatggcaatcgatgcgacatcgcaatttttcgggcacttcggatggaaaatctcctcccaacaattgttttagagctgcactgggcgcaacaatgcccaaatcaaaaacaattgtgcagtaaatggaacaggaggggcacatcaaacaacaatgcgaccaaatccagggctagcatcaaaataagaggaaaattctccataaaatcagcatggtaaatctgcctgcggctttcaaaaatcaaggcaaattttcgaagcctttgaaagaaaaaccttggaaatacagcacagcggatgtcaatgtgatcaataaagctgcattcaaggcaatcggcctaccagaaattcaaaactcgaatgcaaatcaaattttctccaaaattctggccaagatttaaggacaaatcacagcgctattatgtgcaaataaaaggtgaggaagccgaaaagagtgaatgaaactttagacaaattcgtcctgcccttcgcaccccgccaattccaagaccaaatgatcatctgcgatcagaaccaaataaatcatcccatgtgtgatagatttcagggccgatcagtagacttaaaagtggaggtgttggggcgacccacatttcaaatattgttgtcattgggtccgtgttttaacggactaaatattgattttgctcctctcccatttggttcctccactcatttgcccaactcattctctttccaatttgccttcgcattgtcgccctcctattttgctccattcttccgaccaaatatttgtgctttatttttccattttcttcaataaaaaaaattttattgtgttttccacctgcacaacacaagcaaatgaatgcccccgagtacagtcgattgggggtgcaggactgaattccttttttgttgccgaaaatgggcagctaagttttattaaccgtttgcaggataaaatgccttttattaaagtctttgtggaacttttgcacggcaaaaattaagacaaggccttcctttttaatttgtgtatagttcctttctgccggagccaacaaatgcgacgcatgcgcgatggccttgatgcttgcactcgcataacgaagggagagctaagagaacatcggcttcgaaaaccttcgggttatttgggcgaacttcgtgcttcggataatttacccgaagattcgggaaaaacacccctaaagaacaagtttcattgtgaaaaatgcacctctaatgattagcttttggtaaaccttaatttaatatatttattattcgaattcgaactcagcaccccttttccaagaagcttttgctgcaacattttttgcttgatggccaaaatttctttgatggggccggctgttcgatgaatttcgctttaacaatggtcgacgaaacatttgaagacacggaattcgggtgcggagcagtccgacgcaaaacaaattgctgcagccaatcttaattgtgtgcttccatcgcccaattcaaacgagttatgcctgaaagggtcagggttttgattttcttggacaattgactgaagaagctgccgacggtcaaagccattttgtttgacaaattaaatttgagtttgacgaaatttattgttcatgaaaacaaacaacaaaatagcgcagaaaagtcgaacaatttcaaaataaaatagcttataattgtcgacggcgtcgccaatgttatgccggagataaaaagggaggaaccgaatgatatttataacaaatgaaatgggtcaagcgatgatgacgtgaaaaaagggaaagaatgttaatatatttaaatacgatcctaccaaatcatttcatggtttttttaacaaatgcacaaaaatgttgaagtttgtacctataatattgaacagcaaggtagggatattttggaacaatcattaattttgttcttctaatcttaaaaattttttgtatgtgttcatgtgaaagtattattgtgttcttccacttagaacacacaaagaaaagaaataaataatatttttattgattgtgtcgaagggcaaattgggaaatacaaaataaatgaatgatgaagggaaagaacaaagtggttgtgtccacttttatggaaccggagaacactgatcgctgctttcgctgtcatggtgttcacatgataaactttgggcaattttaaaaaacaatccactaaaagcagataaacatggccgtcttggcatgagcgggcaaaatcaatatgcacacgttgtagtggctgtttatttggtgaccatccttcctttgtgaattttatcactttttgtagactttcatctttttgagtcggtggcagtgacgggaagatgatcaatttgtgactgcaaaattgtcgatgaaacattcagattctgtgcaaatttttgctatcaaaatatcttcttctggtcgcggataattcgcgttatggtcgctccaattccatcttttgaagcatcagccgcgacgattatcggaagcgaggggtcgaagtgggttaaaagcagatctgacaacatgatgtcttttgctttttcaaagctttttgctggtcttcaccgcaattccaaagttgttctttccgcagaagttggtccagtggtgccctgagttcacgcacctttttgatgaacgactgtagtaagtaagggctccgagaaatgagcgaagaggcaattctgtctgtaagaatttgcatttttcaagttgaatgcgcaatccatatgctttgaagcgcgtaaaaaattggtggatggctgaaaagcgctcttcaagggttttggacgcgattatcccatcatccaaataagcaaatgctccaggaataccagcacatatttgagctgatttgacgccaaatggaagacgctggcactgaaaaaggacacgatgcgtgttcaaacgcagagctttttggattcgtcatccaattccatttgtagatatgcgtcttttaaatccaaatttctgaaaaatgcggcgccgcttaaggctgcgtaaatgtcatcgggttagagttgcgagtctcaatgtcggttggcaacaatttcggttagtcctaatttattccatgtttcaatgctaaagacttcgcctgagctccggtgtcgaccttcatctcggtttttgtgccgttgatttcgaccaaaattttccaccaccatccttgcgttgtgccaatttgtgaacatgttgctttgacttggaccgtgtggaatgaacggtgttggttctttggcgtgaatgccccttttcgctaatattaacaatgtggccttgttttaggcacttgtggcatgttgtttcacggaaacgacaatctgatctccagtgatcagtacccccacttgagccgcatggctggaacggttgtccacgatttgctttccatcctgtgacgggtttttgctgtgccgagtagttttgttgcacggcaatttggtcttgggttttgtttatcgccactgttgagggcgagttcggatggcatttgttggagatttcgtggaaacgagtgacaaagcactgtctttgacaatttgggtcgcttttaactcctcttccaactttttgattgtgactgtgaaccatttttctcagcttcaatcattttaagacatttctgcctcaaatcgtggtgctcatcccttagtgaaatcacaaaaaatcaggcatttaagctgttctttggtgaggcttaaattagcacgctcacatacgcgttgatttgagcaactaaagaacgtaagcattcatatcaacgaacgaaaaaagcgcgttccggcaaacaacgccttcaatttgtcgattgatcccgcccaagacgctttgtcgggcaactccgggctgattgtgtccctgtatttggtgtactcgtcgtagtcgaactttggcttgctcggttaagtctttaccgtccttttcaatgaatgtgccgaagcgtttgtgacacttcaaaagtttgaccattttcggggtcataaacaaacttgaaattctgctgtcgattgagatggccaaattcgttggcttatgcttgaagcggcgcttccttggagcaaagcggtcaagaattgctgaatttgctcggcgtccatcgtccgtcatttgaagttgatgaaagtccacaaaatccacacctagtggatgcttacaccgccttggtgataagcttgacgaatttgttgaaaaaccgcttcttgcggaacctccccttcttagatctattggtttttttgttgatttaaactgcttcttaacagacctcacaccgcctgggttctattggtttttgttgaatttgcagagtccaagtctcaatgatgaagaatggctgctgactgcgccaatttattgtgttcttccacttagaacatgtaagaaaagaaataaataatatttttattgattgggtcggagggcaaattgggaaatacaaaataaatgaatgatgaagggaaagaacaaaagtggggagaggtgtccatttttattgacgagggaaggacgggtggacacagaaataataaatacaataatcagatcgccaaaatgttcaagtttaaatcactatccaacaagtattattgaaaaaaaattttacctggataaggccccagggataggttaaatgacacgaaaatttttaacctatacttttaaaatgactatgttaaaatgagttttggaaattaaattacttagtatattaaaaaataccaaataaacaataaaaaagtcgagagcgtatttgaaaataacttttttaatataaattaaaatttataataatttttatcagacatttattccttaaattttgtccgatttattacctagttttttcaggaaaaaataatctgaaatttatataagaaaattccaataaaaaaatatttaaaaaatttttcagcgatttttttgaaaaaaacttcgaatagttttatcggttcataaaattgattgaacacaaaatggactaaattcattaatcagaaaactgagctaagggagctccatttttaactacgattaaggaggggggaaagtctaaagaaggaccaatcgaaattttaatagtaaaatcaaaattgtccggccaaacgcaccaccatgcctagccgtggcgaattgtgatggtggtgttcatcaccggctgaggacgagggcggtaagaaaacgtccgcggaagaagcgaaagcgtcgccaccgtagccaccaaccaacagcaacaggacgtcatcgtcactcgcgccgccggttaacgatcgaatagtgttgttgtctatggggaaaaggaacgtacgaattggaaagtaaatactaaatcggaactttcgaaatcttgttgtaaaaaagccataaacaagggtagaatttttcacatcccccaccacttatgaaagttggccaaaattacaaaactgatcattagggtcgcgacttttagtgacggagtcgccaaaatagtgatttctagtgaccgataatgacatcagaatcgaaaaattttaatgcagaaatgcgttttttgagctcctttcttcaaatcagttgagcaaaaaaaatagttaaaacctaaaattcacgtccctactgatcattcggtgctatgacgttagtcaaaaaccataataatgttcgttagtcaaaaaaccatcaaatgaaatattttgcggggcccaaacgtgcccgcacaactgaggtaaatcgatttaaacttttgatattattccatagccctaagtttctataattaaattcaagaaagttatgaccaaaaaaaattttaaaaactgagttttttaagtttctcacgtcataactagagaccggatttttatgtgctaaaaatcctgaaatatgtaataaaatatgtgctaaaaaatgctgaaatatgtgctaaaaacccccaaaaatgccaaaatatgtgctaaaatatgttttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattatgaaaaaagtcgatttttaggggtgtatttttcaattttcttgtatttttattgcaatttttctcaaaaatgccaaaatatgtgcaaaatatgtgccaaaccccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaaatccggtctctagtcataacattccaaatgaatgaatttttaaaacatttagggctatagatgatattaagagtttaaatttggctaatctccccggagcagtcccttccgtattgttccccatcccccgaatttttttaaaaggaaattcacatttattgttagaaattttcagaaaaaaattcgggaagggaggagggaaatgagctgttccctgccattccttggccactgtcggcggcggctgcactcactttgccaatttgtcaaaatgacgttgtagttcattgaagacactgccattccattgagcgagtcggtcagattttgagcaatctttttaaaaggacactttaaaaaaacaacaaaaataaattcaaatttatacttcagtgttgttgttggcggtcattttgcgcaccgctgccgccgacgtcgaatgctttttgccggctgcacgttgtgtagaagatgcataagcgtgtcgatgttgctggttgttgctgttggagttcgcactcaagccgccgctgccgcccgtacggcttgaacattgtgtggacgatgaaaagcctccgtcaccaaactaaatgagacaaattttgttcaacaaatccaaaattatacgtcaaaaattcactgtacaaaccttgaacatcttcaacgcctcgttgttcaaaattttgtagaaaatgtgtgccttttgaacatcttccgctatcaccaaacaaatgtccctgtaataaaatatatatttattttattttcccaaccagtaccctacgggcactgtaaaagatttttaattaattaaaaaaaaattgaaatagcttcgctatttaacactgtctctagagggcacttcgcgcaaaaaaactttaataaagggcaattggattttgtaatggccggcaatatcctttttctcttccgctttctcttcctctttccgcaaaattggccgatgacccctccccctcctcaaccccccagaccccttcgaaaaaattccggttgacctccccaccttattttcatgtgtgtccacccctcaccgattgtcaatggtccacgacgccttcatgtaggtgactgtcaacggatgtaccggtgccaccccggtggacgaggccgacgcctgtgcagcagcggcagcagtgccgacggtgccaccaccgccgccatgttggaccttcggtatgaagccggcacttgcgctggacgaggaatgcccgctgctgtcaagcccatcatcatcggccatgctgaacggtgttcgcttctgttaaaaacagaaaaataaaatttaaaaaaagtcacaaatagaaaaatcaaaatttatctatattttaaaagcatacgggttttttggtaaaatttaaacacaaaaagagcattgttgaggttttttaagaatggggcgcaaatgtccgaaaaaatccttacgaatggggctcaatgaccgaataaagccctaagaaatggggcaaaaatgtccgttgcgcaaatgctttgacacgcctcagggttagtcgaacgcaatgcattcattggtctcgccttttccccttctcgcgtcaatcatattgaccggcattctaaactgccctcgggcgtgtctaaattgcccacctccttggccaatttggccgtgtctgatgtcaaactcatttggtgccagaagccgaagatggatgtacagcagccctcggcgcacggctgctccatgtcggaactttacaaaataaaatttgttttttgagataaataatgacaaaa

SEQ ID NO: 6760 - DNA, 1186 bp, Heterodera glycines
tttagtccacatcgaggctcaaaacgggcgcttctcctttatggtttaaattttgttggccttacagagattagaagccttacaacagtgattagaagagttacaattagaagagttttataggtagaggagtaaatttcccatccgaaaatgatgctaattttgccgtaaatccttactatacagtcgacgaagaaagctatttacagcttttccgagaaaatttggtcaaaatattggaaaaggcgaaaaataattcggaaattgcacggaaaaagatggaaaaatggtacaatttacagccaaaagtgacaccaaacaaataccaagaaggcgaacgcgtcatggttaaatttccgggcacaaaccaacgatcgactcacaaaaagttgcgatggaatatatttggtccttatgaaattaccgaaatttcaaattcgtcggcaaaagttgtgccaatagacaaaaggaccgctgaacccttaagtgtgcctttagaacgattaattcatgcgcctaatggaatcccaaatatttgcacagctccgcgcggcagaaacgcttataaaaatgtaataaatgtgatggccatcttagaaattttggaatgtggaaattttgagaatgttgaggcggaaaatttagtggaaaattcgaattcatcagagacgatgaaaattttagttgccggtgatagaatggagattgacgaggcaaaaatcagctggacaagcacttgtgaaggcggagagcatgtgctctgcaaaaagctacttgccgcagatttggacccgattctcgacaagtcccaaggcatcggcgcgatgacaatccaaacgccgctccaagggctgctcactcttttcattctccgggcaaatatcgccatgtcagcgagcaaagaattgctcaaggtgttgttaaagtggaaaagaacggacggaataagtaaattgcaggcgattttaaattcggacccggacttcgaactgataaaatatgtcgaggagaggggagacgcaatccgatccggaagctgcccacgcaacgaagaagtcaaaacaatttggcaaaaatggacaaattgctgtgcgatggttcacggaaacctgaaaatgtccggctaacggtcgatcactttggaggcgccgatcgctctttcggaattgcctgaagcagacagagt

SEQ ID NO: 6761 - DNA, 5666 bp, Heterodera glycines
tttgcgtttgggtcatagcctgccgttgtgcttcgttcaattccgagggtttttgttatttcagcaacagttttgttaacaaattcgccgcctctatcagaatgaatttttttcgggtttccgaaaacgaggattaattgttcaacaaatgcttttgccactgactcaacgtttttgttcgggattgctgcagtaataagatatttggtgaaatggtccaccataactagtacatatttattcccccgttcggacatgccaatcgaaagaatgtccatgcaaactaattcgaatggttctgttgtaataattggccgtaattctggtgtgtttgaccgcgggtttcgcgtgtgggcgcaaattcggcattctaacacagctttaacacaatccgctcgcatgttcggccaaaaaatatttttcggagagctgggccaataacttttttgtgacttaaaatgggccggcgcatttttccttcatgccctttcagctatcaaatttttgccgatatttttgtggcacgaaaagccgaaaatttttccgaatttgcctcattaaaatacaaaagaccatttaacagcgaatatttttgaattgtgcccgagattcgttgcctatctttatgatcttctggcaatttgtgtttttccaggaaatcataaatatagtgcaattcgcttttccgtgtcgcttcaacccattcagcttttggtgttccatcatggatattgttttctccatcctttctgatgacaatttcactgatcacaacagaatcttcaacttcatctgacttcaggccaccagaccgcgaaagtacatcggcgataagacagagttgcctggaagcgaatttttgactatggtagttgggccattgaagaagtacgcgcagtcgttgtccatgaaaaaacgacattggtggaacaaccgagggtcgtaatcggcgactccactggtgcacaactctgtggtggagcaggaaaccaaatcccggcacatttcatcgggaccgtcaacggatcaattggcgatattattcgggcactggacaaggcggtgctgacttccaaagttgtggcggcactgatcattttgggacgggatgccatgctacgaggcgaaaccgtggcgcagatcgcagaagaatgtggacggattcgtgggatttgtgccaaattcaaacatgttcattttgtttggttgccaccaccgtacgtccgagagcagcacaacctgtacaatgaactcctgccgaccctggaaacagtcgctggtgaatggttcatcgcactgacgacgagcggaagaagcctggtggagatgtggcgttttggcgagacgttcgacatgacacggattcgttcggatgggaaaattttgtctgagggattgaaatgttttcgcgcttggatttttacccaaatcccaaacttccccgatgataatgctcttggtcttcgtcgttcatctcgctcaattccatctgtatctgatcacatctctgaattgtctctcagccattctcgcacttctcgatctcacccctatgctgttcgtcaccattatagctcgcaggctcacagaggcggaaacgagatgatcagccgtcgtcgtcattaagcagcacaaccttgaaccccaccgatcggtagccgaattgtttttgcttattttatttgttattgtaagccgaggggaccgtcttttctagtgggcggtgatgtgctaattgacttcatttcaattttaaattattaatttctgtggcgtttcgtatatttttaagagactcaatatattttgtgatgtttttggttgttttatgtagtttttaattttggagaagaaattgtgctgaatttattatttttgtttgtcgtcgtattttaactgtttggtataaatttatttgtgttttgttttgttttgtaaagacagatcgcagagaactgttgacaatcgccgttttgacatttgaattgggaaaagtggacgcaaacaagcttttgttttcaacttggcgctcctgcaacaaaaggttggcttgcttagtgacgactaaacggaaaacttttacgtcggccatataagttgcgataatcctcgtgttggattttggattttatcgacattatcatatatcgacattatcattttttctgtcctcgtgttggactcttcatgcatcccaccgaattataaagcactcgtgttgtgctcttcaagattctccaataaagcactcgtgttgtgctcttcaagattctccaataaagcactcgtgttgtgctcttcaagattctccaataaagcactcgtgttgtgctcttcaagattctccaataaaactcgtgttgttttaaaaagatgattaaccgctctccaccattcaccagacaacgagctcgagatgcggcggcattacagcaacagcaaaacggagttgtagggaatttaagcaggccgaataacaccgctaacacataaaatcgaaatgtttcgttgaataaccgggttgatggtgaacttttagagtcagaagaaagcatgggatccaacgaaattcgcaatgcgcttttggacgtcgcggcaccggatgaacagaatggccaacaagcagttcgaaatgaagcgggacgaggcggaggaaatttcgagcaacagcatgttgatggaggtttgcgaattcgattgcaaaacgttgggagaaataacggacaacaatggcaaattagaaacgaaaattcgaatgatggccatcgcattttacatcccgcgccgcaaaatgttagacctaggacttcaaccccatacgaaaatatgtttgaagagttgcgcgtagagcacaccgtagaatgcagaccgcacaatcaaaatttacaagcaaattttcaaaacatgttgaataatggtgtagctatgcagaaccaaagagttaccgcacccaccggtcttcagtcgcatcctcagcaaattcatccgcacccaattcaacaaacgcaaccacaacagccatcccaacccatgccagcccaaccagtttttcaacaaggatttcctgggtttatctggggttatccgggacaatttccttacggtccttatccaactgcttttggctaccctccacagcaaaattttggctatgtaaacccaaacctccaacaaccgccgatttttaatcagcaatttccgccaccagttttgcagcatgcaaattatgcaatgggtgtacctagccaacagcagccaattgtacaagcaaatcagcagagagaagttcttcaacctgttgcccagcagcaaaaccctccgattacaaaccgtccaaacaattttggtactcaaaatgcgggtgctgaaattcgtcaaactgaaaatgaaatccgtggtcccgggatggaccaagtcgcatatgctctgattatgagtcaaataccttatttaaagggaaatgaaggcgctgaaaaaattaaggagtttttcaagcgttttgacgctaataccgctgaatggtccaatgcaaaacgcattacctcattagaatcaaaactctttggtcgggctgagagagcttttaagtctgcgtgttccaccgaaccgtaccgatatgagtccataaaaagagaaatgtttcggcagttggaagaaacggatgcccgtgaatggagtgcttttgatcagataatgaccggtattcgacgaaaaaacgacgaggatttggacagtttggctgaacgtgtcatcaccctggtacgacgcgcatacccaggtttgactgatcacctggtcgatgattatgctatcaagcatttgattcgaacattcgacaattcggaattggcactcagtttggaattgggaaggacacccggaatgacatttgatcattttgtcgggatggcggcgagagcagaagcgactcaaagggcaacccgtcggatggcatcgcaaaatgctatacaaagagggaggcaaaatgaagcgaattcaacgggaggatttttcaacaattcgcaaacacagcaaacgaacgacaaccgcccaaaatgctacaattgtggaaaattgggccatgttgccagaaattgcttcaggcgtcaagccgaacaaaatggccaaatgcgaaacttcgaacatatcccaacgactggtgcaaactgtaccccaatgccgagtaacccaaatacgaattttatgagcaaacccgaacaaaatgctaatcagcaccgtcctcaacattttcaatcaagaaattttttgaaacaaaatttccttattgaaagaaaagaagtgaaagacaatgaggacgcggtcaaatgcacaggtgttctgaacaatgaacccgagatggaggaatttttcaaaagtttttgggaggagcacgaagacaattttgaagctgctggcaaaaaggaactgtgcctaatcggcaaaataatgacaacgaatgttacaatttttgatcagcccgctatttcgatgatggatggcggtgcacaagtttcacttattaaggcggagtttcttaaaaatattttggaaagtcagaaattggaaggcacaaatctcaaaatttggccgaaaacccggaatgtcgttgacattaatggaaagcgtgtcgagtgttatggaattattttgttgccagttgtgagaagaggttgtgaagcagttgaaattatgttccacattacggatgcgcctattggacatccaattttgtttggaacaaatgcacttgggctccttgggttcaaaatttttgatgctcccaacggcgaattagtggaatttgagtgtgtggacaacaagtctgattctatgcgtgtaatttacagtactttggttgaaccatattcaacaaaatttgttgaactttcaatttcgccggattttgacgacaaaaatgttttgatcactccaaaagaagagaatgacagaattagggttgagtcttctgtagataaaggcagaaagggaaaagtgattacggcaatcacaaatttttcacacaaagcagtaattttgaaacaaaacgaagaaattgctgcagttgaagagttgaagcaaattgccaatgctgacgattgcttgggacgcattgtgcgcaacagacccggaccaatgacctccaagaaacgcgtgttggggttgtgcgccgaatgcgacaaaccgatcactgccggcgctcgtcagatgcacatgttctaccaccttggcaaagacatgaatacttatcgtttccgttgcaaacatgcgggatgcaaagtgcaagactatcggaaggatcagatggaaaaccatcagtcgaaagcgcacggaaaagttgacgccgaaatgatggaagacagaagcatggaattgtacaacatggtccaagaaatgtcaatgcaattgctgggcaccaaaggaaacactcccggaccaactgcagtgaaagcgcaacagatttatgagcagcaaatgcgcgaaatggaggccaatttgggggtgagaaagcggcggaggcctgaatattttggctgcaatcttccatccgccaacatcaacaacaacgtcatctcccgctcttccggtctaccaatttacgactccgccaaccgccgagtggaggatttggaatgtcgtctgtgcaacaaattcatccttaatcgcat

SEQ ID NO: 6762 - DNA, 4575 bp, Heterodera glycines
gtgaaatcaaaatgatatagagtcttgcgccaaaatgtcctgcgccaaagtggccggttcccgactacatatgcccttaatagttaaggcaggaaattttatggtttacatttttttacaggagaaagaagttaagagagagaggaagatacttgactaaacggaaaatattccgccggtggaaacaatgaaatgaactttaatgaaagaaatgggggacaaaagcgggaccagcggggggacaaccacgtggtgggggggggggagaaaaatgtgacgtgatacgtaggggaaaaaagcaaaaattgagacagccatttcctaaaaaatttaaatttaactaaaaatcatccaaatttaatttcccaacgaactctataaatttgaattttataaaaggctaaggagggcgtttcgtaaaaattgccaagtttacagatttttctagtaaaactcatcataatttttcttaaacacaaccaaattaaatatttaattgatcttggattctattagcttgaaaattttcagaaagttttcactcagttttccgaaaattatagcaatttttgagcatttttggtcttgaaaaactgagtgaaattttctgaaattttttatgctaatggaacaaagcgctatcgaacgtatgataccaagattatctaataggttgggtttaaaaaaattatttataatgactagggctaggatttttatgttttaacatattttttttgcggcttagttatggcgagagaagcccaaaaatagcattttctccgaacaaattttggtttagagcgacttataaaaacataaaaacacatattttggcgttttggcacataaaatatgttagcacatattttggggtttggcacatattttgcacatattttggcatttttgagaaaaattgcaataaaaatacaagaaaattgaaaaatacacccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatcctagccctaataatgacgaaaaatctataaaattaagttttacaaaacgatttaacacggattaaaaattcagtatttaaggacatatttcttttcatgatggtcattttttgaacactttctaagcttgcataaaattgtaatttaaatttgttttccattattttattttcatttggtatgttttcggcaaaaataaaaacctaaattcatctaaaaaaatttcggggcctagaaaaatttccaaaaaattcaaatttaaaaatttcaatgtgatttttttgcatttttttacatttttttgcaagttaagcgacgacgacagaaggaatgttggtcaaagacgcacaagtgaagccggacatttcgaagccgcgctgggaccagtcgacgttcagtggtcgcgcacggcacttcttcaccgtggtcaacccactgaaccttttggcatcgaacaaccaattggaaaacagtcgcaaaatcgtcaccgattacgagtgggtgcccaaaataaatggcattaaaaacagtcgaaaatcgtcaccgattacgagtgggtgcccaaaataaatggcattaaaaacagtcgaaaatcgtcaccgattacgagtgggtgcccaaaataaatggcattaaaaacagtcgaaaatcgtcaccgattacgagtgggtgcccaaaataaatggcattaaaaacagtcgaaaatcgtcaccgattacgagtgggtgcccaaaataaatggcattaaaaacagtcgaaaatcgtcaccgattacgagtgggtggccaaaaatggcattaaaaacagtcgaaaatcgtcaccgattacgagtgggtgccaaaataaatggcattcttcttttttcaccatcagacaacagagtacagccaaattaccaatgttttaatacaggaaaacaatgaattcagaaatttcaattgggcttttgcgaatgggtctgtggggggacgcctaattttgcgaaggggtccgattttgttgaaaatcttattgaattttgagttttcatttgttaatccccatcttacttttttcagtggtgccctaaacagcaaagttccgcaaatctttttggttttgtgatttcgatgatttgaattccgtcttaaaaaaattttcaccgaaaactctgaaaatcatactggaaaacatgaattcaaaatttttctgtcgtgtcaaccctacctggaaaatttcgtttaaaatcctagtgaattttgagtgagccctgaaattctttgttttaacccattttttccaggacaggcaattactccgaggatttgtccgtcgatgagctttggcgtgccaaacatttgtacgactcggcattccatccagacactggtgaaaaggtgctgctgttaggacgaatgagtgcacgagtgccggtcgtcacattaatgtgcgttaagtcccccaacgaaattcttgaaaataaattttgaaaattttttcagccttggcggtatgctaactttctacaagtcagtacagtgctcttcatttatttacattcgttcaattttaaaaatttcaggtctgcccctgcagtttttggctggcaattcgtcaaccaggtggattaaaaaaaaatttcagaaaattttcatttttccatgattttttcagactttcaacgcaattactaattattccaaccgttcgggcgatgcgttgaacaactcgcaactgttgcaggcgtatctgatggccaccggtgggaaaaaaattttacctaggcctacccaaaaaccacaaattgaataaaaacgttcccaatttttaggcggtgcgacgggcgtagctctgggactaaatcgtgcagtaacggttcgaattctttaactctatcaacaaattttcagttttttctacttttccctaattttttttttttttttgcagaaattgccagcaatttggggtcgcctggtgccattcgccgccgttgcatttgcaaattgtgtcaacattccgatgatgcgacgaaagtgcgggaaaaaaatgatgatagatagagagatagatatatggcatttcttttggcgtattttaaataaggattgtgttgaatgattggtcggatctgattttctcaaaaaaagaatcggaatcgatgacctttttgattttcaaattaaaaaataacgcctaaaaaagtgcccccaatttttgcaacaaaaatttttggcctggaaaaaaagccaaatctacattcaaaaaaacattttacagggaattcatcgacggtgtccaagtggttgatgcaaatggtgtgccgttgggccaaagtcgcaaattggcatggatagcagttccgcaagtggtcttctgtcggattgctatggtcacgccggggatgggtgagagaatggcacaatttttatttccgaattccgttggcatcaatttgttttttttggactaaatctaccaaaattctgaatttttagccccaattaaataatttcccaattccgcagtttgcactccaatactgatcaatcgccttgatcagaagcaatggttccgcgcacgtccatggctttctccgttaattcaggccgcagtttgcggatttctgctcacttttacaataccattgggttgcgcagtgttcccacagcttagtccaatgaaggtgtaattgagaaatgaaaaaaaactaaatttttaatggattttcaggtggcgaagttggagcccgaattgcaggaacaaatccgtcagaaatttgtggccaaaaatgtgccagtgcctgaattggtctattacaacaagggcttgtgagaacagagattagagagtgccaattattgtgatataaatgctgtaaatatgtgataatcaactattatttatatactgttttttgtatacacataatattgattgtactctatcatatgaataagtatgtagttcgaattctctacttttttaccaataatttttctattttaaacatctttttgttgttgttgttgcagaaaatgcctccaatttggggtagtctgatgccgttcgccaccgttgcatttgcaaattgtgtcaacattccggtgatgcgacgaaagtgcgttaaatttgcaattagacaaacggaattaatggacttttttgatttcaaaaacaaattttgtgaaccaaaagtcaatagacatgtccaattaatgagaccatccacagtttcttaggccat

SEQ ID NO: 6763 - DNA, 1052 bp, Heterodera glycines
cgagcttcggctcgcttattatatagtaagggatagtgaggtcagagaatcaaacaagaaaaaaaacggaacgtaaagccataggaaaaattatgaggaaattaaacgtttatgaatttacagcaaatgatcgcatggatttaaagttaggttaggccactctctacacacatatttcgatcgcctcattgccccattcatctgacaatcgactgcaccaagtgtccgcccctctcggccccgcgagtggacgtcggcgttgtctgccactggtgtttcggcaccaccggcactgccccattgttgtccaaccgagcagccggcccatcgtacatttccgtccaataggcctgcgacaaaaaacaattttcaaatttatttgagaaaattccattttcagcccttgcactgaaattcccactccccccaaaaaaaaaacccacatggtccaggctgagcagtgcctgcatgatttggatctgattggtggcctccgtcatgtacgcggtgccctgttgctggtgtttgtcctgcaccgtcagcagccgcgagttggtgcccaccacagtcgggccgagcactttggccaaattggtcagcggcatctgtgagaaatgttaaagggatgggactttgtttgatttatgaaaatggggttgaaattgtttgcaaacacaaaattttacctgattttcgttggaatgcatcgccaccctttgccaatgcgcacataaaaaagccaactgaaatcgaagataagaaatgtttttttgtccaatttgtctccgtcttccactccaatcaccgtgtcccggtgtggcatcggcaattcctcaatgaacgtcttcagctgcgattcgtctccctcaatggccgccttcagaaattctctgtaggaggacagagggatgagtggctcctggcaaaatgaaataaagcattaaaaaatgaattaaattattaaagccatcccaaatttttgtggtttacctgcatcaaaaatatttaaaaatgccaaagtcgaaatttttttttcatttttcaaaaaccca

SEQ ID NO: 6764 - DNA, 4536 bp, Heterodera glycines
acagcaaatgatcgcatggatttaaagttaggttaggccactctctacacacacatttcgatcgcttccttgccccattcatctgacaatcgactgcaccaagtgtccgcccctctcggccccgcgggtggacgtcggcgttgtctgccattggtgtttcggcaccaccggcggcactgccccattgttgtccaaccgagcagccggcccatcgtacatttccgtccaataggcctggaacaataaacagttttcaaatttatttgagaaaattccattttcaacccttgcgctgaaattcccactcccttcccaaaaaaaaacccacatggtccaggctgagcagcgcctgcatgatttggatctgattggtggcctccgtcatgtacgcggtgccctgttgctggtgtttgtcctgcacggtcagcagccgcgagttggtgcccaccaccgttgggccgagcactttggccaaattggtcagcggcatctgtgagaaatgttaaagggatgggactttgtttgatttatgaaaatggggttgaaattgtctgcaaacccaaaattttacctgattttcgttggaatgcatcgccaccctttgccaatgcgcacataaaaaagccaactgaaatcgaagataagaaatgcttttttgtccaatttgtctccgtcttccactccaatcaccgtgtcccggtgtggcatcggcaattcctcaatgaacgtcttcagctgcgcttcgtctccctcaatggccgccttcaaaaattccctgtaggaggacagagggatgagtggctcctggcaaaatgaaataaagcattaaaaaatgaattaaattattaaaagccatccaaaatttttgtggtttacctgcatcaaaaaatattccaaaatgcaaaagtcgaaatttttttttccatttttcaaaaacccatcaaccaacccgacagtcgcgcaggaatttcttgatgtagccggtgatggtctccgagtcagtttggtccagtttgggcacgaatttcgagttgaattggtccttcaacttcttcacttcggagtcacaactaaaacaaaaaatatatatccaatttaattcaatttttgttggaaatcataaaaaattggtgagtcaaatacggtaacagtacgcaaaacacaccccggcactcggtacaacccgacggtgtcgaggaagccttgctcaagcgcgtacacgcaacggatgatttggccagggatacggggcggcagcaccggtgccaggtcgcccaacgttggccgatgtcgattgttgcagcgttgaggcgtcggcaccattggcacacacagcggcggtgccaactggcaacagtgctcatgaacctggagtttgcattctgccggaaggaaagcatggtaagcatgaaattttcggcattttcccctccccaaaaaaggctttttttcaaaatttcgcaaaatatatatatataatgcctccaccggaacaacggaagccgcgaatgccgagcccacgggcgcacacgccgcaacaggagaacgcggcactgaacaggttgctgacgggcacgtaagtgtgcacacattggttgatcggtttgcccttggtccaaccgcggccgacacacggacggggcggaccaaaatggctgaatttttggggacctggatttgcctttgtattcattcctacatgttcaatgtgctgatttgcttggccgacatcgctgccttatgctgctgttgttgttgttgcagattttcacttgtcggcggctcgtacacattcgactcggacattgaccggttcttcgtcagacggcccggcacagcctttgacggacgacttcgctaaacccaattaaatgccataaaaacaattaaaatggttttgtcacaatgcaccaaattttttgaatcttccccgtttgaacctgtcgctgttgttctccatcggattcggtgctttcgtcgactgcaaattttcgctgctcttcattaatttttacaatgcgacgcgaacgctttgacggtcccgccgcggaggactgcacaaatggcgaactcgagcgacgtttgcccttctgggtaatcctgtaaaatcaaaaattttcgaaaatttaaaaaaatatttagacctgccattactgcggaggacctcgggacgtattttttggtcgtcgttgcactgctggcgacccaccgcgttctgataaaaaattaatggatccaggcaatttgccaaaacaaaacctgcagttcgttgttcgccgcctggaaaacgcgctgatgttcctccagttcggcattcaacgagtcgactttggcacattttgccgccaaatcggcttggagttggcggaccatctccttgtttttgtccagtgccagttcgtaattcctgaaaattaaattgttgacaaatattattcccaagaaaattgtgttttcttacccaatttgacgcttcagtcgactgatttggtcaagcaaaccatggttttcttggactgaattgaatagaattcggcgtacttgttccagctgatccaagagatggatgacaactaaaaaatggtataaaaataatcaaaaaattaatgtaacacgaactgttcgggttgtacaccgttttatttccttgtttataaattcgggcccacaattccgacacgttcagtgtgtctgcttgcaatttgccttcttttccactcattaatcaattatgtatatgtatatatttagaggaagttagttttgctaaaattttagaaaaatttatttatatattagcctttttatagtttgtaatgcaacgtgggtggtaatggcaatggaaaaatcgattagcgcgtaaattaggggtcattaggagggaaagggaaggggcaaacacgaaacagaaacgatgccacgaaattatgctctcacaaatgtacagacaagaaaacggcactctccaatttttgaattcaaatttagcgcgctctctgctcttttgtcattttcccgaaacttacaaacaggcttatttttgtatttgtagcttctattgtggttcaagcccataggcatcgctcgactttagaattccataatattttcagaacttgaacaaattggtaagttttggtaaaaagcccctctccagagccttttacgacaaaaggacgacaacctccgcgccgacaaaagtaactgcgtataaaataggtaatatgcaacaaaatttcaacaaatttataataccgcaatcggtgggcgggccaacaaacaaaaacagaaaacaacaaaagcactgcgatggtggtccgtatcattggcactgtgccatatccatcagttcctccatcattcgtcatcctcctccccgtcgtcatccatggcttcttcctcttcttcgtcgtcatcctcctcctcttcatcttccatctcatcatcactttcctcccccagttcgacgtccccttcttcttcctcttcgtcctcatcgtccgtttcctcctcctcctcttggttcgtctccaacttttggcccaattccgccacaaatttatgcgccacttttttgtcaccgccccactgttggatggcaccgtgcatcttcagagaagtgcgcaattccttaatattccattattggtttattagtaaaatgcctccaaaattgcgcactttcattccttcgttggccaacagttccaccatcgtttgctcatccaaagaaccgacggctgtcgttgcgacggcttgtttgatgacgttctgtttgtattgagttgattacgatttgaaaacggcaacattttcccaccgtggacgattcagcaccgtcaattcggaagaaccagccgaggatgaacacaaatttggctaacaattgatgtgcctggaggggagggaaaaacatttggatgtaaatgaatgcgaaaggaaacttctattaaaaactaattaaagtccctaattatggatcgaaaaacttttcaataaaatcaaaataaaaagctgttttttgggggggggggaaagctgccaaaattggcacacatactcttttcctcgtaattgtgtcattctcattgtccgcaggaggagaaggttcgtctgcgattttcttgatgtacaaaggcactgcgcggaccaaatacgagccgatgtcgtccaaaactgttgcatagaatttgggtgactaaaaattgtaaaattatttaaattttgctccccctttactttacgtcttttctgctggtcaccaaagtgcgtgccatgttgaatgcttgatgctgaaaagcaaatgtacaaaaatgaatgttatggcacaatgccataagaatgcacccgccccagattcgttttacctttttatcgtcagacattttggcgtcgggcggtgaaagcgaaaatagtgggcaagaaatttctgacccagatattggtgggggaaaaaaaaaagtaaaattaaaaagcccacaattaggtaacaaaaattgaaaaatgtcggcattcttcccccatttttgtctttgc

SEQ ID NO: 6765 - DNA, 1580 bp, Heterodera glycines
ttaagcttgtgtttgatctgacctaattttctgaacaaaatttccaagaaaataattaaattagagaattttaagcattttgaataaacaatttctaaaatcttctactttcgatatattttaccatttatccaaattttattttttgccattttgtccatttttcataatttgattgttttttgtcgtccattttgctacttttcccccaattttcagccattgataatccgtcgctttttttgctgtccgccggcgccgcaatgaccggcttcgtcacctgtctgggcttgctccatctgatttttgtgctcaaatacatcaaagatgaacaaattcgcactgatctgtactggctggtgtttatgccatcggtgagcaattcattaattcattagtaattaatcaattaattaattattaattatggagtatctatttttttgacaattttgagacggaaggaatgaaattgaaacccatttaatgtaccacaaatctcagttcagtttagcaaaaacccattgctcgtttcctatggtctttaccattgtcgagattcaccccctccctaaatgttcccttttaattcattaattacttaattaccctctcccccccccctcttttcctctcaggtgatcgccgcttgtggcctcgtcggcatggttttgccgagggcggccattttcatgtacgcaattgcgctcgtctattacatgatctgcatttttgtactcgtctgtttgatgtgcacggtcagtccaattaaaaattcggcaaatgcaaatttagttcaaattttatgtttttataattcagctgaacggttcccgcaaagcgatgtgccgaaaactgatggccaagggcaagcgaatttcgattagagtttgcccgttgggctgctgtttgttctgcttcgacaaatttgagccgacagagtgcgtttggcggggggggggaaattggcaaaagggactgatcagagaatgtccaaatctcgacaatgtatgctgatcaatttccccaacatttgatcagaaaatgtcgaaactccacaaagtaatctaatcaaaaaatattcaaaaaggacattttgatctgctgatcagagataacgacaaaataagcagaagagatgaaaaatatttgttaacaaagcgaacaaacgcataaatgatctgatcaatgggataagattacagagagtcctctgcttatcaatgccccaaaaataattgctcttacaattgccgcttcattttgttcgaccagtcaaattaagctataaaactgatcaaaattgtccatctttttgctgaccattttctgatcattcgttttgaatacaacgaatttatgaaccaaaagccacgaaaaaacaaagttcaggaagaatttccgccgctttgaatggctcgtgttccaatcgccgattgtgcgcattctgctcgaaattctgaacatcaccgtgtttatggtgaataaacatcccaattaaaatcgaaatctaaataatacatataattaattaaacaaaattgacattttattaggagctgagcagtcgctccaatctg

SEQ ID NO: 6766 - DNA, 4313 bp, Heterodera glycines
  misc_feature (80)..(80): n is a, c, g, or t
attaggagctgagcagtcgctacaatctgttcttacagctgtccaattcgatcgacatcatctctctttttgtcggctcntacggctcctacataattgtgccaatcggcgcttcgctgctgcacgaatatcggcacgtttattttaaaaattaaatttttatatttttatatggaaaagcggcaaaatgtttgcaaattaattatcaatcaaatcccattcaattatttccgataaaaaggtaattaattttcaatgcaataatccgacacgattagtccgttattccgtcgcattattatttgacttacaaaaacccattcgcttatcccttggcattaattggataatccctcctcaaatcttcggaattagtaattaattacattttgaaaagcattgcttcttttggcttaaatttgtctttcgcttttcctccctccgaaaataattaaaatttatttttttaatttcagttttttgcttctgttccgtctcgtagacttctgccaattgttttggtccgtgcagaagttcatcgccgatttcatcggccccctcaatttgatcccgagtacggccgacgtttccacgccgttgccctcctcggcggtggcacaatgtgagcggtgaaagccccggcgggtgccaatcgcaaaaccccaaaaatccggcattttttggaaaatttatcaataaaaatgcactaaaacgaaaatttctcctctaagaatcgactttaaaaatatttaaaaagacacccttaaaaatcggcccaaaaattttcacaatatactcctatgaaatgaaaaaattttctcaaaattcactttcttggcaaatttttaattttaaaaattattttttaggtaaattattttgggttttttgaccttaaaatcccagtcctactcatttgcatctgcaacaagtgaataaaaattatttttgctcaatttttggctaaaaattatgtcactattcgtcactatttcgcactttttgccactattttgtcactattttggaagtagtcactattttagttaactattttgagatttctcgtcactaataaaagtcgcggccctacttatcacattatccgctgtaatcggcacactgagaaaaagccggctaaatgattttttggaaatgaatttaattagggaatgaattttattacacaaaaaattaaaaacatattcacaaaaagagttgactattttagaaatttttaatttttcttctctctgatattttgacaaaataaaaaattataaatttttgtttttaaataaatttattaattctgataaaatttagtaccctaattttttaaataatttccccccccccctcccctcagtttacatttgctttttgctctgtgccgagatgcttttcgcctctctgttggccaccgtttgctttcggccctcgcgctgtgccttttttgaccggcatcggagtgccaatgccattgcaaatgcaaattccctcgaggagtgtgccgtggatggcggtgcccattcggtcgcctctctcagcgcctgcggcggtgccgaggacggagacgagtcgcgcaacacatcggtggagtcaatccattgtcggtggcgaaactttgatggggacgaaaatggggacgaagcgattagagggggaaaagggcaaagaatggcaaacgaatggcacggcaaaacggcggacagagagcaaaagtattgatcagagaatgaatggggcggacgattgattgatcagcagcaaagagtgattggaaagaggcagcagcagcagaaggatcgaagaaactcagcgattggaaacaaaaaaagtgatcggaaaaagtgatcgggtagattttgacgaaaattgataggaaaattgctcaaaatgaaatgccaaaatttgatcaacgagtgatcgctcgaagttttgaccaaagtaatttaacaaggccattaatttttgtgttaaatttcccataaaaatacttaaaaattaattccaatttttagatatttttgcacaaaaatttgctcaaattaaaaaggccattatttattttagaattttccaaattaatttttctttttgctttactttctcacataatatttatgtgtttgaattaatattttaaattaacattttttcattggatgttaatgttttgcttgtattagtctcggttataaatgtttattttgatgaattttgatggcaaatttatgccattgccaaccaaagccaaagccaatcaatttgttgtcgttttattccattttcatggaaaattctccaattatcgatgtctattattaaaagcaaaatattttttgtcgaaactttaaaaaattttaaaattatttaaaaactttactttcattttttggactgtgaatttttacggttcttaataaaaaaaagcatgtcatttttggcatttgccttttcatttgttgaaaattatgaaattttgcagaatcaataaaatcaaaaaaattaataaaatatagaatttttgttaaaaataaaacatttacttatgttattatatattttttttgttaatttcctttttccatttaatttaatttttaaataattttattattacaattttaattcatcatttatattcaaattttatgttaaattcaatttccattttctgttttttctaaaattgtaattcgaaattaaatttccccgttttttcataattagtttgataattaatttaaatcatcggcactttttgttcccccaaaatgccatcgtcgtcctccacccttttgtttctgttactgctccaatttgccgttatcctccgctgtaatttcgtcgcccgtccgtcgtcggcgccgcccgacttccgcgacgcgcggagcatcgtccgctcggagggcgaatggacgcggcgaatgggcgaggaatttgtacggcacaacgttttgccgttcatccgccaattccgacggcagctgaaaccgccgcggaaccttgtgagaaaaaattaataattttaaataataaaaatttaattaaaaatttaaaaatataaaaataattaaaataaaaattaaaattaaattataaaacatttactaaaaacaaaaaattgtactgtaattataatccaagagcataaaatcctaaaaataggttttaaattatttttaaatgaatttgaaaatgcatttaattaatttgcagcaatgggcgcccggcgctggcaatttgttgccatttggcccaaatcagcggaacaatcgcaacagtgccaaatggggcgacgatgaaagcgtacaattcacgcacgtcgatttggacccggcggagcagcgaaaataccgaaaaagtgaggaaaaaactaaaaaatggataccattttaaacattttttattcgtctgtttaccgatcgatggccaaactgattggaactcaactgatcacacttaaatagaatacaaattactaattaatcagttccaacattcatttaatcactggtcctttttcgtcaaatcagtttattgtgtccatttttgagcaccttttttcgctcctatttaatcacttcgtccttgatcacttttaccatttactcactgctttttgatcatttatttgtgtgtctttttggccacagttttcccattttctgccgcttcatttgatcactttcttttccttctgatcatctgatcattcttttgatcactctctctctctccccttctcttttagaccattctgtcgcctcattgttcgacttgggcggtctggtcgcgcgcgaactgtggaaacagacgaagcaccggtgcatccattgcgagaacggcgcctgcgagttggcggacccgcagtgcggctttccgtaccaggtgggcacaaaatcatgaaaatcgcggccggatcagtcaccagcagagggtttacccatgaaatatcgagaaaaaaccctcaaatctcgagtctcgctgagttttagttgatgggaagtcttgcgatttaaatacgttctcaaaaaaatatataagggaaaaaaaaaatatttttttttttacacctaaagtcctatccatattgttcctgaatgatattttctttttgtttatgcttaatctttttatttggacaattctaatttcaatttttcttttaattttaactctatttcttttttttttttaaaagaaaaaaattttttaattttttttaattaaagtatcctgtcaactattaagaaaataattaatttaattaaagtatcctgtcaactatcaagaaataattaaat

SEQ ID NO: 6767 - DNA, 1783 bp, Heterodera glycines
  misc_feature (85)..(85): n is a, c, g, or t
  misc_feature (113)..(113): n is a, c, g, or t
  misc_feature (1745)..(1745): n is a, c, g, or t
tgcatccatgcgagacggcgcctgcgagtggcgacccgcagtgcggcttccgtaccaggtgggcacaaaatcatgaaaatcgcgnccggatcagtcaccagcagagggttacnccatgaaatatcgagaaaaaaccctcaaatctcgagtctcgctgagttttagttgatgggaagtcttgcgatttaaatacgttctcaaatttttaaatatataaagaaagagagagcttcctagatccaggcctggattttcctgggttttgtccagaaaatacaggttcaggtccaacagggaagcaatccatgttcaggctttttcgaaagtcgaactctaaaaaggtataaaattcattttcaaatggacataaaagtgagaaaattcaaaacatttaaatcttagagatcacattagccaaccatttctaagcctcaatctcgagtcttggttttaaaaatgaatcatttcgagtcgagactttgagacgaggaccaaaaaaacagaatgagacttggcccccaaagactcgagaccgaaattctggaacgacaataacattttgttgaacagtttcaatttgatggcttcagtttcaacttttaaaatatttttttcaattttctaaactttaaattgtcaaaaaattcagcttttcgatgaacgagtcgaacaaatttattgtgaattgacgctgcaaaagaaaaggcgaaaaagtccggcgaaaaagccgccactgaaagcgaaaatgaaatgcgcaacgtaattaaaaaagcggataatgaacgaattaaaaatgaaaagcgaggatcacaataattaaacaaaataattacctcctgattacctaattaagcgtaattaggtttcccccgacgccgtccctgcccaacacattgttgacgaccggttaccaaaagaatgggaaattgatgtgcgtcaactgcacatttccccatcagtcggacgtggacacggattacgatagcgacaattacggtatggtagagcaaagcaacggccaaaattgggcggagacgacaccgatgatgagcagtaatgggatggtgggctacggtaacggtggcaaccgtaatttcaataatgtgggcggaagagagtgggacgaccgcggaagagagtgggaggatggcagaggagggagagagtgtgcaaacggaggagtggcgagatggagagacgggcagagagtgtgcgaaggggcggagagtggaagagaaagaaacggaaagcgaaacgacagaaacattaatggggacagaggaaaccaaaacggaatggacaattttgcatatgataacccgtattatggtggaggagggaacggattgtttgatgagggcggcgaaaatcaaaggaattattacgacggaaatgccaatgccgtaaataatttcaacgcaaaggcaaaaaggtatgaagcgattggggaggattttaagggaaactaattaaaaccaaatcaattaaatacatttatttgcctgccaaaaatcgaaaaaattctctaagccaaaaaaggttatggcattccgggccaaaaagacagagaaagtcaaatcgctcggcgccaaaacgggcggcgcaaaattgggcgatttttaattgaaattccggggcgaacccaaaaaattttcgagtatttttatattccgtttcgagtttcagggttcatggcaactcgtattttacgaaacaaagcctacgctttaagccgaagcctaggnctaagcctatgcctagcctaatcctaggctaacctcag

SEQ ID NO: 6768 - DNA, 4778 bp, Heterodera glycines
  misc_feature (9)..(9): n is a, c, g, or t
taggatcanctgaaagaacctgctcataaccgagctatgctatcagcattaaactaacaaacgcttattatttgcttttgatttttaaagaacctgctcatactggaggttgtgtgttctttattacattactaaccaacgcttattgtatttttgctttatagtcttataaagaacctgctcctatcggagatagtgttttctttgtttatttgtaaccagtgctttatatgtgctttgtgctttttcaagaacctgctcataatggagattgtgtgttctttattacattactaaccaacgcttattgtatttttgctttataatcttataaagaacctgctcctaccggagatagtgttttctttgtttatttttaacccatgctttatatgtgcttgtgttttttaaagaatctactcatattggagattgtggattctttattatactactaaccaacgctattatttgcttttttattatgaataactctcataatggaaatggtttgtctgtggccaatacagcctgcctaccctcatgggattttgggcactcagactggcctctttaagtattggtcaatctttacactttccatatctgcactcaatgtcctttttggcaaaataggataggtgagccctgactgatagatttcggcaacggctacacttatggtaattgagaacccacatcatttttcacgtttttaggtcatttgtataaatatttgatatttgcacattcattggtttaattccttcatatttttgtcgcaaccactttttcacgttgattttttgatttaagatgccttctaagcaacaaatgctgaagaagagaaagaaagaagagcacctgcggcgggcggagcaatctgtcagtccaggtcgctcacctatcccaaattgccctcctcagggcaatcaaaattgtcctcttcaggacaacccattgagtgcagatgggaatggggcggcatcaccccggggttttaataccccaaatataagtgctttgcaattgagcaccccggcctcttccattggaagcagaaggggcatacccccaaaagccggaacggagtcaataacgacttcgcaaaacagtgtgtcgtcagctggcacacaaaacacatcggccactcaaaatgttgagtcgccgccaaacagtaaaaaattgaaggtcgaagatgttgatcgaccactgtctgttattgaagcaattacttcaacgcctgtttccacacaaaaaagccgtggtgggcggccggccaaaaaaagaggcggcccaggcaggggcaaaacaaatgattcaatgagcgaaagcttttcaatggatcagggctctgaagctggcataaatgcggcggttttacccaatgtgcctgaaaaaataaatttcagcacagtgcaaattaatttcgcaaccacgcggaatttagcctgtaaaatttggaaatggggagcaactgctctttacgaatgcgatgcaagaaggtcaggcccaagattcattgaaacgtgctggaatgatctggcacagtttctgaatgacgcctttattgtcgaatatttggcatacttggcaagcatatcacaacgaaaagtggtcattgttgatccagctgtgtggcaaatgggcattgaccgtgtcattgaatataaaaatatgacatttgggtatgaccctaatgttccggccgaagtcatacttttgccagtacattttcctggacactggactctcattgtccatgatgtgcaatatggtacacattttgccgattctttgcctaccccatatggaaggttggatccgcaactgacggataaaattagaaagatcatttctgacattttgccgtcaacagtgctgaccggtattgttaatgccgtaaatcttacagtacaacatgatggaaacagctgcgggtacttcgtgtgcctgtatgctgaatcatggcttatgaacaatcgcacgtttgttctgccagacttatccatcaattatgaaaagaagcgtattttatggcacattaacgagctgtatggctctgataatgtgccatatcatccaagggaaggggtgccaactccttgcccaattgtctatcgacatacggatgaagcgcagtcgaaatccaaggccgctgagccaatggaaattgatgagcatgatgacataatgatcatcgaaccacagacaagtggacaggctgctaatgccattctcacccaagcccaagtggatggtgaaaaccaagtcgacacgcttggtttggtttcggagtcttgtgttccgcaagagccaattgctcaggctgacgatgcaatatttgtcagaccgaagacgcctccgaggcgatcaacgcgcataggcagacggcaatccacttcgattagccgttctccttctcccgcaccgagacgtcgctcatcaacaaatcctgttgagaaagtcacagcatttacgaagcgttgctaccttgtccacaagggttggtgctgtgctgccgcagcagcaaaacattttccggaatactccgattcaggtaaacttggcgaaaaaaagtgcgctcattgtggggcactgctcttcccgcatgaggacagcagccattgctgtcgacagggaagggttgttttgccaaagcttaacccgcacccaaaagagcttgaagagctcatcgtgtgcgacaaacaaccccgccaagggaaggagtttgttcggaatatgtcgcgttacaacaatttgctccaatttgcgagtgtttcggcaggaaataagccttgccctgcaggcggacccatggcagtaattctcaacggagaattccatcgccgcataagcagcatgcaggctggcacgacccagattcctggcttcggtcagttatacattctggatccagtcgaagccatggagcagcgacgaaaaaatcccaccttcacgggagagaaaatcacaaacgataaagagtttgtgcagggtcatcagcttaatgatgagacccttgaaattttggaacaaatgatccaagaaaatcatccagctgcttctgcttataagcaggctcgtgaacagctccatgagttgttaagacaacaaaggactgaagagcttcggttcttcagaatgactttgttgaacgagcgctcagctccgggtggtatgaaagacccaaagttgcatccccaccagataatcaccccatcaacgggtgaagggatgtttgcaattcatgcagatcctactggtgccccggcacctaaagggatatgggtcgaaaacaagcaagggcagttaaacgaaatagccccgttcagtccatggactgatagcttgacttatccattaattaagcctaagggcgatgatggatatcacattggtattccatatgccaaacccgcacaaaaaaagcggagaagcgatcaatgtgtcgatcaaatgtttgacactgatgcaatgtccgacgatggctcatgcgagactgagtcaattgctgcatcagatgctgagtcggtcgcatcgaccgaatcattgattgatcgcattgataagacgagaaaattcatttctctgcgagattactgcaagtaccatctcgcaataagggatgaaaatttggagtggcaatatcaccacattctgtcatgtggcggtggtcttggccagcgctgggtcttagaccaagcggccaaaattgattggcaaattgccagttttttgcgccgtccagacatggacctgcgcataagtactccaaaaaatttgttgcattatttggtaaaccaatacaataagcagcaagctcggcaaaaccctaatgcacgacaaaagactgtcgatgacattggtagtgttgttcgcctttctgaaaagaatattaattctcttcagtattggaaaaaaaggtatgaagactgcaacaccatttttgcgcgttgccacgacgcaaaaaaggcgcggctcttcatcacattcacgaacaaccgtgagtggccagagttcaagcaaaacatttacaaaaatggtcaaatgttcactgaccgttttgacatgtggatgcgagtgtggtgcggcaaaattgctgtcttccaccaagagctctacgagaagggtttctttgggactatccttggctcaggagagtccatggagttccaggggcgtggtggcccacacgcacacattgtagcccagactgacctggacgcagttccagaagtcatccaggaatacatatgggctcatattccatctttgccgtgcaaagacgatgactcacccatagcgcaaatgcatcgcgaagtccgcgaactaatgcatatgcaactgcacagatgcagtgatagttggtgtggtccacgtgaccccaactttgggcggtgtaaaaagggcttcccagccccgtactcgaaatgtacgatactacacccggacaggcccgcattgtattaccggcctagcccaaccgacggtggtgcccaaattgaggtgaacggcttaatatacgacaactcgcaagtcgtgccgtacaacccatacattttgctgcgttaccgagtacaccacaacgtgttattcgcatacggtaacaaagcgaacatcaaatatgcactcaaataccctttcaaagggcctggacattgttatgtcgagtgcaaagaggagtccggcagcaaaatcggtatcgatgagccggctcaatatgccaaaatgaaaaagggtggtgctacggaagcttttgcagttgtgcattcaat

SEQ ID NO: 6769 - DNA, 2749 bp, Heterodera glycines
tatccattaattaagcctaagggcgacgatggatacaaatttggcattccatatgccaaacccgcacaaaaaaagaggagaagtgatcaatgtgtcgagcaaatgtttgaaactgatgccatgtctgatgatgactcatgcgagactgagtcaattgctgcatcagatgatgaatcggtcgcatcgaccgaatcattgattgatcgcattgataagacgagaaaattcatttctctgcgcgattattgcaagtaccatctcgcaataagggatgaaaatttggagttgcaataccaccacattctgtcatgtggaggtggccttggacagcgctgggtcctagaccaagcgtcaaaaattgactggcaaattgccacttttttgcgccgaccagacatggacctgcgcgtaagcactccaaaaaatttgctgcagtatttggtgaaccattacaataagcagcaagctcggcaaaaccccaatgcacgacagatgactgtcgatgacattggcagtgttgttcgtctttctgaaaagaatgtaaattctcttcagtattggaaaaaaatgtatgaagactgcaacaccatttttgcgcgttgccacgacgcaaaaaaggcacggctcttcattacattcacgaacaaccgtgagtggccagagttcaaggagaacatttacaaaaacggtcaaatgttcaccgaccgctttgacatgtggatgcgtgtgtggtccagcaaaattgctgttttccaccaggagctctatgaaaagagtttcttcggaacaatccttggctcaggcgagtcaatggagttccaagggcgtggtggcccacacgcacacattgtagcccagacggacctggacgcagtcccagaagtcatccaggaatacatatgggctcatattccacctttgccagacaaaggcgatgactccccaattgcacaaatgcatcgcgaaatccgcgaattgatgcatatgcaactgcacagatgcagtgatagttggtgcggtccacgtgaccccaactttgggcggtgtaaaaagggcttcccagccccgtactcgaaatgtacgattctgcacccagacaggcccgcgttgtattaccggcctagcccaaccgatggtggtgcccaaattgaagtgaacggcttaatatacgacaactcacaggtcgtgccgtacaacccatacattttgctgcgttaccgagtgcaccataatgtactatttgcgtacggtaacaaggcaaatataaaatatgcacttaaataccctttcaaagggcctggacattgttatgtcgagtgcaaagaggagtccggcagcaaaatcggtatcgatgagccggcccaatatgccaaaatgaacttccgtggagctacagaagcttttgcagttgtgcattcaatgccgtttgcaaagctttcccaccatgttgttcatttgtcaattcatttgccaaaccagcagcccgttgtatacagggcattccaactggtgagcaaagctgaggaaattcagcgaggcgaactcccagagacgccatgctctgcctattggaagcaatggcaaaacgaatggcagcatgttccttcgctcaaggacatgctttttgaaaaagtcccagagcaatttcgatgggcaaaagaccgatgggttccatataaaaagaagcctaccaagaggcccccaatcggtcgtgttgtacctgtccctccaacggaccgggaaagatttgcactttatgtgttgatgacgcactttcccggcgatccgtaccacttaaaactggtcaatgggcagcagtgcaacaccttcacagaggccgctctacagcatgggcttcttgaagatgaccaaatttggcacaaaacgctcagcgaagcatccttgcatcgctggccggaccagatgagatttctctttgtgagcatcctcgtctttgggcagccgagcaatgccctagaattgtggaacaagtacaaagaccaaatgtacaatccacagggcatcaccagtgcggctatacgccaagcacgcgagcagcaagccttagccgacattgattggcgattgcactactttaatttaagctgcgtgcactgtggtctcccagatccaccaaattcaatagccaaaaataccaatttggcagttgaagaatttttctttggtgatgatgatctgaatacgccgcctggccagccaaaccaaaggccacaacaataccccccacctccactcaacagcgaccagcaaaaggtctttaatgctgttgtgagggcaataaagtctgacccgaaggaccagactgtgcctcgccgtttcttcattttcggcgatggaggtacaggaaaaacattcctgtttggccaaattatcaagcgcttgcgaaagcccccatacacctataaagtgcttgctacagcatccactgggtgtgcggctatcttgctgccatatgggaaaacagcccattcaacgttccgtctcggcagagaagtctcgctagacaagcttccaagcattccgcttgagagcttctttgcccgacggatacgtgaggcccaactcatcatcattgatgagatcaccatgcttcacaacacggtgatagaggtcatcgaccgggtgtgcaaagaaatggcagttcgccagcacaaggacctcctcttcggaggaaaaacggtcattttcagcggtgacttcaaacagtcactgccggtcgtgcctcacg

SEQ ID NO: 6770 - DNA, 3376 bp, Heterodera glycines
  misc_feature (3227)..(3227): n is a, c, g, or t
ataacagattgaagccactgctgaattatggtgagccaactcgttaaaataattaacccatcgaataacaaaaaggaaacacccgttcttggaacttccctcgaacaattttccgatatatttaatttcatatatacattaatcaaaacaaatctttttaattttttaactatactttttactttgattgtgatcataacatttataatttgtatatgtccaatgatttacccacttctttttaaatactttcctttccgtcgcgggaatgtcgcgactacgcgaaataggatttttaatttaaaaaataaaaacattaaaaacaaaaaacatttaaattaattttaaattagacagataaatattaattaattaaatgtgaacaaaatgaaggaatgagagaagggaagtcatattagtcacaattttttctatccgaaaaattatcaaatgttaaaatttaattatgaataattggaacgttaaaagaaataacagattttaaacaaatgttaaaatgagacaaaatgtgaatgatattaaagaaatagtaaaatgttagaaaatcggaaaaggctaaagtggcacaaactggaaaatgagaaaaggttagtaaaattggcaaatgttagggacagaaatttggacatgccaagttggcaaacaattgttcaagcagaaactgccggtataaaaggaggccacaaaccccccaccaatcagtacaccaacggtttctgagaggcattgcctcgtcctccttttcctccctccccttccccccgtgccgacaacagccgccgacaactgcgccgcccgtccgttcgtgccgtcgactcttggccctgtccgttcgtgcgccgactgttctgtgccatgccaatccgtgccctgccgtgcccgactaccgccttgacacaccgcccgctcaattccgcccgttccgtgccgttgacgtgtgccgagccgaccactcccgttccgtccccaaattgtgccgtcctccgatttgtgccgttttccccatttcaatgccgtttcattttctccacatttcccccatttttgtgccgttccccattttgtgccgtcccccatttttgtgctgtcccctttttgtgccgttccccattttgtgccgtcccccattattgtgccgtccccatttctgtgccgtcccccatttctgtgccgttccccatttttcccccattttgtgccgttcccccatttcccccttcggtttaattacccaagtttgaggactccaataaagtgtattttgaatcgctttcccgcctcacttgacccccagcaattccaccatccccgatcgaccgtcaagcgtccacccccaatcgccccagctctcgccaaatccgggccgttgccagccaacaaactcccattcagtaccggccgctcaatctccgaccgactccccgactcgccctcttcatcccgtcccccccatttgtccatcaccgattgcggaaaggacaaagtggtgcacgacgacccgggacgacgccctgtgcacaacgacgacccggcattcgacaacaaatcgtcaaatccctcaaacagcgaaaactcttcgtcccgcagccaatcttcaaaagtgagaaatcttcaaaagtttttgcttcaaaagggtaaccaatccccacactcaaagacaaaaaagtttttaaagggataaaaccctaacctaccaaaacacacacaaaacagtcatttttctcgaacaaaaaccgacaaacacacccaaaatcccattacaaatcaatcaatacccatcccattcagtgaaaagaacaacccgatcggcatctcgcgcaccgacaaacccaaacgaagttgaagaaaaagaaaagaaagagcattttcggaccgaccaacccaaaagaaacggagacgaaaccaagcaaatcctcagacggacaacagtgataaaagtgaccactgtgatcaaaaatttctaaactgtgatcaaacccaatttaattttgtgataattgtttacctcaataaaatattaactgattaaatcgcagaagggaataaattggccaaccaaaattaagaaacaacacaaatcatttttaaaggaaaaaatgtctggttttatcaggagcaaaatccctctcctcaatcgagtgctaagaaaagaaatccagtcgaccaaaacaaaaatcgaggaaaacaaattcgaatttgaccaaaataatctggacgaatgcacacgggtgttcaataaaacaaaggaaattatacaaaaaattgagccaaactttgaaaaattaaaaactttgcataaaaaatggcaaaatttgatgagaaaaatggacaaagaacagtggaacaccgaatggaaaatccagaaaatttttcgcgaaaaacatgattatttaaagacaattaaggaaacagacgaaatcctcgacactctgaaagacataaatttggaggtaaaaagaagactcaaagtaatcaaagcaaaaccctcttcagacactgaccaagaggatgaatcaaatgatgatgaagaagaaaacgaagacgaagaaattgaagaagaagatgaagaagaaaaagaatacgacagtgaccaggaagacgattcaccggaattgacctcaaatgatcaaacaaaccgtaaacaaacaccttttgtcaattatcgatcgagaataaaacttccaccccaaactctgacacacttctccggaaaattctcccaatggcccagcttttgggacgatttcaaatcctcagtccacaatgacccaaacttagagaacatacaaaaactgaaatacttgcgaggactcttacatgacgaaccataccgaattgtgtccccttaccccctcacaaacaaaaattatcccctaatcatcaaattactcaaatcccgatacggtaatccacaattgatcagagaaaatctgcacagcgaattaagaaatttaagaaaaccaaatgaatccacaagcgaactgagacgatttatcctattcattgaccgaattatcctacaattacaatcccaaggcgaagaaataaaccatccccaaatcaagcaatccattgagactaaactccccttcaatatccgactaaaactgagagaaaaattcaaactctactcgacaaaagaattaatgaattttctcaattcacacactcaagctcgtgaagacatagaacgaatggaagattcnaacagacaaataagaaatttcccccctcaccggccacctcaaaacagaccacaaaggcaatcataccccaactatccccaaccccagctaaaagcaaaacaccgaaaacatcaaaatatacctctctcgccctatcccattacttctgc

SEQ ID NO: 6771 - DNA, 3170 bp, Heterodera glycines
  misc_feature (267)..(267): n is a, c, g, or t
cttttttgaaaaaccccgccgttcaacccttcgcccccgggctccctttgaaagtaaccccggccccaaaccccaaaaacttcccaaaaaagggtccccaagctcaagactcgaaaattagggataatttcccccccaattcaaaaaaaccacccacacaacacacaaacaaatcacaattcagtgagaaaggaccaccccacccgcatcccgcgcaaagagtgaaaaaccaaaagaaaagaaagagcattttcggaccgaccaacncaaaagaaacggagacgaaaccaagcaaatcctcagacagacaacagtaataaaagtgaccactgtgatcaaaaatttctaaactgtgatcaaacccaatttaattttgtgataattgtttacctcaataaaatattaactgattacaatcgcagaagggaataaattggccaaccaaaattaagaaacaacacaaatcatttttaaaggaaaaaatgtctggttttatcaggagcaaaatccctctcctcaatcgagtgctaagaaaagaaatccagtcgaccaaaacaaaaatcgaggaaaacaaatttgaatttgaccaaaataagctggacgaatgcacacgggtgttcaataaaacaaaagaaattatacaaaaaattgagccaaactttgagaaattaaaaactttacacaaaaaatggcaaaatttaatgagaagaatggacaaagaagaatggaacacagaatggaaaatccaaaaaatttttcgcaaaaaacatgattatttaaaaacaattaaggaaacagatgaaatcctcgacactctgaaagacataaatttgggtgtgaaaagaagactcaaaacaattagagcaaagtctctttcggacactgaccaggaatctgactcaaatgctgatgaacaagaagaggaagatgaagaaatggaagaagaagacgaagaagaaaaagaatacgacagtgaccaggaagacgattcaccagaattgacctcaaatgaccaaataaaccgtaaacaaacaccttttgtcaattatcgatcgagaataaaacttccaccccaaactctgacacacttctccggaaaattctcccaatggcccagcttttgggacgatttcaaatcatcagtccacaatgaccaaaacttagagaacatacaaaaactgaaatacttgcgaggactcttacatgacgaaccataccgaattgtgtcccctatccgactaaaactgagagaaaaattcaaactttactcgacaaaagaattaatgaattttctcaattcacacactcaagctcgtgaagacatagaacgaatggaagattcaaacagacaaataagaaatttcccccctcaccggccacctcaaaacagaccacaaaggcaatcatacccaaactattcccaaccccagctaaaagcaaaccaccgaaaccatcaaaatctgcctctctcgccctatcccatcacttctgcattaacaaccaaatcaaaacccgtccgtttggcagaatttaaaccaaaaccatcgcaacccaaaccacaaacaaaaataatattttgtcgattctgtgaaagagacaatcacttgagcaaagaatgcaaaatttattcaaccacggaaaaaagaagtaatcgagcgcgcgaattaaaactttgcctaaactgtctgaaaaaaggacatcatttgaaggaatgcaaatcacctttttcatgtttcaattgcaaaagcaaacacaataccctcctatgtacccgaaaaacaaatcaatttaatcaaagagaacaatttaccaacgtaaacgtcacgcaaaaccccgaagaattcgaagaaacccaaaattttatgtctttagattgcgatcaaaatgatgaaattttacaaaatagtgaagaagaattgcttatgactacggaagcaccagtattaaatcctgaccaaaacaaaacccaaaaagaaatgatattcttcgataatgggtcacaaaaaagttatataacagacgaatgtgctgattcccttcaattaccaacaattgacgaaaaattattggcaatatccacctttaaccaaaataaacccaaaatcatttcatcgagactagtcaaaattggaatcaaaacactaaacggtgaaatcgagtacgtaacattacagactgtggaaaaaattactgatgttacaaaaatggtcaacagagagactgttgatatacgcaagagaaaaataccaattaaccatgcctgtccacaaattctgattggtatagaccactattggcactttatgctaccaaactcacaaattcaaatactcccctccggattttactcaatcgatacaaaattaggaaaaatattatccggaaaaggtacgattgaagacacaaatattaatcttgtgaaagaaaagcgaaaaaaggatgagacaaacgaaatccttcaaaaattctgggaattagaaaatattggaattaccgactctccacatttgacggacgaagatacagctctcatacactttgacaaaaatgtcatttttgaagaaaatagatactacatccgatggccatacaaaagagaaacaccgaatttacccacaaattttggattatgtttgggaagattaagaaatgtagtcaaacaattgatcaaaaacaaacagttggaaaattataataaaatactgcaagagcaaatggacactaacgttaatgaaattgctgaattcaaatccaaaaatttaattcactatctcccacatcaccccgttataaaagagagttcaaacaccacaaaaattcgaccagtttttgatgcttcagcaaaattaagaggaagcaatttcctcaatgacgaaattcaccaaggaccaaaattattacctgatttgtgtggaatgattctccgattcagactcaaaaatttcgtcttaataggcgactttgaaaaagcttttctaagagttggattaaatgaaatagacagagacacaacacgctttttatgggtaaagcagtcatatttggacgagataaaacaaaattaccgagaaatcgaaatgagagacgtagaattaagacgtttcacccgaatacccttcggagtcaatgcttatcggtttttattaacttctgttgtgaatattcattta

SEQ ID NO: 6772 - DNA, 1868 bp, Heterodera glycines
  misc_feature (1761)..(1761): n is a, c, g, or t
  misc_feature (1765)..(1766): n is a, c, g, or t
  misc_feature (1772)..(1772): n is a, c, g, or t
aaaaaagcaattaattagcaccaaatccaacacaattcacgttttcattaattttaggcttcatgttgactgcgctgacgcctgaactcagaggcactttgtccaaggatctcatttttagtggtactttcttcatcgtcctaatgattttgtcatcactatacaattcccttctgttccaggacttgagcagctgctcagagacccggacgaggatgttcgtgttcagacggtgtccgccatcgctttgctttacgctttcgcatgatttggtggccatcaaaaacaaaaatacaaaagagagaacgacagcctagtcacaatgagaattgcttaaacgcacgggcttcccctcacttcgctatgtcctgttcaaaaatgacttttaatttaataataataataaaacagaatactttattattattatcatccctgtaacctattattagattatatttccagagttgtgctatatattttcattgtttgttcatctcccccatttttggtaatttgcgtcttattattattattctcgattttgtcttcccttccctttcaacataattattgttgttataatatgttgtgttggctcattttaatcaaatgaacacattaattttaaattgtgctcaggttttgtccaattgaatatttttgacaccttttccctccctttcgtttattcaccgggcaaagattataattcctgtgacttttcacccaaaaaagcacaaaatggcatatcttgtctaagcttttcaccgttaaaaaacagcttaacgaacttggatttccattgcttgttcgttcggctttttgtcgttccggtgactgttatttttattatttatccccactgctctctttttggtgctttttgccttttcctatgctgctgaatattgtttttttaaccactcatttcccacgatcattgtaaaacatatccaaaatggacactaaacaaaatgatattttaagtgttcttttattgtgctgtttaaagaaaagcgattgcggtttctgatgagagaagcatgtattttcaaaatgagactgacgaatacagaataataataaatctactcgtattcttcatttttcgaaacgataaaataatgaatagtataataatttatatgatgatttggtcaataagtatatcaaaaatcaaaatcgatcaacaaaacaatcagtcggtttggccctgcgcttgcgccccctctttccctttctcccccttcgtctgctcctccccacttttgtcgcttttgccctcctccgcttttcctcccccgccgtcgacagcgtctaaatccaaaagtgcgccgtcctccccgtaatattcgtcctcctccacgatgcgcttcacccggacgccttctccgccattttcctcttccgaacagtcgtagtaactcgacgagtcggtgtcgaattcgacgcaaccatccacctgagtagggaagaatttaggaatttttaggcaattattaaaaaagataaattccctcttagaacccctcccgttgggacaagggggggccatcaatcagagggagttacgcctgtataataatttttagttttattgcggcgaaaaaactggaataagccctgaaaagtggcaaggccataaatgtgggcggacggcttcccaacgcccactcacagccaactcctccctcctcccctttctctctccctcaccttaacctgaactgtctccaactccacttcctcctcttcctngcgnncggtgntcctcctgtgcctcctcctctccttcttctcccttatgtctcttcgtcccctctttctcgtcgtcgtttcctttttgtcctctgctcctcttttcc

SEQ ID NO: 6773 - DNA, 4291 bp, Heterodera glycines
gtttccttggttccttctgctcctcttttccgtccgtctcctccttcccctccgtctttgtctcctctttgccttccgtctgctcctccttgtccttctctgttgctcctttttgctcctcccccttcgctgtcccatcatccgtgttcgtcgtctttgtctcttctgctcctccctctccctcttcacaatgttcgtcttttccgctctgctcatcgttgctgctttcatccaccgtcgcctcctcccgctcctccgtctcttcgtcgtcgtaattttcttcttcctcggaactttccgaccgcggattattcgccagcggcgacgccaccgttggagtactcaccgcactgttggaagaggacaaaagtttggctgaaatagaaaaaagatgcatttccatgtgttatttgtgccgcaccgctcgtccccccccccccctctcacatcggagttgcacttggggtttcactgcagaaacgggcacgggcattggcacaacaacaaacggcggctttttgctggaggaatcggaatcgaccgtcacggaaccgtcctcctgaacgaaagacaaattgcacgccatgacacgaggagacagcgtcagacaaattaatgaaaggagaatccgatctcgacctcaattccgacccaaattcgaatctcaattccaaaaccgacttgcttgttttgtcctcctttaaaattggaaaattcctcccccattttgaccttgtacgtctccaactccacgtgctcctcctcctcctctttggccttctgctgatgtcgctgatcgctcttcgtgtgacggaatgtgtaattgacaacacgtggcactgaaaagggattaacggacaaataaacaaatttgaaaatccaaaagaattccccaatttcaattttggtttcttaattttcgcttgccattgttcgctgccgactttctcgcctccgcttgcattctcttctcacattccgccaacacgtgaccctcagttttgcaataatagcaaactactaaaagagcaaaatattataaaggtttcccatcgaatgcctttggaaaatgacaatgcaaattaattgctttctatgccattccatttgccaaaatgtgcccttcccctcagagacaatcccgaagggggggggggggtgtacccgtccgagaattaattttggattttacatgttggcattcctttagggtctttagtccaacttggttttctggtaaagtggtggtgttgcgcgtggtacggctccttcttcggctgctgttgtgccattgtccccgtgcccaccgtttgcccctctttctccgccccgtcgcccttttcgctctcttttttcttctcctcctccgactgatggtccttcgttttctccgactcctccacctttttctgcacaatcatcaccaaattctcctgactttcatcgatgacaatttcttttacgacgtttcgtcttttcggcacaaaaccgccgcctctgccgcgttcggacattgtgaaaaaggcaacaaaatggtgacaaaatgaaaaattcaaaaggcactgataatagctagctgaaacttaattttaaatttaaaataagaaatttcgcggaaagcaaaaaatgcagcgaattgatttttattttggttctaatcagttgagcacggagttttggatgtaggatgaaccggtcatagttcaggattaaaatcccgctttttcgggttctaaatccggggtacatttattttatttcctttaatggacacttttcacatacatttttaaatgaccaatataaaatttgaattcctataatctgtatacatttattggcatttgaaaatgtaaagtacatatatttttacgcaactgctgaccagaataaattccgggaaaagcttgaaaaggattcggtacattcggtattcctaaatttgtaaagcaaaatgaatttgcaaaatgcaaagaatttgatttttgccataaagttttgttataatgttcatttgtggcataatgttttcgtttacttgaatataattctctatgatttatgggtttccttttacgagtccgagttcgctcataatttagactttttgtctaacatgagtaggtatatgtatattttgcgattactctatcatggcatttttacagaatttatttattttttttatttgttaatctgtgatctctctacaaaatggtgcagtttattgggttaaaaattgcgggggtcagaagcattggagacaaaccgcagtgtatcaattttttgtcgcctctgacaattattcagggaccaaatgggacagggaaaacggtgccgtaatttacactaaatctaacaattcaattttaaagaatttgcatccaattacagacaattatcgaggcattgaattacgtcacgacgggtgcgctgccggcgggcaaaatgcaaacattcattcacaatgcacaggtcgaaagacacacccaaccaaactcattttgttttatttctaaaaaaaattacatgaattttagagttatgaataaaaattatttttttggatgaaaaatgatgaaaagcctaacggtttttggcatagtaattcattttatttctgtttcagattgccaacaaagctcgtgtcgatgcgctggcgcagctcaacttcagagacatcaaagggaacaaatgcaccgcgacgaaacgaatgaatgcgagcgcaactcacagcgtactgaggggggggggggacggcacggggacaattcgtgaaaatttaaaccgaaatgaattattttttagggcaaattgtcaacaaaatcggacgaatttacgctgagaattgaagacaaatttggcaatttgaagagtgtttcctccaaaatctcggacttcaacaaggagtcagtgatgattctgctcacattttgtactaagtttctttcccaatttaagatgctcaatttgttgggcgtcccaaaggccgtgttggagcatgttttgttctgtcaccaggaggaggccaattggtgggccaaaaaactcaaaagtttaattaaactcactgaagtcgggggggggggggatactcattggaaaaaccataaataaaataattggttacatggtgcaaattttagcaattttgaaattaatgtccaaagtggggctcttgaattttctgcattttgcttgtgtattggcattccgtcgtctcttcgtttttaggcctttgtccgagccaaaagaattgaaattgcgtttcgatgcgatttttgaggtgacaaaatacgtcaaagcattggaccacatcaagaaaaacatcaaagaattggtgggttggcttcttttaaattggaaatgctgaaaaaaaagatttcagggcatgcaaattcagctgatcgacaaggaattgccccatttggagaacaacatgagggcacgtgccgatgttcgtccattttgagggcggagtaatgccaatggcacacttacctcctaaaattcgggttttctggcaaccgtaccctcgtcaaacccccgattttcaatttctctcccaattcgttgtactttttcagctccgtcttcgctttgatgaaacgctgaccgcactgaagcacaatcggaagagcattgagcaccaattgaagacggaaagagaggcggtggacggcgaactgcgcaacattcgcaaacatttggaaatggccaccaaatgcaaccatgagtttggtcagttgaccatctctgggcattttgagattttctgaattgttcgtgtcgtaaaatgcgaaaattcgatccgtaactttggtttgtcgctcttccaaatttttccatttttcagagattatccaaggccaaatcaatgcgcaaaagcgctttctcgagggaatgccgccgttgacgcacaaaggcacgcgggaacaactccaacaacaaattgacgaggtcagtgggggaatgacggagaaataaacaaataaaatcggacgaattggcaccgaattcagtgccatttttaaccccaattgcttttggtttaaatttttgttgtccgttcgttgttcagctgaagcgttccgccactgcacgcgaagcggacgaacaccgcgcgtcggttgtgcggcaagtgaaaagcatcgcttttgagatggaccaatgcaaaaagttggaggaggcgtaccggacaaaactgatgcagcacgagtcgagacgaatggtaaaaaaaatggggaaaatttaatttggaagagtcaaaaaaaactctacgaggatcccc

SEQ ID NO: 6774 - DNA, 1865 bp, Heterodera glycines
attggccacccacaaatggggaaaaagtcttcgaccatttatctccggtcagtgattttctttaaatgcacagattcgtttttaattttcagaagcattgaaacactgggggattctgaacagattcaacgcaaggatttcgtcggataatttaatcatttgttttgtcagttttccgattactgtacgatgcctcgtgattcatttccattttagggcaatgaaaaaacgctggccgcgtcggatcccacgattttggactcatcggaccaactccaacggaacaatgtgaagaatgacccgggaccatacactgttctgcgcatcattgacgaaatttataaaccaaacagtaatttttcactttattcgtccagtattctaaattattaagcatttggcaacatgggcgtcaaatgtattgtttgattttttttcctttatttctttttcattttagacaaattggacattgtcaggttaattttctcaaattttatactgatttatttttttttctcagcgcctgttgcatccaacgggacaatttcattcggccaacaggtcaaatttgggagaattcctcaaattaatagttggtcgaaccctcgaataagatcgccattttcagtttaccaggctaactacggcgaatactctcaacgctttgtcccgtcgaatttgcctttgtcacgcggcggcgaactgcagagaatgccaatgccaacggggcgtgtgccggggacaatgaattacatagaactggaaattgtgcgaagtggaccaattggtgtcagtgcgcagccttcgcgcagaggccgatgattgtttaaacgagcgatgtaagggaaattgtgacgaaactattggacatttatttactcttttaaatgttgaaaaagttataattggagcgaggaaggcgacactttcactaattaattaactacccactgattttattttattaggtcatttcacaaatattgtcccacttcgattaaagttggaataatttttgaatcctcgcacaattattggaattctaaaagctatgggtcagctttatccagaacagtatttatgaaaagacctaacttcgttgttgtgccgatccacacattgtatcaaattacggttacatttgacatagaaagacgtcacaaaaataattaacgattttcaaaaagggtaagtacaaaaattggtagggaaaattgcaatagaaccggggaccaatcagatcaaacaacatcttcgtcggttaagtaattgcgcaccaaaaaggaaaactgaaaatgatcattaaaatagtaatgagtagcgacggatttaattttcaataatttgatgtgttttggcctcgccgaacccaacaaggcaaattttgaagaagaaaaaacagtttttcgcaaaagactatcattaacaatacctcgtcaaagtcaatgaatccatcgctatcgacgtcatattccatgaacaattcctaggggcaaagtccgatgattttggcaaaagcctttccctgatagacctcaattagccggccattttgaatatcgccgagttcacgctgaaatgagtaaatataatttgtaattgattcactctttttttaaaaaattttggaaacatttgaaaaaagcatcattttttacatagaaaaaaatttaataagatagaaaacaaaatattcattttttcttgggggggggggggggggtaaacgagctcccttctgcacataccaacacaaactcgaagtcctttctcgcgataaggccagattcgctctgaattggaaattgggtcaaacgttgtcgagtgcctttcttgtctaattgcccctaatttacccttcc

SEQ ID NO: 6775 - DNA, 1917 bp, Heterodera glycines
caaaaagtcccaaatctcgtaggtaagcagttcggcactcaccgcaggacaggtacaatgccaatgccattcgtgccaagccccagcaagtaaaggtcaagtcatccgccacaaagcaatatgcccaaccaaaaacggttccatagccgtatgagagcaagcacaagttgccaatccgatacatgtccaatcatgcggaagcacaaatcattggctctccgattgtgtgcacagacagtcctacccccccccgccatcaattgtcttccatttacaaacaataagaatcactaatcacttagggcacagaatccccggtccggttcgcctccgtcggttccgtcccctcttgcttttgtcggctcggcttccccccccccccaccattcattcgtccatgtgccatttccatttccccctttctttccttccctttcgccatttccctcttcccccctcgtctctccacctgtctgtactccttcagctcgtccgtcgtgtacttgtccaacttggtgatcaacggtatgttgctgccatcttccgagttcacttccgacacattggcggtgaatttgctctgaatttgtctcgttctcgcagtgaattcggtctccaagtcaatggaattgaaaaagttcgaagttgcggtcgatgcactcgttgcggtggagcgccttttgctttttatccaactgcgccgcgtgctttgccttttggccatttgctgtgccatggcattggcatttgcggggggcggcgcgacggtgggcaaatccatcgctttgtcgcaaatttaaaacgcaaaaaaaacgggaatttgacaatgccctaagttaaaaagtgaatttatcaaaaaagcaattgttatttatgtaaaaaacaatttatttttaattaaataatttataatatttatttaaaattactaagaaaatattttgaagattaaataatgaaattataaatatatttttcaattttatatttttgggaatgaaaattgttttttgtaaaggataaatttgcatttttcgtaccatcgaagctcaaaaagtgagaattcacccaaatcgatgccaaaggttcgcatttcataatgcccattttggctcattccctcgtaaataatggcccaattttggagagacggaaaatattcgtctcggcggtcaaataaaaaaatgtgtcaaggaaattcccgcgtaaaatttgatgccaattcacttccgcaatttcactacgcaaatgccaaacatcggcaaagatagcggaaaagccaataaatttgtcaacttatatttttggcattaattgtcaattggctgctaattaccctaaatgaaccgacgaaaaggttcccccgtcctccgcttgcgctcgatgccatggcgccaatgccaagcaaatgcagcgacggccccccgcctgtgccacttttgctgctgcgcgagttgctgtgccgtcggctgtttggaattgcggacgaaagcaaagcggtggcacagttgttggcactggtcactgccaattcgttgccattcatagcgaagaaaaggaaggccaaagacaatttgggggaggggggaggaagaagaaagacggagggaaattacaaaagcattttggaaaggaaacggcgaaaaaaagggagggggagaaacggaaggaaattctgaaaagggaaaggtaaagcaaaaaactaacaaaagagaatggaaggaagggaggaagaaagttagaagaaaagagaagtgacaattcttgctaatattgtaaagccaaaaggagagaaaacaaacggagcgaaaagggaggggggggggggggatttgccatggcatcgaaagggggggggggcaatccatcgatcgaatttagcagggcaaaagccattctctgatgcatcatacttag

SEQ ID NO: 6776 - DNA, 3224 bp, Heterodera glycines
  misc_feature (3178)..(3178): n is a, c, g, or t
cctatttaaatgattctttttttattttgttcttcacgttgtcctcttttatatcttactatcgtttcactttttatttgattgatagatttttctgccttttttcccgaccatgccaaaattgaaaattggcccactaatttttctcgaattttttatggtcaaaaaccaaagctgatataacaaaatcttagtttttctatacaatttagaccagtagaatccgaatatggccttaaatgggacctatcttttcaacctgagcttgtactgctccaactccttgcatgaagttcgagctgtacaggtttgttgcgatcccagagaccaaatctaagaccatattcgaactcaacatacccgatttaccttgtttaattaaattcagaatttccaaaaccacttttaaaacattatgttacttggtggtcttgaaaaatgccgtttttggagaccactttaagtctcggctctccaataattcaatttttgtaattaaaattttatatttttgtgttcttatagtcctaactttgctctatttaatcactatttctctggctctgtatctcttttatttttctttaaatcagccatcaaaaatacctacctctaaaatgaccatttttacttacttaactctaactccctaaatacttttccattggtattgatctcttgccagaataatggcaacatattattgataataatggcgggtattttgaatcatgattgtgttttgttgaaatttaaaaaaaaaatttttaataaaaaaaatttgggtatcaaaaattatgttccaccctaagtaaaagcaattgtattgggaaagaaattaaattaattatttttaaagaatgtggcaattgaaaattttataaaatatatgtaaaaaacgcagtttagagaaccaaacgaaaacaaaacaaaaacattaagtaaatgtgagaaagttggaagaagccattgtaatgaataaataaataaataataaatatggagtgaacatttaaacctaatatttcttttaaaattataattaagagaagcattcttaaactgaaaaggtcctgaatttccagatgtttgcattttacggccatttttcatgaagtcaattaaatcagcaacacgttttaaattaaattaattattataaataatatttggacattcgcataatgttgaaaaatgaaaaacaaatgccaattggttttatatttaaggagaaatagccgcgtctattataaataaacgcatttttgatgttttgttttcacttttgctctgagttttcttatgattcgtaacgtatcgctcttcttctgaagcggtacgtttttctttttttttttaatttaataacaattaaataatgaatgttctcatttatccattttcaaattaagactcattgtgagaatggtgtatatagagaggtttgaagcgaattcttacgaagagctcaacaccgttttggaaagattggcgcgcggtgatcgcattttcaacggtggcgtatttattctgttcgcgatccctcgaaggtagacgaattgccgggggtggagaaggcgagatttgcttttcgttttctcattttcgactctcatcaaaaagcttttcctcagactttaattctcttttctttttggcttttccttttcatttctttcagattctattgcaaatttgcgcttagcactgtcaacacaacaatcgacgacattaatcgtatggccaaaaccatttgccggagctcgtcattgcgtacattcactgctccgttggagtttggaaagagtgagttcgaagtgccaaaataaaccaatgccttttcaaattgtcagagtttgggccgtgccgaacagtccctacaaaattgacaagacgttggggttgcgacagttgccgacgctcatcgaatattcgcttactgatcggcgccgaattgagggacggatggtttacttggacgagcagtttctgagcgtggattacatcacccgattcttcctgaagcaaccgttgaacgtcttccagtgacgagctcaccgcactgttatttattaactgatgttgttgtacatactgtctattaacatattgttgtaaatatatgtatattgtatgcactaaatatgcccaaataatattatacatatgtacataattatgaataacaaagaataaaatgaacagaaaattatgttttgtgtgttattttattctgtcgatttttgagacaacaaaatgttactaggaatcatattttgttcaaaatccgattaaacatttactctattttttggaaaaaaattcaaaatttgaacccaacatttggaatattttaaaggcaaacgttactgtttaattggaaaattaaagctttttgtggattttgggcattttaattcgatttccgagtccaaaaacagccaaatctcttcgaatcctttgccactccatgtgaaagtcgcctccctcgtcaaattgttgtgttgacagtgctaagcgcaaatttgcaatagaatctgaaagaaatgaaaaggaaaagccaaaaagaaaagagaattaaagtctgaggaaaagctttttgatgagtcgaaaatgagaaaacgaaaagcaaatctcgccttctccacccccggcaattcgtctaccttcgagggatcgcgaacagaataaatacgccaccgttgaaaatgcgatcaccgcgcgccaatctttccaaaacggtgttgagctcttcgtaagaattcgcttcaaacctctctatatacaccattctcacaatgagtcttaatttgaaaatggataaatgagaacattcattatttaattgttattaaattaaaaaaaaaaaaaagaaaaacgtaccgcttcagaagaagagcgatacgttacgaatcataagaaaactcagagcaaaagtgaaaacaaaacatcaaaaatgcgtttatttataatagacgcggctatttctccttaaatataaaaccaattggcatttgtttttcatttttcaacattatgcgaatgtccaaatattatttataataattaatttaatttaaaacgtgttgctgatttaattgacttcatgaaaaatggccgtaaaatgcaaacatctggaaattcaggaccttttcagtttaagaatgcttctcttaanttatatttaaaagaaaatataggtttaaatggtcactccatattta

SEQ ID NO: 6777 - DNA, 2797 bp, Heterodera glycines
aaaagttcaaaaaagattttctccggaaaacagtccaaattgggccattgcgataaattggatcaatcagaggccatctcttaaaaacttttaatattttttgatgcaatttgatctgagccaacattttttgcagttgccgtcggcggacaacgcgtgccgttccatcggtgcggcatggaatcgcaatgtgaactgtgcctttggcgcgcttcgttccgcgacgcattcggcgcgcgaatcggtgcaaaaaatggctgccgaagcgatggcattttttgacgacgacgaggaaaacaaaagcagcagagggaggagaacggcagcagaacagcgccaatgatgagaaatgagaggaggacaaaatgaattgaatctgttttaatatcattgtgcatttgctaagggtgctctcttctctcagtctctctgattttgggccgaacgaacaaacactcagttaattattaagtgtacacaccaggaatgccatttcgaggccctgaaaattccgaaaatcgaaattcctacctcaaaaattttaatggaaatcggaattcagaccacaaaaatatcaaatcggaacttcgtgccatccctagtatacacctttataaagtaattgtctctattagacttaaaaataaatagattgttttccacttttgtattttgaactatggatcgaatacgagtggagcacgtatacggacggctttacggaaccgtagcgtagaaaatccgtgagaggggcgacggcggtgccggaataaattgggcttttaaattaagttttttaaaaaggattagggaatttcatttcatttcatttatacgcataagcgtgacgccgaaaaataagaaataatgaaacaatatcaaataaaacaaacaattggtcacttttggagctggggtggcaaagaaatcaacaaattcagatcagatctttcaagaagtttggcaaactcattagaatttagtaatctcgtctctttaggtaaaagtctatagagacgagaggttcgaataaagaacgaattgtgtctatcattggttgagcaataagctgttcttatggtgaattcattttttacagggtttttggaaaaagaaaaggattcattattttgtaaatttattttacctaaaattatttcatgaaaaagttttaagtctatttttaacctacgactctcaagcgacttttgatcataaatgtttaacaattcagcataattaggtaaatcagcagcataattgttacgtctaaatattactctcaaaaaagttttttggacattctccagtttttcaatatccttttttaaataaggattgaaaattggagatccaaattctaaaattggtctgcaataaatattaaacaaatttacaagtattttcgtatcacgagttttgattgactttagtatagcgaaagcagatcgtaatgcttttttcgagataatgtcaatatgtgcccatttcaaatcattagtaaaataaatgccaaggtctctgactggttcgtttgcgggatttttaggaatttgaaagtcatcaataaaataatttattttttgatttttgtgtcctaaatgtaaagttaaacatttatttgatgaaaattttgaattttcgactttttgttcgagtccggggttcggaattgaccaaaacatgtgtcattttcgggatcagcatccccgaaaatttagagcttttacaacagtaaaatatattttatttggttgagcgatcaatttccttttcatggatttttcaaggatgaaatggggcatgatctgttcggttgagagtccggaattaatccctgatttcgagtaaggtttatttttgttgatttacatttgttatggtatttttaagaaagttcggtcaatggatggtggcagaattgcaaaaagctgccattgagcgcagattttggcattatttcatgccttctcctaattttctcttgtaataaatggtccttttttgaatacgtttgtcctttagatacgccagccctggatcagttgaggaagtgaccaaatgttacgaaatgataaacctttcttttccggacgtccgtttctcttttctgtccttttggcattgtccagtttaggtcagttatgtcattcatgttctgccttctaaggattccgttgagcaccaattgctcaaagaactcactcacaacggagctttgataggccaaggtcattttgaattttcatccgtattgcaattctcaacacctttcttctttcaggtgttctcgcgtacaacgcactcaatcactttgactgctacgatttgaacgaagtcatgttcagaatgaaccaatggattgcccgtcggctgacccaaattatgtccaggcccaagtgagttttcttgcaatgattggtggattttttactatttcattttaagtgacaacgtcaagccaagtcgtcgaaagaaggatattttccgaattgtcgtcgccaattccgcggaagagcctccacccgcaagtcttttcaacaaggaaattcactcgcagatgcccttaaattcgaacaaagaacgcttttcaactcagcaggatatcgactattcagttggagttgttttgcataaaagtgagaagaatatttggcaaaattgcatttattcgtttttatgtatattttcagaattttttcgcgttgaggtgatttcggtgagattgttcaagtcaagtagccaccggaggagatgaattaattctaagtcggcggagatgggaaccaagcggagg

SEQ ID NO: 6778 - DNA, 4779 bp, Heterodera glycines
tgtatatttcagaatgtttgccgctgagccgatttcggaccgattgctcaagtcaagtgaccaacagacgaatgaattaactcaaaacggcggagatgggaacaaaggggaggtccaagttattgtgaaaggtgagaatttggagtgtgttcaattaaattttaattcgtcagtttggtcggaggggggatttatgacaccccaaatgaaaaatgtaaataatttttatcgagtcacatgaatttgggtaaataaatgtagatttaatgagcaaagtattaagcttgtctatgaaacgattttcttttttgttcagtgatttctgccaattctcaggtttccccacgactttcaacaaatttcaaattgcttctcttttccccgactttcgtcctttgcacgtcgaatatctctccggtggggaggctgtcgttcaatttgcgaacaaataccacgcagctcaggtggtccgcaactataacggactttcgtttgagaatgaaaattttattttggaggtaaaaatgctaattgtcagattattaatctattcttccttttttattttaggttcgctctgccgggaattatcaacgccaatttttgcaagataaactcaacaatttgtgtgttggaacgaaatgagattttttgacttttttgaaacaaaatatttattcagatgtttttttgttgccaaagtgaacggcttttatattttatggttaagcagcattttaaatttgagaaaaatcgaaagaatcgatcactttagccaagctcagtttttgcattcactttcattgtttgcttataaattacaacttttcgatattacattcttttataatgaaatgctcgtcgtttcatcgccaaaaaattgagccgtttaagtaaaacgcatttggcaaaaatggttcatgaaacgagaatcacaaaaagcttattacaattttatttgatgcaaatacatacttaaatattaaattgagttttggctttccctctccccctaattttctttgtttttgttattggtgctttcccccccccccccccctccttcaacttttctcaccattccatcttatacaatggcattttgttatttggagccaaatgcgaaagtcccaacggaaggatgggttggcataggaaaaaattgaattagccatggggaagagagatggcattcattcagtgccctccggcgagtgatggaaagtgccccttttgctgcccctcccttcgctcgtcttaactctcagcttctctctcttcgcccattcatttcgcttttgctgctgcgtcttttcattgcgcatttttttctcttccattttatgtcactgaaagaggggaggaaggaattgttttatttttaggaattgaaaattcatttagaagaaaggcccacaccagggatggaattccgaggctcaaaaatttttcggaagtcggaattccgagcccaaaaatgtcggaatttttcaaaaaatataataaacaaaattttttaaatatttaataggctaaattttaaaattcttaaccatgtaaaggtgatatcaaactgtttttagtatatttctatattaatttaattttttttaatgattttcaaaatatttttatgtaattttacatttttttgaatttttttttgggacagttacacccttttttgcggcgcgctttatccaaagaaaatttgggtaatagggggagaggtccggcggtgccgataggcgccgctggaaaaattttagtgatttttaatgcgatttgttaacagatttgtccacgaaaatggccaaatttagcgatttcgagcacattttcaagaaaattaaggatttttaggtccggcggtgccgataggcgccgccgggaaatttttaaaaatttcaatgcaatttattaacagaaaattatacaaaaattgctaattttttgaaaaaaaaaattcaaaaaaattccgactttttatcaaaaatgtcggaactcggaattccgtgccacccctacaatgaaccacaaaaaaattataaatgtttatttctaaaaaaaatttcctccgttgccattttcaaggagtacaagcgcgagaaggcgtccgccgaacggacacgccatcgccggaacagtgtgctgcattttgcgtcgtccgccggcaccgccgtcgcatcggtcgcgtgcagtagcagcaacggcactggcggtgaacacgcgcagctgcagcaacagacgacggcgataatgatgccacggcgcaaggccgttctgcaggcaaacttttcatttcttgtgctgccagaaaatgcattaataaggccatcgagaatgactcaattcccgcgaccgatattcgggactgaccgagaaattaacgcatgaatcgaacacccccccccccctaaaggaagtcgagaccgacagaggattgtttcccgatttcgtcattccccctcccgaattcaaataagataacaaaaaaccaaaatttttaaaaaggtttttatacgttttccggcgtggtggtctttgcctttgtcacttgccgaaactcggtcttgggttcgaatcccattgtgtgtgttaaatttttcaaacatttatttttaattagaaatggtaatgcatattttgttgctttttcagaccggcgcactcaattttcggccacctctcagccgttcgcgcagtgtgccacgcctttgttccattgacgaggaagaggcacgggccgaggagcaagaggtacggtaaatgcctgtttataccgtatgatatgcttctctctctaccgcttctcctatacttttaaacagtttccctctattctatgatcacataatttctttgtttttattttctctttactcattgcttattcctattctcggctccctttttattttggttctctctctttctctccctctgtctctctctccctctcttctctctttccctctctctctctctctctctctctctctctcgattgtactcacttatttctctcctcctctccctctccctttcgctttgttttttttttattatctttctatacattttttttctcaatcttcctttctctcttttggtttttttcatctctgatttgataagagatcacttcattgtaatttccaaatatataattacatcatcattatcacaggatgagtgtgacgagactgtgaaggatgaagacgaagagttgcagctttcatcgtctgatctggactcattgaacaccgcggatcattaccaaccagtgccaataccaaccgcgaccacaacgatggcaaacgcaatggcctcctttgcctgtgttgctgctgatcagcagaccatcaccgactcgtcatgtcgttcaagtgcatgtggagacgaactcgaagacgaggacgacgatgctgaggatgaggaaaggaggcatttttgggcagagcatcatcatcaatttcaccgtaatgatgatcaccatcatgccaatactgcgccgggacgtggtccgcattaaaataaataaaattttcacttttcatgtttttcattttttggaattgttgatatcttcaatgaattaaatcacaattgaacacagtaattgagggaattaccgtatttgctctttttatttgcccgggtatattatttttcaaccccctcagaaagggggagataattagatacgggggataaaggggagggggggattatttttcgacagatttatttagtggaaaatttttcaaatttatttttaatatgtctccagaaaatgtcatcgcgtcaaaaaaaaaaagcatttttattgcatttttgttaaaaaatttctgaattttacatgaaatattcgaaaaatgccaaaatatttacacaaaattgataaaaccccaaaatattgaaataggaatatgaatgaaccttatttgcgtttcagaaatttggaattttttaattttaaaaattttttcatttttttgagcccgggaaatttatgcaaatttttggaaattcaaactcacttcagggttggacaatgttagtgaataaagctttaaaaataattatttccagaaattctggaaatttgcgattttttagaaaaattcagaacgccttttgaaagagcgttttcacaaattaaaatactaggaaatccgatattttttgattattatgaggtattttctcttttatttttatctcttttttttgaagaacgttttactaaacattcaaacgaatttcaaaatcaatttttattaaaatataaaaagaaattattttttagaaaaaataaaaattccattttagccccccggggagataaataaagacggggaaattattttcaacctacttcgaaaggggtagattattgatacgggcatataattagagaaaatacggtagtcatcagacacactttgtttggcatggcaatgcttttttaatttaccaaatttttccaagttttaagggtttgtccgggaaacaaaagccggcgaaaaattaattacaaaaaaagacatttgcaaaattcatgtaaatctaacaaattcgacaaaattgagagctctgctcgggacttcgttcgaaatcgattcttttgcttttttatgaaaaagttgtttaaaaatcctaattttatttggattttccagagaacggtgacgacggttgctcggcggactcgggctattcggcggcattgcacacctaaaaatgcattaagctggaggacttataatttgaaca

SEQ ID NO: 6779 - DNA, 4401 bp, Heterodera glycines
ccgtcggatccaatcgaaaaaccttagtcgacccatcagccccttttaatgcatccctacagcccctaaaaatttatttttcagcattttttgatttttggaaattttttaaatttaattgaaattttttcgaattttccaaaatcccgcaatcccgcacgggatcccgcaaattttaaatgcgggatttgcgggattgcgggatttgcgggattaatcccgcgggatcccgtcccgcaaaaaattttgagttccagtcccgcagcgggatccgcaaatttgaaatttccgggctctagtccccggtgatatcgtcagtggttgatttcgtcagtgattgatttcgtcagtgagtgatttcgtcagtaagtgatttcgtcagtagttgatttcgtcagtgagaaataattttaaaaaaaaatttacctatcaaatattaaaaatgaattcaaaaatgcaagtgatatgaacatgctcgtaaatactctaacggatcacgattatcgaaattttccacaagagtcatcaaattgttgtcctgccgaacccattttgcccttctcttttcatgaggtcctctaatcccatcggctggtgctgctcgaaaatcagctactcgccgttcccacatttcatcttcttccaccaattttcgcacaaaagaactgagtcgtgtgttgcctttgagatgtgagttccaaatgccgtgccatccctaaaccaaacaacaatttatataatacgcactcgaaaacctcgactgaattatttgtgcgaccgtgaccctcagcgatacggtcgaccatattccacagaggaggggggaaaagagcatccgtgtgggccaaattcagtgccaaaatttggtcccgaatccacctatctgctgccccaccggcatccctttgcaaaacctcctcattttcgataatttgtcttggcccaatccacgtttttatgaagtaaatgacaaattcttaattttaaaattttaaactcccaaaatttctctattaaccacccccccatttagcaccttgcaaatttggggttggctctattattgacataacaattgcaaagtaattatagacatattccactggaacaaaagcgagggcttgaagacacctcagtgctttacggatgtcctcattattgttgtaatcggttaataaatgcggaagagtttggattttccgaaaaagggcctttccaaagtgaaagaggcagccactgattatcgcatttgggtacacagtttttgctgcattgatcgccccggcttcaaaatcacacattattctgtcagggtaccatcctctgtcaacatttgcacagattgagtcaaaaaaaatttggtaggtgggggaatttttgtttggaaggagtccatatgcgcaaggaacggcacaatgttcgatgataaccgacattgtgtaaagttgtgcaaatccccttggacaactctgaaaatttatttttttcccattgttttatcccttctatacttcaaaagtgccgtcgattgcaatgctttctccgtaagttcttagtgcctccaaaccaaattgggaacaaaaaatcagcatttttttcccttggagattttggttgtaaataacacgattttgaagtgcatttggaaccactaagttcgtggggggcattgcgtcaagtccattatcaccttcctttaatattacacacataatttaataccccaaaattgctctacttgttcaaggtgggttctttttgaatagttgtaattccattgcatattcgatgaggatggagcaactccaatcctcacatcaactggaatatccgcccttacttgtctcacaatatttcgacttgtgggaaaatctgatcgtgcttcattgcgaagccgttcattggcttgtctgacctatacccaggaaaaatccatttcgaacaaattaaaatcccggatccgaacccagggacggtcccaggattttggtttgggggggggggtaccaacccctcgggcgacgacctttttttgctcttcggctgcataattttttgcgctcgattttcaaaagaataaggtggtcttgccccccccccccccaatgggaccgtccctgtccgaacccttaatacaataatttgaacccacgtgtaatgagccaaaaatgggatcgtggttatgttgcgcagttacacgacccattctgtaatttgaaccatcatcaccgactaataaatttgactgcacgattgccctcccagggcaatagggaggacgccgagggcatttccagtaactccagccgtcttcagttcgggaatcggccttagaaaactattaattttttccatttaaaagatttcacttcgtaaagatactcatagtcgccatgagtgatcagctcacggccacgattggatttgcatacagaaaaacggattaaggccattgaagacaaaaaaaagatcaattaatggggagaaattcggaaacgaagtctcgaggtcaatggaaatgaccactggcgagtctcgaaaaacgaacaactaagagacaaaaccgcaaaagcgacccattatcactgataagagtgaccaataggcaatgaaagggcaaacaaataattttttctcgaaagacgaacacacaagatacaaaacggcagaggcaaccctcaaaaagaattcttttctctgataagagtgaccaatagagagtgaagaggcaaataaagtttcgtattttaatgtatgaatatattttcattatttattgcatacaaatgtattatagttcatatgaaattataattagttcatatcacttgcgtttttgaatttattttaatttttgataggtaaattttttttaaaaattatttctcactgacgaaatcacttactgacgcaatcacttctgacgaaatcacccactgacgaaatcacttctgacgaaatcacatggcaccggggggccggtaccccccccacccccaagccgaaatcctgggaccgtccctgccactccaagacgaaccctcatataattatttttttatgtttagccaaaaagtataatcttaatgcattggccaaagcgtgtttgaatgttcccatttccgagctcggcaatgtgtttctcgcttatgaccaatctcgccttctcagcgaaaaagcatgaaattttgtttccattttatcattaaattaaaatcaatcaataatttttgtcatatacaaattttaattttttctttgaagtttggtacaaaaaatcagatcaaatcgatctcttattttttttcttttttttgaggatttctcttgtcgctgcttggattacattgaccaaaatgcggaatcgctgatccaatcggatgcctttttggaaatggaacaaaatttgctgtatgaaattatcgaacgtgaccagttgaaaatcatcagcggcgaactcattatttggaatgctgtactaataatgtacaaatttttgaatgaaattcattttcaggcactccgttgggctgacgcgcaatgccttcaaaatggcaccgaatgttcggcagagaatcgtcgtgttgtcctcggcctggcactgtccaaaattcgttttccgctcatctctctttcgggtttagccgactatgttggtaggtcgtccgtcaatacaatattttaaataatatttattttaaaattcctatttttgtcagtgccatccggcgtgttgaccagtgacgagttggtcggcgtcttcctgacccacgcccacgcggaccgtcgtgccaactccgagttgtaccccaaccaatttcccacccaccatcgatcgcactctgctcagcgcttttttcaacgaaaaattgattagtcgataaagctattttgcaaattgttctgatttttaaccaaaaaattcattaaatttatatcttttctttcttttgtcgctttaagttttgacttttgaaattaacaacaatgaaagatcgaactttttttggcattttttgcgatttaaatttgatttttgacaattttattgcacatcaacattatttaatgtgcaagaaaaatttacgcatttttcccctgaacatttcggcgacgggatcgaaagtttaaaattaactttttttttcagtatatcatacatatactgtacccaaagcaaagtagtttttgaaaatttttcaggcaaatgaccttatcaaaaaagtttttgccaagaccatacgtttcggcatcggtaagggcaaatctattggatttattggtcataattctgcggattatttttcttccacggaaatatgtattgaaaaatgaaattttatctttctatataaagcaaaaaaaaaatgttggataatctgttaccttcagaggcagtaa

SEQ ID NO: 6780 - DNA, 2122 bp, Heterodera glycines
  misc_feature (2090)..(2090): n is a, c, g, or t
  misc_feature (2097)..(2097): n is a, c, g, or t
gtcgcgttggctgtgcgtgcggaaatagcgcaaaaagccgcaaagtcaattgcagaggatgaaaacgcacacatagcacgcagctttaaaccaaataaggcggaaaagacgaccaccgattgggaattacgtccgaccgacaaataaaagcgtctgttacaactgccgtaaaattggccacatcgcgcgaaattgtaaggtcaattcacttggaaaaaatgcggctttgaacaaaataacagcaatatgaattttcaaaaagagaaccaaagaattaagaccgacaatttaccgagagcaaaaattttcccaaaagtctccgcccctaaacgagcaaaggatggccgaaaataacgcaatttgtcgcagaagccgatagagtcagccgatgtttcaacaatttttgctggtctttttgcttcatttttggttgttgccaacgccttttcgaatgtgaaggctaaaactcatagccgccgaatcagctctacggctagtagcagctcgagattgccggcattatggaatccgttgaatgttgcatttgaaaaattgatgaaaagggaaaattccaaagaaaacggaatcaacagcaaagtgaatgtgctgttttattaattggaagtaaaagaaagcagtgaaaagaagcacccaccttataggggagtctgacccatatccgatttctaataaaagtttgccaaattcagtaccaaaactagagttgagcgggaccgggaattttgggcttaaccgggaccgggaccttttcaggttgaataaccgggaattttttgctgggaaaaccgggaaaaaaccgggactagtcccggtcccggtcaaaaccgggacttcggtactcagttgtactcagttatccgtgttcaggtcccggtcccgctcaactctactcaagagtaataaaaaaattttattcttgacaccattcggttctctattaatgttcaaatttaccaagctataatggaaccaaaacgacgtacctgaaactgaacaacaacatccaaaaataataaacaaatacttgaatttaaatatttttttacgaaaaaacggagtttttggaggatcgtcattacagactacgggttccataattaaaaaccccgtaatacgtgttaagaatgttcggaattgacaaaccccgtaattaagggctacggattatcttaacccacagttacgtccactcctgaacaaaagtggatttttcaaatttatcagatttttaaatgaacagcaaattttacagtttgaggtggagattagaacgaatatttgaaaaatcaataaatgtaaagcagtgatcgctatgggcactgagaaaatacactaaaatcaatatacgtaaagcaattatcgctatgggaactgagaaactacgcaaaaatcaataaacttaaagcagtgatcgctatgggcactgagaaaatacactaaaatcaataaacgtaaagcaattatcgctatgggaactgagaaaatacgcaaaaatcaataaacttaaagcagtgacgcatgtgcactgagaaaatacactaaaatcaataaacgtaaagcagtgatcgcatgggcactgagaaaatacactaaaatcaataaacgtaaagcagtgatcgcatgggcactgagaaaatacacaaaaatcaataaacttaaagcagtgacgcatgtgcactgagaaaatacactaaaatcaataaacgtaaagcagtgatcgcattggcactgagaaacactgagaaaatacactaaaatcaataaacgtaaagcagtgatcgcattggcactgagaaaatacacaaaaatcaatagaagtaaagcaatgatggcgatgatgacagaatgcctgcagcataaataggcggcatggcacaagcagaagccattatcaggaccgttttctagttttttcctatttttttttgtaaattctattttttaaaaaatattgaaaaaatcaccaattcttcatgtagaataaattctatccaatcttgtaagtatttacattttttcaaaatatttttcgagaggtttctagcaagcgttaaacaatttcttgtatnttatttnaagggctacccgtattctatttctt

SEQ ID NO: 6781 - DNA, 2414 bp, Heterodera glycines
gttgttgatgatttgaatactgtgcttaaaactgaagctgaggcaaaatttttggaccagccgaagctaaaaaaatgcagttcagcacgccaaatccatcaccgaagaacaaataaaatcaggcaaatttcagtcaatcacacaaattttcgagcatgtcaaaaagcaaaaagcttccgttgcggagagcttcactgggcccaaaattgcccaaagaagaataatgtgtgcagaaaatgccagaggagcgggcacatcgagcgacagtgtgacaaaattcaggcatatcacaaaaataagaggagccaaaatccaaaagtgaatattgtgatgttgcccgacactttcatcaattccgtcaatcgtcgggtctaatgaatgcaccaattttaatgaacgacaaatcaatcgatttcgttttggacagcggcacagaaataattgtcgtcaccaatcagacgtacaaagatattggacgaccaccaattcaggcgtgtcaggaagaagggaaattttttgacggaacgcgctgcaaattccttggccgcggtgttgccaacttccaattcaacggaatccgaacggagctaccatattatgtggccaaaagtggaacaattaatcttttgggcctgactgctttggaccgtcttggatttctggaagaaatgaagcggctgatcggcaccaaaaatattaatcagatttggtccactgattcaaccaaaattcgggacacaattgcaaattttgagaacaaatatgagcaaattttctctgagggccttggactctgcaccaaaatgaagggccaattgatgctcaaatccggcgcaaatcctatttttaaacgcgcccgtcctgttccttacgcaactctgccgacaataaatgccgaaatggatcgattggagaaattaaaagttatcaccccggttgatcacaccgattggtcagcacccattttggtggtcaaaaaggcaaatggaacagcaagattatgcgcagatttttccaccgggcttaaagactcgctccaattgaaccaacacccgcttccgcttccatccgacatttttgccacattaaatggaggaaaatatttctcaaaaattgatttgtcggatgcatatcttcaaattgaattagaagaaaattcgaagaagctgtgcacaattgcgacacaccgcgggcattaccaatacgaacgtcttcctttcggcatcaaatcagcccccggcatatttcagtcgataatggacaacatgttatcagatctgtcattcgcattggcatatttggatgatctgatcattgtcagcccaacattggaaaaacacaacgagcatttggatcaaattttctccaaaattcaggaatggggattcaaaatccgaattgaaaaatgttcatttttccaacccaaaattaaatatttgggagtgattatcgaccaaaacggacgacggcctgatcctagcaaaatttctgcaattgcggaaatgcgaatgccttcaaacatcagcgaattgcgttcctatttaggaatggtaaattattaccaagaattcgtaagaaattttcgcacaataagacagccgctcgatgagttgctgaagaaggattcaaaatgggactggtcgccgaaatgtcaaaatgcattctccaaaatcatcgcaatgctccaatctgatctggcatttacgcattttgacccatcattgccaatcgtcgtcgcagctgatgcgtcacaatatggcattgatggagtgatttcacacaaattcagtgatgggacaattaaggccgtttctcatttttcccgatcacttacaccggcagagcaaaataatggacaaattgaaaaagaagcccttgctcttgtgtaagcagtaaaacgttttcacaaaatgattctggtcgataatatactgttctggcggatcatcatccattatcgaaaaggtattcatcaaaaatgatgtcccaatatactccctcatccgccttgtccgatggtctttaattatgaatgcctatgacttcgacatccagtacattaaacccgaaaaattcggtcaggcggatgcactttctcgcctaatttcgtcacaaaaatctgacgaagaagtcatcattgcgtccgttgagcttgaagcaacattggacaacgatctatcaaatgtcatcaatcaattgccgatcacttttaaaaacttgatcgaagaaacgaaaaaggactcggcacttcaacaaattgtgaaatttgtaaaagaaaaatggccggaaccaaagaattttgagccagtggaaggcttgaattctgaaaaattcacacaattttaccgccgacatgaccaaatttcaattgtcaaggattgtcttatgcttggagacagggcaatcgtcccaaa

SEQ ID NO: 6782 - DNA, 2015 bp, Heterodera glycines
tcgcattaataaaaattcgcaatttgtaatttaattaagttaatgaaaagagagattcttaaaaattgtcattaatggaaacacgtattttgtacctttattttgtgaaatgcgggatttatacctgcggtgtgatgcccgaaggaagcggagtgtgggagaaagtgggagttggtaaattcaaattcgtcttgctcggcctaacagatcacatgataagttttacaaaaattattcataactttccacaaaatcactaatttttgaattctttgcattattctattgcactaagtgttctctattagcctgcaaaatttcaaaaaaatttccttaaacttttaattagtatggccaaaagaactcaaaaaaacctgcgttttggaacattttgtccataactttttgaatataagcaaggttttttattttaatggtttttcatattaacttcataacatcattcactctctaaaaacaataattatttctgcaccagcatttatttttgcaaaattaattcaataaaataaaagtaaaaaataaaatgaagtagagatctagaagaaacaaatgaataacaataattaaatattcctaattaggtaaaaccaaaaataaaaaacaaatttggcatttgtcaatgagaatatctataaagaaaaatcaatatggattataaaaattataatattttaaaaatcaatatgttttagttggcacttccgctttgttatgcgctcaagaagacccattttgaaattttatttaaaattagatttatcaacagaaaaacaatttgcttgccaacaaagtgacagcggttttcggttcctcggtgtagttttcggttgggctgatgatcggctcagtttcagttgtagtcttgatcggttgagttactgaatttgtaaatttaaatgtaatttaaaaaaaaatcgcttaaaatatgaatttgacattttatatattacaaggatataagccgatggtaaaaaaaattcggaagttttgtgaattacaaaattttttcaacatagaattttccacgtctttttttttattaaattagtaaaaaataatttttaatttgtttcaatgaatggatactttatttactaaatttatgtccaactcacggtaaatggtgtgagggcggcgtggcagaaagcatagccgataaaaaatttcaaaatctaactttgtctagaattttgttattgttaaaaattttgctgttttttataaaaatttaactaaacaacgcaaaatttcattatttgaataagcttacatccctgctagtaaaaccaaaattttaatttatctcatttaccgccttgcaagtgtccgagaatgagcggcggcaacactttacaaagacattgcatcaccttcaaaaaatggaaaatttaaatcatccatgatagataattttctgacaaattttaaacaacaaaaatggaaaaaaaaaattttaaaaaataccgccggtttggaaacgagttccagcatctaaacattggactaaatactaattttactgctaaaaaccacgatggcggggttggaaattgggggacggattttgtatgacaagcaaggtcgggacgttaaaatttctagacattcaagtaatttaaattgttttaaaaatgaacaattttggtgatttttatacaaatttttataaaagtggaaatagaaatatttaaattgcttaagcttaaaaaattctactaagtaaaggaaaattgtaattcagaaaaaataactttgtctaaaaaacaaaaatggtcaaaaaatctcacgcggcaaaaactgaagatagacgtgattagcaatattcactttaaaattaattaataggtttgaaatgtaaattaaattaatttttaacagtttcttcatcttcaattaataattctgcaatccacaattgcggacccactaaaagccggcaatttgagcaaaatgaaattatgttcagcccggccaaaaactattctgtacaa

SEQ ID NO: 6783 - DNA, 1548 bp, Heterodera glycines
aactgctttgcatgaaatggggattggcaattgacgcaaaaagaaggccggcaatgtcgccacatgtgcacgggtcccatgttgtgccgatcatttcgagttctcatgctgcacgacagagcaggtcgtccccccccccgcgaaattttttttaaatttttcaaaaattataagtaaaatttttttgaaaattttttcttataaatttttgggcaaaacagattgcattaaaaattacaaaaattttccagacggggcctatcggcgctgccggactcccatgtgttgttccccaaatgttcttggaaaaggatcgccaaaagcggtaaaaaggtcgtcgccatatggctcaaaatcccaaaaactggcctttatagaaagatcccgaaaaaatatttgggattgatcgggattcggtcgggatcccgggtatctgtcccggttgcttttcaaaaatctacgggatagatcggtatcgggattcgatcgggatcccagttattatctgtccggatcgcttttcgaaattcttcgtgattatcaggaccgggattcggtcgggataccaccgattccagctgtctggtccctaggggggggggggggaatgtataagtaggatggcaaaacttgataaacctcgattttaaaaaattatagcggacccgcccccccccctaaaaaaccgaatataaggcaaatccgccgtctgactctgtccccattttttattttaatgttcaaaaaacattttttcattttaaggtcacaatcccatcacaaagtaagttcaatttgagaattagaccggagatcatatacagaaaaataaattgaaaattaaaatttttgaattaaaatattcctgttttttgtgttcccatttttacagtagccacaaattgagcacgaatgagaaaatgacaaaaccgatgacaatgattcaattttcatccatgcacaagagggacatgaaatgaattcatcgtaaataataaatattaaaattaaattataatattttatgaattaaaataaaattatagccaaaatgcaagaaatggtacaattgctgggccatgcacttcttgaaaaccaaaaattcacatacttttgtatgtacatattcactaatgtaaaaaacattcgattttgagacaattccttttgttttgccaatttttaaatgttttgtcattaattgcaatggaaaaacaggaagaagtaaaattgttttttctgtgttctctttggcaaaaatggtttagccaaagactcacaaatcaacgtcatttcaagtcgttaagaaattcgtattttgaaaatctttaaatgcttccaaatttagcattttggcaattacaaattttttgtgttttgttcgaaaattttttgttcaaaaatgtatttatttttagtgcaatttattgggcattttttaataatattggttgattgattataattgtaaacatttaggcatcgtctcggcaactgtttgaacttggccatatccctcatttttgggaatctgtttgtagtggcggg

SEQ ID NO: 6784 - DNA, 2526 bp, Heterodera glycines
  misc_feature (2505)..(2505): n is a, c, g, or t
ctcaattttgactattttttgttgatcagttggaccgattcgattttctccacccatttgaccaacagctgagttttctttttgttctgtttttatcactttttcttcatttacatttttgtcctcccaatcatcgccaaatctttccaataagaagtgccaaattttcaatagcaatggttttattggcgaaattaatgatttataaattttcaatttgacattctatacatcatagacatatgtaatatagataaacatatatcaaatttccctattataagcataatataagcgcagcaaagaatatgatgccaattaggtccaaatgggtaaattccatccatcccatcttcataccgtacctacgtgtgtaccgtacccaaccgttgccatgtttttggccaaaaatgtgatgttcaactgcaaaaacgccttcatccatgggcggaattgggcggtccagataaatttcgcgaagtttttttgcatgtgcaatgtgctcatcggaacgggaaagcatctatgatttatttaaaatattaatttttattaaaaatattaaagtatgaattaagtttgaaataaagaaaaaatttaaaaaacaattattttattaattaatttaactataggatttgcaaaaacccttaattaaatcgtaagactgaaattcctttcatttatttatgatttattattttatttaatgtaattttttaattaaattaaatttaaaaaatacgttatttattgtgttgaacaaatttgtttctgtgatgtaatatttgttgataacagctgatgcaatgcgtgtcttcaataaaacatgggcattgtgtgccttaaatcattaaataatttcatataaaaaatttttagaatttttcaatagagatttcaaaaaaaaagtaattataagaatttcttacaaaagatttttttctggattgtatttgttttgcaattttcctaattattttcacctttttgcatatttgagttaatatttatatagaatttcttataaaaaatcaaacttaaaaatagattttatcaaaagagtgatatcaaaagtaagtacttaaaacgttattctaaactttattgggtcttttgtggtattttatactaattcacctttccaaaggttttttgtcctaaaaatataatataaaatattttattttcttattttgtacatatttatgaattctacaatttcttaaattttccgggtttttttaaattattttgcaattttcttacaaataattagcatccctaagcaaaataaaactaaaattttatgtttatgtccaccggttttccacctgttctgcaaggacaggcattataatgagaggaacggcagcacaaatgccctcgcgaacactgaaaattaattacccaattaaatatatattaaaaaaaattaaaattttattatacaaaaatatttttaatatttcatttacctcttaaagccgccatgtgtaatgaatgcgtttgtgttcggatgtgcgagtatttcattctgcggagcccatttgacaatcattacattttggttcaaactttaagcaatttaaatttaaaaaattatatttaataatttactttttcggtttttcctcacatcctttgcaagcaaaaattatttgataatcaattaattggttaaaagcatcaaaaaatgcatttaatagatgctcaggtgcatatttccaatcaacatgtgttccaaatgcaacataaaggactccttaaattaaaaatttgtcatttttaagcatcaataattaaataataattgttaatggctaattaatacggttggattgataaataagtaattgaatcaacattcgaaaaagcaaaatattttgtgatgaaaaaccaaaaaagcaagctaccataccaataggccaagcgagcaattatttgaagattaaaaaaaaaaacaaattaatattaccctaaatttttccctaatttcatgaataatttttctattaaaagcccatttttacgatggataagcttccggttttcttattttgactgtaaaatctattttttaagctaaataaattttagatttcagaaattaaaattaataatttattattaaacatatttaattgacttttatttaattacccttcgagttcggcttctccataaaggtagacaattcgccaggaagtttttgtaaattttttttcatttcacaatgtgctccggtggcaatcatttctgccccaactaaaatataaattaattaaaaatatatttattctatttttaatttattaattttgttcatttaccagccaatggcatccccattctgtcgatattttcgaaaaagaacatttcactgtgccataaaaattcgaaccaattaaaatttgggacaccaaatttcgcaatgttcggcatcagaaatcgttcaactgaataacaaaaataattattatttttgaaattttatttaattanatttaccataaaattgacgct

SEQ ID NO: 6785 - DNA, 3229 bp, Heterodera glycines
ttttcgtacatttttcttttttctttataggtattttttaagaattatagaaaattcttataaaaaattcaaaattttttgaaaattttatttacatattttggtacatatcttggttttttgtatagatttattttgaattctttttgtacaatccctaataattaaataaattatatttggtatttgaaaacctatatttctttgtgattttgtccggtttataaaacatttttcaattgtaaattcatttattatatagtttaaatattttttaaatataaaatattatttaatttttcccacccgtcgctctgatcgaattgtgcacagtgacactggtccctgacgtggcatagaccaaataatgtggtcgttttcgttgtccctggcctcctccactcgattcccacaatcgctgtctcattgttgtgagtgcaaatccgaaggaccaaaaaatgtcatcgaccacaatcaaatcccaatccgtgctcacaatttcagtaacctatttttgaagagtaagcaagaattttgaatattttaggggtaaaaagattggattattttagaccttgacatgggtcaaggaagtctagaccaattcaaggatttttttaaatttaaattttttttactgggtttttattgggtaattttggacctggatttgggtcctttcttgagcccaggctaggccaagttccaagacttttagaaattttaattttactggttttattgagtaattttggaaatggacttgggttaaggacttttgagctcaggccaagttccaggagttcttaaaactaaaatttagctggaatttacacaaaaattttactggcccatgataagcataaacccaggtccatgctttttaatcaaaatgtggggctctcgaaagtagacatttttagttttcgtaaatttcgccacttgtatatttttcaatgagaaattcaaaacattgctcagaaaaaaattacatttaagagttcgctgttatttttaaaatcatcaggtttcaaaaaaaaacttatagcaaaaaaaaaatttgtttttttctgaatttaaaaaaattgagcactaatatataaatcttttaattaaatattattaatttaattggaataatttcatcaagatacataattttaaaatataaatagtaaatttgaacaaataaacttttttttttttgcctgcccacctgttcactatgatttgacaataaaagcccaaaatctttgtttgacatgtgataaacaaaagcaaatgttggctggattaaacgcgttgaccacaaaagaaatgaaaattgacgtctttccttaattagaataaaatttttcgcttttatttattcaacttttttgaaaaataaattttttttggctgaaaggcaaacatttttttcataaacaatcaacaaaaaaaaatgttcaaataataataataataaaaaaaaacattttcttagaatctgtaattatcctctgatccatctaaccaatcaatcaaagattagctgatgaattaaactgtttcattcctgcctaattaagaactgactgctgttctactgtactgtatgtatcgtatagttttgtaataattattatttaattttgcctcatcattgcttggaacaattggtaatggggcgcgaatatgatgaataaacggtttttgtttttccactggaagaattgtgtccaaaattgcaactgaatgtccacggctggcaaatctaagaaacaatttttaaataaataaggcagaagctttatttggagaaatattaaaaatgataaaatatttttatatatttatttttatattaatctaataattatatttaatttttctttcctaaaaaatgtgggtctttttgatcacgaatattatttacatttgttttgacatctgctgttgtatgtatgtaatctctatgatttttcgaaaaaatttaaaattaaaataaatcattaaatgagtcagacggggtataaatgcaaaaatattcataaaatcctgaacaattcatctaataacaagcaaatgaaaaaagatgtcaaaacaaatgttatttacatgatttagagaccatatgaaagccacttaattcataattttgggaccggggttttaagtttatacttattttttctccggctttaactcgacgagaaatgcacgaaaaacacattttttgtttgaaaattttaggtttttcgcccttattcgaaattagaaatccttattttggatgttagcccataaaatccgtaattaaatattcgcccttaaaataagtttttgcccatattttgacattttgtccaaaatttattaacaaaaatgcaataaaagcgaaaatacaccccccaagaatcgtccaaacaatttcaggaaaatgtatccctatgaatcgaccgtaaaattttcaaaaatagaccaataagaaatgaaaaattttcttaaaaattcaatctccaaaatttattttgcacctctgaactttagaaatcaatttaggccaataatcatatgtcttttacccccgaaaattttgaaatgtatctctgtaactgcaatcaatgaataaaattgtttgctttagtttaataaaaatgggcaatggatcttatcaacgcccgctttccgcgttttaaccgcccagccagcttcttccttacagttttaaattattttcattaaaaaaacaacaatttaaaaattatacccctaaatttgtaactttttcgaccttattttcgcccttatttactgccttattttgaactttttcgcccttaaaaattcgaaccctattcatatacaaaatcttttttttgttgggaggggtataagtaaaacctgaaccgtcaataaatttatgaatattttaaaataaaaaacaaaaataaaataaaaattcacttttcaatcattgggagcattgattgaaaatggctgccactgtcgtggaaaaaagtaaacaaaattttctcggcattgacaacattttgaagcagtaacacagttgtaataagtaggtatgaacaaaacagctttaattgattcatcattaaaataaatctgaaatttaaatattttaaataaaattttaaaaaaataaattttcgaaagaaattttttcaatgaaaaaagagaagaaagaacgactttgaaactgacgaaaaatctgtcctcgcttttt

SEQ ID NO: 6786 - DNA, 7220 bp, Heterodera glycines
acttttgacttttgtcatgcctaccataacatggccgagtatataatcttacggatttgtaagaaacaacccccccccccccccgcgttaaggcattcacatcatcaacattcgcaaaacgtgggagaaactgttgttcgccgcccgtgccatcgcggccattgaaaatccgtccgatgttgtggtcgtctctgcccagccgtacgcccaacgcgctgtgctcaaggtttttgcttattccatggttctggggtcgggctgattgtgattttttattcaatttcggtcccataatatggagcggtaaacccgttacaaatgcattacatggaaaagtttagtttggttttccaaggtaaaagaaagcacagagttgaagcgggtttctctttgcttaaccgaatcgatggcaataatctttctataatacctaaattttcttcatgtttcagttcgccgctcacatcggtgccacgccaatcgttggccgttccacgcccggctctttgaccaaccaaattcaaaagaatttcaaggtttttaattgcttctatcaaaaagattttaaacacaatttggtattttccgttcgggggccccacatttatttagtttaaaaaacgtcaaccgccatgctgatccattcgattatactctgggccaatttgttgctttttgactcccaaatagctgaagcgatgtttttgaaaattcatcgcgctttttaacgtttttaatttaaataaatgtggggcagccaaacggaaaagtacccaaagctttgcacttcataaaagccttggtttacaaccatttgtttgtacaggaaccgcgtctgctcgtggtgtccgacccacagttggaccaccaggcggtccgtgaggcgtcctacgtgaacacaccggtgattgcggtggccaacacggactcgccgttgaaatttgttgacattgccatcccggcaaacaacaaggtttttaccctaatttttaagctatttggagaggggtactgaattttttttactttcaaaacacgacatcgggcagctgcccaaatgattagtcaatatccgaccaaaaattgttgtcactgacaatgaattgaaaaatttttaaattacctgacatcgggacctgaaaatttaatacgcttacaattttggtattactcacccgggcaacaaaaaatgtttcggtactcttttgattgttccttttcatcccaaaacttcccccatcaaaaattaaaacaattccaatccccccacagcaaaagcactccgtcggactgatttggtggctgttggctcgtgaagttttgctgttgcgcggcaaaatcagtcgccagacgggctttgtggtggacgacaagctgatcatgcccgacctgtacttcttccgtgacccgcaagaacaggagaaggagggcaccgagggtgaggccgaggcggacatcaccgtcaaggagggcggctggggtgccaccggaggcatggacactatgggcggcgacttccccggagtacaggttcgcgtcaaaaatttatgccaaattgcagagtcttgaaggttttagccaaaaatcactggttttaaggatttacattttttttcaatcccggatggcttaaagagttgtaagcgataatttgatcgatagcaaagtttttgaaaatataatatttcaaacaatagaattattgttcctaaaatcaaaagagcacattttcttaaatttaatgctgcttaagacctctaaaattgaaaaaatgtaactttggacccgattttagacataggcgtaaatgtccgggggcgcaaatgtctggacacggttaatgggcctggcctgggtcgtctagttcaaaaatcctttttcggtcgtcccaacttcagctttttcacaattatttaattctaaatgtttcaggccgagccgatcaagctggactttgaagtgccgcacatcaccgactgggccgccgcttcgtcggattggaacgcgccgcccgcggagcagcagccgccgcaagcgcagcaaatggttgtgccgtcgcagccagccgctcaggcgccgtccgctgtgcctccgtcggcgattgcaccgccacaggccgccgctgttgcaccgccgccgccacagccgattcagcagcaccaaccgatgccgactcaggtgaaatgcttggttaattgtagcgaaaattgctcaacatgcatttgttgatgacctccttttcgacaaaaattacggggttattcgaaatgaatgttatttgcctacgaaaaagtacaaataatccaagacaaagtaatttatgagtgtacgaatttgggttttgttatttctgttactgattgatcatttgggttttgagtgtcacaggaaaaaaaattgttgctgtttgtcagcacacggttctcgagcagtacaccaccgctcaattatacctttcaatttgtgatttttcctatgtttacactcaaattcggttgcttttttgcagaaagtgtcgaatttccatttgattcaatgacgaaaggaacttcatcgtttggcaagcgccacaacaaaacccacacgctgtgccgccgctgtggtcggtcctcataccacattcagaagcacacctgctcgtcctgtggctatccggcgaagcgaaagcgcactttccaatggtgggtttttggcaggagcctcggcatttgcggccccaacctactcatttaaaaaattaactttgttccatataattttaaatcgaatctactatgcatgatatgttctatatttaactattttcttatcagtacaagaataattccagacgttttttgttaataagcgcatacattaatgggattggcatggatttcttcgatgtatcactggccgatgcagaaattcaggattagtagaatggatagaaatttcaagctttgttggggccttgagcaagcccaattttgttgaaaaaaagttagaataatgttcatgtaaattttaaaaagaagaaaaatctggtaaatgaaataaattggaattttcaaataactatatgacctccctgtgatatatagagaaactagaaagtggttaatttttttaatgagtaggttggggccgcaaatgtcgggaaataccccttaagaaatgggccgcaaatgtcgggacacgttttggcatatgattttctcgaacactttttccaaaaacattaattgttcaaattgcctttttagtttgaaaaaacataattttttgacaaaaatcactgatcaaataaatttcatttttgtattcgtctggctgcgttcgatagctccgaattcaaaattatccaactttataatattgtattaatggcatcgctttcttctaaaggtctgtcaagtccatccgccgacgcaccaccggcaccggccgaatgcgtcatcaaaagcttgtgcaccgccgcttccgcaacggattccgcgagggagtgaccgcgccgcgcaaaggcgagaaaaggagagagagagaggcatcagaaattgatggagaatgaatcttttaaatggaggaggagcgcgcaattgccaggtaaaaaagcccgtgacagcccccataaatggttcgggatttgaaaaaattgggtcgtattcacgagaatcggttgcacttcatttcgccttcttctaaaaaccgattttgtggccataacttattactaaattatttctgctgttttttgtacagtaggcccacttaaccagcggggaattgccccccccccccgcccccgaaatgaaaaaaatttcagaaaatgggtatttctttcaaggttactgtattttactcggagccccgacatttgcggcccagacatttgcggtccgacttttgcggccccgacatttgcgcctatgtccaaaatcggactcaaagttgaattttttcaacccctgatagcctaataagcattaaaattaagaaaacacggttttatggttcattatgatcaataattttttgtttgaaaattttattaatatttattttcgcgcatcaaacggacaccaacaacaaaagcaatagcagcaacaacgattaaaacagaagcagcagctggaggtggcacaagatttcacgtttgggaccattggaatgttcgggcgaaggtatggtgagaaaatgagcaatttaagaattggggcgagaaaaatgacggatccgggtttatgtcgggacaaaaaaaagttcgactcgagattcgcgacgagaaaataatggatttcgggactcgaataaaaactctgattggtctgactaaattgtcaattttcatcgaattagaattttcacctgagcaaaatgatctactaattaattcgactaaatttggcttaattttcagttttcttattttgaccaaattttatggattagataattgactgatctgaacgatttcggaaaccatatcaatattaaacctatcatttcgcaacatttggccaatgctcaaaaaaaacattcatggcttgcgattgtccgccgcaattttccgccgtttgcgtcattttactccgtcaattgtcgacgactgtccatcactttgcgttgtcaatgcctattccagtggtttcttcaccgaatttccatgcgatgacagtgccgcggcatcgaatggacaaacggtggccaaatggcttttcactccatttcaaaacaatgtgccaaaattgttcaaatgctcgttgtatatggatgatgggaattggtcatctgtgcgcgacgaaagcaaatggacaaaatgggaaaaggaggcaattgattggaaattttttgatcagtgaaatcaaattggcaaacttcatgcttatcgtgaggacgaaataatgggtcagcgaatgcttattcaacaaatcaaatttattttgtttccattttttagccatttcaccagcagccccaaatgatcagtagcagaaatgaatgaaagaatgatttggtgagattttaattgagcgacgcagttggcccatttagtagtgctgttcgagaccaaaaatttcccgagactcgaccccgagacccgagaccgagaccgaaaaccccgagaccgagactcgagacttttttcaaaaaattttcctattcgcttaaaaatcgttaaaaacattttttgactctattcttaactaatttttggtttttttttaattttgattcaatttggtacaatatttatcatttcaaaaacgcacaaaacaaaaattcattaaaatttaagtgcaatttgttaactgatttagtccaaaaaatgaaaatattttacgaatttaattgttaaaattatgattgaattcccaccgaaaaatgaataattttgaaaaattagaagaaaaacaactacttggaggggaattacttttttttaaaattttcttatttcttaaaaattatgaaaaattactattacgtttgaaataattgcatttattcaactgaaaaattatgaatcaaaattaaaatgcaaaaaaacagggctcccagattaaaagtttcaaaagcctcatttggtatgcaaaaaagcctcattttgagtcaaaaaacctcatttttacaactttattcaaaacaaaattaatatatgcttactaaaatattaaataaaatatatttgatattttttaattttatatttttatccaattaatgatttcaaaaaatttctgctatcgaagtttttcaaaaaattaaaatattcatatacaaaacaaaatttaaatgagttttaatttattttttgaattttgtttgaaaaaatagttaatttttaatattattactttgtttttttcgcagtttttgtgtcaatttaaaaaaataaagggtattttggagctccggcggtgccgataggcgccgccggggaaaatttttaaaatttgagtgcaatttgtgaacaaatttagtactaaaaatgacaatattttatgattttaatttgattagattcacttaaaaaggaataattttgaaaaattagaagaaaaaataactacttggaggggtactgatcccacgctaaaatgaagacatgaccaagaacataacccactgagccacgcacactattaaggtaatgaagcaaaaatataccaaaagtatatttatttctaacttacaaaaagccgatcattaggggtgtaaaaaagtctcggtctcgagtctcgaaagtctcaaagaccgagaccgagactgaaaacccgagaccgagactcgagaccgagaccaaaaaaaaccgagacttttctcgagtcgagactctcgaacatcactaccatttagtactaagacgcagttgacccctaccgctctaatgcacacatattaagaatggcgcatgaattctattttaaaatttttatattattttaaaagttttatcgcacttaactctttttaatcggaccgggtcagtttagtctggtcgttttagtcggagggtcggtttagtctggcaagaatatttttttaaattcagcctacacattgacattaatgctaatgtcctcaaaattattggaagccacacatgcgacatgagcgccgaacagtggagtgttagcgacgtgtgacccagctaaaaaatgtgcccgtaatgatttttcaatgttttgtttttttattggaaatacattgataaatgcactttgctaggctgaggcctaagcttagaataagtaagcgaacttaagcctaggctaagtaagcgaacctaagcctaggcttaggcttgacttccgcttagaaggccttcaaaattctgaggaaaatcccttttggttaacgaaagctcttcaaaacaaaaatcacatcaaatcaattagcaaaaataaaagatatttcttgaaacaattcatcttcaaaaacattttaccaaatttggtagtggagggagagatttgttctgatgaaaagcaccataaattatttgtaagcaaatttaattgaattttaaatggcatcacagcaatctttgggttcttttgtgacatcatttgaattaccctttcaaccttgtgatcatcttgtcagcaaaatccattaatcttggtatcattcaaaagccctaagttgtcttcttctctattagcctgcctaatttcaaaaaagttatggcaaaaatgttcgaatccagttttttgaattcttttggccataatttt

SEQ ID NO: 6787 - DNA, 2683 bp, Heterodera glycines
gcagtggtatagggtcaaattaagcacggactttcctttcattactagttctccaaaattggaatttgccgttcaattaacattttgagcattttaaacacttgattctattattcttttccatttatttaaatagatgctgcttttaattttcgggttctactcgcactttatcggacgtaattaactattaataactcaaaattgcttctaattccgattatatcattaactgactcgaaattgcttctattgagttgaaaacatcattttttgctagacttgtaaaaattttaagtccaaaggacgagaattgatcacatttctatagagtggataaaatttttacctaggattaactttatggagttttttaaaaactgagaagaatacaccctgaaattaaattccaaacctggtatttggtaattttctcatcaaaatattcctgtctttgcagtgtatagggtcaaattaagcacggactttccttttactactgttctccaaaattggaatttgccgttcaattaacattttgggcattttaaacacttgattctattattcttttccatttatttaaatagatgttgcttttaattttcgggttctactcgcactttatcggacgtaattaactattaactaactcaaaattgcttctattccgattggaactaactgactcgaaattgcttctattgagttgaaaacatcatttttgctagacttgtaaaaattttaagtccaaaggacgagaattgatcacatttctatagagtggataaaatttttacctaggattaactttatggagttttttaaaaactgagaagaatacaccctgaaattaaattccaaaccaggtatttggtaattttctcatcaaaatattcctgtctttgcagtgtatagggtcaaattaagcacggactttccttttactactgttctccaaaattggaatttgccgttcaattaacattttgggcattttaaacacttgattctattattcttttccatttatttaaatagatgttgcttttaattttcgggttctactcgcactttatcggacgtaattaactattaactgactcgaaattgcttctattgagttgaaaaaatgatttttatgctagacttgtaaaaattttaagtccaaaggacgagaattgatcacagttctatagagtggataaatttttacctaggattaactttattgagttttttaaaaactgagaagaatacaccctgaaattaaattccaaacctggtatttggtaattttctcatcaaaatattcctgtctttgcagtgtatagggtcaaattaagcacggactttccttttactactgttctccaaaattggaatttgccgttcaattaacattttgggcattttaaacacttgattctattattcttttctatttatttaaatagatgttgcttataattttcgggttctactcgcactttatcggagggtcggggtcggttcgccgcggccacttcgccgcggccacttcgccgcgggtttttcgccgcggggttttttcgccgccggctttttcgccgcggactttttcgccgcggcaagttcgccgcccgaagaaaaatgtccatttcgccgccataattaaaaatctcgaaaaattttgaaattatgttaaacaacccactatgtataaaaaatcatgctttattaaaatcctttttcataaaaaattaacaatctcaaatgaacaaaatcaaattacgggtccataacacaattatttgaaattccccggagaaattcaacaatattttgggcatcaaaattttcgataatattcaaaatgcgcttgtccgcgtttcggaacttctttttcttcatcggtggttcttcaccgttcacgcagctcacataatcggcgtcacgcgcacgctgatccattcgaaggacatcgatgaatcgccaaattgacgggtagcgacagctgaagattgtttggagtcgacggtgcgctgcttccgcgatgttgtttgttcgctgctcttcgttgacagtccgttcatgcacattccaataattcaccggaaaacgcggacgtgtgcgggtcccatttggcaaaggaacaccggtgtagttgatgaggaacctattaataaccatatgattggcaaattccgacaaaacttaccaccccagaatttggtcgagttcttgtcccacaacatcgttcagcgcagtaattgcaccagtcaaatgctgaattggcacaaatgcgagcgcggtgatcatacgagccgtttctgcgaaaatggggtcacttcgatagcgctaaacgggagactatttctttttttttgggactgaaacttacattttgaagtccttcggaaatcaggcgcttgtgcatgttgtgcactaaatgaaaaaggcaccctcgaagctgagcgcccggaaacactgcggccgcagcgtccatcgccgcttgttcgaagtccattgtgatggacgctggtgagaaggctggccatgcgtcaatgatcattctgaacattttttcgtagaccagtcgcgactttcctgtcagaagacatgtggcgattgggaaagtccattttccttttctgaaatttttctagaagaaattcaaaaaccaaacaaaacaaacttgaaa

SEQ ID NO: 6788 - DNA, 2015 bp, Heterodera glycines
tgctatcgtcatataatctgttggcaacgggcggaaggtctgtatgtcttctactaccggtaagtatttcatcggtaaatcgtgttaaatacccctttgagaaatcatgtttgtatctttctattctcacacggtcgcccactttgattttaggactcttttttgaaaattttttcgcttcattatatatcttttgtctcacttcctcggcattcacaatacatacgtcagcaggtcgcatgtcaattgaggaggttatagtctgaataatgcctgtaccaacgtccaaagctccctcaatccattgttagttactccatctgcggaactttcctatcagcattcatgtgtgcgattagtaaagtcccttttcacttctctgaaatatttggggaagaaatccaacaaccaaaccaaccaaactttgaaaggaggacgtaaacttgtgaaaatggatgtggtgcgatggaaaaagttccatctgcgaacacttcgaccattgcatgcgtccaatttgcgtaagagttcttggcaaaaatcagaatcctgaatataagcggaatttaaaaatatgtcacattaattaataccgatgttgggaattgtcggcattaagtgaaaaaacgccagagtcagatagtaggtattgctcctcctcaactccttcactgcgcttgtacacctgatatgcttggccaatttggaggtcgtgaatagaatttggagccgctggtgcagctacaatttcatggcgtacacgtttgacaatctaaaaacaaagcaaaaaataatagtatgtgtctgcttttcgttaccttcttaattccattggcacttggtaactgagcaagcaccggtgttgaaacgttgaccattgcatttgcacggagttgtgaaggcaattccatgcattccgccgcacgcctcttgatccccgtgacaattttttttgctttcacattggcaatgtttgcttcgtgtgtgtgttcggtgaccattttgacaaaattgttgttcatgtcggtgtgaattcgccctcgacattcgtccctttcgccagaatttcaaactaatatcaacattaaatttgtcgaaaatgtaaaggaatccatcgttaattaatttatccttgtgacgatttgtttcaacttcagacattattaataagtaaccaaatattgcttaatatataaagatagacaatatagatttaataaattatggtacacgagaagtataacaaatttttttttaattatggcggcgaaatggacatttttcttcgggcggcgaactggccgcggcgaaaaagccggcggcgaaaaaaccccacggcgaaaaacccgcggcgaaatggccgcggcgaagtggccgcggcgaaccgggcggttcccttatcggacgtaattaactattaactgactcgaaattgcttctattgagttgaaaacatcattttatgctagacttgtaaaaattttaagtccaaaggacgagaattgatcacagttctatagagtggataaatttttacctaggattaactttatggagttttttaaaaactgagaagaatacaccctgaaattaaattccaaacctggtatttggtaattttctcatcaaaatattcctgtctttgcagtgtatagggtcaaattaagcacggactttccttttactactgttctccaaaattggaatttgccgttcaattaacattttgggcattttaaacacttgattctattattcttttccatttatttaaatagatgttgcttataattttcgggttctactcgcactttatcggacgtaattaactatgactcaaaattgcttctattccgattggaactaactgactcgaaattgcttctattgagttgaaacatcatttttatgctagacttgtaaaaattttaagtccaaaggacgagaattgatcacatttctatagagtggataaaatttttacctaggattaactttatggagttttttaaaaactg

SEQ ID NO: 6789 - DNA, 1352 bp, Heterodera glycines
ctggtatttggtattttctcatcaaaatattcctgtctttgcagtgtatagggtcaaattaagcacggactttccttttactactgttctccaaaattggaatttgccgttcaattaacattttgggcattttaaacacttgattctattattcttttccatttatttaaatagatgttgcttataattttcgggttctactcgcactttatcggacgtaattaactattaactgactcgaaattgcttctattccgattggaactaactgactcgaaattgcttctattgagttgaaaacatcatttttatgctagacttgtaaaaattttaagtccaaaggacgagaattgatcacatttctatagagtggataaaatttttacctaggattaactttatggagttttttaaaaactgagaagaatacaccctgaaattaaattccaaacctagtatttggtaattttctcatcaaaatattcctgtctttgcagtgtatagggtcaaattaagcacggactttccttttactactgttctccaaaattggaatttgccgttcaattaacattttgggcattttaaacacttgattctattattcttttccatttatttaaatagatgttgcttttaattttcgggttctactcgcactttatcggacgtaattaactattaactgactcgaaattgcttctattgagttgaaacatcatttttatgctagacttgtaaaaattttaagtccaaaggacgagaattgatcacagttctatagagtggataaaatttttacctaggattaactttatggagttttttaaaaactgagaagaatacaccctgaaattaaattccaaacctggtatttggtaattttctcatcaaaatattcctgtctttgcagtgtatagggtcaaattaagcacggactttccttttactactgttctccaaaattggaatttgccgttcaattaacattttgggcattttaaacacttgattctattattcttttccatttatttaaatagatgttgcttataattttcgggttctacgcccactttatcggacgtaattaactattaactaactcaaaattgcttctattccgattggaactaattgactcgaaattgcttctattgagttgaaaacatcatttttatgctagacttgtaaaaattttaagtccaaaggacgagaattgatcacatttctatagagtggataaaatttgtacctaggattaactttatggagttttttaaaaactgagaagaatacaccctgaaattaaagtccaaacctagtatttggtaattttctcatcaaaatat

SEQ ID NO: 6790 - DNA, 2254 bp, Heterodera glycines
atttaatgcattcgaattttggaattaatttctcttcccatacacgcaaattgccaaatcggtggatacggtaacggagggactgttacagcaacacgaaggtgcactgcgaagaacacagcagcaaaatgggcaaatggaagcgaaaaatggggaaaatgggagaaacggaagcgaaaaaggtgggaaaaatttaaaaacccttaattcaaatggaatcagaacatcggcccgtgttccgagaacgtctccgcgacgcctacttttgtgagggggcggcgacggcattcgtcgaatgccacgcggtgggcaacccgacgccggaggtcacctttttccaccacgaaagtgccatctgtgacgacggacggcaccaaatcacacgcaatggcaacacgtggaggtgggggggggagggagaggaggaggaattggtgtcatgacaactcgtacaacggcttaggctgccaagttatagtctaaagcttaggctttattatgtacgagttgccttttgtacgaattgccattgactccattcgagattcccgaattttggcccaagaacaagcaaaattgaaatgtgacaaattagttttttccatcaatcactttccctgctaagaatgaccattgtgcgtccgatggtcggcgttgacactggtgaatactcttgcgttgcgcagaacgaatttggccgtgaccgatgcgcctgcaaaagcatttgcggaggtacaaataaccgaaattccaccgagattttatccccaggcccaaaaaacccagaaattgtattccattttcagatgcccctgaacgcccttcaaggcccgacgttgagctttcctcagacaccgaagtgtacgtctgttgggaagcgcccgaacgcctgccggtgaccctcgaaggcgtcatgtacaggtcggtgtagatggcatacgaatttgggaattaaaagaattttctattttttctagtttaaaccttttagactcgaatgccgcccggcgggggaaaaggatgccttttcggcatggactgtggtcagcaattgcgtggaggacgaagcagccgttgtaaagcatttgataccgtaagagaaacaaacttaaaattataggaaaaatttgtatgaaggaaaacatcattatattttatctgggagctaattaggcctaattccaaaatgttctatccacattatcaacattctctcattttcagaatgggcgtctaccaattccgcgtgacggcacacaatgaattcggctggggcaccccttcgatcacttcgcgcattattcgcacccatccgaggggtaattaaaggaaacaattaaattaatttaaaataattaaaggtatcccgaaactgaatttggatgtgctcaggcgggaaggacgacaatttacagtggtgacaatgccacagaaaacggggcgcaggggagccggcctaacgcaaatagcggaaggttgccccaggggaaagggtttaattagtaaatttacttatttatttatattttaacatttaatttgtatttaaatttaattgactcccaaaattaaaacagattttatggaggaacaacgtgaggaagagggaagggaagaagaggaagaaaatgatgagcaaatgggggatgaaagggcggaagagaaaaatgggaacgaaaacaacggaaatggcaaacaacgaacggtgccattgaacaccacggaggacccgctgaagcgctttcaggtcaacaaaagccactaattgaacttaattaatgttaattaacaccctttcaaattcgactcccccccccccccaaatttcagttggaatcggaattgttccgcggtcagttcagcgtcatccgttacgcggttgactccaaaacgggcgcccattgcaccgtcaaaatccgagcggcgcccagccacgggtcgctgatgttcgcggcgccagcggaacgcatgcgagccgcgcgcgctgagtacgaaacgctggcggaatgccaaagtgcgaatgtggcacgccttatagcggtgagtgcctgctagaccggttcagtcggaccaattgggcacgggttcggctgaatccaccgaaaaagtgccaaaaatgtttcgtttttgccaaataaggcttattcctccgacaacgcttttctgctccttttcactgaacgcctttacgaaaatctgttccaacgcttcgtccgattggacgcgtacacggaggagcaaatcgcattcacag

SEQ ID NO: 6791 - DNA, 2287 bp, Heterodera glycines
  misc_feature (4)..(4): n is a, c, g, or t
ttantcgagcaaaccaaaggcacattagtagctcttatatctttaaaaaaagaaacaaacaaataaaattgatcaaattaaaactacaaaaataccgaaatataaatgaaaataaaataaatcaaatgttgaattcacaggtgattataaattgtaaatgtggcacagaaatttcctactcagaactcattgcttttagtaaatccctgaattcctttgccttattaatttgcaccgctaaaactggaaggttattccagtttcttactatcctatggaaaaaattattttgagttttggccgtgtggcgctttactcgtaaaagtaaaggcctcctgggcctttctgagaaaaaaaaattttgctcagcatcgaggctggtgaaccctttgattattttaaaagctgttgttaaatcattgatttttcttctttcttccaatttgtgtaaatcagtgattttaagtctttccatatattttttgtacacaaatccacattttcgaaaagcttttcttgtgaaaaatttttgtacccgttcaatttaatcgtattaatataattaattaatttgtttcgttaattggcttcggctgccactttctttcccttccctttttcggttgacttcggccgcgcccgtcgcttgggctcccgggaaggcgccgccggcgatggccaactgatcgccgaatggacggcgcccgaattgcttttggcacgtcaaaacaatggcacaaaagcaaagatcactgatgagggtgagctctaaaaaagggtgagaataattggctcagtttatggcgctttttaggcccaaacggcgcgggcaattggccaaacgcacagacggacatgtggggcctgggactgtgcacattttgcctgtaacgaattggccattcatcaaaaatttatgacccaaaaaatgcgcacaattcacagattggccggctttcatcccttcgcggacgacgacgacacggagcaggacatccgccgccaggtgcttgagcaccgctgtgacccgaatctgatccctgtgcaagcgtcggaagaagcacttcgcttcgtcacgtgggcactgaaaaaggacccgcggtaaaaacggatgagaggcaaaaaaacagattttgacgggtgtgccagagatttaaaaaaaggtttgtttagtaggcgaatgcgccctgacgaagcgttggaccaccgtttcctcgcctccgacgcggcgatggttcgtcgtcgggagaacattcgctacgcgtcccatcggctcatgcggacggtccaacggcgagttcggcagcaaacgcaattcgcgaggaacggaggagcggcacgggacggtggcggaacggcgccgccgcattcgcacgcgggcggacggacggcaaaaccgacgaaaggagcgatgaacaatggcacggcagggagaacaacggcacccaaacggcgcgttgtgaccatggaatgctaaccaacgcgagagtctcgaatttgtcaaaagccaaaagaatggccaaatgaactcaatcaattagagaaaatgattgtttattttattgaatttctcatattcatttattggctattaaattcatatggttgaccgaaaatgaacggattcgggcataaaactcaatttcgtcctcaaagttcatttaaaataggagaaaaacggatgcaaaagtcaacggatatattcttacaagacataaaaaatgtctcaagactatgtctttttacattcattgaatgtttttgtttgttttgttcaatgcataaaatggataaatttattttcggattaattattatttaaattaatttaattaaatattttttgggaaaatattcgaaataaaaggaaataatttcttcaataaaatatggtaaatttgccattttagtgctctttcccatggcatttctttctttcgtatgcgtgggattagtaacatttattttaagttttgccattaatttgtgcaatttttttaaatacgtaacgaaatacaaaaattagaacaatttccattgccaattttgggctggaaattcacattatttggcattttgccttaattatttccaatttaagccaaaaatttctaaaacttgcagaattgcattttgatgcggcatataaataagcgtatctttttacttgcaaatggcacttcgcatttcggcgccgtatttaatttttcaatttactttttgcctttggcatgggaatgccttgccattcggcttttgtgcgaaaagcggacttcaaacgggccaa

SEQ ID NO: 6792 - DNA, 3493 bp, Heterodera glycines
  misc_feature (3431)..(3431): n is a, c, g, or t
  misc_feature (3442)..(3442): n is a, c, g, or t
aaacgggccaaaagaagcttttcatgcactagccgaacgcctttggcactcaccacgcgcaactcgcctatggcattggcactgcctaaagaaatttaaaaaattcaaaactcaatttatcacaaaattgctttaggcattttttttaatggacattccaactttcgctgccaacacaacagcagaaccagcagaaccgaacgaaatgagtacggtagttgaaggtggagcagagaaaacggtaattaaaggcggaacatcccccccccccttcccgcgccccattcccgcgccccacgccttaagaaatgcaaaatctaaaaatttccaaaaaatcgggttttatgaatttttacgtaaattaaaattccatatgttttaagcaaatgttctctaattatgatttataaatgatcattatccaaattcaaccttccctcccccaattatcagttgttcctcccctgttggtccgtgcttttgtgtgccgttgtgattgcttcagttgccgccgtcagcattttcctcaacacttttctagttttcgtcaccgtccaaactaagtgtgtctttggtatatcttttgtgccaaatttccccaatcaaaaggcaattgcatggctctgccaacgcacttttggcactcaattcgttgtttgaagtgttccatgcgttcggccacttcgtctttctttgcgtcgccctctccgatcggtgctctcccctctcctaccgtaactcctaccgttcgttgaccctttcgcttttcggccttttcgccgcttctttttctatgcttttctccggcttcgatcgcctcttttgcgtgtttttcccattaaagtcaatatttttcatctgttttattgctttatacctttttttagttactttcgcttctcccatttttggcgctgttttgccattgctttttccctttgtgccattccgagcgttgcgctgaccgtcgcattttggcgccggggcgaagaagtgccaacgatggaagtgaccggaagcattggcgacttgatcatcaatgttctgttaaattatattgagttttaaaatggttttgtgttcatttttaagggtggctttgccttcgctttgtacagcttcgcaaagttcgcctgcacaagtggaactgtccttttgtacgctttcctcgccatttggctgtggcacaaacgcagtgcgccgttactttatttttttactaaattaatttattaaatttgacttttttgaagatgaccaaattcagtcgatggcacattgtgccaaccgtcgcattttcgtctctctgttcgtcatcgttctgttcaatgtcggcggttattttctgatcgccattttctaccttttttggcctccttcggcccatccctcggcacagttttggctcgttcgaatggttctgtcaattccggccaatttgagcggtgcgtccaacgtgccgattcttttcatgacgaggcgagaaagagacaaaatgccatccctattcttactaaattttctataaatttcacagctcggactaccgaaaggcattcaaaaagcaatgccaaaatattttgcttttactcggccaaaatcgaaacagtgccattcatccgacgaccgtttttgtgttgccacagaggcaaaaccgacaaagacagcgacagaatgtgtttgccagcagaagatgatcaacggaggaaaagaagcagtggccaaaactgatcagagaatggatcagcagctgagggcaaaaagtgatcaaaaatttatcgaatcgatttgggataaataaaaaataataaattttaaaaaataattttaaaaagtggtcattgaaaattggggtgataaacggggaaaatacagcgatggaatgggggggcacagagataaagctcatttctggtgatcagatcataattaagaaatggatgctcattatgtgctctagaatgctcattttttgctgagtgattccacacttttgacaattttcttcgcccgcaaattgttcggattgaatcggaagggcaatcggatgggaatttcctccgctttgatctgattcttgaattcagcgatgaacgactgctctatcagtcgtctgttcacgacgtcatcaatccaaatcttaaatgatcactctgattatcaaagtttaaaggatttttgccaattctgtctgatcagaaagttcctcgcacataatggcacctcaaatttggccatgaatggcaagtccaacaagttgccataggatatcggatcacggcgattgcccgggttaatttcgcatcggtagaacaatccgtggacatggcacgcaattggagagggcattccgaacagcgagcggacagtttggatgaacagagcgtcgagtttttgcacggtcaccgcactttgacgacccgaagtgccgtgaaaatacaattggaaaatgccgccggagagattttcgacactttcgaattttggcggaatttcgtcgcggaaaattgcgacgcccaatttatgattgaaaactgaaaaataaattttaaaaaatactaaaaattgacaattttaaacgtgagaatgttattttttaaaatgccaattgtaattatatatatttttttaattatttaaaattaattaattaatttatttatttaattgcccaacttttactcacaaacacttttcgtcaatttgctgggcagaaatgtatcggtgttctcgcgcttcaaatacgaatcccagcgggcgtgcgtttcgttgacaatgtttttggcggtcggccgtaatttgttcacttcggcctcaattagaaaattgcaattaattaattgtttttccatttcctacacaaaatgcacatgttttcactgtgcaatgattcggaaagtcgcgacaatcgaagcgccacaaagtccatttggggggaggagaagcgaagggacggcagagattaagcggaaaactgaattaattaggacgagaatgaataatatgtgtgaaattaattaattaattaattacattgtgccacactcacttttgttctgtctcatttcgcaaatttagccgattaatggcaaaagcaagggaatgtgtgggcattacaaattaaataggttctattattacccaaatatttgtgcaaacaaaaacgagtgaattaggtaacgcaattaattaattattcaatggcgacggattgggggaaagagaaaagggaaaggcaaaagaaaagggaaaaggaaaaggaaaggcattgattggattggcatgttttaaatgattcatccgtccgcagaggaaggtaatgaggaggaataacgaagaagaagaagatgaagatgaagaagaagaagaagatgaagatgaagagaaagatggacacacggcggaaggacggaaatataaatataaactanatgaagaattngacaaaaaaggatttgttgcatctttttgcaagtttttctttgtaatttaa

SEQ ID NO: 6793 - DNA, 2580 bp, Heterodera glycines
  misc_feature (4)..(4): n is a, c, g, or t
  misc_feature (22)..(22): n is a, c, g, or t
  misc_feature (38)..(38): n is a, c, g, or t
  misc_feature (42)..(42): n is a, c, g, or t
  misc_feature (45)..(46): n is a, c, g, or t
  misc_feature (63)..(63): n is a, c, g, or t
  misc_feature (78)..(78): n is a, c, g, or t
  misc_feature (80)..(81): n is a, c, g, or t
  misc_feature (83)..(83): n is a, c, g, or t
  misc_feature (85)..(85): n is a, c, g, or t
  misc_feature (91)..(91): n is a, c, g, or t
  misc_feature (102)..(103): n is a, c, g, or t
  misc_feature (120)..(120): n is a, c, g, or t
  misc_feature (127)..(127): n is a, c, g, or t
  misc_feature (136)..(136): n is a, c, g, or t
  misc_feature (152)..(152): n is a, c, g, or t
  misc_feature (157)..(159): n is a, c, g, or t
  misc_feature (161)..(162): n is a, c, g, or t
  misc_feature (169)..(169): n is a, c, g, or t
  misc_feature (172)..(175): n is a, c, g, or t
tttntaatttcacttcaccatncttttaattcccaccntaanacnnaacatttccaaaatttntaccacattttactncnnanantccaantaccttaattnnacaattacttatcaacnaacacantctcctttnccctcttatataacanaaaannntnnatatcanatnnnntgcgtcccttcctaaaaatttctcttttcgtctaaccatcccacctttttgtgctctatttcattttcaaaattgggaacatttttttgtatgtttttttgaaactaaaatgtaaaaaatttaataattatttttgatttaaataatgcttctgtttcgaatcttttggctttaagtaattaaattgtaaaaattcaaaactaaaaattctccactgaagtttttaacttggctttaccctgcttttaagtcccaccgtgaggcgggacagttccaaaatttgtaccacattttactgtggaaagtccaagtaccttaaggactacagaagagccaatgacgcagtcacctttggacagttattaaaaagaaataaggaaatattcgatggggtgcgatcctttcaagtctaccctccctcgctttttgtgcactgtttcgtttctaaaattggttccgaattttttggcattttgaaattaattgcaaaaattcgaaacaaaatactctgaagatttgtaatttcacttcaccatgcttttaagtcccaccgtgaggcgggacagttccaaaatttgtaccacattttactgtggaaagtccaagtaccttaattggacaattacttgtcaacgaacacagtcgcctttggcctcttatggaacagaaaagggtggatatcagatggggtgcgtcccttcctaaaaatttctcttttcgtctaaccatcccccctttttgtgcactatttcattttcaaaattgggaacattttttgtttgtttttttgaaactaaaatgtaaaaaatttaataattatttttgatttaaataatgcttctgtttcgaatcttttcgctttaagtaattaaattgtaaaaatcaaaactaaaaattttcctctgaagttttgaacttggctttaccctgcttttaagtcccgccgtgaggcaggacagttccaaaatttgtacaacacattttactgtggaaagtccaagtaccttaaggactacagaagagccaatgccgcagtcacctttggacagttattaaaaagaaataaggaaatattcgatggggtgcgatcagggctggccgtgatcacggatcacggctcacggatcacggaaatcacggggtttttggggtgccgtgatctcggatcacgggtcacggattttttcaaattttccgtgattttaatccgtgattggcatctaatcaaaattttcagaaaattttcccaaccctctaagaattttttctaaaattttcccgactttcagtatcttttggggtgttcagatcgtcatgaaggactgagcatgttggtccaaaagattttttccgcatcaaaagttagcttacaaattagaggaaatttctctacataaatagatttttggttaaatttaagaaaaatttgaaaaatttggaaaaggtcgccgcaaaaaaagcggtttatatgttttggtttctttaaaacattttttgggaatttttcccgcgattaaattccgttttttaaataaatttaaataaaaaatcattagaaaaattttttttataatcacggatcacggctcacggatcacggaaatcacggggattttggggtgccgtgatcacggttcacgggtcacggatttttttaaaagccccgtgatcacggctcacggatttccgtgattggaaattcaatcacggccagccctgggtgcgatcctttcaaaaaattactctcgtcgtctaccctccctcgctttttgtgcactgtttcgtttctaaaattggttccgaattttttggcattttgaaattaattgcaaaaattcgaaacaaaatactctgaagatttgtaatttcacttcaacatgcttttaagtcccaccgtgaggcgggacagttccaaaatttgtaccacattttactgtgcaaagtccaagtaccttaattggacaattacttgtcaacgaacacagtcgcctttggcctcttatggaacagaaaagggtggatatcagatggggtgcgtcccttcctaaaaatttctcttttcgtctaaccatcccccctttttgtgcactatttcattttcaaaattgggaacattttttgtttgtttttttgaaactaaaatgtaaaaaatttaataattatttttgatttaaataatgcttctgtttcgaatcttttcgctttaagtaattaaattgtaaaaatcaaaactaaaaattttcctctgaagttttgaacttggctttaccctgcttttaagtcccgccgtgaggcaggacagttccaaaatttgtacaacacattttactgtggaaagtccacgtaccttaaggactacagaagagccaatgccgcagtcacctttggacaggtattaaaaagaa

SEQ ID NO: 6794 - DNA, 1998 bp, Heterodera glycines
tccaaaaattgtaccacattttactgtggaagtccaagtacgttaatggacaaattaattgtcaacgaacacagtcgcctttggcctcttatggagcagaaaaggggaaatatcagatggggtgcgatcctttcaaaaaattactcttttcgtctaaccatccctccctttttgtgcactatttcgttttaaaaattgggaacatttttttgtttgtttttttgaaactaaaatgtaaagaatttaataaaattatttttgatttaaataatgcttctgtttcgaatcttttgactctaagaaattaaactataaaatttagaacaattaattctctgaagtttttaacttggctttaccatgtttttaagtcccaccgtgaggcgggacagttccaaaatttgtaccacattttactgtggaaagtccaagtaccttaattggacaattaattgtcaacgaacacagtcgcctttggcctcttatggagcagaaaaggggaaatatcagatggggtgcgatcctttcaaaaaattactcttttcgtctaaccatccctccctttttgtgcactatttcgttttaaaaattgggaacatttttttgtttgtttttttgaaactaaaatgtaaaaatttaataaaattatttttgatttaagtaatgcttctgtttcgaatcttttgactctaagaaattaaactataaaatttagaacaattaattctctgaagtttttaacttggctttaccatgtttttaagtcccaccgtgaggcgggacagttccaaaatttgtaccacattttactgtggaaagtccaagtaccttaattggacaattaattgtcaacgaacacagtcgcctttggcctcttatggagcagaaaaggggaaatatcagatggggtgcgatcctttcaaaaaattactcttttcgtctaaccatccctccctttttgtgcactatttcgttttaaaaattgggaacatttttttgtttgtttttttgaaactaaaatgtaaaaaatttaataattatttttgatttaaataatgcttctgtttcgaatcttttggctttaagtaattaaattgtaaaaattcaaaactaaaaattttcctctgaagttttgaacttggctttaccctgcttttaagtcccgccgtgaggcaggacagttccaaaatttgtacaacacattttactgtggaaagtccaagtaccttaaggactacagaagagccaatgacgcagtcacctttggacagttattaaaaagaaataaggaaatattcgatggggtgcgatcctttcaaaaaattactctcgtcgtctaccctccctcgctttttgtgcactgtttcgtttctaaaattggttccgaattttttggcattttgaaattaattgcaaaaattcgaaacaaaatactctgaagatttgtaatttcacttcaccatgcttttaagtcccaccgtgaggcgggacagttccaaaatttgtaccacattttactgtggaaagtccaagtaccttaaggactacagaagagccaatgacgcagtcacctttggacagttattaaaaagaaataaggaaatattcgatggggtgcgatcctttcaaaaaattactctcgtcgtctaccctccctcgctttttgtgcactgtttcgtttctaaaattggttccgaattttttggcattttgaaattaattgcaaaaattcgaaacaaaatactctgaagatttgtaatttcacttcaccatgcttttaagtcccaccgtgaggcgggacagttccaaaatttgtaccacattttactgtggaaagtccaagtaccttaattggacaattacttgtcaacgaacacagtcgcctttggcctcttatggaacagaaaagggtggatatcagatggggtgcgtcccttcctaaaaattctcttttcgtctaaccatcccccctttttgtgcactatttcattttcaaaa

SEQ ID NO: 6795 - DNA, 2564 bp, Heterodera glycines
gtcagaaatgttgccttaaaccatctaccgtattttctctaattatatgcctgtctccaataatctacccctttcgaagtaggttgaaaaataaactacccgtctctatttatctgcccggggggataaatggaatttttattttttcaaaaaaataacttcttttctaattttataaaaattaattaattctaaattgaaattcgtttaaatatgtaataaacatgaaaaaataatatagaaaaatcatttactaaacccggaaccggacctaacgctctccccccccaccccatgccctttttcagtcgttttcatatacgaaatttttttttttaagttttcgtgcagccctctgctggtgggggttaggaaaaattttctagaaaatatgaatcggcttatcagaaagaggcataaaaattcgtataaattggatgggaaaataattttttgaggggttttttttttaatattttggttagggtcgaaaaagtcgggtcgcaattgtcttggattttctgaatgattttttttgccccttcattccttcggctccaattccgaataattttgatcgaaaaatgcatttatttaaatccggcaaaaatatttacaaaaattgctataaaaaaaatgccgaaatatttacgtaaatacacataaagttggaggaaaaatatttaatccaaatagtaataattagtgctcaaaataatatcaatttaatctcagatcagcgattaacaacaatgttgtcgtacgctgatcggccgttgtgccgccgactccaatggcacaccgcgcacacaatgagcagccaaatgagcagggcgatggcgaacacaaatgcccacagggcgtaccatgcacgcctaacaaatttgaaaaaaacgataatgataacctagaaaattgacaattttttcaacaacaaaaaaaatggaaagcttttctgtgtcagaaaaaaaaattatcgcaattttttgaaaatctttgaattttgtaaacaaaaaatttttgaatttattattataatattaagtgcatgcaaagatcgtcaatatatttttttaaaagtatggcattcccgccagcagtgccgtgccgattaccccagggatttgttagaattacatacaattttaatgtttaatattcatcatatttaaaatatttattaattttatttaaaaaatgaaaaaaaaaatttataatttgccatttccaaattatcgccagaaaattgcatgcaagcaaaactcacttgtatgctcttagctgcacacgctcttcatatgttcttgagggggtaattaatttattgaaaattgtgtacagaagcaaattaaatgtgattggaaaactagagcccggcacgggattttgcacgatcccaatccgaaatcgggattaaccccactggattagggttcgaagttgtatgcactaaaaatacaaaacatgcgcataaaacatgcaactaaaaatcccccaaatatgccctaaaaaccctgaaaatgcccaaatatgcaaaatatgccttaaaactgccaaagatggcttttaactctgaaaaaaatgccaacaattgtgtatgtataaattaagaattgactttgaaaacaaaaaaaacaagggctaaggagcattttttagacaattgcaaaaatattgaatttccaaattttaaaatttttattatatgctaaaacaaaggtacatttttatataaataaatttttttccaaaagttcttacaaaagttaaaaatttttcgatttttaagggtgtattttttttatttcgcaaaaaaaaagtcgatccttagggggtgtattttcgctttttcgcatttttcttatgaaatttgccaaaaatgaccaaaatatgctctaaaagcccaaaaatggccaaatatgcatttcgaaaacccccaaaatatgctttatatgcaccaaaaaccttcaccaaatcaaaaaattttaacatagaaatgctatttttgagcccctttcttcatagcatatgcacagaaaaaatatgttaatccatacaatgtatagccctactcatcagtcattagttttaaggacatttgttgttgtcatcctttgcttcttcttctgtcccatcattgtttttgttgatactacatattgccaaattgttgttgtcatcagtttatgctgctgtccccccacccttttccagcaattttccctgtcggttcgtttgtccttgacatgggccaattgtgcgcgccgttcggcgaaagtcgccgcatccccgcggggcatgtttttttagtcatttatttacttataattttacaatttgttttgttatgtatttgggagcaaaacaacaacatcatcatcatcatcatcatcatgtacaaacatatttgcaaaaagccgaatgtgatgagcacttctgcataatcattttggtttttttttgttgcgacatttcctccaaaatctcatttattataaggcaatttaaagtgatctatctatgtatgatcatgatatctgcttcatactttacatatacaaagt

SEQ ID NO: 6796 - DNA, 2774 bp, Heterodera glycines
  misc_feature (16)..(16): n is a, c, g, or t
  misc_feature (2742)..(2742): n is a, c, g, or t
atgctctaaaagaacncaaaaatggcaaaatatgcatttattctcgaaaacccccaaaatatgcttttatatgcactaaaaaccttcaccaaatcaaaaaaattttaacgtagaaatgctctatttttgagcccctttcttcattgcatatgcgcagaaaaaatatgcaaagtcacacaatttcgaaccctacgtataacaacaaatgataaaatttcaacaatttttctgcgaatttacccctggaaggcttaaaattttggaaaaatttcgaggcagggactatctcatagccaattaattaattggttaattaatgtcgctaatatcacacaacaaccgctgcttacaattcgttgaccgcctgctcgttggcacgtccgcttgggtcagccatctgatacttggacagcattcgcacctcgtcattccaaaaggtcggcgtcgggaaatggatcggtccccggttcattctgtaatttgctggctataatacagtaaccgtacaaaaaaaggggatatggtaaaaaaaaagagcaaaactatgaaacaaaacagctctttttaaaagtatttttaaaaacccgatttttaggggcaatttcttaatgttttttttgaaaaatttttttaaggatcaacatccagaccattctgtaatttgctatatcgtaactgtacaaaaaacgagagatacaaattatggaacaaaaattatttgagaaccttgaaaaatatgtaaagtacaacaatttcttatatatttaaaaaaattcgcttatttaggtttttttttttaaatttttttataataaatttttatctttctcaaaaaactcaaaatatttagcagaaccgcaaatatgtgccaaaaaaaactgcgaatatttagagcatggaaaatataggggaaaacatattaaatcccttccctaatgataaatgatcggggtttttttttggaggtggtctcggattttgttgttcacaatttttggcacaacacacactttggcggcatgttcagtgaagcgtgttgcattgtgccgttgccgcatggtggccaactgaaattcctcgtcgacggatctccggtggccacaaaatttgtgatcatccgagtcaaactgaagacagattttgatgattaggtcagtgttgatctgaactatcacaaaaaatatgtccatcaattgatcagtggaatatattggcattgaaatattactcaaaaaacctaaaaggatggacaaactttcaaattcattaaattggctaaaaccaaaaaaaaaggcaaaaatattcacaaattttgaaatagaaaataaaaattaattaattaattatatttcattcattagaaagaaatacaacttgaaaaaatgttttccaatttcgtaaattttagaaaaacaaaaaatttgattaatggtgagggtttttgtaattaaacccaaattaaaatttcaaatcttagaatttttttaaaagaaagtttcaaaaaaaaaaaagttttttgcttaaattgtgacattaatatgcttatttaatgcaattctacgtgtcctttgttgttatttttttaattcaaaagtaggcccaaaaatcgaaaggttccataaaattttgaaaaaaaatcgcagaaaaaatctaaaaaaaatttttcttgaaattttcttataaaaatgttctaaaatttttactgctgattgttaatatttttttaccctgatcaatcgattgccaatattattaatatgattgatttgaattggacgctttcttactgtaagtagacaaataatatatagtacacttacagtcgcgacattgccttgtcccgtcgtgtgtacggctcgagatggaagttggaggagtagccttcggtgaagatgaacgcatggtccaatccgtggaacgcgtcctgttcatggccttgaggtggatggtaaaaaacgaaaattcgtcatttccccttttttcgttaaaaacccaacccggttacggtaagtaaactctgctgtaaccggtaaactgttcgatttgccactaattatagttgaattgcttacaaaagcatttttgtggccggctcaccttttcgcttccggtcccggcgccgcacgcccactggacgctcgccaaacattgggtagaagcgccggtcctcttccaccacgtcgccccgtggcacaaagtcgaaggagtacacaaaggctggcacgccgctggccacatacgcgtccacctgaaagcgcgttcgctgttgttgagcgacgggaatgaactctgtttggcaaattggccaagtctcgagagcaaaatccgaaaatgccattttatcgagcagttcgtttggtatcgatttacggtttttcaagcacctctgcttggcacggtgccacaaattccacgtcactttccaggtcctgtagacgtgccaccacccccggcatatcgtaggcaaagtcgacgtcttgctaagccaaaaattgtttttgagttttaaagacctaggctaaatttaagcacagaccaactatattaaatttaagcataggccaatctttaggcataagtttgtgaaaaatttgtagagaaatcgtagagagttggagcatttttcgaaaatttctgagtcgtcggaaatccgaaaaaaatgttttgagccatctgaattccaaaaaaatttaaatccgaaaaaaaaaatttttttttagcgctcgtaataccggaaaattnttaagtctcagaataccgcataaatttttggc

SEQ ID NO: 6797 - DNA, 1437 bp, Heterodera glycines
taaaataagaaatcattcataaaaggatattttttttgtgagattctttggagctaattcaatatacaaacttccgcttaccgcggggtcggaattatcgtgtctccggcaccgcccgcgcgactctgacccccgccaacccccgcccccgcgaaaagccaccctcgccccacggggctcgaaccctattctaaaataccgtttttcttgtgtctaagttcttttgggtgaattttacaaattttttcaaatgtgataaaattatgcgtttgcaatatacataattttaatatgcaattatacataattaaacagaactcagtgaaaaccaattcgctcctccggcggtggattatgtggtgataatactgcggacatcctgaccatacagggaatgcaaaggattatccagtaattaaataataggtaagaactgtctttgtccccggagggatgactgttgttttgggtccatctttccttcattttggcccctgttgcttttgcgcccacagctttttcagctcccatagctattttcgatcagccattacagatactgtatgtacaaactgctgaactgtatttaaatactacttggaagctttttaaaccatttttagcaataaaaatttatttattttttaaatgataaaagctcgaaaattttgaaattctgtaaatcgtttactatttattgtatgtataacaacgaaataggttcaataccatttataattcttttaatgaacaagaaaaggacccaattaaagaattggggaaaaattggcaattttttgcttttaaaagaaattcaaattcataggaacaaggggtgtgtgcgaaagttcttgtcattttcgttttgttcccctgtttcgccatttttttgagtttcgttttagttttcggtaaaattttaattttgtttcgtttttcgttcgctaattatcccccatgggcaattattttccgaccttatcagaaatgggaggataattggagacgggggggaacaaaaatggttccaatttgtgaaaacgtgcctaattcggcggccaacgcgcgccagaacatcggcgactcggacacgttgacatgcagccggaagcaggccaacatttccgccgtgttcaacgactggcccgcactgttcgacaaacactccgggatacgctcctgcaggttgcaatgcttgtgccaccttcagcaacaaacaacaagaaaaattattgactaatgatcagtacagtagttagtcacaggctctgtactatactgtaaaatagagcccggaattttgaaaataccggaccgggcccgggaccgggcttcgaaaattgaccggggcgggccgcccgttcaaaaaaagcccgttttaccgggcccggtccaaaattttgaccgggcgcccgtacgggaccgagttgttttcaa

SEQ ID NO: 6798 - DNA, 1968 bp, Heterodera glycines
tatttgcacaattttcatctaaaatttctttaggggtcacacgatggatgatctgcagaaatcttcaaaagcgtgtcgagaagtcttaaattaaatttttttttttcattttttgtcagaaacgtccaaccgttcagaaatagtctcccatttttggctctcgttgagttcctccaatttaaccaaaagcgatcggagcagaataacacagtccatcagagctttgttggtcgattgtaagtcgtaagcgatacggtaaacattacagaatgacatccaacaataacttaaatgatcgatgagttgcaaaccatgaaaaagaccaaccaatccacaatttgttcgtagatgagtaaatggtcctgaccaaattcaccagggagtcgcaaaatttcaaacgaattcgagtctcgggagagaacgtgtacttcttcgtcgtaaataaaaaattcacctcggagattcgaaagagaacgacaaacggtcgccgattacgaacaaattcgtttaaaaaaaagaaagaaaaaagcccactcatttttaccttcgttaacgcttaaacgacggacgagcaaaattccgccagaaaaaacgtccacgaaagtgtcagtgccagtcgaaagataaaacacaaagaaaaagaaagaagagagcgaatttggcaaaataacggcggtaaaagtgttcaatcgcacaacaaacattttcgaaggctcacaatacagtagaaagcattttcgaagtgggagttaggaattcgacaagcctaaaaccaacaggaaaagtttaaacacctttcgaaaacagaaaatgcataatttagttccctataagaattcgctttttgctggtcaaaaaaagcaattccgtttttcaaaataaattggcaaaaaaagcatggaaaaggttccaatggttttgccatttaaccgctgtcaacgacgactggttcgccaataacgcggaaaatttgagtggaatggctttggtcgaaattttagccattcaacgcaaaaaggcgaatatgacaattttttaacgaaaagagtgttgccagtttgagtgtccaaataatagagtaagccactttggaaaacagtgagaagcacttggccatcgggggaccaacacagaaacaacaactgatccttcgacttggaggacgacggaacggacgaaacatcgccaagaaaatcaaagtgtttggcagaatcatcacgagaaaaatttctctaaaattaaaaagggaaaagtttaaactaatcgaattcaaaagcagcaccttccacccggtcttccacaagtaacgcttaaccaccacttctccgtcaagtgacccaagcgcaataagactgattttcgggttccaaactgcgtgagaaacctaaaaaataacagaggcaatgaaatttattagacattcactgatgaaacgaacctcaaatttagtcctaaatttgattttgtcaaaaatgtccttgttttccgcaaccgttattaattcctttttcatattccaattgttgaaatttagaaaaatgattacttttttataaaaagttttcttgaagaagacatatgttcacatttatttcatggaaaattgcaaattcaaaatccgaggaaatctttccttgtaataaaaagaaagtaaactaaataagcaatcttttcagcaaaaacaaatataaaaattttgaaattggaataaatacgatacgataaaaataaaatgataaataaacagaacaaaccaaaatcttctaactaaatattttagtagtataaatcttaaggtaataatactttaaatggtgggcattacaccatttttaaaattcaaaggatttgaatttacgatctttttgttcgattccgggtatagtataggatgaaattgatgccggattcgtattctccgaccctgaaaacagtttttttcaaaaagagcccgacatctaaagcata

SEQ ID NO: 6799 - DNA, 4730 bp, Heterodera glycines
gcaaaatccgcttttaatggctttaataagcgacttacaattagggcggtacgtttctttcccgaaaaatgacagcttcggaccaattaatcacttccgaaaatggcaacacccattcatcggaaagaatcaccggaatacaaacagaacgaagtgcctcgaggaaactgaatggatggacgagtttggattttctgtcattcaattgggacagtcatttgtttgtaggacaaagcaaaagcacaaaccgaaaagagccgagccgacgaccccgtggaatcaaacagaaggtggaattcgccatcaactgctcatagtcccaccttcaatttggcgttggaattcgatttcctttccccgttccgtccttttcacctgccataattcgcattgtcaacttcacaacgttcgtcctcgaacttcttccagtccgtgttgtgcttgcaagtggtggcaataacaatggatcggttatcgttcaaatggtgcaaaatgttgcgcgtcttcgacccaactccgtacacatatcgttttcctttaaaactggccaagtatttgtcatggttgggaaaatgcggttggaaatgctaaaaatgaaagaatttatggcgaaaggaaaagcaatggcaaattacaaagaaacaaaaataaataaagaaaattacccatggtttgtcgtccttaaacgggtgctcattgttaaataatgggaacgaaaggtcgaaatttggtcgaaaattctaaattttcaaaattattcgtataatcctgttataaaccaacaataattacatccataaacccatttatcaattggacctgcaaattcgaactcgcccacgcgaccattgccttgccaaagtcgaagcccaagtcggtgttagcgtagtcggggaaagtgccaaagtataaattaaacaccaaatgattccgtccgtcgtcccataactccgttttggtgtgctccgtcccaatttgctggtaatactcacttaaaatggcttttcgcgttgtcattcgccgtttgcttgccttattcggtctctgtccgttgtatccgcactcaacacaaataaacacgcctcctccgccctctccgtgtaaaaatgactttctttgatcactttcaacatttttgtgaacaacggactccgtctcaccggcgatccatcactgtacacgtaaattttcatcgattttggcgctaaacatttgctgaaattgaaacaatttgacattgaacagctctcaatgccatctttcgatgattttctaaatttgtataattgggattaaatgcaatgactatgtattattgaagatcacttcaaatccaataaagttgtttcactgttccatagcgaatgaggacgaaagtgcgggcgatttggagaaacaatattagcagaaaagacaaaaagcaaaaaatggaacaaaagggacactttccgatgcattcatttgtccttgatgttgaataaataaaaaggaaaaataaataattaaacacttaagaaaaataaataaataattaggtaatttgtaagtgagagtttaaaatgaacacaaatgccagcagggaattttactcgttcagtggacttggtgaaacggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcgggtgaaacaacataaggggaacattttgacttgttaaaattttttgatctcaattacattttagggtcgcagggaacaaaaagaattttttttaattggtcaaaaagagaagcatcggtccactaacaaataagtgagaaaaatgccgccagcttctgctgaagggtccttaacacagcggcccaattttgggctctcagtgcaaataggtttattatttatttagtaatcagaacgccaaaactttgcaaaacttaaaatttttttgggattttcccttgtaaaaatagaagagccgatctcgagttaaaaactagacagctaaaaaataaactgtgattcgatagagggggacaaaatatgggcctatacaaaatttcaaaaaaagttacccacaggaaaaaattttttcccatggcaaacatttcaatactttaattcttttttagccaagtgcgcaatttaaggccaaatcaaataaaactaacaatattcatcgatgctgtacgtaactaactctttttgaaaataatttttttttgacacgaaaacttttattaataaaaaatatttctgccttcttcttaaaagaagaaattaaaattaacacacaacatagggaggacttgaacctgggaccccccttttggtgactaactcacagaccactaagacgaaaaatccaacttaattgtacttggagcccaaaattgggccgctgtgttaataaatttcaatgggaaattaatattgaatagatattcaaaaaatcaaattagaattcattaaaaacaattagtttacagcataaaatcttttttatttaattatttccagaattataattatgaaaattcaatcaatgatcgaaaatattaagctgataaaaatgtagaggattgggaagagatgagagtggatgagtttgttcggcgatgtccgccgttttgtcgccgtgccatcgaataaagcgcatccttccgccagcggatctgaatgtgtgtttaaatcgctttttcttcaatttgccgtttcaccgtcgttccgtccgctgcgttttgcctttgcccccctcctccgctcggattccccgctttgttctcttcggttgcccttagcactgccaaagtgcttcccccgctgctttgacgtcgtcgttgatttgcgtctcccctaaaggaacaaataattggttaattatgggccatcaaagagcagttcatctattcaccgtgtccaacgccaatcggacagcaaaagacggcacggcaattggtcagtgatcactgagtggtgggtgatcagcatgggaagcgattggaagtaacgcttggaaccctgaggaatgaatgatcaaattgccaagggaaaagtggcacaaaggaagcaaacaatgactgctcactttgatgcgaaacccatgctcattgcgaagcaccaaatagtgggcaatccctttctgattcttctcatccctttccactcggatactcagtgccaaaaatctgcaaaaggaaatttcgataattcactttttaaatggcaatgatcgaatgccgttgaccttcgcctcgtgccggacagtcgcagcgcgaaatggccaacgggcatttcccgcaaatggttcatcacagagtctctgaattttgctctttttccaccctaaaccatttccgaatgcccacttttcttgcgatcgacaaaaataggccaatttctccaattcttcaatcattgggccgacgtccatcggataaatccattctttgcttaaattacagtaattccaaaactttgacttgtttttcttatggtattatgtgcccacattctgtcgtcgtacagtagttcttctccctcattttttgtggcgtttggcggtgaaatttcgcagcattcgttttgcttctattaatttggatttaataaagtttcagttcattaactcataatttaatattgtgccttactttttgatcttccgctgacttttccaatgttcgaattggtgaagaaagatgccatcggaagttttgggggatttggttggaagagcgttttgtcagtgccgttgcggagacagccgaagaacgcaaattggagaggggccaacgcggttttcgaaagcgaaagcctaagaaaatgaacgatgacggaagaggacaacagacaaatcaacggcaaatgcaattttcggcaataaaggcaaaacccaataattacagtttttgtccaataatgccccattaatcagtcactcccaaatggcgcttttcctcgtaaatcactctctttctgatcatcgcatctccgccggtcgttccctcccgtggtgagtcgttccacaaaaaagctcagtgtgggcgttccacaaaaaactcagtggttgattggtcattttccaaaagcctatcgcaccactttcggggcaccaaaagtgcctgatccggaatccggaccggcccggttaagaacaattttttgttcagttttttcaaggactatctccctggccgggtccggttcttgatccattcactcggagcccgtcatgggtcgggcacatctgccggaggaccctcagcctcgcccccgaccctgtcggtggccaacccaagctaagcttgccggtaccagcggcttttttgtacagctcgatgagctctacaaaatggtatcaatggcgtcaggctatgtctactacaaatggagaaaattggtgagaagtgatgtcaaaaattgaaaaattaaaaaatttgaaaatgacttgcgttccgccgtagattactattaaccggacggcaccgagttttgtgaattgaataattaaatttatttatttaattttatcgagcactgagattttttgtg

SEQ ID NO: 6800 - DNA, 1603 bp, Heterodera glycines
  misc_feature (34)..(34): n is a, c, g, or t
  misc_feature (76)..(77): n is a, c, g, or t
  misc_feature (127)..(127): n is a, c, g, or t
  misc_feature (209)..(209): n is a, c, g, or t
  misc_feature (1598)..(1599): n is a, c, g, or t
gtcatcatttctttgctggactgcatgacgttcncgcatcagcaaattgcttctttggcgttgaggaaccgccgcnngaaaattcgttgaaatagcgacgaagacgaaaagcgcattgggcagagancggcgaagagaacggcgacggagtgccctttggaaatgaccaaatccaagcaattaaacaaaagaatgtgttgtatttcttntaagccgtaacatgctatattttctctcattgtattcaccgatcgttaattaattaaccaattaattaattaattacccgcttagtcggagtgttcagcaggtgctctcccgctgctgctgtccctccatccgacccgaaattggcttttccccggcaaattgccatggcattgtccgggggatgccatgccattagcatcgtcgtggtcccgtcatcatttttcccgttctccatgtgacagttggccatttcgtccgcctcccccgcggcttcttcccactgtttttgctgtcggaatgcgtccgcaagtgccgtttggatgtgctgtgcattgagcggtgtgctgacgcggaacacgtggcacaacttgcggcccggcacatggtgcccgtggtgcgagtgctgctcgcgagtgatgtacgccaactgcgcggtgcggacgcggcacacggcgcagcaaaccttgcgcagagaatggctgagcagcggcggaggcgcctgcaaatgcgaaaaacactttcccagcgaaatttgcatttaattttgtcaaaatgctctttttgcccaaaggatggccatcatcattcccatgacctatcatttaccattttaataacatttctttcccgggaagtgccgagaataattaaatatgcaaaatgccaacagagaatgacgaatgtgatggatgatgacgaagaaaattgttcgggaatttattccttcgagggtcagccattgaaaaagcaatggaaaggaaaaaagggtcaattttattttcaaaatgttcatcattcaaacaataatttttttcattttaaacttttctcttttttggtcactcaattcatcatttaacgcaccgaaaaccagcggaagaagcggacaaaatcattcattctgatccggcggatgcgaaagaatgtcagcaggtgggagaaagagagtcaattaaatgggggacggaaggggggggggagtcgcaacaggacaaaaggcaaatggtggaggaatggacgacgcatctgttggggctgacattctttgcccttttaatgctgcgcaatttgaaattgagggacatcggcggagaaatacggacggaaggaaagattaattgaggcaggggggatgagagggcgaaaggcgggggataaaatagcccgggatatattttgaattgttatcaagtgccacttcctctcccccccccttgaaacttcggtgttttgcttccgtttttggcacggttcccctttgctttttccctttgcttttccttcgcttttccttttgcttgttccctttgcttttccttcgcttttccttttgctttttcactgtgcttttccttcgcttttccttttgctttttccctttggactcnntaga

SEQ ID NO: 6801 - DNA, 1166 bp, Heterodera glycines
tcagtcgtggccacgggagccaacgccgaaccggtccgaccgagaacgactcccaccacaaccgcactgctcgtgtgcgacgagggcgaaaacattcccgaggcgttatgcgccgccgcctttgaccctctccccgtcgacagcggaaatttcccccctcccaaatctgccagagttgcccacctgatgacccagacccttaaagcgtcgtgccaagggggcccacccgacggaattcctgcttttgtcttccacgaccctggcagtcagtccggctacataagccgggcaatgacagagaagctccgaccccctcggctctcagagcacctcctccgaattcacactttcggagactcccgccccaagaccgtccgatcagcaaaattcgccattcaactgcagcgcctggacggaggctgggagaccctcgagctcaacgtaatcgacgagatcacgaccaaaatcaaggccctccaatgggacaccaccgatggacccctccccccaaatgccgtcctcaaggtcgtcgaaaaagcgccggacattctgattggcatccgagaattttgggaattcttcaccggctgttcaatgctccattccgggctccacctcatccagacggttttcggtccgatggtggggggagaagctgagtttcccgaggccccacgacacatcccgacaattgccatgctgacctcccaccccagtaacgtcgagtcattcccctcatcccgcgccgtcaatgacttttggagtcttgaggcgattggcatcacggacgacccgagtcagaacgacgaccatatcgccatgcagcaattcagcaacaccgtccgccaactaccgtctggccggtactctgttcgcctcacttggcgggaacctcgtcctccactcccctcaaactgggccatcgcttatcgccgccttctttcaacaaccaagcggctgcaatgctcccctgagctcctcgaccgctattctgccgaattgacacggcaagtggacgccgatatcatcgagctgaccgggcgagacgacgacgagcatttcctaccgcatcatgctgtcatcaatcccaaaaaattgcgcatcgtcatcgatgccagcgcccacgcccaaggcactccaagtctcaacgattgcctccaccgcgg

SEQ ID NO: 6802 - DNA, 4396 bp, Heterodera glycines
aatttttaagaaaaataaaggatttatagtgcctgccagtccgaataagcaccgtgggggaattttttttctttgaaaaaggggagtttaggtaacattagtatcaggggggaatccgctaaatgagcgtaaattttcagatatggaaatggcgcgctcataatccgccgtttttttcggatcgccttatgttataaattacatataatttttatttcaagcccgcattcatatcactcatcaatgggtgtatgtgtttaagcaattgcttataaaatcccgaaataatccgaaggccaataaacgagatcaaatggaaaaaatcttttctgttctcagttttactgatacaacgcccaaatacaatggaatatgtaagtgtgtcgttaggagaatgaaggtgctgatccaaatcggacaagattctctaaccgacctaataaggaatccttggtcggtaaacgatcggcatcaagaccagtcaagtcggacgtccaggacgccttacatgccattgaagtcgagccggaggaccggctcttctgcaaaatcctgtggttaaaaaaccctgctcacccgtctcaggcgacaatctgttggtctatcgctacaagcggctcgttttcggcgcgacatgctcccccttcatcctcgccgccgttcttctccaccacttcgataggcacgaccacccattcgccaaggaattggccgcgaatatgtacgtagacaacctcctcatcgagtgcgagacggaagaggaggccatcgacaagtcgtccaacgccaaacaaatcctcaaagacgccgacatgaacctccgggagttcctcagccactccccaaacgtcatgggacgactccccgaggacgaccgactcgacaaaacgccggccaaagttctgggactgacctgggacaccccccgcgactgcatcacctttagtctcccaaaggacacagacatcactgctacacggcgttcagtattgagcatcatcgccagcacgttcgaccctcttggactagtcgggccatgtcttctgcccgccaaacggctcttccaacgcctgtggggagaaggaaccgcctgggacacacccctccccgagaccgaggcggaaacttggattcaaaccctgtccctatggcaaaaccaaacgattgtggtcccgcggcattccattctcggcaagcaaagccgcctgcaactccacgtgttttgcgacgcttccgaacacacctttgccgctgccgtctacatccgaagcgagactgctgacaactcccaagcgaacctgattttcgccaaaaaccgcctccggccacgaacagcaaaccagcgcttcaccatccctcggctcgaactcctcgcaatcctcgtcggcatccgcgccatgcgtttcgccgagaaagagctccgccgtccgatcgaagagcgacatttatggtccgactcccaaattgccctctcatgggtgaagtccgaggagcccaaagctcaattcgaacagcgacgactcgtcgagattcggcaaggaccaaccaccaccttccatttcgtcagaaccgaccaaaatcccgctgacatagcgacgagaggctgtactccggccgagctctgcactcgtcaaatgtggtggaaagggccggagtggctcacgaacctggaaaccgaatggccggacgagctaacgttcgcaacaccagccagccatccctctcccgattttccgtgtgaagactcggaacccaagactctcttggtcaagcaaagccaggtgccccctcccctcgttgacccagcacgcttcagcacaatgctcaccctcctcggaacgaccattctcatcctccaattcatcgggcgctgtcgtccaaaatggctcacgattggcgcctccaccatcccaaagagcggccccccgactggagatgccttccgagccgctcggaccttcctcatccgacaagaccaacaccgcttactcaacggctacgataagcaccctaccgttgtcaacgaggacggcctgttgtgcctcaaaacccgactcatatacgcaaccggcccgcccactctcgcctcgccagtcctcctcgatcggcattcccccctgacccggctaatagtgcaggaagtgcatgccgatctcaagcacgccggcgtcgattggaccctcaccgagtttttgggccgttactggatgccacaagcccggcgaaccattcgcggaatcctccaaggctgcccgtcctgtaggagaatcacggcacccccctttgcgaggccaaccatgccccccctgccccccatgcgcgtcaaaccggctaatccttttgagttcgtcggtctcgactttgccgggcccacctcctctcgactaagcgacggatcgctcaccaagacctacttggtcatcatcacctgtttcgttacccgagcagtgtatctagaggccaccaccgatctgtcagccccaagcttcatcaatgttttacgacgattcatcagccgtcgcggccgaccaaagcgaattctgagtgacaacgccccgacattcgtccaaacgagcaaggccctcgacatcctgaccggcccttcggccaaaaccgaccccgtcacatttgccgcgcgccgaggcatccagtgggacttcattcccgcctacagtccatggatgggagcttgctatgagcgcctgatcggcctcgtcaaatcgtgtatcaaaagaacaatcggccggcggattcttgactacgacgatctgagtgccttccttgccgaaattgaagctagcgtcaacagccgcccgatcacatgggtatcagatcaaccggattcatcgaaagcccttactccgaaagacctcgtccaacccggcctcctcaacgacctggacatcgccgactctgatcttgactacgacgggggcatctccggtcccgagcgtctcgctgcactgtggaaggcttaccgggaagccgccgatcacttttggctcaaatggagtcacgagtacctcatcgccatcagagaacgcgccggatggacccacaaaggcccccgcctacgggcccccaccgcaccccgcgtaggccaagtagtcattatcgaagaggacttccgccctcggaacttatggcccatgggggtcgtcgccgccctaaatggttcccctccgaatgtgcgaagcgttcaacttcgactgccgaacggacaaaccatcactcgaccaatcagccgtctttgccccttagagacagaaaatgaggctccggaaccagccctggacgcgaccaaatcgacccccaccaatcaaagaagcagagacttcaaaaccgccgaagtgtcggtacccgaaatgccgactgttccggcaccttccggagaaccgatggtccatccccaccatcacggcatgcttacgcggcgaaaagcgcggctcctcggaattgctcccaacaccacaatggccttcgccttcctcgtcaccttcctctgggcccaagtttccccgacccaaggcctctggccattcccggaccaccctaagccgtcccccggatctgattgtgtcgggaatcacctcaactgcaccctaagaggggtcaaaatctcgtcgaactccgccgtccagaaggtgaccatctgctgcttcgactcatgcttcgaccgattggcggccgctacgattgattatgagctgtcctctgaccttcttgtcaatgaatatagttgctccaccacctacagtctctcgtcaactcgcaactgtatcgacgagatcacttgcccggccctagatgagtgtgaactcatcgattgtgcactttgcgtcgaacaactcgtcaattggcggtgtaacccccggctcgccctcgctctgtttctgctcaccggatcgttgataagctgtctgatcggctgggtcgtctgcttctgctcctcggttcggctcgggatcaaactcggctatcggatcatcgcactactcctctcgtggccgctacgggtagcattcttcatcgccggccatccgtggacgcgagaagatcgagaacgcgtggcggaacggctcgagactggagtccaaagggttcggcgacagacccgacagagaattcagaacgcacgtcaacacggcaagcgggctcagcgagctgccattcgcctcatcggcatccttctcgccactcctgccctcctttgtaacacggagaccatctcagtcatcactcagactgagtcgtgcctcaagggaccctccgggctcacctgccgaatcaacaccgccaccaccctgactttgcttccggccgggcaaacgagtgcgctactcctccgaaactccagggaaacaccctcgggaccgtcaaactacgcctacagtca

SEQ ID NO: 6803 - DNA, 1749 bp, Heterodera glycines
  misc_feature (185)..(185): n is a, c, g, or t
  misc_feature (1688)..(1688): n is a, c, g, or t
gatcccgagtcgtatggccttggtttcgctttcggcctcgacatgctgtcccccctcccgtttttttggccctggtcccatcatcctgctcggcataaccgttgtgacaatcggcctttttctcctatttttattcgtcaaatattcgccaatcttcgccacgtatcgcctaattttacgaattntcgtcgggtgtgtgttgattcgccccgcaatttcttcatcaattgaatttgtttcccccaccccctccccaacctattcttcacatactttcgccgaatcgcaaaactttgggttatctctttctccaagtgtctgcgtcgtcctttgtgtcgccatgcccgctgtacagcaattcagccccacctttccctgctccccccctttttgtcatcgccaagctcttccaaattctccgtgcccttcggcagatgtccttttgttggccatcgcatcaacagggggagggggaggaaccaatctttggagcgacaaacaaaaggagacggataagttgggcgggtgctgtacgatcctttattttgggaagggccgagcccatctgtttataaatacattccccccctcgggcgacatccacttcattcatcaacattttttttgcatttcatcactcaacaaatttcggatgccttcccccttaaacgccaaacccaccgcgcttatccccccaaaccagcgaaccctcaatccttcccccccttttgctaatggtgggttcgattctgacgggggggactccggatcatttggggctcacacccctcgccaaccccgtcaactcggcccccctcgcttcgccatcactcatcgccaaccgccgatccatgctcgctcatccccttctccaccgccaacaatgccgattttaccccgagccgacactcttctcgagcgtcgtttgggcggaggatggtggctccatcccgagggacgccgattggctgagagttttctgcgagaaaattggcttcgccactccatcaatggccaactcgtcaattgggaccgcttggactccgtcccggcccaggaacgtcgcgttcagccgcacttgtccgtcgctgaccattggcgaacggtacgagaaactcctctccgtcgtcctgagctcccggcggtgattcaagaacgaggagtgagaggaacgtccaggcgaagcatcgctcgacggcgccgcaccggaataccgacgtggctccgaggggctccccattttgatttcttccccttagaggctttggaggtggaacccccggacccgatctaccgggccccccactctcgcaccccctcggattacccctcttctgatgaggacgatcgaccaattcagctccaccgccgattcgaacggctcgccatatcttcacaggccaattggaacccgccgcaacccgtcgttccgccatcgccaacctcaggatggtcagaggcggagtcgccctcgggaggaaatggcagagggagaattgaaaattcgggcccgggagcgatcccggcggtgaacaacccgccgcatttcgtcctccagccctccccttctcacctcttcctttgcgggaccccccttcctccaatgtttgtccctgtgacttatgtgtttcccgcctctattgctccaattcattcatcaacgagaatggccgccggggatggacttncgggccctcccccctagactcgcgcgggatgaacgcaaaaacggtgcctcccctgcgccta

SEQ ID NO: 6804 - DNA, 2486 bp, Heterodera glycines
  misc_feature (2477)..(2478): n is a, c, g, or t
atgaattgcgactgaacggctcccatttgttgcccattgaggagaaatcgcaccaaatgttcggcgccacaattgtcgcctcaaaggacggcgattccgtgctggttctgtcattatcattatcattatgatcacttatcatatttatgcatttttactttctttttcccttaggcttgtgcgcctcattacaaatatttcttcgccaaatttgaagtgatcgaaccggtgggcagctgttactacgcccgggaccatttcaacaaaatccaagaatatgcgccatgtcggcaggaacgtgagtaaggcgtgatgagtacccgttgaatatcccccccccctcgccgtcctcagctgctcgccacggtcgccaccgacttggctacggaatgtgcgggtttagcgctgctgtgccggataagggcgaccagcgactgttcatttcgggaccaggagtttggtattggcaggtgagcattttccaaacatcgccgacaaaggcattcgaatttcgagagtcgccttttcagtctcgacttgtgaagagtttggaaactcggcaatgagttgatattctcttttaattgtcgatcgttttcatttccattctttcccatttcgaatgatcagttaacttatcaaagtttgggtttttcattgttttctcttttaggggtctgtcttctcccaaaacattcaaaatttgactgatcggccgggcaccgccgatggacccgcgcacaccgaccaccaccaattgggtaaattaagcaagacccaaatgaattagacttggtcgcactttcgttaggctattcaaccgccaccggcgattttgacggggacggaaaggacgacattgtggtgggagtgccaaggggaaacgaactgatcggaatggtggggagaggaaagtggggaaagtgatcgggaaatggaaatggttgaggtgtccatttacacacgagagctgaagccaattgtgaacataaccgaacgggacggacagaggtgggcatggggcagaagaaattgttaaacggatgagccgagagtgggcgagaccaacttggcattacctcttcaggggccaatacttcggcggttcggtggccgttttggatttgaacaacgacggactgcacgatttggtggtcggctcgccgctgttcatcgattggatgagcaacgactcgaaaacgcaggagcgaaagccgcgttacgacgtcggacggatcagcgtttacctgcaaacggaaggggtcagttgggttggaaaattgagagctgatcagagcaagagcaaagaaacgaatgatgacaattccatcgttttgcgattgagttgaccgcttagccaaattcaaattcaaattgcagcacggcttccgtgacccggtgcacatcctcggccacgaccaatggggccgttttggccacgccgttgccgctgccggggacctaaacggagatggatttcagggtaaaaaatcactgtcatttacaacacaaacttttatttcactttttggatctgttggtgggtgcaccatttgacggcgaagatgggcgcggcactgtctttgttttccatggctccgaaaatggcatccgggaacggcacgctcagcgcattttggcacgggacattggcagggacatgctcaccttcgggtgggcattggccgggggcagagacgtggacggcaacggatacccgggtcagtggggctgaacacttatttggatggacgggttcgaattcagacattgccatcggcgcccctcacagtaaccaagtcgcccttttgcgcgcccgacccgtcgcccaagtgcagggatcgatcagaacgacgaggaaagtgagcaacagaaaaggtcaaaggaaacatacccaatccccccctactattaagagcatcaatttggacgacaaacagtgcgtgacggagttcggtcggatggcatggtccgtcaagggccattagcacttggcaattgcttttccctccagtgaacgtctccgcgtttgtctgaaactgttggtcggcaaattggcacaaaacgccgtcgaaatgcacgtgcaaatccaattggactcgcgcacaaagggcgattcgccccgggcctttttctcccgcaaggatttggacaaaaagcgcggcgtccgcgtcgacccctcgggcagccgcgagcagccgtcgggtgttgagcaaattgtcacactgagcaaagggcgcgaggtgccgaaagcattgggcattatttaaaaacattttttggatggaatgcttctcaatttgaaatttggggggggggggggggtgacagtttggattaatcaattgaatttgatttattcattttgccaggtctgcgagacttacgacgtttacgtgccggtccgtgaataaataataaagcctttgccttgttttatgcttttttggctccattaattcactgttaaggacagnnactctaga

SEQ ID NO: 6805 - DNA, 1092 bp, Heterodera glycines
ataataaagcctttgccttgttttatgcttttttggctcattaattcctgttaaggacacaattcgtgacaaaatttccccaattattctgtccatgaattattcgttggtggaaaagggcggcaccggcgttttggagccggcggtggacacaacggaaggggcacaaatggagacggagttggtcatcgagaagaactgcggcgaggacaacatttgtgtgcccgatttgcatgtgcaggcgtatccgtaaggagggcattcattttaagagacgtcaaattgagaatcaaacggacaatcactgattgatcgatcatttgtcaataaaacgaaaaattctgattgatcgatcaatggccaattaatctgaaaatcactgattgatcaatgtttcggtcaaacgtacaatatttattgatcagtgatggctaatttatctatacattgaccgattgattgatcagtttccaatttccattcggcgcttcccttttttaggacaagtgacaaatttatcgtcggtgctctcgaccaagctcttacgctgaatgtgactgttgagaatcggggcgaagattcttacctgacgcaatattttgtcacaattcccccggggtgggattgaattttgttgaattttcacgaactttttaaaacattttttagctttgaatacggcggaattgaaaattacgaatcgaaggcatttttctttatttgcttttattttgctttcttattttattctttcagtattctgtgagctgttctccggtgcctggccatgatcaatcggacaaaagtcagccccaaccgttcgtttgcgacgtcggaaatccgttgccctctggcgcaaaggctacttttggtgtcaaactgagcggtgggccggacgtggacgtgtccaaggagtacgtggaggtgcgcatgggatcgaactcgacaattggggaggagcagggcaacgaggaggacaaccaattggtggtgcgcattccggtggaaatcaacgcacaattggtcagtgatgagtggttgggtggggggaggagggaaaaagtgatcagaccgaagagggggggggggggg

SEQ ID NO: 6806 - DNA, 3167 bp, Heterodera glycines
aagagaggcagagggatagatagacacactgatcaattgaatagaaagagcaattgaaagtgaacagaagcgggtcaaaaagaacgcatcaactgattggaagataactttgggcttttcaggcgttggtcggcagaagcaacccggaacaagtggactacagcatacggaacagaactgctggggtggcggcaacctttgactttgagattggacctgttgtcagtcatctttaccaggcaaatagctgccattaatgctaattgctcagttttatggtcatttctgataggtgacaaaccgtggccccagtgccatttctggcgccgttttggacatcgtttggccctcctattcggagaagggcaaccacttcctgtatttgatcgacatgccattcgtcagcgactccagcaaggcgaggtgccgagtgaatcagccgcaaaatttgaacccggcaaaccttgcagtgagccattagctgaattcgttttcctgaggttttctatttgtttttttattttcagatttccaatgagcacgtgccaacgcccggccctggcggagtccacggcggcgcaatttcgctggaagacgccgaagcggcggcggaagaggaagtggcggagacgccggcagtccacgggggaggagttgcaacgggcagaatgaaagaggaggcggatgaagaattggaagaggaggaggtggaggaggacggcgaagaagaagcggacggagaagaagcggagggagatggaggtgaagagtacaacagcaacggagagacacggagacggaagagaaacgcaagaaggaagacggcgacgagacagcgcagcgacagagaggaaagcggcgtggcatccgcggcggtgcggcgcaacctgcgccagcagcggcaaatgctgcgcgaggcggtggagcaggcgaaggaggcgggcacggccacggaataccacggagtgttgggcagaaagacactggtgggcgagagacgggcagagagacagactgatcagtggcgaaaggacaaacgaacattttaaggaggagggggggggagagcgatttttggagaaacaaagtgtttggggagacgcaaaaaggggcagacatattgggcgattggaagaccaatttagcatttcggtgatcagagattttaacaattagaattgcgcggcactgaactgcacacacatcgaatgcgacatcgaccgattggaagagaatgaatttgttctcgtcgaaatcttctcccgggtgttcatttgatttcccctctttctcattttcctcttttatccctttagctttgggttaacactctgatcgacgaggatttgcttgaggccgatctctcctcgttagcttttgctcgcatttcggcacttccgttcgccccaaagtacagcccaccgccgctggtgatcgctgtgaacaccgaagtgaacccgacagaccccgaggcgggcacttgggaattgccggtaaattctgccgatcatcaggaagaattcatcgaatttctgctcatttaaagtggtggctgtggctgctggccattctgatcgctttgcttctgttggcagtgatcattttctgctgctggaaggtgaacccaagggaatgccattgcgaaagagtgcccttccctttcttttttgcccttccgtttttaaatttaattttgatcagtcaaaagggtcccttgcccattgcaatcgctgcgcctatccttccaattgcttagcaatccctcccattgcttctgatcactttcagtgcggcttcttcaaacgaaatcgtccgccgcgagaaaaggcgcgcctttcgcgtgggcctgccgctgcggcgacaaatggcggcgaacatttcggagaggaaaatggccgcgggcgagggggatattacgcggataaccaagcgagatacgcacagccacaaatgtaaggggggcgggaggggggatttcaatttttatttaaatttattaaatttaattgaaatgtttaaggtattcccccgaaagacacggcgcgcgagtgtgagaagaaaggctaatgaagaagactaattggttgactaaccaacagccaatagatgagattctaaaacccacacttttacttgttattttttcattggttttgccgttgccattttttttgtcgatttttcccttttccgtgtgcctttctttttcttttgtccctcccaccgaccaaaagccaaattcccagagccttaaaatcattgtttttttctttttgtttcttttacccttccattttctgctttaaatttccttcaccacggcgttttcttgccaaattaaccatttaattaagcacagaatttcccccaaattgaaaatgttctgtttttttcacatattttgtcattctcattcagctagtcaatcccttctttcatttcttaatatttcgtggtatttgtaattatttttataaatcctttgaaaattttctggaaaaattttcggcgctaaaacccaaaagaataattgacagactttcgttttcaacgacaaggctaatccagaaaaatatttgatattttcaaagggtcttaaaatcaacaatttccatttctttcccccaatatttcaataaatttttcatattaaaatggttctaaatataaaatgccatttgcaatttctccctaatcgtttctccccgtcttggcacagctgtcgctgctctttttgctgttttcctccgcctgcccccccttcccacgcctttcactcgccgccgttttacaattgtcccacggcagcaaaaagtaactaaacgccacgccacccattcatctcacacactcatcaccataccaataaaagcagcattagcacgccatcgccacaattccttcattattttgctagccaaaaggaaaaagagtaaacttcaaccaccccccccccctaaaacaaaatcaaattaaactaattagctgattggccaggaggaatcggcttttcatcttccatgatggacccctcggaattatcgaaaatacccccccccccccccccctcctctccccccgatcaccgtcctgtgaacgatcgaggggcaaagcttttactttatctcacggctggtaatgaggaaaatactggtagattttccatt

SEQ ID NO: 6807 - DNA, 1332 bp, Heterodera glycines
  misc_feature (88)..(88): n is a, c, g, or t
aaaaagtttaagtggaaaaacgagctggcgccgaaacaccggcgccgaaacgccagcgccgaaacgccaggccccgaaaacgcggtgngtccgtaacaattaatggtatgtaatatttaattttattgtattttccacccaattaaaacaaatgtcgctccttcccgcccatccttttcttgtgttgggattaattcatttgcattttgccctgcccacggtcataaatttcacttttttgttttgaaattcgttgatgactcatctttgcctttttcttttgtccattttcatcgccttttattttcaccgcccttaaaaaaggaaaagggcaatggaaaagaccaaaacaaacaaacatttcattctttcttttatttttttcaaattcgaccttaaatattttcggcctttccattttagttgttgttttttattattacttttcttcattttgataatggcatccgcaaagtgtgccagggaagactgtggcaaaacggtgtaccctttggaggaattgaaatgcctggacaaggtgaacagctctttttctatgaacgtatttttgttttttcaaatcctttttattttttgacaatttaggtatggcacaagacctgctttaaatgcacaggttaattactaataatctaaaaaaataatgtgaattgtgtcaattttaatttctaaaatcattttggggttttcagactgcggcatgattttgtccatgaaaagctacaaaggctacgacaaaaagccatactgccaagctcattaccccaaaacggttccgtcggccgtggccgcaacgccggagatggaacaagcgaagcgaaacacggcctatcagagtcaggtggaggagggaaaggaaaatggcggagaagggaagagacggagcgaattttaggtgaaataccacgaggcgtatgagaagcaaatgaaaggcacgaagatggaagtggtgagaaagttatgaagaaacgaaccatcaataaagttcaaaaacatccgtcaccaaaagacaaagtttcgaatttaaattgcaaaattcgaaaagtaatccattaaagctttatgataatatttggtctgtgccttaggacatacgaaatataaaaaatacgaaaacgataaccatttactaattgtaatgcttacgttaggccgatgacccggaaacgatgcgacacaaagccaacatggtaaaccaatccttggcccattaccacggcgaactgcagaagaaagagaaacaggactcacagagggacaccactgcaggttcagccccgtctggtcagtcaatcctttgcagtcctaaca

SEQ ID NO: 6808 - DNA, 1885 bp, Heterodera glycines
ccttgtacctcaaattttttttcaaaaaatgcgccattaaaaaagtttttgaaaagcaaaataggtcgatttacatggcttgatataattctaagctaaaataaaaaagtaattttttttaaagtttgttaatcaaaattctaaaaattttgaaaaaagcccgggcccggcgggcgcccggccaaaattttggaccgggctcgggacgcccggtaaaacgggctttttttgaccgggcggcccgggcccggctaattgtcgaagcccgagcccgggcccggccttttcaaaattccggactctattaactattcatttgattaattacaaaaatggacaatcattacaacaaaaatatatcaacattttctaattcgaatgatcaacgctttggcccttcttatttactgtgagcaaatgtttggttttgttttcgtttcacattttatgccgtttccccacccatcagtgggctttgctctgtccacttttgctcctgctgcccttctttccatcggtctttggcattcttttgcaggcatggtgaagaatgcgaattagtgagtgccaaatttgaggcggcgctcgaaattgtcaagaaatgttcgtcgtaattttccgctgtcattttcacgtcgttctgtgggaaaccttcactgctttgtggcactttcagttggccgtttgtcttttgattatttgccggggaaacggtgccgacgagggattgctccgtctgctgattttgggactgagtgaaagttacgacgatgttttgaagttcaacaatgcgtttggtgagcacttctaagaagagaatgccatttggaaatggacaattggactctttgtcaggcacatttccatggggggggggcatatgccaccctttaaacaatttcagaaaaataagcaattttttttgaatgcccatttcaaaataagtgccgaattggcaatgccatgccttttttggcactcaccgatcattccagcgaaggtctcttgagttcggtgcatttcccataatgtttcgtgcatttccgcgtgcaactaaatgaatggtaaaattgcattttcctccaaattctctccgtttccttcgtaacctttcccacgtccaacaacaaattgcctttgtcctgcaacttcctttggtcccattttattcgtcggaattcgttgatggcattcagaaacctttttgatcggattaattagtaatttattctccgattgtgctttctctgttcctcactttctctggtgctgtctcagtctgagttcgtctcccttttgtccatttctctgctggtatttgtggatgaacctgtgatcagttagtgatcagtcaatcagtgccaacaatcaatgcttttccaattcctttggctttcccccccccccattcgctcttttttcctcttttcttgccaagtgtgttgaaggactgaagcagcggcatttttgcacgcatttgtcagttttgagtcggccctgaaagtttcgatttcattttcttcgaaaaagagtttcgtttgctgttacataaagttgttcacatgcttttccgcccgagacagctccaatttgcgcgaaattactgcaattaatgcggaggaaacgccggcaccctaaaaagaaggaaacattggaggaaggcaattaacaaatcataggggaatagggggcaataatgaccacaatgcccgtggtaattgacaggaaacggccgcaataactcgtcgggacgacgtcgccgtagcctaagtggcgggggaattgctaatcgatgattgggacgggattgaagggtaccgatggacatgaagtgacctaaaggggacaaaacaaaaagaatgggcaattaccataattacttacc

SEQ ID NO: 6809 - DNA, 2674 bp, Heterodera glycines
cattcagaaacctttttgatcggattaattagtaatttattctccgattgtgctttctctgttcctcactttctctggtgctgtctcagtctgagttcgtctcccttttgtccatttctctgctggtatttgtggatgaacctgtgatcagttagtgatcagtcaatcagtgccaacaatcaatgcttttccaattcctttggcttcccccccattcgctcttttttcctcttttcttgccaagtgtgttgaaggactgaagcagcggcatttttgcacgcatttgtcagttttgagtcggccctgaaagtttcgatttcattttcttcaaaaaagagttttgtttgctgttacataaagttgttcacatgcttttccgcccgagacagctccaatttgcgcgaaattactgcaattaatgcggaggaaacgccggcaccctaaaaagaaggaaacattggaggaaggcaattaacaaatcataggggaatagggggcaataatgaccacaatgcccgtggtaattgacaggaaacggccgcaataactcgtcgggacgacgtcgccgtagcctaagtggcgggggaattgctaatcgaatgattgggacggattggaagggtaccgatggacatgaaggtgacctaaagggacaaaacaaaaagaatggcaattaccataattacttaccataatgaaccaaaatgagttggagtagaccatctccgtgctgcccgtatagccttcgttgtaccgttcgcattgagtgaacatccaagacatgcaaacccaataggaagcggtgaaaatgatcgaaaatgacgggacaatcgaatgaatggcaaatggtcggcggatgtatgtttttagatgcaaacttacgagcactgtcattggatggtcggccatcatcgtttttatgacgaatcggaagtccattgaaatccgattgagtgctgcgaaagggtggacaatttgccagggggggggggtaattaagcgacctgcaattgaccgagttgccgcgtcctgtgggtttatcagatcagttcaaagtaagccaaaaaactacctgaaattgtcgggaatggaggaccatgaagcgacaaagcaaataagcccggagaaacattggcacggacaaaaggacgtccaaaggcacagttttggtggcaattcttcgttcatggatataaggccatgaaatgtttccactgcctgagagcggcgggtaaaaaaaagaaacaaattgggaggggggggggggacagacaaacggacaaatgccgactgactgaccggggaacggacacacggcacagacggcgatttcgatgaagctgacaaatggcattttgagggaacggacggaaatacaccagaagccaatggccagaacttacagttttattattcggtcggtggtcaatgcaactcgccaatccctggaggaaagaacaaagaaacaaaaatcacttttcgaattatgccaccgactcggccccgctgtcaatcaaagccattttgacctgaaaaagccaagtgagaaaagcttcgctcaaaattaactatgaatcagtgttcggccacctcaatgcgatggtaattaatcagcgaaacaattagcatcagagtggaagtgacgcaaagcgaccgcaacagcacggagagaagcgactgcttgccgatcaatcggttggccgtcaactctgaagcttggccgctcagagtgccattcactcggatgccctggcccaccttggtccatcacgacaaaggccaagccgacaatggccaaggccaagctgaagtcgcagtttttgtttcgcttcacaaagtaaatcttgcgcatcttgcaacgcatcttcgcctgactttctctgtgccaggaaatgtttgtgtagaaattgtaattaattgggttccatttggacaacgaacggagagaaaaaggacgaggggggagggcattggcactcatttgaaaacgaacccatgggagggaaagggaatttgagccatgttcccctggggttgtggggattgattgacatagggaaataagtcggaaagtgagcgtgggtaaaaacaaagccaaatgggtggcgcggggaaagttgagttgtgtgtggcactgttaatctgttttacacactgtctcttaatcaccatggcacccgtcccgggggagaaaaaaggacctgagaacggcgcccaatcacgcaagtcattcccacggcccctctaattgacccccccccccctcccactgattctcccacgcggtcgtggcattgttctacgggaaaaagccttctgaacgctcacgtcgttatggaaatgccgtagccggactgacgacgtcgaatttggcggtgtgtggccgaagacgccacttgctgctgaagggcgcaagttttgttgcgcttggcaggcgcttcttctgctgccaaattccattccaaagactttgccttatcaaaaacgacggatcgaagaccgccgcccgtcggttggagttcgccgttgcagcgttcatctgtgaaaaggatgcaaatttaatagccaacaaaaagaaatgcatttgaaacggataaaaaggaggagagacagagaaaagagttgcaatgaaggggagggagggcgaagggaggggaaatagggaggggaaaga

SEQ ID NO: 6810 - DNA, 873 bp, Heterodera glycines
cccccccccccccctccaattggcattgttcccacgcacctatggcaaataacattttcagttgtcggagaataattgtagatttgggaaagggaaattgaagagaaaaagaaacggagagatgaagaaaaaagtgaacacgaaaatgaagagaatgaagggcacacttcacagcagacacacaaaaaaggaagaagcatttggccgacttcatgggacaatttgggcaaatgcaaatgggtgaaaacgaaagcgcagctgatgaagaagagcacgggaaaaggaagggagaagggaggggagaaaagcgggagcagtgggggggggcaaagggagaggaacgaatacggcacgaggggccaagaatttcaatagtttgaattaaaaaaatattaatcggtctcgaggtttaatctcgcacaccattaacactgctgattcatttttttggctttgctttcaaattcttgccatatttttctatttcctttccaaagcttcatccatcatagactgacttgtgcgattggattagtcaacagattgtcgtcgtcatgttgcaacagttgaacagtgttcagttggaaggttttgacagtgccggggccaagccaatcgcacgatttgttgcatcggtttgtgagaggacgatttggacaactgaacggttcggggggggggggagtcaaggcagtacaaaagccagttcgtacaatgagtggtttttacatagtttttataactcaattaaaatttattatttttcaataaaaataagaatgaatttttctctttaaaaaacaaaaaactaaaaaatggttttctgttaatgaagagtttttttgtcaattaaaaaaaagttttgaatgtcta

SEQ ID NO: 6811 - DNA, 987 bp, Heterodera glycines
ccccggtgtactgtaaggaacggtcgcaagagaacgcgcataggcaggtggtggcacagctgattgaactgataatgtagttatttaattaaaaattggaaataaaattcaatttctaaatttctttttcgaattatatttttgcaacctaaatttcccataattttggggaaattaagatatgaatcgattgacactttcagcatacctttctcattcatcatatccgtttgatggtgcggcactgcttttacaaccattggcttggctaaatagacattttaaagggattaatttgtgcagaaattgatgtgataaaatttaaatgtttttaccctgtgactttttgtctttcacttgcgctgttttggcaattgcgacttttgactaaattaaataattaattaattattcaattaattaattgcctgttttcggctctccctttattgcttttgccgctttgactttcttagctggctttgctttttttgctgtttcaaatccttttggcgatgcttttccttttgctggagatgccgccactgctgctttaaagtaatattttaataaatttttaaaattgtttttacctttttattgtcttttttgacagcctttgaatttgctaaaataaataaataaaaatatattttttataattttaataaaatatttttgcccacccatttccattaggacagccatcaccaagcaaaccatggccatgaagagaatggtacgcattttgggaggataatttaaatgaaaaatgatatatttttcggcattttcaaatgctttttatatgctccgatgccaaattttatttcgaaatatttgattaaaagttggccaaacagacagagagagtggaaaagacatcgactgatttttttgttgacgaattttttttttcattttttcattcataaatttttattttttccattttcggtgatttcttcatttatttgccaacatcaa

SEQ ID NO: 6812 - DNA, 2070 bp, Heterodera glycines
cgacattcatttattttgctggagcattggcacttagtaaacaaatttgaaaaatagaaaacactgaatttctctaatagagccacgggtgttctattttttgtattgctcgcagggggttaaaaatgtaaatttttaatcaaaattaaaattcacagctttatggattgtcgagagcacggcacaaaggtctttggcactgaatcgctgcattgaattggtgtcatacggtagtgctgcgaggttactgtcccatggcaaacgcatatatctggatgattttctgcgtcatctacggcattacgtcttcatctttaccatcccgatcattttcaccggggtgtacggcatggtttttcaacccacactttggctacatcaatgacccaaaaagagaaattgtacgaaataaattgcaaaaaataaataaattttaattgcaataatttacttttacagtatcgcaacaaattgcttactatctacgattataccatggctactgtactcacttcatatatctgtcctttttgcttgttctcctcatcaaaattggctttaaatacagcaaagttggcttatcgaatccaaccaatggcttacaaacggcgaaaatggtaattaagaaatttaaataaaaaaataaatttggatgaaattgttacattttcatatttcattccatttttataaattacgctgtttaaattttttggtaaccctcccaacagactaataaaaagaaaaaaatttttgttctattttgtttttataagttcgtcgagcatttagccaaaagcctccaagtttgaatcataaatgagcgaacaatcatatacaattttttgatgcaattaggcgccacttgagaaagcagaaattttggacattcacataaatttttaaaatttacctgacaaaataatcacgcaattttaaaagtttgccttttgtcttgtcgacaagaaacaccgctactttttatattcatccacttttttgtgcttgaatcatttttgaaggcagagaatttctctgacatacactatttcttaattttgctttcccaattttattttattgcgtgagaatttgttaattgtacataatgaaagctaattatctaacaattaaaattgcaatattgtgtaatgacaatgactcgggtgtttgaacttttaatttgtactcagacaaccacacactttttaaggccccagtgaagggaatgaatggcattattaggaagagacgcacattcaaagttctagcaaaaaaaaagtcggaaattttgaccaaattaaaaatcttattatgtttttttagttgtttattaacataacaaagcttcaaaaacttggaaagactgtataatccaatttatttttaaaattaagcaaaactcaaaaatgctgaagatattaccatctactgcccggttgttgggtccctaaaggtcgggatccccaaatatgttcataaatctgagtaaccaattttgctggtccctataaaattatatttaaggcccgccactgcccaaacttaagtcattaattaatttaaaaaatttttgtttaaattattgccattccccaatagggtccccgaaccgaacaattttaccgacctgtcctcccaggcgttccactagaatttcttacccgagggttcggcgacacaccatacatttaattaattgttggattggattttcatttctttgcatttttaattaattcaaattgaattgccattttttgataagataatattctaaataaaccatcgaataatatgagtaataacggtaattcatcaccatcttcgtccgttaatgaatttggagagtccgaccaaatttacgtgtacaccgtttgggtgacaatcattcagcaaattttgtcactttttggcattgcgctaaacagtgccatcgtttacatcaccatcaagcacaagtagtgactgaaattttttggcattgtgtcaatttgtcattcctaaatagagtagagaacatgaccctaaaatgcgtcagtgaaaatgcatactgatacaatattttta

SEQ ID NO: 6813 - DNA, 3454 bp, Heterodera glycines
atttagcaaattttgcactttttgtccttcgtcatagcacctcataatccatctgtttttgttgtatctgccgggccagaaattctccattcttcgaacaaacaaattcaaaacaaatgaaaacgttttttagttgatttttagataattaattaatacaacaattgaacaattcctaaaattcgcatcaaatattacattatatttgctcattattatttttgaatagtttaagtgtcgaaagaattatttttgctgaggttctgtgatttgttaaccaattcgtaaaattatctgggaccatagcaacgcgagatttttgggccaagaccaaacccagctatttctccttcaattgctaaaaagacggaacggtgtccacttaaatttgttttttttttgataaaacaagattgaacccgatttttgatttagactaaatttatggagcgcatatgtccgcagcgcagattcgagtaatctttatcgtaattctcaaattcccgatgcccaaattccatatttcccgatttttctcacaaaagtatgcaaatttttttggcataatgttatttcattttttaattaataatttaattagaaactccaccggagttatttaataatatgctttttatattgtttccaaatttcttgtaaggaaaaagaagaatggcaccgaattgacaccaccagataaaattggaatttttatattaactttttagtaattttggcattgttttctttaatgtttcattaattttaattaggaaacttcaccgtagttacggctttctgttggccatctgttctttttgtgacgcactcaccgaattggccaccccattggctaccggtaaaataattaaataaatatattatttcattatttattttttaaaattatctttagttctcgtttttcttcgtgtgcggattcctttgttgacttgtgtttatgcccaattttttgctttcactggaagtattaattcatttataaatctgttttggataagcgttgatcgatttgtggcattggcattccccgttttgtaattatataaattattattaagaaaattaaatattcaggaaattaatcaaactttctttaagttttcgtaacatctcaaggttttccggaaaatatgtgttaattgccaatgtcttttccttgtcaattgcattttatattatttatttgtcgtttttatttgctctacaaaatcccgaaatgtaattattaataattgattaattgactaattaataataattttaccaattgaaaggatggtctattgtgagcctggtgatatggttcaaggcgaagtatttttggttgcttctcttatcgtggttatttttactttgcctacaattgtcatttatattataatggggattatgttaaaggtaattaaaattaaatgacttacggtggttgttaaaaaaatgcattttgatttcccagtgatcagaagtgatcagaacaacagcaacaattcgtcccagtcccaaattgaaatcactcgtcgcattttcaaatcattggctgtgatcatggcagtgatcttttgcttttggttcaccagttgtctggtggttaacattgtggggcgcggactgatcacaagtgatccgtcatctcaatttctgatcacacgattagtggtacaaatggtcacaattgcaggggcgatcaatgcaccaatcctatatatttgcaggcaaatttagaattaatattaaaaaaacttttttaataaataaaggttttttagcaaagaatatcgtgatatcttgaagagtgagttcggttgggtcattaaattgtggtcaatttgaaatcgaatttcatttgctcatccgaaacccaatcaaaatgcttccgctgttatggttgtgtcaagaactttgaaaaattcaaacgacaatcgagtgcatgtcagatgaaagaaaagaaaaatgttttaatagcaaaaaattgagcgttatttttacaaaattagattaatttatgcctttttagaattgatcatagaatcaaataattattgataaaaaatcttgtacgtcatttgtcacttgtgattcacacgggccaagtaccgtaagccatccagctttttcagagtgtacagaaactgcgagtcccttcgaatataataaaatagatttaggatccattttttcttttacaatttttctataaaagacaacccatcatccaatgatggcattatgcaattctgaaaaaagcaatcttatctagtgttcattattcttggaaaacccgtgaattgaccatgcgattcatgaccgtgacaaaaaaaaagcgtgaaaatcacggtaaccgtgaccgtgccgtgagtcacggcacatctctaccattggcacgctaatccaattcctcctttggcccaacgccgctctaaatgcaaacagaaagccggcccggtctcgccaaacccgagggtcaccttatagaagggcggtgttggagtgataaatacttcaatttggcgagcttttaatactgatttattttgtgcgtgtcaaccccttcccatgaccttaagtagggttcggaccccgtccccgtccccgggggcgggacaggtttttggggctcacccccgtccccgcccccgtgactctgacccccgcatcccccgcccccgcgaccttcgccctcacgggggcacgggggtgaaaaacacacccctaagaatggcatattcgtggaattaaaggcaaaaatttatacaattttgaattttttaaccatcttttacaaatttttatgaaataaagtaaatttgcttatattgtttaaaatatttgtggtttagtggttagtgcttcaacattaacaaactttttgttatgagttcgacaccggttgacgttttcttttgattttattttttttccaaataaatacagggtttttctatgttgttattctaagaaatgttctggttttggggtagtaccttattttcatctaaaaaagggaaatttctaaaaaatttgactaatttctaacaaaattcatatagtcttaaaaattttccgcttgcggcgccaatcggctccaccggacctctcccctcgcacactcaccaagttttttggaaatacatttttgatcgaataaaatgtaaaaatatttgaagcaattttgcaaaatgttcttatttttgaccctaaaatcttattttttggccttgatgttcttattttgaaaattttgaaatagaaaccctggatttagacaaaaacacccataaaaagattttttggagctaattaaaaacaaaccctcgcccccgtccccgggggcgagaaatttctcacccccgcccccgcccccgcgactctgacccccgcaatcccccgcccccgcgaaaagccacccccgcccacggggtccgaaccctaa

SEQ ID NO: 6814 - DNA, 4016 bp, Heterodera glycines
  misc_feature (3902)..(3902): n is a, c, g, or t
aaatgttcaaaaaaattaaaaagtcaattcagttttcgcttataagaattaagaaaatgccaaataaagtctaaattttacatttttttaataaaaaaagttcaaatttttcataacaaatttgttatggccaaatttcactattaaaaaattcttcgaaatatctttgccgttaaacatggtaatgatttccacctcaacaaatggcctttggcttactcaaaattgttttgctacctttttatttgtcctttttctacgattcaaatgggctctttttttaattaattattattttttacacatcccttctcattatgcgctaaagttttaatcattttctgatcacttccgtgcccaatcccccctcctcccccccccccccgccggtgattgatctccgctgatctctcactgatcattcgttccctgatcgtcgtccgtcacacattcattcaatttgactgaatagacgacagacagtctctgttcatcattcattaatgtgtctacacaacatagatcatcattatattagtacaaatcattcaattaaccaacaaatattaaaggtagctatgcccgaaaaataagtatcacaaaatatttccccaaattgcgcatttgacacccaaataaaataacataattagccttgagagcaaaataacaattattgctcgtcgaataataaaaaacaatcgaattaatatttatgtaattgtcaagtgacacggtattgacagtttaaagacaaaatgggtctttttaactaaaactctcaaaaacattttttttaaagttcggataaatagtcttttaaaattctatttctttttttttaaatttcaaactccgaaaatcgtgcgcaacaacaaataacacaacacaaaacggatgaatgggagggaatacattgagcggattttcagtacgcgacttcattcttcactgattgacccttccttatggaaaaattttgttcaatcaaatacaaaaaatggatagttttacattttgacgtgctttaaaaagagcgttttttacattatggttgtttttaaaattttaaaattatgataatagctacaatttcctaaaactcgaatttaccaaaatttgtctctcagtaatttcttactgatttgatgatatttttacaattcatattcattcaaaaaaatagttattattcctcaatatgaaaaaaagctttcaacgtgacgttaatttatttctgtataaattttgccaattttcttcaccaattcctacacaaaattcaaataaattttaaacattgttattaaaatatttaatcaatttaattgtaacataaaaatgattattaataataatcttttcatggtcaattattcctactcatataactgtcatgttctccgcctctgccctcattctcccaatttttcccagccaaatcatccaaatttttcaccctttcatttcgcgcaaaacactcaaaaattcgttcgtcacaatatactcactgtttttcccaacagcagcagttaatgtttgcccaaaaccttcgttttcacaattattgcatgacagactgacgactgattaagaggtaggtgaatttgtctgatcagtaaaaaagaaatcgtacaaattttgatcggagaccaaaaataatcattattcaattaatgattgggtttttatgatcaaaatttaacatatatactttaaaaaaaaaattttttttttatcaattattactaattcccaattttcatattttatatttattatgtttccattttttaagctatatatttttataatctcaatgttattaaatccgcttaacaaaatgtgtgaccaatttaagaaaaaattcgctcattttatttgttaagtatttttctaaatttaatctctcatttatccatcagataatataataaaaattaaataaaatattatttaattttcaatcaaaaatcccaaaaattcctatttttttcttccctttgcacagctgcatatttaatctcaaatttttttatctttaataattgaatatgctttatttaatgcattaaatgcataattattattcctaaagtgctaaatgagcaaaaaagggagcagagaattggtctgaaaaattgttttaaaataatccttaataattagtactaacataaaattaattttcaatcgatgtagaatcaattaaattttctttaaggaatttaattatttctttttaataatttgaatggaccgaatgaatggcaaaaagcgttgttccactaccgttgcgccacgaccatcgcgcgtcgatgcgccgtcttacggtaaccgtaccacctgctgttgctgcagtaatggcggctttcgctacgcaattttgctgatcactgtactgtgcctgaccacaatttgctcaaatatgatcgccttcaatttcacgctgattttgatgcgccggccgaattgggccaacacttcgtaccccgtggactcacacatggtcaaaaacagtcatttggtcaggaataatttataaacttaaatttaaaaaaaaatttttttagcttttttggacaaaaaataatgaaatttaaaattatttttatttttatgtttaataaaaaatttaattctgagtttgcttctctaaaattatttttggctttgaatgtgacacagaatttggttgggtgaaccatgctgaaaataagcacttggaaaaaattttaaattttcccatataagttttcaacgactatttccagaatatttcttcccccgctgatttcaccgtgctcaacgagtcatttgtgatcccgcacaccgtaccgtactccagtgtggagaagtcgcgcctactttacgcggtcggattggccagcatggtcagcacatttccgttcagcgcactgtatacgcggtacggtgcgcgctacgtgttttttgctgccggcgtcatcagcacattagccaccgcactgttgccgctggccgccgcccatggcatggccgcgttcatggtcatccgtgtgttccagggtcagcaaacaaaccattgcattaccaagatgggacatgggccatcgaattgagagccgaccaatctcgcactgggcaatctgttgctttataatgacgaggcttaaaaattataagaaaatcccaattttcataaaaaatatctttttaccaggttttagggttcaagtctatttcatatttgtccatactttgacagattttcaacagtataatgttttctatttttttttattctaaaaataatttttattacgtatttagccatttctaaattttagccttcataacgaattgaagagttttgagaaatttgcgatcaatttgtgtgtccatatattgtaatttttatgtaaattgaattagccgtcataataaaattgctaacatttgagggcttgcttatggtgccaactttgctgccattggctttgtgtgccatcgatgggccacccttagacaacatggctttttcctgtaatttagttaattaattattaaagataattatgcgtatcttttcaaaaaaaatttaagtgcttgcatgactaattttacttcaattgcggtcacattgacaaatccgatggcagcatttgtaagtgctaattagtatttgttattattctcataacaaaaataaaaatttatatttttcaattattgccattttttctaagataagctcaacgcctgcacttggatggccttgggtaacaattttaacttattattaaggctttgagttgtgttgactaaaaaaggacaaatatggaaactaaaaaatgggctatttcagggcacggatttttagatgctcaaaatcccgaaataggtacctaaataattgctanaaaactgccaaaatagttgataaaaaactgaaaagtgctaaagtagttgccaaaaaattggaacataattgctcaaaaatgcgaaagcttctcaaaatctcaatggtcaacggg

SEQ ID NO: 6815 - DNA, 2569 bp, Heterodera glycines
aaatatatatatatatatatatatatacatatatatatatatatataaataaataatttatatttgatttaattttaatcatttgacggggcggagtcgttatttaaaaaacatcacaaagggcgttatttaaaaaaccatcattatgaaaatttttgtcgaaaaattatttataattttgctccaaagcagccaatttttaattcttgatatcattcgatagccctaagtgttctctatcagtctgcaaaatttcaaaaaatttcttaaagtttcaaaaaagttatagctcgaggaactcaaaaaaccgtggttttcgaacatttttggccataacttattttaaagttaatagattttttttgaaattttgcaagctcataaagaacacttagttctatcgaatgatatcaaggattaaaaatttggttgttttagagcaaagttatacgcaaaaatttttattttgatggttttttaaataacgcgcataatgatggtttttaaataatgacatagcaccatttgcacagtcaatttgctcatttcgttgtcgctggcattcaattcgaaaagtccgtcactttgttcatctctccgctcatttttttgctgttcatcaaagacgaatcgtcacaagaacaatggcgaaatgttttccttggaatgagtgttgttctgctcgtagtaagtcaattagtaataattacattatttaagccgaaaataaattaataaatcacaattagccagagttatggctaaataacttattttatttattgtacaatggtaattcttttcataaaaattaaagtttaattaaatgaagttatttactttaattaaaaataaattatttatttgtgttatctagtttaaagtaaatttttataattatttgtgtaattcaatttaaaataaattttatatctttttgtttttctcttgcaatcggaaattaataattttttaaaaataattaatggtattgaattgaacaaatttttgccaattcttaaaatacaaaactaagacaatgttagttagcactaaatttaaaaatactgccaattcaataaaatgaaaacattttttaaatttaggctaacattttcttttggttttttgcggatgatcagccagcaaaattcaccaaagaaaagatgaagattcgaaagcaaaaccaccaaaacaatttggaagcaccggccaaattggcatccgcagaaaaagcgaaggacggaggagaaccaatcgggagaaaacgaattgcacaacattggatttaggaccaacaaaatcaattgatcagacaaattagccccaataatattaattgttaattaccaaaaatggaaaaataggaaataaaaagtcacaagggagacgggctaatccacaggcaatcctcagaggaataggatttaatccgttcattaaatttaaaacattttcatcctaagacaattatttgtggatccgtttttcgtttgtttcatttcaaaaattgggaagtttgttcattttttcaacaccctagaatattataaataaaaaagattcattatgaatctgatcatgattaggtccgatctctttcaattgaactgaatccccttttaccaactaaaaaatatgcataaatttcattgattttattgtacgtatagttttgtatatcaatgatttaaatttttgatgttgattatttgataacaaataaaattgatttgaatatataaattataatttgaatttcatcaatgagctgtaagtgaaaaaacgtcctcatggattttgcgatgaccgagaattttggaaatttataatacaataaaaaataataatttttgattaaaaacaaaattatttgttctaagaaacagaaagaaatgaattaatttatcttaaaattatagattttatcatattttcctagtctcttacaatatgaaattaattattttttcatatttttaaataattaaataatattgaattaaataaatttttgccaattcttaaaatacaaaactaagacaatgttagttagcactaaatttaaaaatactgccaatttcaataaaatgaaaacctttttttaaatttaggctaacattttcttttggttttttgcggatgatcagccagcaaaattcaccaaagaaaagatgaagattcgaaagcaaaaccaccacaacaatttggaagcaccgccaaaattggcatcggcagaaaaagcgaaggacggaggagaacaaatgggagaaaacgaattgcacaacattggatttaggaccaacaaaatcaattgatcagacaaattagccccaataatattaattgttaattaccaaaaatggaaaaataggacataaaaagtcacaagggagacgggctaatccacaggcaatcttcagaggaataggatttaatccgttcattaaatttaaaacattttcatcctaagacaattatttggggatccgtttttcgttggtttcttttcaaaatctgggaagttggttcattttttcacaccctagaatatattaataaaaaagat

SEQ ID NO: 6816 - DNA, 6895 bp, Heterodera glycines
  misc_feature (40)..(40): n is a, c, g, or t
  misc_feature (59)..(59): n is a, c, g, or t
cagagtcgaaatcgcttatttatatttatttttgtatggnaatatcaccggtgatatgnagaaaggaggaaagaccaaaaaggatttaaaaagttaaaattcggtctccgatcactttgccatgctatgatgcgagttgtgttaagtaaaaagcaaacaaaagtcattctcttatgcttaatccaaaaaacaaattatattcattaaaattttagggtttattccttttatttgccttttcttggcaaaatgcattttgaagagcaaaggccataaatgacatcattaagcggagccgaaaattcgtataaattaaaataattgatattacaactgattcgatgctttgttttgtatttactgaagcaaatcttgaaacagacagcttattttgccaattatttttcataaataattcattccgttgcactttccttctgctgattggaaagccaagcagcaggcgacaaaaaaaacaaagtaaatgaatgaccaattgcataagcaaatggcaattaattgctgcttttgtaaacattgccttcggccgttctttccttcgctgtgccattcattcattccttttgcatccgttcgtttgttcgtttcgttccgtccattagccttcctttgtttgccgttcattaccctttcagtggcgtgggtggactttgaaattgggcagcagaagcggagggaggttggcccgcgggcattatcagcggaaaagccaccgttggcctatcgcatttcaatgcggtgaaattggcatttcaatggccaattggcggggaaaacattttcagagacaaaacaaaatggcacaacatctgcctaatggtcataataagcactacagtatggaaaagggaccagcagggactaatgccgaaaattaaaagaaacaattaattaattgattaattaagagccaacggtttattctctcatcaaaaataaataggtaatcaatcagactatttatttggcttcttctctgtctttaaatggggttttactggtgctatgacgttagtccaaaaccgggtgcaatggcgttagtcaaaaaccatcaaatgaaaatattttttgatataactttgttccaaaacaactaaatttttaatttttgatgtcattcgatagccctaagtgctttctattagcctacaaaatttcaaaaaaattcgctaagatttaaaaaagttatgaccaaaaatattgaaaaaaacttggttttttgaacttctcaggtgataacttttttgaaacttaatgaatttttttgaaatttcgcaggataatagaaaacacttagggctagctaaaaataccaagataataaaatttgattcatattgggtgaagttatgaataattttctgtcaaaaaatttccatttgatggttttttgactaacgcccattttgatggtttttgactaacgtcccagcacccttctaagcatggaaaatttgaaaaatatgtcgctaaaattgaaaaatttttggattacaaaaaattaggcaaaaaagaaaaaaaattaagagcaaaattcgggtaaaaattaatttttttttttttttgcaaaaatttactaatttttgcttctatttttttctagattcatatttttaagtaaatgataaatatgagctcaattacgaaattctatattcatgcattaaaatgattttttcgacttgacaaattttatgggtttacgaaatttttttaaaatccaaaccaattcccagaaatttattgtccgtattttcgtatttaaagtggttggcggtctcctttgagtctcaccgtcaaacgacccggtccgtgaaagttgtgacaaatttgggatttatcacaggggtggtaattagctaattaggtttatccaccagaaatgtaacgaaatccaactttcccatttttgagtttttaagttaaattaacgaaaacgaaaaaaattattaacttggaaatacttttatttttcaattatgcgcatcttttgcgattttatgttcaaatatgattctagtacagtatactcgtcccataaatttttacgcgttctataaaatttttctgaaacctcagcgtgtcgaatgagaccgtggtgagtcgttccacaaaaaagctcagtgtgggcgttccacaaaaaaagctcagtgtgggcgttccacaaaaaagctcagtgtgggcgttccacaaaaagctcagtgtgggcgttccacaaaaaaagctcagtgtgggcgttccacaaaaaaagctcagtgtgggcgttccacaaaaagctcagtgtgggcgttccacaaaaaatgctcagtgattgataaaataaaataataaggttaaataataattttgaactgtaaatgtaattttgatttaattttattgcatgcttttaaattataatttttattacaaaactaaaaaaggaaaaacaaattaattgaagacaattgataaggtgctaattttctttgcatttcatgtaaagaatttataattttgattcccgaaatagcgaattaattgataacataagaatgtcatagtaaaatctgagtatttaagctaattttattaatctataattcaaaaaatttaattaaataatccctcccaatcgcaacaatgcatccaatcaaaaaatttttatttttgtaccttatactttaccaaagtgtcaaagtcgaacaaaaaccagtacatcgtcgtgctatcctcactgttttagcaattggaggtattgcagctctcgttttgataccaattgtggtcggatcggcggtggttggatatttgatatcctatagcatacatggcgttaatggaaaatgttagtcagtttacctacctactcaaaaggcttatatcataagaatttaaattcccctgttaaacagatgtccaacgactgaaagttttttttccccttaaaatgagaattgacgaacacacaatcacgatggatgttgagacttttaataatgagtttttattttccaaaatcgaacaaatttggcgcactccaaatttagaggagatttgttttaccggttagaaaaaatgactatttatctaaataaaatttttagaccatgaaggaaaccgacaacgccacgcccgctcagcccaaattgagatgtttttatattttgctgtgaaaaaagataatttaaaaatttcaatgtgttgatttttagtgcttgttagtccttaagcaagacaataaaattgaaataaagtcttttgttatcagttaattttctatttcgggaatttataatttgttaaatattgaaaaggagtcaaagaaaattatcactttatcaataaaaatccttatcaccgattttatccaattttctttttcgctttaaatttttaaatttatttcttataatataaatgccattttataaaattaaacctcattttttctagcatctttgtttcttttatttcctggctcattcatttgaagaataaatatgaaattctattaagaaaatgctcagtattttgcacaaaatcactttcatcgtgaaattgagaaataagcagactctatatttataaaaatgctatttttatatttatatgaagattagtgacctcatattcgtttagcgtgttgttaagattttcatctagtgctaaatataatttatttcttggtctaggtttcgatttcccatttttaatttttatgatgcggtcatctatttcagacataactgtttggaaaaaatttaaaaaaacgggtaccgtcgcattacgaacactgcttggttcccttccctaaaaccttttagttgcatttgttcatggagtttttttaatgttttaatttctttattttgatagcgtttgacaagttctatagctttgtgattttttataaattcttcaaaaccggaattggtagaggtcgaatactcaaatcgaaataacaaaaaaataaaaataaaagtcttattcattttctaaattataattttattaaacatataaaaatttattgtattaattttacattttcagtggtagcccaaaattatatgtattgatggttattgatttcaacgtggatgttaccaatacaataattaaatttattattttaaatttattattttattttatcaatcactgagctttttgtggaacgcccacactgagctttttttgtggaacgcccacactgagctttttgtggaacgcccacactgagcttttttgtggatcgacctagcaccgaaatgttctatttatttacaaattttatttttcctacaatttttttaagtaaaatgtattgttgttaattttgattttggctttttaataatgtatatggaagattttattgccggaattcagtatataaagatataattattaaaaatttttacgtgaaaatttaatcctttttcgatttttctgggtttacatattctataccaattgatttccgtactctccattcattcactacaagtagcttatatttttgttttttattagtgtaatacatgaatattatgaaagcattattttttattaggcaatttgtgaaaatttgttgccgtttggccactgtcggtgctttagacagcgccaggggcgcagcggcacgccctgggaaaagtaagtgttattttttatttctttaatttcctttttttcatattaatcgaaaatattagtttcttcctttaaattttattaatattttaagtcatcattagggctaatattattaggctctaaatacacacaaaaggcacaaaaaaggttataaaattacaaaaacatgttttttgtgcgtttttggccactgggtgcacagaaaaaataaataaaaattaaattaataaaaatttgcaaattaacgtatagataaaaaagcacccacaaaatcattgcattaaaaaattaataacagttaaagaaaaaatattttaacataaataaaaatatataataaagactaatcgagaaaacaaagagctaccgaaatataaagattttaaaatttattcattttcacgaagttatgataatttcctatcaaaatttttcgtaataattatagaaaattttcaaatttttaaattgaaaaactgctaaatataaattgttttaaattttaacttaatttttctttttgtgttagaagaaaacatttttgttaaatttattttttttatatttcatttttttttaaataaatgaataaataatttaatttattcttatccgttactgatattttgattccaattgattcaagtttatatgccctatcgaaatcatgctgatatgaattacaaaatccaaatgatcaaattaaaattaaaataattaatttaaaaattaaaagcgaacatatattttaattaataataaataatattgaaatatttgctatgttgacaaggtcttcggtcaactctcgatttttgctaaataattataatgaatgaaaaggtttacagtttatacttttgcaaaaaagtgcatcattaaatatactataaaatgaattattaatagccatcaagtaaacaaacaaatttattaataatactttatttcaatttaaaaaactaaatttcatttattaaataaaaatattatctcataatttaatatattcagtaatatattatatatatattttttataaacaaacacataattaatataaattaaatcgtaagaaatatttcttccaagtataccacataaacattaaatattaaatttattatttaatatgtatgataataaactcaagttaatctttgaaaaaaatttatgaagttagttaaaatatttcacttatcagcgtaaacagtttaaatgtcgcgatatgagtgaaaaatgttcaaaatgccactttaaattaaataactttttaaatctttcaaattcataaatctttttaagatgcgcataagcagaatccaaatacaaaattcaaaagaaaataaatagaaagtgaaaatttaataaaatcaaaaaatgcattagataatactaatattaaaatattaaataaataatacgaaaacaaatacaacatagaattacttttattaatctttatctataaatcatatcaaaagcttggcatttgagattaacaggcatgaattttgtattataattacaattattatatatttatttttaatgtaataagttcatatgtttatcctttttcactttttagtccagttttttattaattataatccatttattttttaaatctaatttttacgtaaattttcggtatgattttaaaattgtaaattttaggctatttggtatacaaaattactgaaatattagatatttttaattttttaaaatttgtaaaaaaatatactttttaatatattattttaaaattttataaatgaataaaaaaaatcttacattatttttcagttatttttaatttgttttgttttaaagaataatatatttttaaaaactattaatttttaaaaacattcttcaaatagtaaagccttattatttatatattaagtttattagtttttttttaataaattaacttaaattgccagactcgaaatgtaattcatttgaaattaaaaatttttgtgctgaataaaaatgttcccattcgctccaatcgtcgttggcaatgacaaacgcctcggcgttcgccttggcattgcgattaagcggattaaatttatattttaggtaaattcaaactattattttacaatcatttgcttatcatataaataggtgtacaatatatttgaaaatagtatttctattttttttttattaaaatagattaatatattataaaaattttatatacatttattca

SEQ ID NO: 6817 - DNA, 3840 bp, Heterodera glycines
  misc_feature (812)..(812): n is a, c, g, or t
aggaagagaagaaatggcaaaaaaaggaatagatagggcttgtaggaaagtcgcctttaaaacgatcggcatattcaaaaatgattttgactccggtaggtggttttcttctgccagtcccttcgaaattttattttattggagagaaatttgttaacaaatatttcaatgcacaaaaaataccaggattaagccgaagtaaaatagtccaaataagagatttaacataaataatttgtacaattaaaaaaaattgaaaatgaaatatcgaagagaaaaacacagaaacattggtgggggagggaaaagcgtttggcaattggcaaaatgccggggctggcattatgttccgaagatatcgccaaaatgggcttttgcttactatgcaaaatacggcacacaatgtcataacacaagccaattgatcagtggtcacgtcaataattttaaaattgaattagaatcgatgactgctcagcatgcgttattaaaatatttaaaataataaattaaaacctttaaatattttacgaaaagtttttaaatattattttgtattaaaacaatctttttccatttcatgttgatttcccgtaatattcaatccgtaatttttttgcataatttatgtgtaagaatttatttattttttaatttgtttctttcgtacattagcgaagagatattttaaattttcaattattttttattataaaattaaaaataattttttagtttaaatcaattattttgtaattttctgatatttttaaatattttacctaattagttctataaattttcctttttanatttataaaatataatattttttataacttaaaaataccttttaaataactttctcttaatagataaaaagacaaaattgtttaatccatattgctgatttataaaaaataaaagaaattgaacttttaaattataattcatttttcggtataatttcatggttttctctgttctttagcattttctcatcaaagttgaaggtttttttaattatattttttttagcataatgaatataataaaattattttttgtttgtgcataattaagatttttaatatttatttatttttagtatttttaaacaatatttattttattaaattatttcttttcgtttctttatgtaaattaatagcattcttcccttgtataacatctttctttcttctttttattattgcttcgaaatttaaattctttaagtattttaagttatcatattgcttatcgattcaaaatattaaatttcttttaaatttaaatttttctattgacaataataatatactttttattcaataaaattttgtattatttcttctgatcagtacaacatttggtccctaatatcgggtcccaaaatttcaagtctcccaggtatcgtgtgccatgtgtgaaaatctgttcataagtctgagtttcaaatttttattatgccgtcgagttttctaatcaaagccgaaaaaagaaagatggtgaaattttggcaaaagtttcaatagtttatttgtatccaaaataataaattggtatttttacgacaaactgtctgccccagcagggcccgtcttatttattttttgaaaaaaaaatatttacaggaccggtggttaatttagaaaacgaaattcaaaaagcctcaaattttgtcactttatgataaaatttttttgctgtatatgaagaaatgaatctgcagattaaaaagataaaaaaattcgatttaatgcaactttttagcacttaaaacaaaatgctgcattttctaaatttttctttaatgttaaaagttacatgaaatcgcaaaaatccgcaacccataatccataaaccgaatccgtaattacgcccagccctgcttacaataggtaacgaataaaaacttttatggaaaaaattttaatttaaagcaaaatatttggttagaataataacagattaataaaaaatattttagtttttggcaaaatgatttatcatttatttattattaatatatttattgttttaataaaattacatttatttttctgattatttattatttttcttattcctaatttaaaaataaatgtttactcaaaaagaaaacatttttaattttttttatttatagaggttttcttcgtgttttccgctctaaggaattcgtaggttttgtgccggttaattttcgtttctatttttttaaaactttttttcataaattttatttaaacttataactatataaccattcttttgagtctgctttttttcggtttttatatcaatattttcataattttttttttagcgaatgattccttaattttgttgaatttttttattatttataatagaaaatactaattactctttaacttttttccaatccattaaaaataatgtttgctaattttttgaaattaaagaataatgaataataaacctgaaattttctgtttttaatttatgtatttatttaataaatttttctttttattatataatagcattttatttatgtcccatcgtattcttaaaatgcaaataaatcaaagagaaaattataaaagaaaactaaatttgaaagaattttttttttctttaatattttcttctcgcggtcagttaaatgcgtataaaatatataattttttttaaaatccaatcattttttaaatttattcatcattttttataaagaattagagaaaataaattaattaatataattgatgatgagaaatataaaaaatcattaaaaataacaaataattaataaaaagtatataaaacgattatcatttaaattaataaatattgttttaatcaaaccttttttaaattaatattgtcgtcctacaaaaaggttggaacatgcctagtattctgcgcaagattgaaaatattatagagaaaattaattttaacacataattttaaatatttaatttaataagaaaatagttgagctaacagcattttgttaagtaaaattcattaacaaacaaataatcaattaaattaaataattttattaatcaacctttttaaaatatttatagatatcataattttattaaaaacaaaatttataaagttataaagtttaagaaataaataaaatttcttacaaaaattgtaaagtcgctatctgataatcattagtatataattaactactaaaattaacaaatatataaaagaaattaatgttcaaaaatcaaaaataacaagtttcaatttaaaaaaattggaaaaataaaatattaaatttaaaattgtgttgaaaatattcaaaacatttcattttaattttctatttgatgaaaaattaacaaaatttagactataaaaggagaaggaagctaaaccaaatgaatccactctcgccttgaagtataaatttaaagtgtttaaaggtaattaaagtttttcgagaaacattaaattcgacgcttcatttatatatctaatcaaaatgataaatgataaataatatattaaacatttgaactaatcataattgagtataaaaataatttatttgcagtcaataaaaaaatatatatttgaaaaggaaaaaaagtataaaattttatgtttaatttttagaaggtttttattaaaataattttaatattaaaataagaatctacttcaaaaatagaaaactaaaactgaaatgcaaaaaattaagaaagttttaataaaataatatgaatgaaataaaaaaggtcaagaaaaacaaaatgacaattaaagtggaacattagatataaattattttaattatttttataatattaaatgataata

SEQ ID NO: 6818 - DNA, 1041 bp, Heterodera glycines
ttagatgtaaaataaatgataattaaatgttttccttggtttttgataccattttacaaaaaaaacaaaaatttttttaattggtctaatccttaaataaaattcttacttataaatacatttaattattaaacaaatatgtgttaacaaaatagatttattttttggcgtcaaaatgaatgtgaaaaagaagctggtcagacaagagaaaattcaaattaatttataatcctaaataaattgatcagaaataataaaataagatttttacgagtgccattatttttagagaaataaattattttataaaagtataaagcaaatatacgaaaattaaaccaataaaagataaaatataattttccatgattaaaaaagttaaatattgttgtgtatcaacaatttattaataaacaccaataaaaataaaatgcacaaattgatgaggtcggaggagtgcagcgacggaggagaataaaataataaaaatgtccaatgcgaatgaatggagcgtagagccatgagtgagggaatgggcacccttataaagacgcggggtcagagaaatgtggaggagataggcagagagagagagaatggaaatagtgttggacagagaaagggggagagagaatagtcgataacaatgatgggaaagtgatctttgatccctatccaacacctccctccttaagtcgaatgtccctcgatttgggagtcatgatcggattaagccgtatttaggctttgacgggtccaggtccagtcgttgaggtgcttgtttggctcttcctgatcggcgcaaaagaactggttgagcaggcgattgctgacgatttgtctgcggtttgtgcgcgatcggcgattgttgcggattttgtgcctgtgtctgatcattttcttcaacacgatcattgtcttccaattcaattgggaaacgtcgcctgatttggttggcatgacgatgaatggctcggccaagcgtcggtgccaaaatgcgatacgtcggagatgtgcctaatttctcaataatttttcccg

SEQ ID NO: 6819 - DNA, 2442 bp, Heterodera glycines
  misc_feature (88)..(88): n is a, c, g, or t
  misc_feature (98)..(98): n is a, c, g, or t
gtatatgaagaaatgaatctgcagattaaaaagataaaaaaattcgatttaatgcactttttagcacttaaaaccaaaatgctgcatnttctaatttnttctttaatgttaaaagttacatgaaatcgcaaaaatccgcacccataaatccataaaccgaatccgtaattacgcccagccctgcttacaataggtaatgaataaaaacttttatggaaaaactttaatttaaagcaaaatatttggttagaataataacagattaataaaaaatattttagtttttggcaaaatgatttatcatttatttattattaatatatttattgttttaataaaattgcatttatttttctgattatttattatttttcttattcctaatttaaaaataaatgtttactcaaaaagaaaacatttttaattttttttatttctagaggttttcttcgtgttttccgctctaaggaatttgtaggttttgtgccggttaattttcgtttctatttttttaaaactttttttcataaattttatttaaacttataactttataaccattcttttgagcctgctttttttcgctttttatatcaatattttcataatttttttttagcgaatgattccctaattttgttgaatttttttattatttataatagaaaatactaattactctttaacttttttccaatccattaaaaataatgtttgctaattttttgaaattaaagaataatgaataataaacctgaaattttctgtttttaatttatgtatttatttaataaatttttctttttattatataatagcattttatttatgtcccatcgtattcttaaaatgcaaataaatcaaagagaaaattataaaagaaaactaaatttgaaagaattttttttctttaatatttcttctcgcggtcagttaaatgcgtataaaatatataatttttttttaaatccaatcattttttaaatttattcatcatttttataaagaattagagaaaataaattaattaatataattgatgatgagaaatataaaaaatcattaaaaataacaagtaattaataaaaagtatataaaacgattatcatttaaattaataaatatttgttttaatcaaaccttttttaaattaatattgtcgtcctacaaaaaggttggaacatgcctagtattctgcgccgttccacgtattcgacacgaaatgcttttgctaattctgtgacggaaattattgtgccaccatattatttttgttcaacttattatatattaaattatagaaactttttcaaatatatgagcagaatgttatttgataaatgtaaatatattttttaatatgatagaggatttatttattgattgcttcataagtttaggcgtttctcatcattatcactatataaacattttttgtgaatttttattgacaatctcagtagaaaaggcaaaattcttgcccatgatgtttttttctatatttttaaatttaaattaaacacatatacattaatttattatttctagagaatatttgttagttatttgccaaatgttcaataaataatatattttatctaattgaatgaggcacattactttctgacattttatttgtttattggtttaagttaagatgagaaattccataattttatttaaattcataaattaatttttttaatttttacagaaaaatttgttttatatatctgaagatgattttaagagcgccagcccttgtttttgaactataacttttttctttgacaacctaatctaataatcttggtatcattctatagcccttcagaagtcctattatacctactaaaaagcaaaaaaaaaatttgacctggaaagaagttattaagaaaaaatcacaaccattttgacttttttgcaattattagataaaacttttttaagaatctagtaatccataatttattgttcacaaatatatgcttttgttgatttatttataaatgatacaattaaagaaggcatagattattattttttaaatagcggattttatacaatttaaaataaattaacagaagattgaagaaatggcacaaaatacggtggagattggttggcaaaaatttaatatggcaaggaaaatgacaaaatatcacaaggcacagaagcaaagtgagatgcattaggaggagagaaattagaagaaagaggataaatatgagaagagaattggaagagataggataaataatattacattgaaaaagcaatttacaacaaaagggaaacaatgagcaaaggtcagaccaaaatgaagtgcaaatgggagagaaacatctcggcgaactgacgactgatttccagcgcaattcgcaacaaatccatgtcaaaggagttgggccgccactgaaaatcgttcggttattgcctaaa

SEQ ID NO: 6820 - DNA, 7378 bp, Heterodera glycines
  misc_feature (585)..(585): n is a, c, g, or t
  misc_feature (7038)..(7038): n is a, c, g, or t
taaattaaattacattttatttttctctcagaacccccctaccaaggggacgcggagcgggctaggtaactagtgaaaacatattttaaaccctaactgcaaaaacattcaaaattttgctgagctaatttttaattttgatcaaaaaagtattttacagaattgatttttttgcaaatattctatcgctgaaatttaaattttcaatcagagcgagtttgagcacataaaaaacatattttgttgtttttcgcatatatttgggggttgaaaaaatttggattattgaacgggatgtttttgaattttattttttttcattattaaataatcgcttattcttatccaagataaggtcaatagtagttattgtacgtatttcatcgcagggtgtgaaacagggatgggccaaattgaaaaataaaaagcgaaatgcgaaaagcgaaatttgcgaaactgaaaaatgcgaaatgaaaaaaaagcgaaatgcgaaaagccaaaatatgcgaaatgaaaaaaaaagcgaaatgcgaaaagccaaatttttttcaaaaaattttacgaatagtcaaaatcatacatttntgagttgtgatgcaaaaacaacaaaatctctgcattttccggagtcaatctttttctcagatcattaattattaatcctgcagcgctaaataggcgctcactttctgcagatgtcgccggcgcggaaagaaaacgatgcgcaagacatgtaagaaggggccattttacagcattgtcccccgttcagtacccgtatgggtcagagtcgattgggaatttttttgtcatgcaaataatcattgacttcaacctttaattaaaaacaaatagattttgaaaatttaataattatgacttccgctttttggcggttgttcagtgtttctggactaggtaacggttgcgcagtaatgtctaatccgcattctgtggcaatattttgttcacatcgggagaaaagatcatggaattcacttgagccttgtgattgaatttgatcagtctcgcacacttcagttataattaaatcctgaaaactattaaaatataaaaaatttttatacaaagcaccttaatgttttggacatttctgcttcatttgtaagccaaattttatatcgatcatgcttttctgcattcaaaaaagaaagtttgaaacgagggtccaaaattgtcgacagaacaagctctctgctttcatcccacgaaaatcttttaacgtttccactggcatcaatttttgcatccattcgatgcttaagcccatcggtaattgccttttttacatgtttcaaatcgccttcttcttcaagtgcaaagcaaatcactctgaacaaaggaatcattgcagaaattggcgttccacgtttttgtaagtcattagttgccgaatgaatttgagaaagaatctgtaagaacaattttatcaaattaaactaggtatttgctacttttctcaatgccgaaataaccgtccattcgttggacgaaaaccgtggcaaatcagtgtcttgggcacataacaaatttgttgcctgtcgattaaccaaaaaacgatcgatcatttgaaaggttgatgaccatcgaacctgaaaaatacaatttttgatatatataattcattcagcacttcagtgtccttagttaatgataatttcggcaattccagaagtttttgtaaattctcaaattgttctttctgtacaggcgattttttaagctttctgacaaattttttaatccgttcaagaaggctttttgtcgattcgtcatcattcaactttcgaacaccgtcccaaatggcctgaatacataatttaaggttacataatgcataaactatatttaaccaaattgcatttgtgcgcaaagcaatcgattgattttaagccaaggtcggtacaaactttgaccatcacctctgcagcatcccgtaaaacgacaaaattttttgacttttctaatgaaaattcaacaaaaactttcattaataaatcctttaagacagtagcgttatgccgtcctaaaatttaataatttaatagaatatgatgacatttgttaacctttaattggcttagcagccaagacaacgaattttagttggccctcgtaaatgaagtgacaggtaactgaaagaagagagtgcgctgcatctttagaactccaacaagtggctgcaggtccactgcgatcattcccattattttggtgtttatgattgaagttttttcgccatctttttcccatgggcctaaaatcattatcaataaaaacaaaaacctaaatggaataactttttgcttgtaatgagtgcagtataatcaatttaatgtgctttggaggccaggggtgccattttgccctggaaacccggcatttgccgggttttgggggtccgtgccgggtttttgccgggtttttgaaattgccgggtttttgccgggtttttgggttttttgccgggtttcctgtgtccactcatttatttgaattttattaaacatttcgccaaaattaagaagcaaatatagtttttgttaattgttcaggtttattttattcatttttgatcatcattttctagtgcgcagaatgtcccaaaaatctatttctgatttcatttccaaagttacatttcaacaatcatcttcaactcaaatttccagcgctgaggaagcaatttcagatttagccgtttctgtctcgagtgatgaatttggggtgatttcaacaaattgactttttacatagcaaagttcagatcacctctccaaaaaggaagaaatattcgcacaaaaagcctggaggaggaatatcaaattatgattctaaatatacagagaaattcaaggcagattccatccaaaaaagcaacaaaggaaatgacaaatttttttgcaaagcctgtgatcaaaattacaaaatacacaaaatgggcgaaaaaataatcacggaccagatcaaaaccaccaaacaccaaaaaaatttgtctgaacttaacagaagcgtgcctttgaccgattttgtcaagcaaaaatcggtagttcattttgggactcagtaattaatctaattcaatataattaaggctactgaagagaaacgttgtctcgccgcagaattaacactggcttaccattgtgcgcgtcacaatttttcaaaggaattcgaaaacagtttattaggtttgggtgaaatggtcgtctatagggcaaatggtgtagtacaaatggtcgccagatagggggagacttgggggtaggccatttgagcaccaacaggcgctcaaatggccggctgagcgctggtactgaaatgtcccggcgctcagatggccccagttacctgaccttacactacttataaattaagagtaaaaaatcaaagtaaaatttattttaaaaaatggtaacaaaattttatttttatcattttatggtcggtcgatggttcattcatttttttgaaaattgaaatatttaaaataaagtcaaacttttgatgaaataatataataaaaaaaaacattgatttatattctgtattactccaatttaaaaataacaaaaatgcatgaaaatataaaaatttggattaaattatagctaaataatattgaaataatgaatacataatttatcatcatatcagtaatttgataattgaaatgatgtttgattaaaaataaaaatttcattcacatttaaaaggttaataataatttcgttttgatacaattaattaattcagatagattaatcctacaaatgaataactccataaaagtagaacttctaaaaatatactaaaataaaaatatgcgtaaaattatattatatagcaatcggacccgacataattccccgcagccatcataagccatgaaatatttttatttaaattacaattgaaatgaaattaataattaattctaacaaaaataataatttaagacaattattaattttattatattatagataaaggacctgatttgctaaacaactagcgaataattatcacattaaataattgaataagaccatttaatttaattaaaaaaaaccaatgttttttgttattgaattaaaaatatattatgatgcagaaattggtaaacaatacaattagcccatttatataaattaaaaaatcaaaattaaaacagaatttattaaagatcaaaggacctaaattgctgcgggaaaatttttgagtattttaatgctattttgttaagaacattgcttaaaatttcaaaaaatttactgaattttttactttttgggtttcggggggggggggctttgtcccccgcagcccctggcgatttgtgtgtgtttttagtcactaaaagacgcggccctaatataatccaaaaattaaagagccaaaatgatttttaaaaataaaaataacagattttattttattttttggaattttctattacttggacatttgcttatttgataaacgcatcaagacgaatttatgatttttgttccccaatatttgttcccattctctttattaataaatataaatatttgttaatttcgactaaatttttcttcggatcgaatataatctaataaatttacataactaatacataatacagcattagaacatattctacaaatacaaggaaattaatatgaaaaatatttcattatttgtacatctattccaatcgttggtataatggttgggagcactcaagaaaatccgaaaaatgagaaaagcaaaccttcaaacaaaaaattattatatgatataattttaaattatatatttgtgaagttcgagaattgtttgatgcataaaatgataatttttataattatgcctaattgtgggtgccatataaatttaaaaattttaattcaggtcccggaaacaactcaaagaaattctgtgtgatacgctgtgtaattatattataaaaaaataaaagttgtgggccaataaatcaatcacaacgaattcaaaaaatgtcaaataaataatataaaaattacgttttttttggaaacaagaactcattgagttttctcatgttttaaatcaaaattttttaatcaaaataaattgcttaatacatttaaaataaaaacatgttgaatttaatgcattatttaaatgtaaaattaaattatttcggaatcataaaaacggatatgccacgaaagaaaattttaaatttacataggtttgaatttggtgtattgaactgcaaaatgatttttgagtaaaaaaaaaagtaatgattttgagtaatataaaaataagtaattgccgcagctaaggtattaattttgaaaagatttattacaacagcataattattaaattcaaaaataatttttatactatagaaaaaaaaacttttggcgttagttgcaaagagcactattttgaatttttttttaagattctaacataaaagccattcaaaaatttggattttcgactttttgttcgaatttggtttcggggtttgaacaggccaaaataattgtcatattcgtgatcagagacctcgaaagatactataaaataatatttattttaaatataaaaaaaagcaaaagaattaaatcaaaaaatgacaacaaaatataataaaattacaatgaaatgacttaagatttaaacaaaattaatgaaatatttgtaactaatttaaatggacttgcatttttggtagtcttgacttcaatcaaatcattgaagaccaccaccttactcatcagtgacccgttttttcttaatactttattggttacagtaactgctttatcataagaagcaaataaaaaataaatagcttaaatacaattaacaaataatattactaatcctattgtcaacaataattgatatttaaactaatttacaaataatattaatgttttaaaaaaaacaaataacgccgaaaaagagcttaaactcaaaggcaaaaaataaacagtcaaaaaacaacagtacacacaatcgaaccatggacatgatctgtttaaatttattcttataacaatttttttaataaatctagtgcaaagaataaaatgtgaatcattgtgaaaaaataaaaaattgaaataatttattaatataatattatttgaataaacaataattattaaattatatataatctttagaacaataatattatttatttatgaaaaatagaaagaaagcatttcatttttacagtgtattaatacaatacacttatgcttaaattaatattcttatttttgttataatatggattcatttttttgaatgggattgaaacttttgataaatatctaaaaatcaagtttaattggcaaagctttatattaacaaaaataacttatattatgtaaattaaacataattacagtaataaattgcaagattaattataaaattattatatttttaaaattttgactaaaagatgaaaatttaaacataattcaaaataacaaaataatactattaatatactcatatttatacgaaaattattattaggatcaaatatttaatgaaaaaatataaattttaatatagcctaaaagtacattagttgttgtagaattagggaaagcagctgtaccacaagatctggaacaaatgctggaacaaaagctggaacaagagctggaacaagagttaaaaaaagttctggagcagggaatatttaaaattgtaaatgtatagctgcaaatttatttccataacactataaatgcaaaattcataatcaagtataaaagtaaagaataaaattgaagaacattttgaaaaacaaaagcaaaaaagatgcaaattaattaataataattgaaaaaatgcttgtataaaattattaagcattcattttttacttattccaatttttacctacgtaataaaatattcgagatttcgaaaaaatcaattattttcgaaatgaaaagaaataattttctgaaagtaactttttatataaaagattacaagtaaatntaattagaataatatttttaatttcggtgcataatccaataattttcttcaaatttacacatttgataggatgaagtttgcatacaaaaaaaatttttttttgcttttatggatttaaatttttaaattattcatattttatataatgaatttttaagcatagtttaattcatttttagtcaactgtattttgtttgaataatttatttttagtttcaataatataataaatatataattttttaatattttatataatttttaacttttatgcatttttagcggaaattcattagatatcattaaaactttattttcgtgagtcgatgatgcaagtttc

SEQ ID NO: 6821 - DNA, 2159 bp, Heterodera glycines
cccccccccctctcccaattaaccgctctttttttctatctaaatttgcatttgcaatgaacgattgtggaattcttaattgtaaaaaatagcttatgttggcggaataaataaatacattgggaccaattcaaataacgaatataaattaaacattccaataaaaaaaaaattttttttaaataaaaattaacacctgtaagataaaaaatttcatgctcaaaattcatatttaaataattatttgacaattatttttttcaataaataaaatttattttttgatttaacaatgagtcaacagacactgatgattaaaatactttttcgcttttagtctcaaaaatttaactcaagtgaacaaattgataattttgatattattaggtacccgtagtattctcgtagccggcaaaatttcaaaaactcggttaactatcaaagaatttacagcccaaacaaatatttaattaatgaacacatttgataattttgtagtaatgaccgagcaccactaaaagcatgcattcctgagaacagtaaaaaaattcttaaaaaataaaaatgaaacaagaaaaactcatttatttaaaaaatttatataaaaaggttgaagatttacaatttgtttttaaggcacttaaaatagcaagagttaaaaatcacaaaatttgtttcatatgttaagccgctcattaattcattctccgtcaatgctgcttaaatattccgccaaattaattgtgacaaaatgcttatacgataattatattaacatcgatagagcaatttttgttaatgaaaatcgcagacattgccgttaactcactggtaaatcttataatatcttgagcattgactgtttattttccgaaaattgtaaattaaaattcataattttttttaatatgttttgttttctatgcttttacgcttagctcaaaaaataatatttgaggagctggcatggctaaacaaagcctgatttcaaattaatctttaattaaattctctctgttttggttaaaaattgtattccttgtttaattattattttgttgtagtctctttaactaatcattcagtaattactaattctcttcccccctgatgccatttctcgaatacatttgaaggcacacggacaacaatattagcatcctctttgccgcctcgtatttgcatggtcaatgcctctttgttggcactgatgggtgccggtcaacaaaaggtccgaaattggatgctcatcggcacaatgactctaaaaaattttaaataaatcatattttatttctgttaattttaaatttatgaagggcaatgactattctgtaaagaagaaaaagacgaagaaaaaaacttggaaaaacaaacagtcatttgaatttggatcgagctggaaacttctttttttaatccattaatctatatgtccaattattgatctattattagtaccgaaaacaattttgagcattttatttttgaggaattcaattatttaggtaattatgattaaattgccccaccgcgaaccattgaaaacggccatcctttgtgcgaaagtaaagtcttttccatgtctcatctgttccgttcacgtgctcattgaataactgagaatttgcaatggaaaatttaaaaaagttttatttttatttaaaaatttcatttatttttgaaactaagcaaaaaataaataattatttttgcaatttcagaaaaatgtaagcaatattaaaattgcaatttccctccacacctccaaatgcccttccattggcttgaaacgccgattttccactaatgggttccattcgacctgaaaattgacattaatgaatttacatgttaataccaaagattttcgaattatgaattgcttgtgaataaaaattataaatttaatttaaaaaatttaaaaaaattatagcaaaaagaaaaaaaaagttaaaaatatttaacacattaagctaaaaacaatatatcgaccttaaacagttggctggcaagccaatgaattggccgatcatcgaccaaagaaccatttgggatggtaccatccgacaaatgttaggatgaactattttccattcaaaaacaaaacaatctatgaaagatgcctaatatcccttaaaaaaattaatattggatta

SEQ ID NO: 6822 - DNA, 1566 bp, Heterodera glycines
atttaatgaatctaaaattgactattttttattcattctgaaaaataaaacgaattttttcgaattttacattctttttttgtgcctatttcgacattttgggggtttttcaggactttcggaaaaatacttaacaaaaatggaataaaagtgagaatctccctttttagaaaatataaccccctaagaaatgaaaaatttaatgcctatttacgattttttctgcctttttttttgtgcctatttcatgatttttttatcctaatatggaagcaatacaaattacattcgccgctcagaaaatttgtaagatcgttatatctgtctgtacctatataaatgattctttttttattttgttcgtcatagagatttttttaactatatatttaaattatataattatttcattgttatgaatgtttagtgtaattgtagcacgacacaatgtgccgctgggttccaatgcccagttcggattcccatcgttctgcttggcaatcgaccatttgcacaaatttctttttttgccaaaaaaataattaggcaaatattccagagcttaattgaaaaccgattaaaatagaattgtgtatttgattaattagcgaaaataaattccccaacattcttgaaaggttttaataaatttaaaaaaataaatgataaggaaaagatcagaaattacgtatttgttaatgaattttcgaaatcaaccagctgtcaccacatttacagttgaatatagccttctctacctaaaaacattttaaatttgcttactttaccaatgtttgtttttgttgcacctctttactgtaggatacagttttagccgcaaagtcttgcatcagaccacagtcacctgtcacattactgtacacaattttcatagcaaaatttccactttcgcttctgaaaagccttttagttcattatctaattagtaaatatcaagatagaagcgagcttaaattacaaaaatgtcggaatttcattgcttaaaaaattaattgggtgaaattattgatattattctatttaattttgctacaaaaggcttcggtattcccaatgttttttaatcggaattccgttcttagatcaatcaaaatggatcccaaccctagtacaatacattggctgaatcacatgctggccaaatgaggacagtttgatttgaagaaatgtttcaagtaggcccagcttaaaaaattcaattagcgattataaaaaaatggcgctactgaaaagaaggagtccctttgaattttattaaatttaaaaatcaaatgggagcaaatgaatcattttgtcgaaactggccagttgcgtctgagcctgtttagaccaccataacttttttctttgttgaccaaatccaacaatgttggtatcattcgaaagctcttaacaagctctatcggctttcccaaaaatcacaaagatataccgacaaatataaaagttataaattaaaatatgcaaaaattctgactttttggtagtgttcatgttgcaacttttttataagttggtcaatcgcttagcaatattttatcaaaa

SEQ ID NO: 6823 - DNA, 1829 bp, Heterodera glycines
ttttgtttgcataattttttttaagatgatggctagtcgagtagacttattcccggtgggttttcgtgatcggtgatcacgaatcatttatcactccgaccaatttcgaattccttaacccaattcgaaacaatagtcgaaattcgaaaaaacgatgaaatctttctatgtcttttatataatttcaattagcgattcgtgatttgtcaaaatttatgtcagtttcgcaataagttagttagtacttacattgactcaattttgggctcccagtcaaaaagtaaatgtatgtgtgacgacgtcgtttttgtaagatagtaaagggacaaatggcggaggttcgcgtcacttgggcaacatgaatatttttttaattaatttttgttcaaaaaaattaaaaaataaaatttttggaaattttttttgaaggtttttgccaaccgaattggacaacaagtcccacctgcctcgccccccccccccctgatttttaataaaattcaaaaggcgccttctttttagtagtgccaaaaaacgacatcaattattttgttgtcacctttgtcaccaatgagatgtaatcagcttgtacagtatgctcgttgtacggttggttagtcacggcagtaacagaagcgctcgtgcaacccatttttgttgaaacaattagtgatggtgccaatgttgtggtatttgaagcggagttcatcgcaacaagttccttattacttagaatttttgtaaattctatagtatttgaaaaataattttaaaatatttgcgatgccaataggcgtcgctaggaaaaaataggaatttttaacgagattttttgtatgtaaaattttgaacatcaagatttagacaaatcttaaaagtttagggcatttatttgcagtttcttagattgcctatctcaaatgcaggacaaatctgaaaaacctgaacacttggcatcccttttattttaaaagaaatgttgaacgattttttaaataattcgattttggccaaaatttttgtttttaccattgtttcgttaaataaatgttgctcatctttgtcaaagtggtgttgttcactttcttttcgagccgatgcgctaaatttttgtttcaaataaattaatttactggaacggggataacgcaaatttatgttgagaattggaagggtggttttttttttggtatttgcggcttataatgtccactaccgtctgtcaaaaattttataaaatttaattagtggtttcatgttgctgatcacgttggcaaaatctcattaaattcgtccgtattccggcgaattgatgatcatcagatgacatgaggtgaaatgttaaatcgtgattagcgacccttggaaaccgaaaaatcgaaaatttttgaagggttagcttaatctgggagcatttttttaaatcaattatttcaatggatcgaaactattcaatatgacttttattttaaatcagaaaataattacaataattttcctcgctgtattggcacatctgctggcaatggaaaagttgaaattggtggtaccaattgtgatgattgacaggcaaaaatggttgactgttaaaatataaataattggaaattgatattaattatatatttttaaatactttttacccataaagtgaaaatcgttgcaataaaaattatttgaataacgaacatttttaattttttttcttaaataatttttgacgccaaattatgtaatttatcaatagtttaaataacattttttggcttcatagaatccaaaaataggaatgaaaaagtctcctccttttccgggacaataacatattg

SEQ ID NO: 6824 - DNA, 2873 bp, Heterodera glycines
  misc_feature (1075)..(1075): n is a, c, g, or t
  misc_feature (1170)..(1170): n is a, c, g, or t
  misc_feature (1209)..(1209): n is a, c, g, or t
tccgccgatctgtcatgaaaagtgaatagctgtaataaaatgctttattatacgaacttttgtatgcgaatttttttattttttataaatttattatgtaattgtatagctaatgaattgaataaaaatatttgatctttcgagattttccgagcattaatttttgaatgatttattcacgtgttaaataaaaattttatatttttaattaattcaattaattccttttgttggaaatttaatttaatctaaaatcatatatctactctttatggagcttaaaataagcaatataaagtaaaacacaaaacaaaataataagatatgaaattttatttaaaattttttgaaaatttaattgattgcattaaaattattgtgtcggattttttttattttaatgaattaaaaatgatttaattagcttaattatttttctttcaggtgtaacataaatattatattcaaatctaaaataaaataaactaaaattaatggtggttatttaatttgatttaattctttttgttaacatttattaaatgaaaactgctttatattaatgtggtgctaaattagtagcttaaccataaaaccaattaattatgtaacacagtgttttattcaaaattaaatcacaacaaatttaaatatgtattttaaaatgtgtattttcaattgttcaacccgttttgaacagttgtgtttggcattaattatcctgaatttattggttttcaaattttacatttcattttctttctcctcctcctgtgcattttgctgctcctcctttattaaaaaaacagataaaatattattaattttacacattaaatgagacataattatgtaatttactatcctgtcttccatttaaccactatattatatcctgagggtattggacttgtgctgggattttctcgaaaatctttggttataacttttttggagatgaatttttgagaaatatttcatttcttacaaattaggggtgtatttttcgtttttattgcatttttgttaataattttggacaaaacaccaagagttgaaaatattttttttctanatttttttttagctgctccacaaaacattgtatagggcatgggatacggtattcctagtctcttgtttcttgaacagttccactacagtatccgnaaaacgttgttcagcttcacagcaaattcctacctcgtncacatgttcagtatttctcttttgcgctttgcgttttcagctcaccgtagctgacattgtaataatcttttttggcatcaagcttcagatatgcatatctgaaaaaacgacaaaattaaaaaaataatttcttaaaattttctaaattttcacttactcatcgctgacattttccaactgaagcgcaagttgttgccgaatttgtgcaaaatcttgtcgcattcgtgggtcaccagtccaacatgagcacatcacacgataacttaaatatatatatatatatatatatatatattcacaaactttttagagacatgaataggaccgtgggcgggttttaccaagacttttacagatgaacctgatccggatatatttcaaaaatgcacccggatcaggaatttttcttgaaacccattcattgatcatgaattcttaaaaaaaatttataaaactcagcaattttcaaaaaattttgttttcttgagttttttaaaaaattttcgaagatttttctcttgaaaatttctatgtttgaattttttttaaagaactacggtaggggggggggggttgggaacagaccaccttgaacattttcaatattcttttttttgaaaattatactagtcatcgggacaattgtctggctgtatcatccgttttccagactccaaatacagtagcatttcatcaggttgcatcccggggtacggtgtgccgcccaatgtaatgatttcgaacatcagaacgccaaaagaccagctgaaatggtaaacaaacattgaaaaaaagaattaattccttcttgcaattgacgagatattgaagaagcatttaaaaatcttaaagtgtcttttcgaaaattatttaaaaaaattaatttttaatttagaaaaccctaaaaatgataattatttcaaaaatatttaaaaataaattaattttctcttttagcaaaaaaaaaattgtgaaaaattatagaattttttaagtgagagtgaattgcttcgccgtgctcgaacattcattagtcagttatggcgttagtcaaaaaccatcaaagggaatttttttttcataacttctttcaaaagtaaccaaatttttaattttagatcattcgatagcctatctttttcaattagcctgcaaaatttcaaaaagattcgttaaatttgaagaatgttatgaccaaaaatgctcaaaaaaacttggtttttgttttttgtcaaaaatttttcatttgatggttttgactaaagtcccagcaccgggcattctctcttcaaatgcttacacgtcagaactggtggtaaactcgtaatgccgtattgcctcgggtgccatcctgaaaatatgacaaataatttataatataatttaaataatttatgaaaattaccatttaattggcaaacgccctcctcggctcttataattggagctgtccgcataaatgaaacggcacagaccaaaatcgccaattttagcataagttttgtcctggacaagaatgttacgagcagccacatcccgatgaacaaatcccttttggctcagatattccttaaatttaagcatgtttaaaagagtggaaaaaatttaaaacttcatggtaaataaatgaaaaatagtgaaagaaaattgtgcttaaattatgc

SEQ ID NO: 6825 - DNA, 3950 bp, Heterodera glycines
taaaaaggaatcaaaatcattgaaaaaaattcaaattatttaaaatagtgttacttgagattaagccaaatcttctcttccattcataaattgtgctatacaaaacgccaatttttcccgctattttcttttcaattttccaattcgttggtaaattaaatttttgtgaaaatgcctttttcacgcttttaaattgtttaattttttcaatttgctgactttttgtaaatttcttgattaaaccttaaagggaagaacggggggcggaagtttgggcaccgggaagtttgggcaccaggaagtttgggcaccagaaatttgggcaccgggaagtttgggcactaaatttaggatttaaaaaataaaattatttttaattgtctataaattgcaaccatctaatttaaaagcatagtaaatttaatcaagttacgaatagaaagtttttttaacgaatattcactcgattaagcatgcttattttgctaaactgattaccattcattctataaaatgccttacatatatatgtattatttgtatcattacaaggctcagtatgttcaagatttaaaatttataaatttaaatagtattagacgggtctcttgtcatttcgggcccaactaagacggtattcagggtctaagtccataaccagtacatgtttaattctacgtttaaacaaccgtaagaattgactaaataataagaatgccaggtttccatataaaaactttttaattttcaagaacatagaaatttttgagcacaagggttgttaaatttactaaattttaatgatttatataacattttatatatttatattgttttatttttttgaaatccctccctctggtgcccaaacttcccggtgcccaaatttctggtgcccaaacttcctggtgcccaaacttcccggtgcccaaacttcatgtcgccatttttattatatattgtgccttatttaagagttttatttcattctgtacattcgtttttgtttttattccaaaaattatattttttgctttttattataattattaaagtgaatattttattttataagtgattttgttaatttgttgtttgtgactgattttttaataataagaaaacggaactgcttaatttgaattgaagagttttggtgcttttggtcattatttcgcttatattttttaatttatgatttattattattattattattatttcgatttataataaacacaagcttattatgaaaattttgactaaaaccaatagtatcaaatccctcttgttcatatcttaaaattttaaagtcttttttaaagtattccttaaacaattggaataaagattttaatgaagaaataatcttttattataaagtaaaaatgatgttataaaaacgtatttccagagaagtttgaaataaatattgtctttattataaataaatttaacagctttctaaattttgattattattttcttttgaaataaattaagttgatcaaaatctgtttaccataaacattcaatagtgaaaatttattattatcttaaattgttttttaaaaatattggcagtgtctaatcaaatgttgatacataacaccgtgttgacattgcatcatattttataattagagcgttttaataattttcagttggccattttttaacaaaattcattaaaaattcttaaaattttcctccggcaccgccgaccccccaaaaagctatcctaaattttgctgatttattgataattcaattttataatgtttttcaataaggaaatttttaaacctaaaattttttatcaagaaaaaaatgaattttggcgttcaattcataaaggtatattctctgaatttttttagatcatttcttaggggtgtatttttccgatttttttgaatttttaatggaatttttcgggaaaaaacgccaaaaaaggcaccaaatcgctaaaactaatctttgtggttttttagaatcaaggagcaaacacatgttttttggctgccttttctatcattttccaaacctttagtacaccattcaatagagtttcaatagctctacaattttactcagaggtgatctttcgctttttctattgataaaaatggtttttgttttttttgggaaaagattaaaaaattcaaaaaaaccgaaaccgaaacggtataccgaaaatttttcttcggttttttcggttttttaaccgaaaccgttcgaccgagaattttttgagtttttcggtttttttcagtttcggtttttttcggtttttaactgaaaccgttcgaccgacccacttgtcaggtctcaaattttaattaattataaaaaaaattcccaaacaagttttatgaagcttaactgaatttgatatattttttatgatatgttacaacagaatatttttaggatttcaaattttcccattctttgtagttagtaaattttgcttctcttaagctgcacttttttatcttgggaaagtattatgcttctcacccagacccctattcttgccagagcttatttagtcccgccgggaccgggactggcaaaaccgggactgggatttctgtttttccaaaaaccgggatcgggaccgggacctgaaaaaaccgggatttgccgccccggtcccggtcccgctcaactctagttgaattggttggatggtgggcgtccctactgcgcgttgctttggaaaggcgtaacatgcagcaaagaaataaaattagacaagtggataaagatagaaattaaagaaatagtgagataatgagagacataagatagcgacagaaagatgagagaaagagggcgttagagtttatgatgtacatattatggtgctatgtcgttattttctgcatatgatccatattttataaatataattaaaaattaataaaaattaaaaattcaaataaaaatttaaaaaatgaaataattgaaaagatcctttcgtacatttaaaaaaaacaataatacatgtgccacatcttttaaaaattgtgttatgctaaacaaactttcattttcagtttttaggttattatagttattcgatggtttactttatgtgctccatccattcatttactattaatatttaataaaatttttaaagttatagatttttaacattcctttataatattttaatttttgtcagaatttatttgacttctattccttaattaaccatttataaaatatttaattatttagattttagaaatttttgaaaataataaataattaagtaaaaatcttatttttttttgtaaacatctgttagaaatcgagcttaaatttcaaaattcgccaggcggcctatcggcaccgccggccccccaaaaacctattttttcttaaaaaattagccaaaaatctctaaaatttggtaattctttagacaaaatctgtgtaatttatgccaaaaggaattgaattgaggcgatacattgactaaaggaatgtggagccatcacatcattcataaaaaattaattttttgtaaaattttttggagttaattcaaatcaaacccccgcccccgcgggggcggaattatcgtgcccccgtccccgcccccgcgactctgacccccgccatcccccgcccccgtgaaaagccacccccgcccacggggtccgaaccctagaaaaaacagataatttctttataccaacttaaatcattattaaaggatgcaacattattattagatttttcattcaattttttgtgttaatttgtaatatttttgttaataagtgtttttttttgtttttcattttttaatcatatttgccctcgtcaaacttcgtaggctttgcgcttgttttatgattataattatatattttaaaagaatgctcttttacctaattgataacttattatttttgacctttcaatgacct

SEQ ID NO: 6826 - DNA, 2460 bp, Heterodera glycines
attcaatatattttaagtatactgattgaaaatctatagaaacttaattaatttatccaattaaaatttatgtaatttatcttacttatagtatttttaatttatgtttcataatcttttttggtaacgcatcctaaggcattttctttatttgtcaacccgaaagagcatcccgaattttcactttgtcatcccgaggacattttttatattaataatttgttatttttgacttcatttattgggggattttgtttttctctgtttttcttttttgtgaatttttaccgcctccgcaggttttttttattgcctaggcactgatggccatcatttccaagcttttaccccactcccttttcctctgtgattgtcccgctttcgcccaggccaaatgaatcgtggttgccaaattctctaacaatccgccgccggtgcttccagaaacacagcggtaggtgaacgcgctgaattagggctaagaacttccttaaatctttacctaaggtaacaaaataatattacaaataaatacaactaaataaagttacataatcatgattaattgaagtggaaaggaaaagtcagattataaattaattcattattcagtaaaaatacttcactgagttaataaaacataagattaaaaaattgctataataatttaattaaggggtgattaaaccataaaactaataaaatgatgaggctgagatgataaccaaaataacaataaatgtttttaatttttatttctaacgttaaccttacaaaagaaaaagttgatttatgctattcaatacagtgattcgaaaacataagtttgaccttacggaaattttttttttgttatttataactaaaaactcgaaaattataattattctccgtaataaatgacagattatctgacaaaaagtgcaagatttaaccgaattatttgcaagttgtcattaaaaagaatgcaataattttaaaactaaacacataaatttttttattatatattgaatattttaaattaaatataatagtttataaaacaaatcactagaacaaagaaaaattattgaatgatttatcaaaaaagtttaatgaatataattttatcatatttaataaatggtaaatatttgaatttcatctccccgaaatggattgccgttaacaattgcactttttcgtcgacgaaaatccaacagtaatattacatacatatatttagataaaattttacataaaattatttaaaattgttattttataatttcataaatacattttttgcaagtagcgtccatttttatataaattaatgagaattagtaaaaaaaaatgaagacatttgcgaatgaatagtcattttaatttcaatttaactattataactcaataaataatgaagatagaaatataacaatataaaggctaatgggttcttataattgaatgaaatgctttaaacaacatttccaataagcaattaattatttctataaaatcaaaaagtcaagacgtgacaagatatttttatcattttacctagaaagtatatttttattagaatatttttgacttaaaataattaatcaaaaatggggcgatcgatagaaaatattgggttgatgaaaaattgctaccccaaaatcagaacattcttataaataagaacaaatggaggccccaagtttaaaggccagcttgactcactcttactggcgctaacgaaatcagatgattaaagtgaaataaaataacaaacaactatatttttcattgaattcaagaattaaaccttaaaatatatttctaattgaaattataaataatagtcactttaaaataactaattaaaatgcataattttaaagaaacgcattaaatttcgaactgtgaaaatgaaatgtcatggagtataattactaattagattgcccttgcaattttattcaaaggaaaaatctgctgtacaaatatctgtccgcaagaaaataaacggataaattttaaaaatgagacttagaacatgcttcaaattagaaaagtataatgaattattaattaaaaaataaaattggatattactttttaaaataaaatgaaaaaatttctatccgtccaatgatgagccatagtaaacaatgagaatttttaaatttaaattaacctttttattattaaatacaaatgtgatagaattgttttcaacaacttttattcttaataaaatttaaatttttacttttttaaaatttaatttaatacgagattaaagtaaaatacttcctttatatagtttaaaattagggttttgaagaagtcattatattagctgctttttaaattttttgagtaggattgttacgagaatcaagtcctggagtgcgttctggacttcaccaagctcaatcgacttaataattgtttgtaattttttattccttcgtttattaataa

SEQ ID NO: 6827 - DNA, 2393 bp, Heterodera glycines
cgcccgtctcagggttgatcaccgaagcgcccaaatattctggccctgttcgacctgtgcccaaaattattttgcaaatttaaacccaaaaataccgccaaagaaggcgtcgtggaagtcaattggtccggagtccgggcagttgtcgaagtacgccttcatggctgggttgtcctccagcattgcgttcaggtggcactcccagatgatttccacctcgaactcccgcgcaatgtcccgggttcgcttggcatcacgggccctgagggctccggccgtttctcctccgcccacaattgccgcatcgtcgggaaagcagcttgggcatccatgccaatagcaccttttgaatgggtaaattggcacatttttcgaattctttccttacccattgacctcgatggccaagtttttgtcttcatcagggcgctccatcatcccgtccaagctgtagttgccgaatttgaactcccctccagggctttcgacatggcgcaggactcggccattctcccgcaattcttcttcggcacgccactgagagtcgacaaaatgtaaaattaaaataatttggatacaccttcaaatatttcctggcgatggagctctgtttgccgcgcttctcgtatcccaagtgtgggatgatggcgacgcgctctttgtcgtggtgagccaactgcacccaatacttcatgcagccggacgggatggtgaccgaatccgtgatgtcatgccgagtctcggacaagaacagctgccgcatctttaccataccatgcgccaggatttgaacatcttcaaaattattattaaaaatttttcttctttttataattttttacccgtcttgcagtagtccgcaatgacctcgctcagctcaaacccagtttcccggttctcgtcgtaccattgttcaaactttgcgcgctctgccggaaagagtccacctgggtaatagtcctccatcggcggaagagtgtccaatacagtgccgtaattttcagcctgtaattttattaatttttattaatttttcaataaaccacccttaccttattgaatttgtgtggaaaatatttcttgttttccacgccctcaatttccagaccaaacgtcttgacaaagttggccagtttgattgggatcagtttgtagctgaagtgatcaaaaattttaaaaatatttaatattcaaaatatttacctgtcccggaaaacggtggttgtgtagactcctgttttgcgggccttcatttccaggagatggttcccctggcggatgagttcagggcggacacccatgcgcagcatttcaccataaatcagcacatgatcgtagcgggaacctttaaattttatttattccaagttttttttaaaataattaccggcgtgggcgtacgcgtatgttgtcaccgactccggcttctccccggcttcttcgtaccccagcatccagttgttctcggcgtcctcatctacggcatcctcttcttcttcgcattccatagcctcgccgtcggtgttttcggcattcttcctctttctgcgcttcttcgctccgggctccatgccgaggacttccgtttcgaagttcagcaaccacttggtgaaggctgccagtgggtcttcgacgaccttgcggcattccacgtccgtgtgccagaattcgaacggggaccaggcataagttcggaatcggccacaaagcgcgcaggccatctccaattcctggtcccatatgcccttttcaatgcacctggtgcaagtcacgtgggcgaagcagaagttgaccttttaatttttcatatttaattacccactcaaaaaattacctgatgcttgaatcgcatcagttgcgggtccggcttgaagttcgttgtacactcaaagtcaaaaaacacaaaacgcttcaccttcttgactttgggccgataggggatgtagcagtcgcgcggtgcgtgaaatccaaggcagaccttgcagaatttttggccacaaatatgaccatttttcttgtcttggtcctgtgaattctttattttttaatttttaaaaacacgaattaccgccacacggtataatacgccacagtccacacatttctttgagcttttgcagaccgacttttcaattgtcgtgttctcgttcccacgtttgaccgtacattgcatgccgcgaacatgatgatcataacaattttggctttttaatgtcttgaaaagaaaattcaaaaattatgggtctcataccttattgcaggataaacacgacacaaagaagccattttcctcaacacaatttcccctaaaattgcgccccactcgttgcaaatgccaaaagtgcgcaggaatgtgcaaaagtgatcaactccgtttcgcttatcgagataca

SEQ ID NO: 6828 - DNA, 4483 bp, Heterodera glycines
gagacagagattgtcgttgtacagaagctcatacgttgcaccatcggcaatacggtagtcgatgttgaagtcgttacgcccttttccagccattttcggtttggcgcacttgctctcgattgccgtgatgtcaattataaatggttcttcaaggagtgatggcctttccttcgctttgttgctttggtcgaccatttcaaaacgcgtcaggattttttctgttgccgagttgtccagctttttaaagtgtacagccacttcgtagtcaaggtgttttgacgtcagaaggaaaatgaagtggtccgcggatattttcattgatttggccccctcggaggcataagaaaggcacatggtgaataaattgcgcagaatgtcctccggaaaaacagcaccaaacgttaggctcatcaaaaattgcccaataaaacggaacgctaaacaccatttaaaaaaaaaaatacctcaatcaatcaaagcacaacaaaaaaatttttttaaatataattttcatagataaattaaataataattttatatgatgtattatttacaaccacacctttaaaacgtcccgcttccgcctgttcggcagagagacatgtaaagccatcgccgttgaacaattccgcctccaattcgcgggtaattgacggctccttctgggccttgcgctcattgttgtccgatggcacaacctgaaaatgtctcccaaaattagaaaagaattttagaaaaacatttcgtaaaaactaaccgagatcggaaggcgtttcataacctcatccaatggcggtgcttcgtccatcaattcggtgccgtcatccccaacaggggaatacggtccgtcgagggtaggggggagggaattgtcggaatattggctcattgttttctttcttaaattaaaaaaaaattcacccattgagtttagttaaaaatgtcaaagaaaatggccgatcaaaaaaaaatcgggcatgacccctctccagggcgatgatttgggccatttttggagagttaaaaacgcgcataggtcaccccctacacgtgtttttaaccttccggcccaagccatcacattggagggcatgcccaccaactatgactatcatagcaagcgattatggaaccgctcatggaactcaaagtgtgtggcactaccatcccaaagtgcaaggattggtctaggcctccctatgttgggtaattactccctccataaggcacttgcgccaacgcccacagcacatatgagttccgtcaacgcgggttttaatccggggtgttgagtttgagcagctgcgcgttcgacactgctcagtgactcgcggtcctccgggccagccagtcccggttattctctcgctgtaccaatgcagcccgtaggcagggcacattagggctaggaaccgccacccccgctgctaggaacaggcacaccttcaccctcaaggccagcgagtgaagggcccccgtccacaccagaccgactatctggctgggcttaaacatcgctgtgacacccggcgggctatgacggaaacatggtttcggtcagtcactgccgcagccctggataccagcggaataagccccgtggacagtgaacgcccgtgcccaccactctgggaagtaacccagtaccggggcaggactcctcggtttaaggatggcccccaggatatttgaaaaggcttaacaaatatcctaaaggggtttagtaccgagtaaaccagcaaaataacaaaatggggtgagaaaggacagtacaaagtacttatgatcaatgaaaatgaataaaaaacaaggggaaaatgaataaaaaaggaaaaaagagtggaaaataaaaatattttaaagagggaaagcaaaaataattaaaatttggaagaaaaaagcggaaaattaatgaaaaataatttttaatttgaaaaaaaactgaacgccaagaatttaattaatttttaaatttcaaaatacagaacggcaagaatttaaataatttttaaatttgaaaaaaacagaatgccaagaatttaaataatttttaaatttgaaaaaacagaacgccaagaatttaaataatttttaaatttaaaaaatagaacgccaataatttaaataaattttaaatttgaaaaaaacagaacgccaagggttgaaatatttttttttttaatttgaaaaaacagaatgccaagatgtgaaaataatttttaaatttgaaaaacagaacgccataatttaattttgaaaaaaacagaatgccaagaatttaaatattttttaaatgagaaaatggggaaaacaaatgcaagaaattggcaagaaataaatagggaaatttggcacaaaaatgtgcaaaaaattggcaagaaataaatagtgaaatttggcacaaaaatgtgtaaaaattggcaaaaagatagggttaaaaattgtggcaaaataatgccaaaaattggcaagaaataaatagggaaatttggcacaaaaatgtgcaaaaatttggtaagaaataaatagggaaatttggcacaaaaatgtgtaaaaattggcaaaataaagggttaaaaatttgggcaaaacaatgccaaaaattggcaagaaataaattgggaaataagggggcaaaacaatgccaaaaaattgcggcaaaatggcacaaaaaactgtaccataataatgccaatctggcacataaataataaatggcaaaaagtaatgggtaaatgggtaaacaaatgccaaagaaggaaaaattaaggcataaataaatgataatggattattgattggcttttccttccgtaaagtgaattaaatgaaatgaaaatgaccaaatggacaaaaaatcaattaataaattgtttattgtctgaaggtgtcaaattacataatgggcatgcgggaaggagggcggcactacaaagtacgcgaccaattaaaaaaattgaattgtttatttggcaccgttccaataaccccgcccccttcataattgatttgtttatttgacccctcctcccgccttctcgccgcccgctctcgccccctgcccccgctggtgacgtcaatttttccctttatgagagcaaattaatgtttattgtccattgccaatgtggccgagtggttagtgcgtcagtctggccgcccccctggggttcggatccgcttggtgcggggaatttttggagaattttaaatgaatttaaattcaacgtctttgacctttaagacgtctaaaataatttaaaattaaataaatttaattaaaataatttgcataaagtcgcgcagtcaaaaaagtcgcgcacccccctgcaataggtttgggtttccaagaaaaagtcgcgcaataggttttggcttcagtactgaaaagtctggcgctcagatggcccgcgatcacttggcggcgctcaaatggctggcgctcagttggcccgcgctcacttggcggcgctcaaatggctggcgctcagttggccatgcacccctcccacgcctatggggggctaccgtaatccggtgaaatctacaagggtaactactaagattaatgaatattttaatactcattttaaattaaattaaattctcttaaaggactttcaatggaaagcataaaaaatgttaaataataaaattaaaaaataacataattaaaaatttaaaaaaagtggtgaatcaatagaatacacagattttttagattacccgcatataaacgatataaaataatccgaaattagttacaataataacattaaaatcaagttatcaagttccaaatagcaatcattgggctaaaactaaatattttaatgaatagtgaatttaaacacattaataaaaaaattaaaaattaagttattaacagcatcattaaatgtggacaaaatattttaattaaaccaaaagcataaaataaaagatttgattttcattctaaacaaggtctaatgttttatgaggaaaaggttaaagtttgagggctataatcatttcaaagatattaaaaagggtgaaaacaccaaaaactctaaaaagaaaaaacattaacccatttcatttcaaaattcaaaggaaaaattaaagagttcgaaaagacttgttaaaatattttttaatatattttttgagtttaataaattttattagaatttaattgaaaagcattaagctcttcggacatttatttttgattattcttctttttattatattaaattaggatttttctttgggtttaattaacttaatttattaaacatttcttgtggttattattttatatttaaaatcccgatcagctttttgccatttatataaaaaatatccgttcctaatcatcaattttctcgttattatttttcgaaattatgaaatcccgtaatcattttccaatgttttgttattttttcgttggtaagaaatacacatcttcatactatgaatttctttgtattagtaa

SEQ ID NO: 6829 - DNA, 2223 bp, Heterodera glycines
  misc_feature (2195)..(2195): n is a, c, g, or t
aacataaataataataataatttgtatgacaaaaaagatcattaataaatgaaaatgaaagtaattagtcttaattggcttacacatgtcattacgttcgtgtggccctcttgcgtgtcaacgattttttggatttccaatgaaatttggttttttcattattatttatgttttgattttacaatttatatatgaaaaaaatttagttgaaaaacatgcacatcagataataattttatgccaaaacagaaaatgtataattaaaataattaatctgaattggcattttacgtctttgcgtttgtgtggccgtctttcgtgtcaacgattttttgtaatttcaatagaattggattttttgatttttttaaaattatattttgttaaggtccacattattaaaaatgagtaatatacagggtgcggatcgaaaattttcaaaatcagaacatcgagcccaaaaaatcagattatggggtcaaaaatcagaatatttcataaaatagcttaaaattgcttgtgtaacaatttaatcaattatagtatcaaattttgtatttttcgcctcctacgatcatttttaacaattttgaggaggaaataagataaaatcgtctcaaaaaatcagattttttaaattttttgcacacttaatgcgtttagctaagcaggaaaaaaaccattttacagtttaaatttctggacccaattttttaatacctctccttacatattttggagtttttctaactattaccaaggtacctatttttatacctaacttgagcatttttgtatctatttaacgtttttcttccataaaattcacaaccctaataataataataataataataaaataataatttgttttgacaaaatagaaaaagaaaaatggaagtaattagtagtcagaatggtcatgttcacgtctttgtttgtgttcgtgtgaccgttttccgtgtcaactatttttttaaatttaaatcaaattgggttctttggtggaatttttaattataatttgttatactcacacaatattaaaaaatggaaattcaattagcgtgcaacaattaatataccatgattatttttaaaaatataaaattatacaaatcaaataataaatattatcattattttgtatttacttagttaataatttacttggacagaatatctgttattaaatttcggcatttaaaaataatggctcccggacatttcgacaatgaccgtttcgccaatgaccgtttcgacaataccttttcgacaatgccgtttcgacaataaaattaaatatatttttttaaataaaattcaaatttctgcaaaattatatggacggtgcggatttgggatcaatataaaaaagtttttatttcgtttttttcaaaatagcattatgagaatggctttagtttgtcaattttcggcgcaaattgcttatttttttaattaaaaattgaaacattgttttacacctaaatagttgataatgaattagaagcttttaccctgaaaaaactattcttgattaaaaaaacaatttttttttgttcgaattcgggtctggagttcggaattgggcaaacccgagttaagatccgttatcagcaccctcaaaaacgcctaaaacggttcataaatttgactattttttcttttcaaacccacttttgaaatttttcaaaaaatatacaatataataaaaaaatttctaaatattttaataggctaaattttttaattcttaaccaagtaaaaggtatttcacaaatgtttttagtatattcgcttcaaaaaattattcaattattttatcaaaatctttttttgtcatttttcattattttagaacatttttgggaaaaggagtgactatttacacgtttttacagcgcgattttttcaaaaacttttgggaacttggagaagggtacagcggtgccgataggcgccgccgagaaaattttgttaacagattttgtccaaaaaattacaaaattttgcgattttgagcaaattttgcaagaaaaatagggattttagggtccggcggtgccgataggcgccgccgggaaatttttataaataacagatgtagaaaacttactagttttttgaaaaaaaaattaaaaaaatttccgacttttcatcaaaaatttcggaagtcgaaattgtgaccccanaaaatgtcggaaaccggaagtctttccg

SEQ ID NO: 6830 - DNA, 5514 bp, Heterodera glycines
ccaaatttatgggggttttatgcttgttaaataattttgtgcggcgttgtgaaggaagtcgatgatccattagatggcattttagcgcaaattgcggcctttatgcctccttactgtttggggtgtgtcagcataatggaaaagtacctaaaaccaaaaagtgcaaaaaaagggagacaaaaaaaacgaaaatattcatcaaaattggttcggattttgccggattaaatttgaaaataaaaaaaaattggagaaaatatttttcttacttttatgataatttggcagtaattcttttttccattttataaatgtttctttacaaatgcccaattctttcacaaattctttctgtttgccttggccatataattctttaaattcaccaaatcgttcaatgaatttgacctttttctgctcataaaaactctttttcatttttttttctttaaatataattcatttttccatttttatattaatttttcaacaaaaaaggctggtttttgggattaataggctcaacaatttgtaaattctgtatttttttaaaataaatttacaatcttttaaattttttgcttttaaatcgctgtttttgtggcaatgttttttcaaaaaacttttttggaacagtgggagggggcggggtccggcggtgccgataggcgcccccgggggggggaaattgaaatttgagtgcgatttgaataccgagctttattaatattaatcctatttacgacaatctttttataaaaagcttagtgaaaaatcgatttaatgctatgaaatacgtgacaattttactgttggcaaagatgtttagagaaaaaagaataataataaaaaaagattaaaaacaaaaagatattaaataaattcatttaatgcattttgattttttattaatattctaactattaagaatgaatttatggcctttaatattcattattttttgtatagcttataaaattgaatccggcaaaatccgaccaaattttgatgaaatattcggcgatgaatgggaaataaatgaaagtgtagaaaacggagaagaaaatgtaatcaaatcaattggtcaaatgcaaaatgatcaaatttttaaaaatgatcaaaatacgaaagaagaaccaaatgatgaacagaaaagacaaatcatccgaaaatatgaagccataaaagaaaagttgaagcaaagaggaaaatttcaacggaaaaaccaaagcaaaattgagacgaaaattggaaaattattaggcgaaagtcgctacaaaatatacaaatggaaaaaagatttgaatttaaataaaaagaaaaacaacaaaatgaaaaagagtttttatgagcataaaaagagggaattcatacaacgatttgaagaatttaaaagtttatatgcccatggcaaacagaaagaatttgcgaaggaattgggcatttgtgaaaggacattttggaaatggaaaaaagaattggcaccaaaataccataaaagtcaaagtaagaattattttagtgaaattaaattgtactttttctttaagaacatcataccaatgaggacaaattgatgaagatgaagcattatttgcaaataaaagaagcaaatccaaaaatgagtgacgaattaattgccaagaaattgggaattggaagtgcaactctgaaaagattgaaaaaggaatgctctcatccaattgatcagtgatttttatttgatcatgattgttgatgaccatgaatagtttcgaaatttacaatatcatttagttgagactctaacctttttttcgtttctttttatgtcatggtaaaaagattgtttttcaaaatgctggttcttacaaatgattaaacgatttgtgaaatcgaattaaaggaaaattattcttaaaattggttttcatttataaataaataaaaccattaaacttagtaatatatactaattctattttggtttatgaaattcctgaaaaaatttggcggaaattctgggcgaaattcttagaagggatgaaaattgaaataatttgacaaaatcgtttaaattattgattataatcactcttattgggtaattaatggaatgacgaaagcaatgatgaaaaaataactcttaattgaaaaaaaaacagaactcacatgtcccccctcttttgatcaattattgaaaatgaaagatgatgaatgatggtaaaattaaattgttcaaaacttcatatttaatatatttttaaaataaatttgtcaattatgtaaataaaacaaaaacatacaagtttttttttataaatctaatattagaaaaattctgggattttgttaattttatttttaggaccacataaatattcaattgaggataaatcaaaaaagatgaagcaatattttgaaattaaagaattaaatccaaaaatcagcaacaaaataattgctgggaaattgaatattcaacgcttagaaaaaggtaaaaagattattcctcaaatttcgatttatttccgagctttactttaaaatggtgtgccaagtcataaatcccccccccctaccattgaggatttatggacactgccattgaagtgccaaatctacacagtggccaaattttgggctccaagtacaattatgctggatttttcgtcatagtggtctgtgagtttgtcacaaaaggggggggggggtctcagttcgagtcccatgcatgctgtaactgtatttgaggttttaaagcaaataatataagtgaaatgataacacagtttttaatgaagctcaaaaattttttaaaaaaaattttatttcctgtaaaaacgaagaaaaccttttatcgaactgtgtctattcaaaatcgaattgctcttctccattgttttcttctcccgtcgatcaccaatttctttttctaaatcaccatcaataaatgacattgataagcgaaatttcgtcagtttcctcttcagattgatcgaactcatcatgctcttccctccgatcactttgtctctgaattattatatataaattttaaaataaaacaagtttaacgcaatcaccccctccaaacatacagacctgcttcatttcatcaattttgcccgtgtcgaggagccaattgttgacaaaatggtgctccaattgctgcaaaatttggtctgcgtccggcatacacttccacagttgctcaagtcggcgccaaactgaatggagcgcctcgtcacgtttaaattcagattaatgggatagaaaacatttttcaccacaaccctgttcatctaaaaggccaagaaatttgtgctcgcgagcgaagggaacaaaatggctcaacaaaagatgtgccttgggcttctttgagagaaacacgcgcattcgctcctgggcagacaaaaaagatttaaaatcgttgacacgctcctctagctcatccaggtcattcggtgacaatggctctgcctaaatttcatatttagtttgagaaagaagaaaaaagggacttttgaaaatttttggattttcccgaggtgcacaagggttctgcaaattgaaaaattttcgaaaatttgttccctcaaccagaaaaatgagaatctgtgcgatatcgtttgccatcatttcttgcataataccaaacatttcacactgtttttttcagtactggaaaacctcccgtgccggtgacaaatgaggcggtcaacgaagtgcggacggcactgatgcgggaatggaatgtcatgcagtggctggccaacccgtacctcaacgcggtgagaacagaggagacaatgcaaaattggcagaaagcaaaatgcgttcccgctcaaaatttttggattttttaaaatgaaaattgcaaattttaaagctgacttaagtataattcaattgctcccattcaggaaaaggaggcgccatatttggagcgttatgggaacatcaacgacgaatggacacagcgaacggtcgaggcgaaacatcgcaaaatgcccaacaaaccgaaaatccggcaaattgcatctggcgaagtggagaagagacgtgccaatgttggcaatttcttacatgcccatcggacggtggaggacgaactgaagaatttggagcgcagaaaccgatgggactgaacaatccatcaattcaatttccttgtcatttcaacaaatcattgttttagctctacttatatttgctggccacataaaatggggttgttcgtttggatttgggtagttttttgacaaacggcggggggatagcgatgattaggagagaaatgcaaaaaaacgggacaagagagaaatagcacatggaaagacagtgaggggaaaagagagggtgtctttttctgtcccgagcaatgaaatgctacgatctcactaatttgaggtcaaaatggatacatttttttatccaaacacaatacaccacatacaatccgcataacatataatacacacgtatgagcgagaaatattaatacataacacatgttcagagaaaaacatcacatatatgatcacaacatcttagtcttctcttctcgcttatgcaaaaatgagcgccagcacatgcagaacgcgtcccaggagcttgtacgggcccagcaaggcgaagcttctgtttcgatccacctaaaataacgaataaatatctcaaaaataaagaaaacgattttcctacccgcaagacaaccgcggctacacaaattgacgcgccgaactttgcactgaaggaaaatcaattaatgctatggtaaagtctaagttgaggagccccaccttgatctgacggaagagacgctgaaggcaccacatttagttgatgcgcatgttcaatcaaatggtcaggacgagacacagtccatgggctttgcggtggtccggttgatgagcgtcgcggcacatgaacattccttgggctttgcggtggtccgtttgaagggaattgcggcacatgaacattccatgggctttgcggtggtccgtttgaagggagttgtggcacatgaacattccatgggctttgcggtggtccgtttgaagggagttgtggcacatgaacattccttgggctttgcggtggtccgtttgaagggaattgcggcacatgaacattccatgggttttgcggtggtccgtttgaagggagttgtggcacatgaacattccttgggctttgcggtggtccggttgaagggaattgcggcacatgaacattccatgggctttgcggtggtccgtttgaagggagttgtggcacatgaacattccatgggctttgcggtggtccgtttgaagggaattgcggcacatgaacattccatgggctttgcggtggtccgtttgaagggaattgcggcacatgaacattccatgggtttcccccccccccccacacctcagaactgctggaatttatccgagtcaaaactcgagactcaaaacattgagcagaaataccccaaaaatagatgaaatattgaaagacgagattcgagtccagaaaatt

SEQ ID NO: 6831 - DNA, 4927 bp, Heterodera glycines
ataataaattctaaaattttacccaggaaatccatgtatttttgtgttttgcctggacctggattttttttcacatttgacctggacctggatttcatgacaaaaacccaggaaatccaggtttcgaaaaatggcctggacctggatccaaaaaaatccaggcctggacccaggtccaggtcgagctctagctaattcttatttaaatttgccctttagctgcaaaatgtgaatgtgagcacaattcggagcatcgaagatgctttggtgccgttgatcaagttcactttccaatttgatcaaaacactccgatcgatttcgacattggcctcgtcacttttgatccgaatgagcaaatattcaaatcaaaaatgccattaaaatacgagcaaagcaacgcattgtcagcaaaaattgccaaagaaattggcgagttatctgaacagagaaaacatttcggaggaggagaagttggagagaaaaacattgatgagaagctgaagaagaagctcagatcactttcaagtgggcgacattttttaattaaaggaaaataagaaaattttattaaattaatattcttactaaattcgttaaaagccctcggcttcgaaatttttctggttacgccttaacaaagaaactgtaagtctgaaaatgcatatgtgttatatactattggatagagaaaggtcgatttctgacatattaaaatgtttaatattacgggcccataggcaaatattaaaaaagttatggggcctcaaaattcaaaattttgcctgtgttttcccttcagcgataatgcccaataaaaaatgaattttaaaactgttttcttttgctatggactaataaatttatttatttatgttgagtttgaacccggacctccaaaaatttgaatttaaccaactgagccaatgattttgctcatttgcctcacttggccaccttcgctgaagggaaacacagacaaagtttcggcttttgaggcccataacttttttaattcttgctatggcacgtaatattaaaaacgcatagaagtccaccctgctctctctatacaatggtatataacagctatgcatttttcgacttacagttcgggtggttcccttgtataagacccaacctcctgagattttcatattcgctgttgacaataagctatatagagtttaatttttttctttttttaggtttcgaagtcagctcaataattttaaagcgaattttggccactgaaaatacagaaaatggaaacggaaacattttacaaatctatcgcacttttttactgatgatcaaattttgggcaagaggtaataatttaattttcacagaaagtaataataaattaacaattcttttgccattggcactttcagagcatcacatttatgacaacaaattgggcttcttcaatggcattagtctctcccttttggtggccaaagtgatgcttctttacccaatggcatcacttccttttctcattgaaaagttcttcttcaccttctccacatggtcattttgttttaataatttattttttaaaaatttttaataaaattaaattgtcacttttttttattttaaatgtataaattattctatgcatttttttaggccttggccaaccccggtaaagctgacagatttgccaagcttgtccattcttcgctggaacgcatccgatgagagtgacaaacggggggtaatttactcgagacggggcctaatgcccggactgacaatgccaattgtcacgccgggacatattgaacaaaatgccactttcaatgtgaaccgatccaccgcaacaatcattcagcgggaattgcaaaacggtgaatggaaagtcgggacggaattagccgcgggagagaaatttgttagcggaaaatccgggatatatataaaagccgagaccgggagcagcagtcaaacccatatccctcacaaatcagttttgtataaacaatgaaaaacaattatttatttttagctattaaaatcattcgaaattggccgatggatttgcaaaatttgcaagaagaaaaatgggaaaatctgttaaaagataaaaagtttgaagaaaaagtaattttaaaaaagaatatttctacaaattaaaattccaaatattttttcccgcagttttcccatttcattcgcattaattgcaaagccttcgctttggccgacttttacgacttttgcggctacgtggagacgcgaattcgtctccaattgctgatcgatgtcgaacgatttgatcgcattcgattggcccatgcgaagcaaatcgttgaaaagggacaaattttgggagagaatgaaaagggcgatgaaaatgaagcatttccagtgtcaaaaaggtaacggtgggatggcacaaattgaaattggcactattttaagcggtggttggtgggtgaacggcttcaactatattactgggatgttccaattttttatctgaaaatcgttagaattcgcttactgagaaacaaaaactgaacggcacaaaatcggcacacatttggggatacactacacacaaagggtaccaaacattttggggaccgtacatttatggtcccttctctaagtcggactaatccaaaaagtcactctccaaaaaaccgaatttcacaaatagcaaatcgtgtaaaaattcaattatttggataatattaaatttaattaaagtgaacattatcaaaaaatttggctaattgggcttgaattggacgataaaatcgcagcagtgggagatgagtggattcagagattaaactcaatgctttttcatcaatttgacgcgaccattgagaaggcgtaccgaataaagaagaatttggcaaatgaattgatacaaattgaactaaaatcgaaatatgaaaaagatgaaaattattaaatgtatttaaaaaaaaattataatttaagtcatatgtaatttaattttaaaagaaaaaaatgttatagctaattcaagataaatacaaaatttcaacaattttaggttggtaaaaaaaattttccgttactgtatgtctggtttttctggataatattttagaatttattattttgagtggccatattttataacgaacgccctttatgatgttttttaaataacctaaaaaaacatttgcaattggatgcccgtatcagtgtagataatctttgcagttaatttttgtcttgaagttgcttatctgggccttcggactgtttactcagaaattagataattcttgaaatctttagtaaattaatgcatgaaagttaggggacagcttttttccaaaaattaaaaaaaacaatacaaattttttcattgaaaataagaaaatgttgagtctgttttgtgtattgttttgccgcacattctgtgccgattcctccaatctcaaactgtataaacttaccatctttatttgctttgacctagaaataagtgaaaacaatttgcaaagtcgttctcgaaggtgtgccttccttaccttactgcaacagaaaaaaaacagagggattttgggttttattttacaaaaaattcaaaacggcatttttgccttctttttttctacgtgcccttatgatctgatcgatgcgtcgacccatcagcacaatgaagaagtacgttttcctctcattttttgttattcggacttagtactaggtcgttgcataaaaaagggcgcttttttattaaaaaaaaaatatcaaaaataacaatcataacaactgtaaatacaatatcactcaacaaaatagtttccctggaccctaacaacctttctccaacgagaaggaagtttcctaatgccgcgacggaaaaaatctgtgccgatctttgaggtcaggtactgccccaccgcctcctcgacctcggcgtcttcagtgaagcgcctaccccgtaaaaagtttttgagagaaagaaaaaggtggtaatccgaggaggctaggtcagggctataaggcgggtggggcaacacattccaactcaatgtctgggaaatgtactgggttgtcaaatgagaacggtgtggcggagcattgtcatggtgagagtaggggaccgtcaaattggccctgctggcgccggatgcgataagcgatatccaccgcccgcagttggtttatgtagtttggtgctgtttctccccgcccggaattgttggaaccatttttgcgcttgacgaggagaaatcacatccgcgccgagaaattcattcacttttcgcgccgcgggcgccgctttttcgcctttttttaaattgctggtgtaatagcttatgtgcgtgctccttattagcgttcatttttttagctataaaaatttgcaaattgagatatgaacaaaatcaataaactattttgtagacaacaattagcttaacaaaacggtatataaaacattttattatgttaacaacaaaattttttataagccattataaaaaggggccctttttatgcaacgacctagtattaattggtaaaatgcattgccctatgctcacccatttgtctctgccgccgatggcattgcctttggcggtggcgaaattggaggcgcaggcaccgatttttcagccaccactttgctgttgttgaagaagttcagcggagagccgttgaagaaactcaagcgcaacgcagaagaagaagactgaaaatttaaaaatgagaacaggacaaaatcacgccgctagaaatttttaaaaaaattttcaaacttagaattttttcaagaaaaaaatcttagaaaatttttttatacgaaaatttcaagaaaaataaaaaaaatttcgaaaaaacttagtaatttatcataaattccaaaaaaatgaaaatttttcaaatttttattttcatgaaattttcgtataaaaaattttt

SEQ ID NO: 6832 - DNA, 4060 bp, Heterodera glycines
  misc_feature (3895)..(3895): n is a, c, g, or t
actgaataagccaaatgccaaactgatacgattgctgtaatgtatcacaagcgtcaaaaaagtaaatgtcgcaggaaaataattggcaattttattttagttttttgtaattgccacaaaggaaagggagggaaagggaatgagttgggacgcgaggaatggccaaatgttgtgaaaaaagctaaagcaaacattgaccgaagtttctttttttgtgaataattgaagccaacaagcactattaatgaataaagaatttctccgttatatttgcttttcattaaaaaaatccctttttattttccgttttcacaacttttttttcatttagtttttctgaattgggttaattttttgagttaatttctgagttgacacctttttataaaaatttattattatctaattaacataaatatcactctcttttgaaatatgaatcaattttaagcaaaaataagtaattataatctaaagcctttttatttaagtattattctaatcattttaattaaatcaatagaccccgatatcctgctttaattgcgctcaataccggaccacaatgcccggacctgtctactccggttgtgccggattttcccaaaaatgccggaccgtatgccaacacttgaactgatttaattaatttgcgctaattatataacatccataaatttattagatttcaaatgctttatctgccaattattaaaaatatgatcaaaaagttttttggcccattatttttcgacttggctgcaagcatgctgttcactggcttaattgtgttggtgcttatcaaaacaaattttgagtggctccttttttatgatgtggtaatttgaatttgaatttgaattaaatttgaatttattttattttaaattttaattttatgcaacaatttggctcatgtggctagcaattgcttttatggtgaacttcatttgttatgtgcactcatcagccgcagcagcgcaaatccgccatacagtaaccaaaaataattaattgtatccataaatgacactttaaatagttttataagtgtttgttttaatagacatttttatatatttttaaaaatatttttagagtccaattgccattccgcatccgacatttatctgcgcatttgcactgacaatttgtgtgacaatcggatattgttacatttttgtaatattttttcgttattcaaatataaattgtttataagtaatattattttatcttattttttaaataaattgtactaaagcttgatatttttcgtattagatttaataaaattattgaattttattaataagtaattcttttaatttaattagtctattttaattagaaaatcaaattaaggtttacaaaatggcactttatggatgcgataaagccgtggaggcacaacattggcacaattatgaccttggactccgtgttacgcttaacaatttctgcgttcgctttggtttcgttcatttacataatccaacggttatttaattttaatatttttattacaaataattcatttttcggtaaatgattatttacaaaattcagctcttacgtcggcagtttgcgtgacgattttgatccgattgccagaaacacaattaattttgtgttcggtgtgatttggtgccgctttttgctcctcaaggcacttttcataatcgaggcataaataccaagtatttaaaatgaaaatttaattcaattcagcaattttgtcgcgataacaccgaaatggactccgtcatcaagaatctttgtcctccttacatgtaaaatatttttgaaatatttttataattttcaattgataaatttattaattgtcctacaatttgttcctgaaacaaacaaaaatgatctttaaaatctcaaaaatctcttgctatattgggtgagtgcataattattgaacagctcacaaaacagcaaaattcggttcaaatgcttcacacaatgagtaatcgtttgcattgtatgcgtaaaagctgagatattccataatttatagaggacagattttggcctagcaaaataatttcatctttggaaccagcaaaccaatatttaagagtatttctaaattccttaaaaaggataaaaaaaatgtgaaatatataaaaattaaaatgaaatccaaaattattttaaaatttatttatttttaagcaaaaatggcttccattgcaacaatgcgtcactgaacaaacagcaacagatttggtatcggcttcattatgggcttttaaagtcggcaattgtcacttgtgccgccgaactggtccccgtccttctcgtcggacattggtcagaagattaaaaaaaaaaaaaaaaattaattttaaataaatatttaaattttaattaaaattgcttttaaggattgcctgtggacatgcaaaaaaaattgcccagcaaaatttgacacaccgggcaattagcaaattcaaggtgaagggagagcaatgattaaatgatttctttattcaattaaaaaccctaattaaggtcatcagatggtaccaaaactggttcaaacttgaaggtaaaatggcattaattatttatacaaaataaaacaattaacattaattttgggttaaaaagtgaataaattatatattgaattttaaaaacggcataattttaattttactaaatttactttcttttaaatatattttaaattcaattactgttttttagccgatgaattccccgaaatgcttacgctaatcgtgtcaaaatgctataaaaatgtgatgaaatggcaatccgttttgatctgtgtccttagcattttcctgtggctgttgtgctttcacaattacatcaaagacgacgagcaaagtgttgcggtactcagccaagacattgccgaagtgtttaccggattagtgcaactatgcttcttcataaatgtaaacattatttaaaaaatatatgtttactatactttttattatttgttatttaaatttttaaatgcggttttttatttttaaattcttaaattttcagaaaatttagaaaaaataacttgtttagatccataatttaatacaaaataactaattaattacgcattgtattgtaactttcagcttttcattctcacacgggaaattcccaaggaagggcttgacacggcacgtgctgctcaatcacgtgccgaccacgtgctgctgcttggctcaaccattcttttgacggtggaatgtgtttgtgaggtaaataaaaggacatttaaaaatattgttcaaatttatataaaaaagattttaaatttaaataaatattcaatttttattttttagtgcatagaaatactgcacttctcacacaagaagcaaatgcgcttcctgaccaaatgtttggacattttttacagtattttcacggaggtaataaataataataataataaataattaaaatgttattagattttttagttggccaattggtttgagatttattgtttgaagaagattagtgcgcttaatgatgatttggtccgaaggcttcgcgacactttgccatttgtcgccatttgcggcatcactttgaatttgtccgttttcgtgatgacatatttttacattgaggccgaaaaacaccatttacaggtgaactaacaaggagaataaatctaataatatttataaattaatttatatttaaaatcgtgaataaaaaataaaatcaaaaaatattatttaaaattaaggctggaaataaaattttatttaaagttttttgcttatacgcattgaagaaatgagttcaaaaaacgtatttcagagcaaaaatttttttatttgaactaattattcgtcaataaaaaaaattcttggaaaaaaaatttatttcnaatattttgaggtggtgtcaatatttttgtaaaaaatttggcatttttcgaattttatataaatttcagaaatttttacaaaaatgcaataaaaggatttttacgcgataatttttttagcgatttgcccaaaaaattttccaccaatttttgacaaaaattttt

SEQ ID NO: 6833 - DNA, 1196 bp, Heterodera glycines
tcgtgttttttttaattttagggtcaatattttataaattagaggtttttataataataaatataattcccagccctattatgtaattattttcatcgctttttatgccaaataaacacaaataaatctaataagtatttaaaaaagattattaatagtaatgctcttttaaaggaaatgatcacaagtttgcccaatgattactttgtgttggttggcgttgttgcacgcattttggacaccgccaattacgtgtacacttttaccagcgcactttgttggctcgaagttttgctacggtaaacaaaaacaattgtttaattttattaatttatttaacatattaatttagttataagaagaacaacaacttctttatggttggtaataattttgtgaaagaaggcaatgcaaatcacgcatttgaggaaacggccttttaaaaatgatcaatcccatttaatttaatttttgcatcatttataatatttttataaaaaaataataaaggattcaccacaaagaatttgccattgaaattttcaaaaaaaaactcataaaagttgaaaatttaaaaagaaatattttcgataaaaagaaaagcccaaaataaattgtaaatattcatagataagctgcatgaaaatatttttttaaaacagaggcacagttttcaaaaaaagtctctggcccccccccccccccctcctatgatttttttaacaaataagcattttcataggtcccaaaccaaatgcagtgttttccttggagcttctgatttcctaaatttttaaaatgtaaaatggagtacttattaaaatccttagaaatttcctaaactatttaagattttgctacgaattccgatttccgatcagttctgagttcgtcactcgtaatttcgatttccaaaattgcatccccagccgttgcttacttacttagacgactgtgccaaacataagatatgtcaaagtcaagctatttaggggttcctggacatttgggcgctgaattcatttgggctgaatcgacaaaatgttcagaggacattatgattttacaatcgtttatatgagcgaccgatggcattttcccaataatttgtcaggggtcttaccccccacccccccccccccttttttcatttcgcatttacttttttgaaattttattcacttattttatttatt

SEQ ID NO: 6834 - DNA, 2955 bp, Heterodera glycines
tccgtccgattttgcggaataatgacttcgccgccacttttttttactttgaaatttctgtcaaccatatgcaaaagtgagaaaaaacatttggtattataaaaattcacaacatctgtgacaaaatcattaaaaaaaagaaagaaaaaatttgtaaggaaaattgtcataattagggggttatcaaaatgtgaactgtggaaggagggaaacgcacgaaaaaccttttacctgcttggtttgttactttaggacgaagtcccatatgcatattttgtgatattttttcgcgatttatatgcatatttaatgtttggatattctggtgggcgttactcaaaaaaccatcaaatgagaaaattttttgatataccgtatttcctcgattataagccccggggcttctattgttcaacccccctccaaagggggcttatattcgagggggggcttttattgttcaacccctttccctatataaattcttaaaattttttgctttctgcataatggtacaatttaaatcttaatctgaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacttttagaattttctatcttcaaaatgaagaagttattacataaattttggaaaaattcgttttttgagaaaaaaaaattaatagcgctgttctgaaaaggttttttgaaaaacacgaaattcttcctctataagcttctgtttattctatatttttataagacttgaaaaaaagtacaaaaataaactgattttggaattcgggatcatagatggaagcaaatggtttttttgtgccatgggttcagatccacttgcctgtaaaaatgttttttagggtttttgagaccactaatcaagaacttggcatccattttgcccaattccaaagccttgatccgaactcgaaaccccaaaaataatttttttttaaatgttgcaggcatgtggatttgaacccatggcccaaaaacccatttttaacaaaacaaaaaatatattgggtataatatttctatatttgcttgaaaattttttagtgattttcatcaaaatcttttccagtgcaatttattaacagaaattttttctaagctattgcttcgctattagacaatttccaaaaaagttatacatgaaaattgcgaaaagtcgaaatttttgaagttttttcgtaataaaattttttccaggcttgaaaatcttttcgcttttggtaaggctaatagagcatgttaagagctttcgagtgataccaacaatgttgtatttggatgtcaaagaaaaaagctatcgtggaaaaagagctggcgccgaaacgcgagcgccgaaacgcgtgggtcccgtttgtacagtctttctaaaatattttatgaatttaaaaaaaatactatttttttcagaaaatttttgtgttttaaaagtatttaaaataacaaataaatattataaaattatccataaaaagcgacgaagaaattgatgcagaagtttcctaatattttttttgttaatgttttattaaaacaaattgttcaatagtttttgcacgtttctgacttcaaaagttttgaaaaaaaatttttttgaggggggcttatattcgaagggggcttctatttttcaacctccctccaaggggggcttatattcgagggggggcttccattcgaggggggcgtataatcgagtaaatacggtaactttgctgaaaaaaaccaaattttaaattattaaaagaagctatcaaaagatatcaaaatttgtaaattttgttcattctgggcgaagttatgaataattttctgtcaaaaattttcaatttgatactttttgagtaaggtcatagcacctaattgtcactataagctgattggaccgggataagtgtgatctaactacgagagcacttaaatattttcatatatttagaaaaacaaatctcttaagtttaagtgtgtgaaaaatccgagaaattcctgttaacttaactttggatactgaacaaaaaagggacaggaaggaattttggtaaaaaaaagcgccctatttgactgtttaagttttcttacagtaatgactgcgcattataattaggaaaatataaatgatttacacaattgtttctttcaatttgcatttttttttctaatctaatggcaattttcagctccgtccaattcggattcgccgaaaaaccgttaccaattcgaagacgcaacggcacttatgcttatgatagtgatggccagtttttgattgacggttcaccccaaggaccaaaagccaattcttataatgccggcgatgttgtcggaattggcattaatttggccactcagcaaattttcttcgtcaaaaatggccttcgtttgggttggtgaatagaaattttacggcacaaatcacttagaaactcaatctgcggatagcattttactaaaaacacaaaaaatcatcatttcgctgcctatttctaaaaaaaagtagaggaattcggccttttagcaacaataattgcacagttttcaaaaattattaaaaatgcattaaaactcaacaaattttttgttggcgcgcctacaaaatataatcgtaaaatgaatatttgaaaaaacagcttcaaaccagggcttccatctgtcctggtttgtcagatttgtcttgatttggagataacgaccaaaatttgttctgatttcttaataaactcataattttgaaattttatgacattatatcactatttaatcaagaaaacataagatttatggcaaaatttggtcattttttggacaaaaatcagttaacaaatcgcattaaaattacaaaatttttc

SEQ ID NO: 6835 - DNA, 5791 bp, Heterodera glycines
  misc_feature (5766)..(5767): n is a, c, g, or t
caaaacgccagtttttgccgccatttgttgccacaaatgaaaaaacaatggcaccaaatttaaagcattgcgtgaaatgttaacataaacagaaaagaaatggagggtgacaaaaaaccattttaaaatattcaaaaataaaattaaattgcattttattagtaaattatcaaagacataaatagtattaagagcaatcaatcaatcattttgtcaaagtgaatgtgaaaaatcacaaaaaaacaacctaagaaaataatttatttcaaattcttattttttggtccgcctattcgttcgtccgacagccaattcaattgtcagtcagtcgaggcaattcagtttgttcacggagcatcgctcaaagcggcgacgccgggcagaaccttgccttcgagcagttcaagactggcaccaccaccggtgctcacgtggctgtaaatttgtggcaaaaaaaaataataaaattttcataaaaaatcagaggggggggggaggggataagatgttcaatgaaaccgaaaagtgccaagaattgcttttaccgcaagtcccaataatcgttaaaaaaagcttggtagagggcaacttgcccctctaaaggggtcgttattttaggtgggaggtgtctaaattttaggaaaaatgacacctaaataaaccaaagcaacaaaaaattacgacatttgggagactcacctgactttgtcctctgctccccatttctccgccgcggtggccgtgtcgccgccacctcaaaaaatagtaaatattcaattttccaattgtatcgtcctgctacaattctgcatttgtgatactatactcacagtaaacccaattaattgaaaggcccgtatccgaagtttagaaaatataaatgaaatgtccatattttaaaaaatccaaaaaaggtaccaattatggttgttgcacccgacttggtcgcgccaatgaccgcctccaacatgcccttggtcccatgcgcaaagtttggccactcgaacacacccgccggcccattccatacgacagtttttgcacgcccaatcacttcggcaaattgtttgagagtttcctgaccaatgtccaagccctaagaaaatcgcattttttgtataaaaattttctttcttttttttaaactcaaccatttttccgtccggaattccatcctttgcgtcaacattggcgaatggagtgccctctttgaactcatcgccaaccacaaaatcaaccggttggtgaattttcacatttttgtccttcgcttttgccatcaaatcgttgataattttggaaccctaaaaatacaaaaaacaaattaaaattttcatcgattttgtaacatttttaataggcaatttaataataatttcctgcatctatccagcataatcgtcctaaaaaaaacattaatttccaaagaattatgcacatatctatggctccaaatttttcagggtcgcacttttggacacaaaattcgacatcccaaggcgtgcccggtccccaatcccggattacagaatatgagcctgttttttgaagaccggacagcccagtcccaagaatgtgagtttttttaactcaaaaataatttgatgaacctcctcgtcaaacagcgatttgccaatggatttgccggtgagcactttgtagaaagtgaatgccatgccaccgcagatgaccatctcgtccaccttgtccaacaaattgttgatcagctgaattttgtccgccactttggcaccgccgagaatggccaggaatggacgggtgggcgactcgagtgccttggcaaaatactccaactccttcttcatcagaaaaccagacgccctcttctccatcgcacagccgaccattgaactggaaaaaaacgccgaattttcgaataaaatttcattttttcggcgtcgctgatactaagctttccaggactcacatttgtataaccaggatttgaaaatacattgtatcttataaatagactattttttgtacattttttccatttcggcacatcaaaatgcgctttcaaccgtttttttgaattccaaaagccgaaaaaatgtatgctaaaatacttacatggcaaatttcatgtttggtaaccccgaaaaatgtattaaaaaaaactcggaatgttaaagaggtggccccatcctggagtggtaatgtgccatcattgacccctcacctatgcgctcgatgcgccgtgccaaatgcgtcgttcacgtaaaggtcgccatgttttgagagagatgcacgaaaggcgttcaccgcctctttggacgctttcacctaaacgcatttttgtatatcagtgctaagcaatttactaaaattgagttggaatcggaaatggaaattgaattcacaagaaaaaggggtccgtcccatttttatgagatttttgtttctaaaaattgtttaggcactgagttggtctcaaattgactgcgtttatcaagaaatttgttctccgcacccgaactcaaatcagcaaattcgatgggtccaattgaaagaatcccataaaaattagtcgtaaaatgccaaaaaatttaccgtttcgccagccgaatttttgccttttccctcctcctccacatgaaaacgaaggttctccagcaaaatgatggtgtccggctttgggtcggcggtcgcattttcaatttctgtcccgacacagtcagtcaaaaagacaaccgtcctaaaaaatgttttttttcaaaaaggaccacgaaacatgaataattagcacacaacaacgtcactcatttgggtcgaatttccgtttttctacggaccaaatttaacactcaaaatcattttgaaaccattctaagccgtcaggcttggaaaaatgaaaaattcatttagaaataaaagttgagaacccgatgttcgggcttggaaatgtcgatgataatcctgaaactgttcaaaaatgtcggcgcggggtcccaaccatggggtcggatacaatttgctttttaattacggaaatccgtttccgtaattaaggggtgcttctaattagaccgtactttccaagcagtcgctccaattcctcgtgcaccggcttcatcgaatattttgcctgtgcttggccgtccggtcgtcccaagtgactcatcaacacaactgactttgcttcatggtcaatggcatactggtttgagagggagaaagaaacattagcatttttaatggagggacgaattttcaaaaaatttaggttagtgaatggaaagaggggggggggggacttaaaaaattcatttcttcaaaaacaagacccaatatacgaatgaaataaatactggcgagcaccagggaagggggaagactcatctaaaaatgcaaaaccaaaccacgaaacggaccaccgaaacgaaaaaaaacccgatttttcaggcgcccatgccaaaaataaatttttctcaaaaaaaccaggggtccttttttaatagaggaaggcatgaagcaataaaaactgactttgattgtcggcagagcggccacaatgcgctgattgctcgtcactttgccatcctaacaattaaaaaaaaacaactttggcatattccaactgttttgatgagtcacccccaactcatccataacgctgcgagtcatcgccgtgtcatggcattttctgcttatgtggtcttggccgtggtatttttgattatgcggtctcggtcgtggcattaaatgccacggcgacgactcgtatcgtgctatggatgagttgggcatggatgttgggtttaccccgttttgatggtggatagttagtttttaccttaattggcacgttaaaatcgacgcgcattaaaacgcgtttccccttaagttcgagttggtcgattgccaatttagagaaagaacccatgcttcttttcaagtgatttaaaataatttttaagtgctaaaaagttcgaagtgtaatgtgatttagcactttattatgcggaaaaaaaatttttggacggacggacgtgaaatcgagtgcaatcaattgataattagggctgggaattgctgggaacttaagtcaactgacttttttttttgctgactctaaatggccttaaaatgacttaaaaagtgttctaaactttgtttgaagcttataacatgcattttttgtgactttttttacttttttaattttttgggattgagtttttgcgacttttttcgtgattttttttgactttttgaggcaaaatttgaattttagtgaataacatgccgaaaaatacaaagaaaattacgaaaaataaatttagatcgataaaaaggcaatgaaacctggatgaattttttcttaattgttggaaggatcacttttttatgcctatttaggtacctatttataaaattaagtgcctaaaaatatgatcaaaatgttattctataaattattaaaaatgggattttttaactttcgcctaatttttcaggactttttttccatttttcgtgacttttttgcgttttttatgactttttggcgatttttagcgacttaaattcccagccctattgataatgctgcattaaattttgtttacttcaaatgaatacatagaactccgattaaacgaaatgtatttcaaattgatcgctctgaatgaaaaacaataaataacacaaacttttcaaatttgtcaatgaaattctctcggtttttatttttttattcatcaacacatcattaatactaatgaacatggctctactgcattttacgcgtccaatcgacttttacgcgtccaatcgacttttacgcgtccaatcaaaagtttacgcgtccaatcaattattagaaattatttaattatttaaaatattggcattaaatgcttaaatgtcaaaatgaagactttgattaatacaacgaaaagatgattagacagggtattgaatacgtatttcttcgagaatttgctgaaaaattttttcgttagatgcgacgcagtgttttcaattgtgtggccaaattgttaataaaaaatcacaaaaaattttgatatcagaggttatcgaaaccaaaataagcacgcacaaattagtctctctattattaaattttataacaattgattgaatgcgtatatacctatcgatactttgataataagtgatcaatgacggatttaaattttagtaaaaattaattagtaattttttatttctcttggtgttacgtttttaatatttaaattattttttgcaatggttggtaccttatgtcaaaaggatgttcgatttaggaaaattttgattggacgcgtaaaagtcgattggacgcgtaaacttttgattggacgcgtaaaagtcgattggacgcgtaaaagtcgattggacgcgcaaactgtgattggacgcgtaaaagtcgattggacgcgtaaaatgcagtagagccaaaaaaattccaaaacaatgtaaaattacttaaaatattttcaaaatcattaaaaaatttttttaaaaataaatagagaaataaattaaaaacagttagacattaccttttacatggttaaaaatttaaaaaattagcctattaaatattaaattttttattatatttttttttgaaaaattccgacttccgacatttttggggtcggaattccgacttccgaaaaatttttgggcctcggaattccgacttccgaaaaatttttgggcctcggaattccgactttcgaaaatttttgagcctcgaaattccgacttccnngaaatttttgagcctcggaattcc

SEQ ID NO: 6836 - DNA, 4306 bp, Heterodera glycines
tccccacttcatcctcattttgcgggttcccttaacaactgtctctcctcaaatcctttttcgtgttaattatcattttcatttataattttgtttaatttaattcatttctggaaaatccggcatttatttattttaatgattgaataataattattattttagaaatattttataaatatttatcaaaaattgactttaattgtaatatatcaaaaaatttgcttctatggctttttcaagaaataaaagaaatttttcgaaaaattgatgaaatttgttaaaaaatgagaatttttttaaattcgagcaatttcctattgtttaaaattggacgcataacaaaaagtaaatgtttaagcagtttctgttgaattgcttctgccgcctttactcagtaaaagcaagcataattttgtcactattccaattaattttaaattgcacaatttttaagaaaaaataaatttgtccgtaataacaatattaataattccctcccaccgccaaatttggacgtcacacggcttaatccgcttttcgtcggcacttcactctgtctgattgaaagcaaatctgatcgcctcctcctaagcgaaacagctaaaacaaattccaaaatcccatctaatgccttcgtcctgttggcttttcctatttgtcattgaagagatggcaacgatggacgattaatttgctttctaatacttttgacatcggcacgaaatgccgattctttcaacattggcacaaaatgtgccgtgccgtcccctctgctcgtgtccaattttttttttacagtattccggcaaatattcggcttattgagatctcagtgattttactccagagtctcgactccccataaaatccgggctttttcgaaatggactgaaaaagtgcgatatctaggggtgacggataaagccagtaattaaaatccataggtaatacctaccgtatactcaagaaatcacaaattacggtctacaataaatcattgactcggtctgctcagaacaaagaattatcaaaaaaaaattttttcgaaatctaatgaaaaattcgtgcatgtaatttttgccaactttttgctccgtctccccgccaataaataccgtagtaatccaccgtaatgcgtccacttacttccctctgtacaatactgtcgctgttcggcgtgttgctgaacattctgttcttggtggtcacacggcttcaaagggtcgaacgcattcaggtgatgagcactgtaatcggatgaataaaatccaaaaaaaaattttctatcaaatttaattgaaaaatgtgaaaaaaattaaaaaaaaaattaaaaggaaaaaatgtttacaaaatcttgaaaatcttaaaaattgaaaccccaaaaaggcctattaaacaattttttacattttgccattgactcatttttttcatcggcacccaaaatgccaaaacaggcgggaaatgctaatcaaaaataatcgtaagaaataaattttttcgaattcaggaagttctcatcttcttgcgctccatttcgatcggctatattctcgtcgctttgtctatcatggctgttgccccgcaggtgatccgctttgatcacattattttggcactgatcattgacagtttgatcaatgattttttaagtcgatcactttggcatccgcaaacattcgcattccgcacggactgctcgttgtcggcaacgcgggcgcttcttccaatttcatggtcagaaagacaatgtccttaaatccattcaaatgcttaatccggaaaatcaatacaacgaaaaaaaccaagaaattccggatttaaatgccaaaatacccaagatatttgggatttgaatgccaaaaatgatgtgaatcgccggatttggatgccaaaaacgcgaagaattctcagatttgaatgctacaaatgcgaagaatcaccgatttgatcggttacaatgccaagaatcccggatttgaccggctaaaaataatataattccggatttaaatgccaaaatacccaagatattgtgatttgaatgccaaaaatgatgtgaatccccctgatttgaatgccaaaaatgcgaagaaatctcggatttgaggatttggatgccaaaaaagccaagaaattcagggatttgaaggcaaaccatttctggcaacttttttcatcgatttttgattataacagttacagtgccactgatttttcacaatgatagtttatcaaattatcagagtgcgcttgctgcattcggcgtcggcagctttctgttcaccgccttctcctttctgttgctgtttctgtaccattaccgtaaaacggcgggacaggcaaattaatcaattaaaaaaaacattataaccacaagaataccgtatcaaacccgatcagaaagtgatacaataattttgagtgtaatctaataccgtatctaatctaagtggaaaacagtagggagatttacaattaggtctaatacagtatccaattcgatgataccttatccgatccaggcaaaaacaatatacttactttaaaaagcagaatcaaataccgtatcgatctaattaaaaaaatataggatgggagagttaaaattaggtccttacagtatccaactgatgcagaaactaataccataagctatcgttcgggccttcatcatactgtagcaatgaataaatctcaaatttattgttctcaccaatttttctattgagctccctcccccaacagatgtccactgtttttgcgccaaaaaatgtgcccgtttttgttggcgttgcgtttgtgtactgtttggtgcagtccgtgctgctctattactccaaagttgaaccatctgtgagtaaatcatgtcaaattgggtgaacaactaattgactctgggactgaatcatctccatgccgaaactcgaacaaaatttaaaaaaaattaaaaataagactgacatttagaaactgaattttgctaagaataagcaaagccggaatggacctcggcccgtgttttcgggatcatggctctacgggaataataaaaaaaattcacattgacaaattcttaaaatgaaaattgggattttcctaatcgactgaaatcattaagcctaggattagagtaagattttctactttttaaaacgtttagtgacagatattacagaatatctgaaaatatctaggtaatcgaattttgatttccctgattactcccgcttccctcggtccaaatttttatgtttaaaaattttagagttttttttgggggttattggcctagacacaaagccaaatgccaacacaaaattcaaaaattcaattggaaaggggtagaatttccaaaaaatgaagggtgggtacggcctgaaaaatttccgaatgtctgagactcttgacacacccaaaaatgccaccaaattttttctacaagcttctgctggaacggctgagccgatcaaagaagtgggagcaggtacagctgaacctgggcatgaacccgaacaacagtttcgccattgacgggccgggcggaggtggcggcggcggtggcgccgcgtgggacaaacaaacggaagcgaaaacgggcgccggcggtcaacaaatctcgggcggatttcagtcgattactggcggaagcaattactcgacgctaagtgtggcgattgaaagccgccagtatgatcagagcggagtcagcggactgaacggaggaggcggtggatcggagatggtagtggtaggaacattttggggtatttggcaaaattacactgatcaggggagggggaaactttggcaattgatcagattgaactcaatggattagtaagatactgagaattttacactggatcaacagaggcttaaagtctaactattccgacactaaactatgtttattgatcagacgcttaggtcttagactagtcaaatgataaggtagcagagggtgaactgatcagagaagagggtgaactggtcaaagaaatttaaaaggaagtgatcggagatcttgcaaaaaggaaatgttaaaattgatcagagggggtgaattaagcaaaactgtaagcaaaactgatcagtggtcaaagttttcaaaaaaacacattttaaaattaattactatggctatagactgatcagagttttagtgaatgatcaatgccaatttgtgatcccccttcggcacagaatcgctacttggagggcacttttggcacggactattcgcgcaatccgctgtactttttgtccaaaggtgtgctgatgatcacattctgtatcatct

SEQ ID NO: 6837 - DNA, 1125 bp, Heterodera glycines
ttgtaataaatatcataatgtaggatgggatcagcattctgggagtttactgtcgggaattaacggcccaaaaagtctgggatttggagatagaggaaaggcgtgggattagtgatatcgtggaccaattccaagtgttggcatgttggggatggcccttggaatcagtgatattgggcttcaattcaataggaaaggtttgggtaaggctcaatgtttccgggaattcggtttagaaacaccaccgggacggggatcagggtcagagttccccaatttgatcaataccgacctccagttcccgaagaggttgcggaatggtccaaaaatacgggaatttagggtctgatacatcatagggacagggcggggatcagggtcagaatacctccatttgatcaatctcgtcctccaatcaccggataggttggggaatggcccaaaaattccgggatccgggaggaaacatcacagggatagagcaggattagggtcagagacttccccatttgatcaatcccgtccccctaatcgtcaaatcccgtccccctaatagtcaaatcttgtagccctaatccacctctcgttcagcaccactcaagaatttctcggcatttcactgatcgcacccatccctgtgctgttcccgctgatcaacctgttgtgcctgaaggagttccgcaacatcaccagccaaattgtgttgtgcaaaatttggatgcgcaaaaagcgacaggaacgagcggcagcggaacgaaaagcgcaggaaaacattgacgaagacttggtatcggcaagcaaaaacaaggtgagaaaaggtggggaggagagagacgaagggagaaagagagacggacagaaagagagagagaaaggcggacagaatgattaaagagagaggagagggaagggtagaaactggagagtgacgaaaagattaatggacactaattgttggagcggagagatatagagaagttattgcgagagtgtgagagaggggaagaaagagagaggacagagatagagagagaagggggggggagagagagagaagacagagagaaggcagacagaatgattatagggagagagaggagaggtaggggtagaaactgaagagtg

SEQ ID NO: 6838 - DNA, 2031 bp, Heterodera glycines
  misc_feature (1702)..(1702): n is a, c, g, or t
  misc_feature (1872)..(1872): n is a, c, g, or t
gagagggggagagagagagagagaagagagagagagagagagaaagtgacagagaaagaatgtgagttaaagagagagagaaagaaagagagggcgagaccacatgctctctcatccacataaaacctttcagttgcgcaacaaacggatgccgaattcaaccaatgggactgaagggtatgtgactgattgaatggttagaataaaactgaacccgttcgggatcaatgcttcaggcaaatccagaagaatgtgccgtccgaagcgcgcagtgaaggcggtgccaccaaaagcactgcgtcaaaagtcagttttatgaagattgtgggtaattagctccttgagactctcgactttcataagttttaatgctcgagactctcatgccattgttaatactcagccaaaaatgaattttttgaacagaatcgcccggaggacaaagacggacgctacaccgaggcaaaggataattcgcaccgtgaggcgcgagcattgttcggcaagcagtgatcggaggcggatcaatcgatcagaagcaatcaataaccaatcgatcggagagaatttctgttcccgagttgcttttcgagactaacaaaagttaatagtattttggattcaataagttatcatcaaaatttttcgactaacgcagtgcaaaaatgaatttttgaaattttagtaagaaaattttatagaattttttaaggacaagatttataaggacttttggggaagctattctgattcgatgtttcgttctctagtcacaattctcgtttaaatatgcatttatttctcgactatcattaaatctcattttgaatgcatttacagtatgtgtacaagttatccctataatacagtagcatttggggtaatttttcttttttccgctaatcctttttcacataaaaaaggcgatgaaaataattgtaaatttaaaaatatcatggaaactttaacattctttttcattaaaaatgcacaattagaaaattaagggggcctctattagcctgcaaattcaaaaatatttcgtcaattttgaacaaccttatgaccaaagtacatcagaaaccaagttttcattcatttttggccatgactttttggaaccttaatgaaattttttgaaattttacaggctaatagaggatagttagggctatcgaatgatagcagcaatgcttgatttggttgacaaagaaacaaattaaagtccgaggcccaactgaccgagtccgtcaggtcataatacacttgtgttattgggtggatcctcgctgatcagcaggagaagtgaaaactttatttgagtgtgactgatcaaaaacagaaatttcacacagatcagatagaactttaggtagaactacaaactatgcatactgatcagaagcattagtcatagacaccacagtaaatgatagggtagaacaggttgcactgaggaactgatcggaggcttttggaaaaggaaaacgccataaacgcattgatcggatcgatttggcaaatagactttcaatcaataagaaatccatttgagtatctattaaaatacagttaataaatttaattaaataagccatcaaaatcataagcatagcaaaaggaggagaagcaaatcgtgtgcttcaggatagtgaggatttgtttggcattgttaaagctggatatgttgttcatgtgtctngggatgctgccgctcaattccaaattttcgtgcaatataaaaatgaaaagaaagcgataaatgtatatggcacggaaatggtggcaaatctgaatggcattctgcccaaaaaaaacaaacacggacaatacacactgtgcttgaggacgacaaacaaatccaaaatttgngcattgagccggattcacaatttacttgtccgacaattgagtctagcgactaatgagtctgatcatacataattagtgagtgttttttgtttataatcttttttttggcttctaatgaatggatattgattctaatgacaatttgttattataccattg

SEQ ID NO: 6839 - DNA, 3339 bp, Heterodera glycines
ttttcgttcaaattcaaattacggaattgactgacctgttcaaaggtgaagagcccagccttctttccaacttcgtgaatgtcctccatgaccatcgctttcacttgctgatttcggcacaattcctccattgtttttccctcaatgcccaattgtttttttgccgcctccggcaacacatcaaagtcgggcacaacaacagccaccagacatgtcttcagactttcgccatgcacaaagcattgggccacgtattttgaacgcatgtagatgagttcaatcttctcaggtgcaacgtattcgccctaaatcatgtttttttcttattacatttgaattttttttattttttcaaaattcttacaattagaggtttttctagtaataaatctataaaatttcttttaaaaaaactcctattttaaaaagatattcacgttgatacatgaaaaccgttagggggggggggagggggaggcaatcaaaattctctgctaaattcgaaagggtgtcgagtatgtaaatcgacatgtgatggggagaggtcgacccaacccctctgtattatgtgtttttaacaatttgttagttcaaaaaatacacccgttttttcattaaatttttttttaatttcatggcctctcccagtgttggggctctcacctgggccaacttgaagatgtgcttcttgcggtccacaattttcagcgtcccctgctctgtccatcgtccaatgtcacccgtgtgcagccacccgtctgtgtccagcgtttccgccgtttgttcagccattttgtagtagccgcgaaacacgttgggccccttgatgcacacttcgcccgcaccatgcgtggcaaaatagttgagctcgggcacatcaatcaacttgacggcacagcacggaaccggcacaccaacatggcccggaactgggtcaccttcgatggtaatctgtgcaatgaaaatagggaatgcatagaatggaaagaacagaaaattgtatttagatttccaaaaaaaaaaaaaatttctcggctgcaactaacgacaccaccagaccaccatttgctcataattttttgaaattttttttttggaataaatttctggaaaattaattttaaaaaattaccgttgctgccgcaacacactccgtctgaccgtagccttcacacacaagggcaccggttgcacagcgcatgaatgtgagcacagtttcggacagcggagcggaaccggtgatcatcagtttgacacgaccgcccaacccttcgcgcacctttttgaacacaatttggtcaagaagcgaattgttgcgaacaatccaactgtgaaaaggggacaaatatacgaaaatttggacagtaaatggaaatatttttaaattcgtatcaatctttttaagaagttgattagaatttgttttaaaatgacctaataatgttgaaagttatttatttatgggcgaaatccagcctggagcgaaaccagggaaaaaacggggaatacgaagactttttgctcttcggccaccaaaaaaaaatgtttgattttttaaaaattatagatatggaggctagttttcttttatacaagtttcggactaaaaataacaattttgtttcattttttggtcaaattttgaaaaatttagtgagtttgtcgtcaagaaattaaaacaaaaaacaatttacttgttcagctcgcgcgttttcagtccaacagcggcgtcaaagagcagacgcgtgaagacggatttgtttgcctcgcccaacactttgtcatagattcgattgagcacacggggaaccaccggcaacacagtgggacgcagtgttttgatgtcgtcagcaagcaaacggatgtcgccacggaagaagcccactgaaccgccctcacagtacacatccgtttgcatgacacgctaaaaaaggaattttaagatttttaagtaaattggtcagtcatttttaatttacaaaatttagtttttagagggaaaaacaaaaaaaaattatttaaatccctaataaatcgtatgaattgagtggggagctgaccaactccgtcagaatcgaaattgattcaacataattttataggttgtttgattaacaattccccatcacaatcttggtatcatcgaaaactttaataacatgctctctagcccaattaatgtttttattaaaaaaactacaaaaatcctttcatttttgcagttttcaaacaataatttttttgtgagccacacaattgcttacaattagcattagcttacaaatatctattttctaaccaatcaaagctttcaaatgacaccaaatttgtttggttttaccaacaaagaatgtaagttttgacactttttaaccaggaggaaggtggagggcagggcaattaaagtaaaacctcaaacatgtgagccaacggcaggaaggagaacatgacgtcattgtggttgagttgcgtgtttttgaaatagcccagcgccgtacaatcggcaatgatgttcccatgcgtgagcatcacaccctttggaacacctgttgtgcccgacgtatagcaaatggtggccaagtcgtccgggctcggtggcacatctgacaacgaagcaacctaaaaaaaaaatttgtgtgtgatagcaaattttaaaacattttgactcttttcatatcattaaaaatcaaaaacaaaaaattttttccccctttggcaccacgagcccccaaattgcttaaacattttcaaaaaattgatccaaacaaaccattaacaaaatgaaaaatacaattttttggttacactacgttcccccttgccgtaaattatttctccaaaatttcatgatgaattaacaaacattttttcagaaaattttcaaaaaaaaaaattatttttttcatgaaatttttataaaaaaaattttccttctacctcttcatgaagacccattcgctcaaagttgtcaaatgagaacagtttgacaccattctgagcagcaatgtcacgcgcggactcagtgagttcgtcgtaagcgggtgccatcaaaacgatgtacttcaaggacggacacgctgattttcgttccaacaacccgttcactttagcgactgtgtcgcaaaacttaaagaaaacaaatcaaaatatttacatgtgggaaaaaagcatttaaaattataaactgtcacacttccattaaaattttaatttttacttacaattaggtctttctaaaattccaaaaggggtttttaaaaaaaattcttaaaatgtattttaaaaattcgagcgaatgatagctagcgggaaggatgtgcgggaaaataattttaccgt

SEQ ID NO: 6840 - DNA, 1037 bp, Heterodera glycines
gcgccgtacaatcggcaatgatgttcccatgcgtgagcatcacacccttggaaacacttgttgtgcccgacgtatagcaaatggtggccaagtcgtccgggctcggtggcacatctgacaacgaagcaacctaaaaaaaaaatttgtgtgtgatagcaaattttaaaacattttgactcttttcatatcattaaaaatcaaaaacaaaaaatttttttccccctttggcaccacgagcccccaaattgcttaaacattgtcaaaaatttgattcaaacaaaccattaacaaaatgaaaaatacaattttttggttacactacgttcccccttgccgtaaattatttctccaaaatttcatgatgaattaacaaaaaaatttttcagaaaattttcaaaaaaaaaaaaattatttttttcatgaaatttttattaaaaaaattttccttctacctcttcatgaagacccatgcgctcaaagttgtcaaatgagaacagtttgacaccattctgagcagcaatgtcacgcgcggactcagtgagttcgtcgtaagcgggtgccatcaaaacgatgtacttcaaggacggacacgctgattttcgttccaacaacccgttcactttagcgactgtgtcgcaaaacttaaagaaaacaaatcaaaatatttacatgtgggaaaaaagcattaaaaattataaactgtcacacttccattaaaattttaatttttacttacaattaggtctttctaaaattccaaaaggggtttttaaaaaaaattcttaaaaatgtattttaaaaattcgagcgaatgatagctagtagcgggagggatgtgcgggaaatcaattttaccgtaaataagggatcgaaaacgggaaatgaatgccccagggaaacaagatagaaacagtgaaaccaaaaaatgcggaaatttccaagtcgagattaaaaaaaaactggtataacccaccaccaatacaaagttgttctggatatcaaaggacacagatgcgtccataaccaatgtaacaaat

SEQ ID NO: 6841 - DNA, 4168 bp, Heterodera glycines
  misc_feature (127)..(127): n is a, c, g, or t
  misc_feature (257)..(257): n is a, c, g, or t
gggaaatcaaatttttcccgtaattaaggggatcgaaaacggggaaatgaatgccccaggggaacaaagatagaaacagtgaaaccaaaaaatgccggaaatttccaagtcgagattaaaaaaaaanctggtataacccaccaccaatttcaatgttggcctggttcacaatgtacacagatgcgtcggcacccaatgtttcgtacagcggcaccaacacattgttgaatgcgtacaccgcttgctcgaccaacacnccactccaggccgattcttggcaaagatgccaacaaagcattgttgtccgacacttaatccggcaaaataatgacacgtattagtacagtagtaaaagtaaagagggttaaattgtggacatttgactaatattagagcaaaacagccctcccgcctgtactccattttgaaaaaataaaatcaattttctaaaatttatttgttatttttggttcaatccaataaaaacaaaatgaaattcataataatcaaaaaaaaaaatatttaaaccattttaattgtaagagcaaaggaaaattcaaaaaaaaaaaataagttccaacatattgttcgcattttggttctgggatttggattggtctaaatggaacctgacattttttcaacataaaaatttttgaaaaaaatggggatgcattaacggacagattaggaaaataatttataacgctggggcaacaacaaaaaaaccacctcaacccgagcgaacgtatggcgcgcgcaagaagcgccgaacggtgcaacgcgtccccataactcagccattcgtacggttcaccgtcgcattgtctgtttcgaaagccgagcattggcccattcttggacacatgcgccccgcgccgtacgccctcataaattgtctttgcgttcgcgtgagtgaagcgcatcagcgcgtccgttttcaaatacttgcacacgcgtgagccatcctggagaaaaagatacccactcttcattatatcgtcatgaaaaatacattaaatattttttatgacaaaaatctatgaaatatagaaaaatttaaaaatttcgagggggagggtttctaatttttaagcctatttatttgtccagaatcgctgattaatgaaaccaattataatttttatgagccaaaaggatcacccacgctttggtttttcccgtgccacctacctataaacaagaaaataccaaaattaattttgcccacaaataaatttttaacatccgccagtttaacccaccggcagttcacgagtttgagactcgggatcaaccaacggcaccattttcttcgctgacggtcgtgaggaccacacccaccacagtcccattgctccaattgtggcggcggcgccaattgagtacagcagtgaagtgttgccgttgttctgttcattccaatcgctgatgtcggcaattctgattaaaggagggaaaggggatgggttccaatttttacgctcattttttgtcaatttttagaatttagggggggggggggaggggggaagaaccgcgggataagacaaggaaacggaatcgggattaccagaggccggaacaagactggaccctgtcaggattcccaggatcctgactctgatccgggcaattcacaaatcataattctgtccggaattttaaaaaattctgggaccgaggatttacttgactgaaaacaccattttcccacccatcctcaatgcatttgcgtaaattatatcccggatctttactctaccgtccaatgttgattgggatggaaatccaaacgggagtcgcgtctttgaccatttcgggatattgaaaaagcgcaattgtttaaggggtcggaaattgcacacaacaatttattgggggtttcggggtttgttgtcaattgaaggaattgaagtgtttgattttaggagggcgggacaaagacgaacaaattttaattaattagctgtgctaaaatagtcgaaattaattaagtggaaagttaagttggagagaaaaatgcatgaaatttcaaatgttgtttggtgaaattccttcttactaacttaaatacaattatgtacaatcacatcacatactagaaatgcgcgttcagcagcgtgtgaaagcggagaaatcaaaaagcgcttttttgaaaaaaataaattccaattttggaacaagtgtaatggttaatggaatttggcgatttacgttgtaaaccgtcagtcatccaaatttttatgcatctttgagaagtgttcagtgttcatcaaagttacgtcgttgttctctagaaggaatttttacatttaagatgcgcaaattttttgataaatcaattttagtaggaaattgaaattgatataggtaatttaattgttactgcacgaaaatgagcgatatgattcattgggtttttaacgttaagccttgaagcttctagcttcaacttttaattaatgtatgatcactaaattacttgaagatttacttgaaaatacacattttcatttgtaatgggctgtgatataaaaggaaaagaaattttttgttttatattcgctttcttatcacaattttatgtggtggatttgccaaagtttagagagattgccttccctttctcacaaataaaaatgagttatgataagaaaaaaaaaaaagaattttttttggaggggtcgtctttcggcccgttgaacaaatgataaagtttaaatgtgagaattgttgtgtggtgtgtttgtgttatgttcagcagaatacttaaatacctatgtgatggaggaacggcacggaaaaacgatggcaaactaaaatgtgcaaaaagataatcggaaaaggggcatcacggtgatgtgatggacctggaccttggaccccacaaaaatcacatgatttgatttggacctcccccgccccgttttcccctctttcttataaagaaagtacgcacattctctttttggttttattcttattgcatgcaataacagttctctcttttttgggtgcggaaaaaaaaagtaattaattaattaattgtcggacatgaatggaaaatttttatttttatagacagagaaattattattagattttagtaaaattagtaaaaaataaataaataaaataaaataatgcatcttattcatttagaaatgtttaaaaatcgttatagaacattcgtcttattgttagagagtgttttaatgctgcaaaagtatattagcgatttttgacaaagaattggcatatttttttgatcattttgtggttcagtttgagtttgtttatttatacattgcaatgatcgctgacccacaaaatgtccagcccacgaaatgtccaagtctcgaatttgagtttttttattattcagatgggcctaaggttaggcaacgggtaatataaaggttatattcgtattcagcgaccccgaaaaccctaaaaatcctaaattagactcattttgtttttataaattttgaaaaattttggacatttcgtgggtttttactcttttggacatttcgtggcttggacactttgtgggggcgccgcaatgatttactaggttaactcattagctgtaaataacaaattttgatttaaactgccaaactctataaacaattagacaataaacatcatcgtttgaatctaattaaatgaaatcgtcgtcataaacttattttccttttcaagagataaaaaatattttatagttatgtaagaatataatttaaaatattttttttttgttaattagacgtggaaatcgatattaattctaaaaattccaagaaattaaaatgaatttttaatttttaaaatgggaaaggaatagagaaagagatatattgaacctgaataaaatctaatccaaaattccaatgactcagtgttaaaaaacatgaatagaaaccggcatgaaaacaagtttttattctcagggagctgggagttttaatcgaagcaacaggaatcgcgcaaatcctttatttttatctttttcggtggccattacattaaataatgttggcgaaaggagggaggagaagaaaaataaatagcttcaaaaacggcgattagtcagagccatcaaccgatcattagggaaaatgatcgccatcatagcgattttcactttgttttttat

SEQ ID NO: 6842 - DNA, 3905 bp, Heterodera glycines
  misc_feature (105)..(105): n is a, c, g, or t
attgagtcccagagattgaaatgctggtgtgttagtcccagagatgaaatgctgttggttgagtcccagagattggaatgccatgaaagttggggggtagagtcncagtgtttggaatgccagagatttgagtctcagagattgaaatgctggtgggttgagtctcagcgattggaaagcctgagaattgagtctcagagattgaaatgctggtgggttgagtcgcagagattggaatgtcattgaaagttggtgggtgtagtcacattgtttggaatgccggagattttagtcccagagattggaatgccggagaattgagtcccagtattggaatgctggtggcctgattttcattgagtggaatgtctggaatgccggagatttgagtcacagtgattgaaatgctggtgggttgagtcccagagattgaaatgctggtgggttgagtcccagagattggaaggccatgaaagctggtgggttgagtcccagagattggaaggccattgaaagttggtgggttgagtcccagtgtttggaatgccggagatttgagtcccagagattgaaatgttggtgggttgagtcccagcgattggaaagcctgagaattgagtctcagagattgaaatgctggtggattgagtcccagagattggaatgaaattaaaatgctggtgggttgagtcccagtgtctggaatgccggagatttgagtcccagagattgaaatgctggtgggttgagtcccagagattgaaatgctggtgggttgagtcccagagattgaaatgctggtgggttgagtcccagagattggaatgccattgaaagttggtgggttgagtcccagtgtctggaatgccggagatttgagtcccagagattgaaatgctggtgggttgagtcccagcgattggaaagcctgagaattgagtctcagagattgaaatgctggtgggttgagtcccagagattggaatgtcattgaaagttggtgggttgagtcccattgtctggaatgccggagattttagtcccagagattggaatgccggagaattgagtcccagtattggaatgctggtggcctgattttcagtgattggaatgtcattgaaagttggtgtgctgagtcccaatgtttagaatgccgcagatttgagtcccagtgtttggaatgccggagatttgagtcccagtgtttggaatgccagagatttgagttccagtgattggaaagcctgagaattgagtcccagagattgaaatgagtagtataaagtcccaggggccggggtccagacccctgcccctgcttaaaaaaacacccatttttgttcttcatgattttgtcccaggtgccggggtccaaatccatgagagaattaattaaattaattcatccagaggcagagggactcgaacccaatatccctagagcaggggtccatatacttgcttccattcagcacccatttaacaaggatggatttaattcatttacaagcaaacggactcgaacatccagagggtcaaatacacaacactaccaaccggccaaccatctagttatccaaaacgcgacaatctttttaaaaatttgtaattttaattattttaattaaacgaaaataatttaaggctaacgaattggaactttatatgtatcagttaaactcattgtacagccacttaaccacagtaatgacttaaaaaaggttcaaaggaaaattacattatagattgagctaattcaatctataattaattaacataaaccaattcgtataaaaatgatttatcacaaattgagaaataatatcgcagataaaaattattgtattaaaccttcaccaaaaaaaaaactttaaaaaaaaacttaaattataagaaaaaataatctcaccaccatcaccacccatttaacacttttgctcttggttcccttattgttcaactttctcgtcatcatctgacaccaaaattcgaagtgggcattttgaagcagaacggtctccattgtcagatgacgaactgtcatcagacgagtaaattttttgtttttttgatggtcgcgtcgggccgccactgcgaagcactggagccttgggcggtgccggtagctgtgataatttgagaaccgaagacgcagccgaaagcggagttgcgcaaaagtcacttgtgcgaccagaacttgtagcagaagctgcaccgggaagagaaacgtaagagcccctcccatcgggaatcgagctgacgacgcatgtattaccagtaactgcaccacgaacacccacgctaccacacaccacaccgcaattctgacccacaacagtctttgcgttgccagtaaccgcggtcaatgatcgtgtgataatttgcttgtgataattaaagacattaaataaatttcgttagttaactatctattttcagaatttgatatggtcctaaaattatttggacattttcaacattttcactatctataattatttttatttaaaacattttttcatacagaaaaaaactgaaattaataaaattagagaaaatagttttagaaaaatgttttataattatgaaaataattattatttaaatttgttgtacgtttgttattccattaaaaataatttgtcaaaaaaatgcaggtattttacaatgactatttttttcagatccattttcatgaaaatccgatacgttaaattacatacagaaatatgatgggttgcttcaccatcacggccatttccagtaacgggaccacaaccagcagcagagtttgcacaagctataataacattattattattatcaaagaaaaacacattttcaacatgaacagtagacttacagactccgcgcgcaattctcgggtcagttggccgagaatcttgtgtaacggttttttgagcggccggctgagcatgagatgaggcaacatttggtcctccttgctctgctggtccataagcgataacgatggtgaacgattctgccgcctgaccatccactttggcctaaaaattcttttaattaaagaaaaattttagtttgaatattaaacattaatcctaaaaatgcgtacaaaatggaagacaagagttttcgggttttaataaacgcccaaattaatagacagaataaaaaaaatttttaaatttgcaatatgatactgaaaatctctatataaatttattaaaatttgaaaataattctattaaaaataaaacttaccatttgtggtattgtgataaccattgaagaagcgctacatgagaatcggaactgtccgcttaaaacagcggacttggctttgcggtattcatggcgaatctttatcaatgctcgttctcgctggaccacttcttccatgcgtcgcattctcagctttcttttttcaacttttattttattcatttcgaaagcatgccgcaccgcggctaagtcgcgtttacggccacactttgccgtgtttgaagagccagcgtgttgttgttcactcattttttaaaaaataaatgcttataactcaaaaaaaaggtttttaaaattattttgagaaaataattttaatttttgggtaaaatcgaatttaattattttatgataatttaattctttttgggaaaataaattttaattattttgggatatggagtaggctaaggtatttggcgaagtttataagcataaaaaaatggcgcagtgtctgggtccgttccgattcgtcttaaacaacagacagtgattacacgggagaaaatcggctaggacggacaggcgcggaaatgttgcgaagattgagacggagattgctgcgaaattttgtgcattttggagccgaggcaatcaatcacacacaaaattttcaaaatccagacaaatgtgag

SEQ ID NO: 6843 - DNA, 1196 bp, Heterodera glycines
  misc_feature (14)..(15): n is a, c, g, or t
atatgcaaacacannaactcatcaatcaccaaaaataccagacgtattttgatcaaaaaaacttaacataatttattctaaagccggatctaggcgttaaactggtaaaaagtgccttcattctactgatcttggcagactgataaatcatattgtcacatttaccaaaaaaaatatactagacagttgtgaaaaccggacttaatgactttgtttgggtataaaagaagaccaaaatttctttcgaatgcagaataaatttaaattattaaaagttaattaactttaatatttaactgcaattaaaacaaacaatcagacaacacttcttctttattacacccaccaccaaagaaggacaatggaaagtaaggcttttgtagcgagttactgttattctttaacagttaattaatatttattaaaatacttttttttaaataaatttattcttttcttgcaaaataatattaaattggcatgaaatcgttctattttacttacgccagcaattttgtaaaaatggatacgttatcttttttttaaaattaataaatttattccttgcaaaattatcaataaatttgtatgaaatcgttctattttactcgcgccagcaattttataaaaaaattgatgcaaaattaatgataaaactggcgcaaaaatagcccatatttaattaagtgctaattttaataaataaactaccaatttcggagagagtaaaatttctttattttaatgtatcaacatagtgaccttttttcaagtttgatgctcttacttttacttcttttacttatatgacacttttgcaaaaaaaaaacaaacgaaaaatgccaattcatttcaaaacagcctttattgcatttatttgtaacaatttgcactaaactttttatcaatttcggagagagtaaaatttctttattttaatgtatcaacatagtgaccttttttcaagtttgatgctcttacttttacttcttttacttatatgacacttttgcaaaaaaaaaaacaaacgaaaaatgccaactcatttcaaaacagcctttattgcatttatttgtaacaaattgcactaaacttttcaatattaaccgggaaaagtttgtctgtgccgcaggacatcaaaaacacatattttttatcgtaaatatttattagcaaaacaaatcgattcgagcaat

SEQ ID NO: 6844 - DNA, 2384 bp, Heterodera glycines
  misc_feature (21)..(21): n is a, c, g, or t
ttaaaaaaataatagcaacantttcaaaaaaaatattattacattacgcattttatattttttcagtgatatcgaaaaaaaacatcgatgaaaataaaacatctgccgaaatggcacagaaatttgcactgatcgattatgaccggaacggtcaaatttcaccattaaaactacagcgagtcctaaaaaacggcacgtctaaaccgttcaacatggagacgtgtcagctgatcattagaaaattcgacgaacaacgttgcggttatattggccttacaaaattcccagctctttgggatgtacggtttataaatgataagcagaaaattaaaatatcaaaaaatatataatattttttaaatttccaaaaccttaatatacttaatgcacttaagtgatgcgcctgtacaaaacaaaatatattttaatgcaaacattggggtttcgagtctaccaattacattaatttattcaaaataataaatgctgattaaaaaaaaaccttcatgagggttttaaagtttttatttgtgtctatttcacctatacgggaaattatccaaatttttttttcatttacatatcttttacatatttttgttttttttataaatgttttttacatataataacatttatatacatattatttaaatatttcgctatctttattacataaaattcccattcctaattattagtttttttctccacctgtatgtaaattcgggcaaattcaatgtaaaagaaaaattttttatttcaaaaaaaattcaaatatgtataaaagaaaacgtatttttctctgcgctctctttttatttcgttttgatttagtagtatacatatcaaatcattttgacaggattatgtgttctttaacgatacaatttaacgatttttattattacagtacataaacggatggaagtgggattttgcacacttctctgaacatatgggttttttaagtatgactcaactacagtatgctcttaccatatatggtaataacattttttttaaaaatatgttttattttttcaaggctatagttttactaccccgttttttaacattctgctacaccatttcgatcgaactaaatctggtattttttttttgctttaaaaatacatccttcaaaaggacgaatttacttcgatgattttattcatcttggcataactctaaagcgtcttacgccacccttccgtaatgctgacacggaccgtgacgggcgcgtaaatatacgtaagcaaaattttatctcatttttaggtgccaactcgttaatttttagtaataacataaaatttttcctccaattttttttttgcactaaataaaaatctaaatcagtttgcatctaaataaaatatttttcaacgaattatttaattttgtaaatctttgaagatttcgaggatttcatcttaatggtcttgaccgctgaagtttgatttctctacacaacccaatataaatagggatgatttgattaaaaatatcacttattctatttatctgtataaaattcttaattttaaaatcaaaaaaagcaattgcaaatatataaaaatatatttatgatatttaatacttatatggcaaatcatacacttgctaattcaatgtttacaccctcgtacccattaagcaaaaaaaatgagcggattaaaaagattccaaattgtcccatcctctcaaaaaagagtgaccgaagattttccaacgaatccaaaagatcttcgtgccattattcaatttaactcccctggcctattctatgtccgtgccagaattgccgatcttcagttttccctatacaaggtttcgggtcgtctattctagccaacattataaagtagcacggatttaggcctgtccgttgaagaattttggcacattttgtaagaaaaagcttgacgaggagctgtattgtgccagttgtgcccaccatgctaacaaggcaatccgcagtatttacttgagattggagctccgcgactgtgaagatccggagatttgccagactgttactgtcttttccaccgtagcggaacattacctgggcctcaaggttgaacgatttgccaaaatggtagaagagcagcctgaacagctcgaagcgttgcttaaatctaagattgagcgtactgtcaccgccaaacttagtataaaggttcacaaatttactacgtatataaatattatctttttgaattttaaggcaaagggtgagctcaagacgatggactggattgttctgtccatacagcatgagaacggggaaaacgatggagatgatgagacggctcctgatgaacaaaagaaaactgacaatgataacgaagatggagaaataatcgagattgagaaca

SEQ ID NO: 6845 - DNA, 1101 bp, Heterodera glycines
  misc_feature (954)..(954): n is a, c, g, or t
  misc_feature (1001)..(1001): n is a, c, g, or t
  misc_feature (1043)..(1043): n is a, c, g, or t
aattattaagctaaaaattggacggtggcacggcatttttccgcggctattccaaactttcatcttggcaaagaaacacagagtgccattttaattgatgttttggacagtttgattcaaatttgggcattattttttgcaaattatcaggtcaaattggactacaaatttgaaaaaatactcaaggaacctaattatgatctgaagttgctgaatgaacacgaatttgaacaacttggaaaaattgggcaaaaccttgtaaaaaaatttaaagaaattaaattttttggaagccaaaatcaaacaaaacatttgacagcggaaaagggtaacaaaaaagaacttaccgtagctttactcacaacaggagaagagaaaagtgtgattaacactaatgaagaagcaattagcacacttaatgaagaatttgatgcaatgatgaaagaaaaggccgaaaaagttgactcggatgaagaatatggcaaaatgaacaaagaagcattgaaatggctggtacagtgattgctgattgcttttattcctatttttcactaaaatttctgtatttgaattcattttggcggggggagggagttaaggcatctcatccaaagcagggctgcacgcaagtggatttacaattacggaaatccgcaatccgcaattgcggcgattttctcagttgcggaaatccgcaatccgcaattacgggtgtccaaaaaccccgcaatttccgtaatttccgtaatccgcaatccgcaattaaaaaattttttttttaataattttaaattttattttaaaaaatcctataaatcttttaaagcaatttaaaagcatattaaaaagcaaatttataaaagcaaaatcattcaattgagaaaccagttaaaagcaaattgtgatgaagaaacaaaagttttgcaagattttctttaagtttgacatttttanattgctaaagaaataagaatttaaacaaatgtacatattttctttanataaaaatagaaaaaaattcattttataaaaaataatcttancagaaatcgtctcgaaaaataatccaatagtcaaattacggatcaaaattgcggataa

SEQ ID NO: 6846 - DNA, 3140 bp, Heterodera glycines
ttttcttgataaaattttttatttaaaaattggccttctttaaaaaaaagttgaaatatttaaattactttcatttgcaatgaaatatagacaaaataaaaatgtttatttgcctatttttgtgcctatttaatgcatatttttgcgttttttgtgcctaaaaaaggaatccctattaattaatgaatgcatataaatttaatttataaattttaaaaataaatgattaaaaatgttttttttaatttaaaattacggaaaaacaaaggaatattctcgagaagaaaaatgtgaatgaaaatcaatatgtgtatgtatgtacgcgagcaaatgttggtgaagttaagttgaaggaaatgggaacgaaacgggccagttgcgtctgagccaagtttagaccaccataacttttttctttgttgaccaaatccaacaaagttggaaacattcgaaagctcttaacaagctctataggttttcccaaaaagcgcaaagatataccgacatgtaaaaaagttataaattaaaatagcaaaaattctgactttttggtagtgttcatgttgcaactttttgataagttgttcaatcgcttagcaatatcttatcaaaagcttctaaacatgtagagctttcgaatgatgccaaatttataaaatttgacaaacaaagaaaaaagttatggtgctttatgcttggctcagacgcaactggcccctaccgtataaaaaaggcaataaaatagccaaatgccaaaagcaaaaaataaataatcaaaattcaaattaaaaatattttcatgttgttaagtattccatgtttattattaaaaattatggatgagtttccctgtatgatttgcctgtggatgagatgtctttggataacatttatctgtccttttggggagtctttcactcttatctttgtgttggtcttttgtgacgataaaattgtgatcagatttaatgattgcaatgattttatttttaccttttaaaatttttccttttgaagtaaaatatttggcgctatttacaaagcgtagtatttgaaaattttttgcacttttttgtctaaattttttcaatttttttcagtttaaaaagtcctgaaaccaagtacctgggggttttcgaggtcactgatcacgaatatgacaatttttacgaatatataaaaataaaatctaaaaataaagtgttttttgattgattaacagggctgtcaaaaatatgcacaaaaagtggccaaaatatgcgcataaatatgcaaataaagtcgtgaaatatgcatcaaatatgcacaaaaatcgtaaaatatgcaccaaatatgcacaaaaagacttgaaattaggggtgtaaattaattaaaaaattttattcctcataattttaccggttgtttttgcaatttcaaatcaaaaatttctgaagatttccggcagtgaaagctcactcactgttgacccactcgcgcacccattcagatttggatttaattttaggcataatcaattttttttttcttaagggatattcaaaccggaaaatatttgacgagaaatacaaaaaacctgaaaatatgtataaaaatggcaaaatatgcatgaaatatgcagaaaaacccaaaatatgcaaaaagttccatgttaaaaaaacaaattctgcataaaaaaaaactatgcaaaaaaaagtgaaaaaaatttccaaaaacggccacttttaaagtagcgccgtttttttcctactattcagagcatggagaatccaggaaaaaaatatgcatttgcatatttttgacagccctgttgattatattttaagaatgattcaaaaattttagaatttttcaggaaaaaaaatatgtaatttttcgtgtttttggggcgttcgagtttcgtattttgctttagtttcgcattttatttttcgattcccaacatccctgatccgcactattaccgaggaatgaatcccccaacttcttttccgtttcatggttttctttggtacaaggtgtgaataataaatgatgatgatgaagaacggatggatggaatgaatcaggttgggggatgaacagatgagagggaggaggagacgaccgtctcccacccctaaaaacatttttttccttttccccattttcttcccccgtcctctcccctctcttctgcagctttccgctgttgagaatgaaaatgggaatcgatttcaacgatgatgtgtgaagagagagcgattttcctccatcatcatcccttcccctccctccccccatccgccccaattccgccaccatttttgtgtgtgtgtgtttatcggctatcctcttctattccacacccaaacatccttttttcatttctatccccaaaaactttaaattcgggaaaaatggtttttattcatctggcgtgaccaaaaatctcataaatccattgcttgtactatgtgtggagatgaatgaattgcgtccaatgtatctacatactgttcatttgcgacgacgatttggctcaaattttcaatccctcccaaaaatttgttcggaatttcagaattttgtttttttaatgctaacagaatcagtgactacatattatttccttaaggcgcgacccctcggggaagaaattctcggggagcgcggaggaggacaggtcggggagaagtcccaaaaatgtaggggacggggttgaaccctaccaatttatttgaaggttgtcgtatcattcatattcaatgccaaaactggtaaaactaaaaaaaaaaatttttttttttaaagtgtgggaaggcctcacaaaatttttttttgaccagtcacagacagcatgcatcaacaattaatgacatttgtttagatttgctgcaatttcaattccattttttaaattttgtcgacaaattaaacagtgccgaaaactaaatgacttccagggatgacgaatatgactatttgtttaagggtttgtcattgcattttttggcatcaaaaatggccaaattttttttttcatttatgccatgtaaattataacgatttttattttgtttattaatctgaaagtgccggactaaaaagcgtcacaaaaaccactgtttgtttgagttcgaaattggtcaaaaatggat

SEQ ID NO: 6847 - DNA, 2588 bp, Heterodera glycines
ttccgtcccagcccattcattttaaagtcatttttttggtgtttcagttgtattaatcggcgactcgggggtcggcaagtccaacctgttgtcccgcttcacgcgcaacgagttcaacctggaaagcaagtcgaccatcggagtggagtttgccacgcgaagcatccaggttttgttttgccccacccaattaggcctgggcatgaaaattattggaaatcccgtacttttagcagccggattttatgggtcagtaaacagcattaaatttttaagaaaaaattctgttgtttgaaaactcaaatttaaaccatttaggtattcttttttttaattaaaaaggatattttctttcaaatattttttaaataaaaaatatgtaaatttttttttaaatttttctattcaaaattcttgtacttaaatgggctccagtttttttttttggggtataactccttagtagttgatcgaagcgaataaatttagtgtatttgatagccttaaatgttctcggtctacctgccaaatttcaaaaaattccgttagattatacaaaaaaaagtgttgcgatcaaaaaattacaaaaaaaaaaaaaacataaatttttgtgtcattcgatagccctaattgctctttgtttgtctgtcgaatttctttaaaaaacttacgacaaaaaaaatttaaaaaacgtgttttcccgaacacttggccttgacttttttttaaacgggagtcgaaaacccgaaaaacgattccattcaaaaaaaatttttaatgattattccaggtcgactccaaaacggtgaaagcgcaaatttgggacacggcgggccaggagcgctaccgggccatcacttccgcgtactaccggggcgccgtcggtgcactgctcgtctacgacattgccaagcatgtgacctacgagaatgtggagcggtggctgaaaggtgtttgtgtgtgccggacggaaaaaaatggggaaatttacggcggaaatttttggtttaccagaaattttctgtgtgccaaaatccgacattttgaaaaacttggacatggattttctgggtaaaaatcccattccttgtagagacctggacccaggaaaaaaaccaggcctggatcggggtcgatccaatattttttcaaaaattatttctactttttcattttctggcatttttttttcttggcggggacaattttgtaggcctcttcagcctcttcaccggtgtggggaacagcctcagattaattggacaaaatagcgaaatgacgtattttcactataatcgttttttaaaatttaattttgcggcaaaaatggaaaatttaattttttaattgaattttttccgggacatgcgctggggacagcagcctcagattaaattgctttcttaactttaataccccgttttttgtccaatgtatttttttttaatttggtgacattggaaaaaaaaggaattttttttttagaattttttgctaaatttagcccattgagataacatttgcaaaaaaaacattgaattattgagagccggcgactgttttctcgctttttttataatgtgtctgtcacattttttagagttgcgcgaccattccgaccaaaacattgtgatcatgctggtgggcaacaagagcgacctgcgccatctgcgggcagtgccggtgaattttagtgaaaaattccaaagaaaaaatttggcagtcgtcagttttttttgaaatttacgaggccaaaaattgggtatactttgtctcctctcgaaaaatttttaatttataaaattttcaaaaaattaaaaaaaaatttttttttgaaaacttggaaatcatcataaaagtgaaaaattttttaaatcttttttaaaaaaaactccaaaattgtatttcaagattaaatttttactttccccaaagactgacgaggccaaggcgtacgcggagcgcaaccagctgtcattcattgagaccagcgcgttggacgccaccaatgtggaggacgcgttcaccaacattctgaccgaaatttatcgctctgtcagcacacggtaagtaaaacaaaaacaaacaaaaaactgatctgaggggctgattaacccccgattttactcaaaatttgcaacaaaaaaaaaaatttcaccagcagcaaaacctcataaattttttaaaaataaggcttgcggtattccagaccacaatcccccatattttttggaaaattgctagtttaaactcttcaatatcggtacgccaaaaaaaacaattgaattttggtgccgctatcggatctgcaaatttgaattgttgttagagatcgacattttgaaaaaagcctggacctggacctggattccatgttggacctggacctggacttcctggacaaaaatccaggaaaatccaggtccaggaaaaatccaggctcatcgaacctggatccaggcctggacctggattttttgaaatttattttaaaaatcaaaagaatgtttgaaaaaattaattatttgcgtagaagcatctaaaaatatgtaataaataataataatgtgtttttaaatttatttaat

SEQ ID NO: 6848 - DNA, 4351 bp, Heterodera glycines
cgctttatctcgttgtccactcggtccttcggacacaatgcgaacagccgagtccaactttggctccttggtcagcggattgttgcactacaaaaaagcattttttaaataatggaatattcgagaatttgtgtgattttcgaaataatagtgtttacaagatcaatggtcttcgcactgtccttggacacgtcgtcacaccacgtctcgcaccacagccattcctggggcagcgagtggatgcgcacttggtgaatctgaaacattgaggaatggggataaaaatggaatgaattttctgtaaaaaatatgagaatttgatttttttttcgcagaaaataaacgcttaaaaaatctaattcttgggatcagaaaggccgaagttggagagcataactttcccactcacggaaatgaaaaaaaaattcaaacttagaaattaaaaaaattttctagaaaatatttttacaagaaaattgcaagaaaaagatttagttgaaaaatttttctaggggttttttcgaatctttgaaaaaattagtaatacaatataaaattttgaaaaatcgctttaagattttttctaaatgttcttacttgtaattttcttataaaaaattctctaatttcttttgaaaaattttggtttgtgattttttttttaaatttcggggaagagaacgatggcggtgactgatgtcgccgtcagacacactaaactcaaaaatgcatagaattgacgaattttggtgtaaagtttgtcaacaaattgcttgccaactcaccatgttgttgggcaaatcctggtccaggtttgacaacgagttcgggtcggagctgagcccttggtattggccacggagacgatcgccggcggcaatttggctgaaaatatttacaaagcatttaataatttgatgattaaaaaacatttttgaaaatcaacacaccgaaatttgaccaaatccaccacgtaaagagcactgatgtggtatttgcggcccgccaaatgctgggcccagtagccgctccgccagaaccgaaagccgtccatggacttgcgactgtcgcaaaacggcgtgtagctgcaaaagcaaatttcaatcatacatatacaaggggtgtctcgagacacccccccccccccccctcgttcgtcgtagggggggggggtcgtcgcggagtgtggtcgtaacgaagagggaaaatttccttagcgaaacatacaaaattcaaaaaaattttcccggcggcgcctacgcaaagaaaaagagtgtggctgaatagaaaaaaaagaataaatataatataaagatgtgagaaaacgcggatgcttatatggagagagaaagcgtaggtggagcaattttagcagagcgacaaacaacaaaaaagagtgactaatactaagcacagaaatcacatcacaggaatataaaaaatcacaattattcaaaattatccaaattaactcaattaaatttctcttcctcaatttccttccatttctctctctctctctctctttttccctcatttcttctttttctccactttcttagtcgctttggcgacagcccttgggctgagacaccccttgtacatgtatgaatggcacacaattaatcggaaacagtcctaattggttctaattaagcacacccttctgccggaccaagccctcgaattggccaaggccgcttctcaagtgacgacagcgaacgcaaatcgcaatcagcgaacggcacaacaacagctgcaagcacccactcaaaatggtggggacacttcctcctcttccacgtcttccgttgtcagtgagcgaaggacatcacaaatggcttatttcgaatttcccgaggtaaataattcatttatttaaaatccagaaacaatttgagattaaatgatcccctttcaggctgattttgacagtttggaagcactcgttgagtttgcgtacaccgcccgacttcgaattggaagtcgccgggtaaaggagctttaccgggtaaggagtgtttttgttgtgcttttttgttttccgtttgattcaccattttgattgacgtcctcaatcaatcaataatcaatcaatcgatcgattggtcagactgcctttgctctccaagtgtcctcggtggctcaggcgtgtgcccattggctagccgaacacctcaccgtcagcaactgcatcggtcttagcaaaaaagcaaatctctttcttaaacggttcaattcacatatgcacaggggccacttttccgttcccctccatttctcataaaggggggggagtatagaaagggttgaagaacacaaaattttgtcactgtttttgcaaatttttttccttgtgcatgtgtgatttaagttcttccagtgtttctgacaaatccaaaatttccaaaaattattctgcaaatctgtttcccgattttttttcataagaaagtacaattgaaacaccggttcattcctctttcttgggaccttaaaattcttatctcatcagtttttactggatcaagttgataattttttgctccataatgcaattaaattttattacctacagtatagtttttctgtcttgcactgttctttggtcttttgtcccttttttaattccattattttgtgggtcctttggtgactcattctctccattatcaatttatcactgattcgtttgttttttgttatctgatcatttaaggtattcatcgtcaagccaacctcaacaaagacgcttttctgttgagccgagtgaacactttcatccgtgacaatttcgaggcggtggtcggcgatagttcggagtttgcgcaattgccgtgtatcaaaagtcggattatcgtttcggcctccgacgggggaagagaatttggtgaattttgattcgaaattctaatgacacattgatttgctcttaattacgataagtaattattgtgtctatttgcatttgcagcagcacaaagtgaccaatcgcacctcaaagcgccccttctcccctcgggggatgaactcgccctgcgctgtcttcgctatttccagcacagcgcactccgcgcagcgggcgaacgcgtcgatgcgcacatcgaatcactggcggagaaaacgcaccttttggtgaccaactcggaggagcagcacaaaccactggcgaacaacaatgggggcgcaagcagtgcggcgccgacgatggcaaacaatggcaatgggcagcagcacaacaacggacgactgcaggacgccaacgaattggacgagaaagtgctgtggggggggggggaatgtgggatttgcaggaacacattaaaacaaaacacgacatgatgttacaaaactccgacaaaaaactttcatttcattggaaatccatggtaaattcggtttcagagtatgttgggatcgtgtgacctcgtcagggactacaaacggagcgcgagcatagcagcgagcgggaaaaagtcctttattgtagcatcatcaataccgaatttggatttttcctatttgttaggcttttgtcgagcaaaaccgaccaacagtcgtcgcttcacgtgatgggtgccaccccaattaagctgaacggtgccgacatgggaagactttcgaccaaggatgccattaaattcgcttcatggtgataaaaaagtgcgaaaatattttcttactaatttccaatcagtgagtcgctatgttcggtgggcagttgctgctccaacggaagcattccgtccgaaggcattgccgtaaacggcgattcgctcgccgccgtcaattccatcgcctgtcgtcagataatttgtgtactgcccactgctcccggcttctgggtttgtctggccctgctcttccaccggttggtccgcatcagcatccatctcagcgaggacgaggaactaatccgaaggcatcgcgaagatagagaaataattttgcattcactcccttttcagcagtcgtacaagttcagtcgcgagcagtacagatgggattggtgccgagtcggatggttcggtcacctcaaccgacgaccatggctccaccgacggcactgttgatggccgacgcgcagttctacctgcgcttggcgaagcacgttgtgccattggagcagcctttttggacggaaaaatcctgatttcgggcggatacgaccgaaatctttgcttacgaacatcggaggaattagacatttgtggcggagcggaagagtggcgacagttggcaccgatgtgttgcgaaagggcacgttttgacgcggcggtggtcaacggaaaagtctgggggaatcacaaaagataataaaaagaaaatgtgaaatcgcaggtgttcgcag

SEQ ID NO: 6849 - DNA, 1416 bp, Heterodera glycines
  misc_feature (8)..(9): n is a, c, g, or t
  misc_feature (21)..(21): n is a, c, g, or t
tcctctanngagtccggaaanagtctggggggaatcacacaaataataaaaagaaaatgtgaaatcgcaggtgttcgcagtgtgtggctccaacgggaacaacgacctttcctcctgcgaatgttttgacccgacgacgggacgatggaacgaagtgtgtccgttggagccggcaagaagccacaacggtaaggaaggaggaggagacggggacggcattttggcaaaatgggcaccacgagttcaggttgtgcttccctcagcggactgctctattgcattggcggctccactgatcacgcaactttgggcgattgcaggtgctacgacccggcgacaaacgaatggcgagagatcgcaccgctaaaggcacaacggtcacaggtgggcataaaaaatttaatgaatttttcgtaaaaaatttttaatgatggggggggctgatccgtggggaaagggcgggggaaaccagtgtatcatactaccacaggctggctgcacggcgtggcgtggtttggtcgtgtgcgttggcggctgcgacaagtggaactgtttggactcggtggaggcgtacgacccgcaaatggaccaatggcatcaccttgcgcgtctccgtacgcctcgtcgcggctgtgcggtcgctgtgctcggcaattcgttgtttgctattggcggtcacgatggtcacaacgtgctggccaccgtcgaagttttggactcgccaaacgcacagtggcgccctggcccatctatgcagcagagcgctcgtgttcaccaccacgcgatttccgcctcgggcattggcatttttgtcgtcggcggatttgacggcacacattttttggccagcatggaagtaatggagagcgaggagagtggtgagacggatgtttaaatgtggaaacaaattctaatttaaaattttaaaggttggcatttttcgcttgacgaccggaaggtggaagtggatccgacacttactctaattagcgggtctgacagaagcgagacggcggacgatgagcccgaaactgccagcacgacgccgaccccgcgaggatgaaaaaaacgaaaatttccgctaggattgcattgtttgtgtttgttggattgtacgttatgccaatcattcaacggagaatggtttctgatcttccgggttttgctttcttcagttatcttttatttacctctaaattaaatttatagtataagatccgactctttccctttaactggcatttgacgaatgaaatgacagcttgaatttcatcaccgtcctattgttaatcatattatttagcccaaggcaactgtttcgatgaaacatttatgaaaaataaataatgtaaataaaatacaaaacaatgagaaatacgagctaaacaaattgcatctcaacaaatgaactggcgg

SEQ ID NO: 6850 - DNA, 1339 bp, Heterodera glycines
gctttttttgtataattagtgtgaccaaatatcgctttttcaactcacctctgtctcccaacggcacattttgctgttggatggcaaattgcattttgtttccgcccgtgtacactttggacactgacccgcggctcacttggtagcgataggcatgcccctgcaagaatttgacaatctttttctgttagtgttactgaaccacttacaaccggcggtggcacatagccttgggagtacggatgcgaacggggacggagttggggattttggtggtggtattggtactgctgctggacaatcctacgcaaaatggaatacttcaatattacgagcctcttccctttttaaaaacctatttttcgttgcatttttttaaattttggatttcagaggaggctttagcccccttcagcccccccccctttgggtaccccattcattttatacattgtggccggtgctgcttggattgtggtggtgggcgcaactgtcgcgtgcggtcgctgctgtagcggtggttgcgctccttcagcagaggcggaggacgaagtgcaagtgccggagacagtgttgacgccgtcgtcaccaatgacggtgggcgagccgagggaagtgccggtgccactgacgctgttcgactgctgctgcttttcagaaggaccgctgccacctccggtgagcagcatcaactgtttgtaagtgacagcgggcagaagagccgcgtcgctgggcgagatcagtcccgactcggaggacagggaaaagtccaacggattgtacaacagaggacgactcatcgctaaaggggaaatgaatgaatgcatcaggaagatgtggcaacaataaatttgatggaataattgtaatattaatacactgaccagcggttggtggcaattctctttccaacgcaatctttcgcaatcgctgtgcgtctgcaagtacggcgtcaatttcagcttctcaaaagaacagaaaataagcagatgaaaggtgttaaagggaaatgaacaattcaaatttgggcacttaaatactcttcacacccaccgtcgtcggtgctgctcatgtcatcaatttcgatgcgcccgtcccagattggtgccgaagttgtcaacgcggaggcatgcgatgtccaattgcgcttgaagtggacggtcgtcctttcagccgtttcagtgccctctctttcggcatggacaacaataatgcgctgatcctcgcccttttgttttgcctcggcttctctttgaagaacactttctgctgccgcttcttttcgatggtcagtgggtagcgttggagaaatttgctaaaggcaaaataacaatgccaa

SEQ ID NO: 6851 - DNA, 6272 bp, Heterodera glycines
  misc_feature (64)..(64): n is a, c, g, or t
attcgggttcttacgcctctttccttcttcacagtgtcctaaaactccgattgcgacatttcgnccggttggtttcccctgcgttgcgcgagttgcctttgcaccacttgttcagtggccatgccggcgtggtcaaagcctggggtccaacgaacctatgagagttcataaaatggcaaaataactttcttccacaacttttttcccgagtaatcgctggtagcgacatattgcgtcttcgagggcgacagtgatggcatggccaatgtgcaagttgcctgtcacattcggaggtggcaaaaccattcggaagacttcttgggatggagaatcgacaaattgatgtgaagatgacgtcgcttcatcatagtgctgctggataagctgaatggctttctcattgtaggtaccaaatttggataaactaaatattaaatagaaataataaattgttgcatatacttgaaaactaacgaactgacttcgtcaaattgcgaacatgcaaattacatgaaaaatgaagataagagcgcaatctcaataatttcatctcaatttctgaatttaattgccaaaatcaagtttcatcaagcatatcccatcgaacatttgatttagagattaatttaaagtttagcaaaatgatttaagataaaatttttaaaatttaaagaactgctggaaagtgatcgaccgaaccctttcaagaaaaacacatttttatgaccaggaaaaacccgtcccagtttagtttctctctctgttcccccccccccccaccttcccacacagttcaagtgtcctaggcatttaataaaatgaatcaatgtgaaagattaattgtgtcactttttttccgctgatcgtttatcattgggttggtaattaggtaggtataattttattcgcaactccatttcccccccccccccccgcctttttttatttgctcccaccacacattcattcatttctcattatttattgccttttaacattttcttcgttgcacatagacatttaagaaaatggtattacacatcattaatgtaagaaattaattcttttgagtcgatgcatcaacatttcttccattcattctccgcgttcagcaggccgtcatcattttagttcaattataatgtgaatgagaatatacatttgtttcaaaatcatttttatccttaaatgctgctattaaggaaaaatattcagacgaaccaacatattcgtttatttttaactgtttttagattcatataaaaataaaaaaggcaatttcgccttatataattaattttctcccaatcaaattcatttcgtctctatgctacataaataaaaccaacacaaagaccaaacgacaaaataaattagaagaaaaaattgctattgcaattcaaaaggacatatattttacaacgacaaagcaaaaatgactacggaatcacttgtcatccccaaggacatagccaataaaagtaataaattaacaaggaaaacttagtgaaatcggaaatattgttttcgtttcattcctgaattttttttacactttttagattatttgaagggggagggtccggcaaatgcgacaagggaaaatctttggaaaataaagcaattatattaaaaaaaacagaaaattttcaaaatgtctatcaatttaattgaggaattcttacaataacaataggaataagacggtttctcaacaataacgaggcaaaactaattaaaagtcatttagtcatcgatgaactcgaccagaattcattcgaacgatggaaacgaaagggatgcgttctcgaaattgtttgtgaatttttgtttccttcatttttatttccccatttataaacagaagcagaggaacaacgtgcgcttgtttcttaatgggactttgacagaaaatgagtgagtgaaatcatttcgattttagtggaaattactcggactaaaattcttacttttttttattcttccaggactttgcttacaaatgaaatctttcccttgttcaaacaagcgcgagaagctcttggttcagacagttttatatttacgcttggtctgcttattccgaacccaaaatgcggctatgtgatcggcaaagaggggaaaaccgtccaaaaaattcaggttgtacagaactcgggtccacattattaacgttggattccgatgaaaatcaaaaataaatgcgctaattttgaataatttatacattgtttgtcgaaaaaacatttattttccataaaatattctttcgaaaaatggacatacttaaaatgttacgcgaatttgcaatgttttacaggaatgaaaccagaaaaattctgggaggggagtcggtgcactcggggacagtcccaggattttatctggggggggggggggtacctcccctcggacgacgaccccttttttttgcttttcacaccactttttttgcggcggttttcccaaaaaacttttggggaacagggggtcctgctatttgttgacgaattttgtccaaaaagtgacagattttgagtcgttttttagcagattttcttcaaaaaattgtggttttttttggaaaatttgggtgaggctaggtctgggggggtaccagaaaggaaaatctaaaattttcagcaaaaaactatcttttcccttaaaaaatgtctatgttattttaaaaattcaaattcctatatttattgccccccttttgcttgcgggcttggtaaccaataaaatttttcattgttttcaagtgtttttttctattttttaaaattacattaatttaggatgattttggggtcgaaatatttattgacaatggcaagagagaacccgtgccggaagggttcgcccgtctgttcgttcgctcttcggacattgactcaatgcgctgggcccgggcagaggtaaaactgacagaatatgcgaaaacaataaaaatacaattgtttttttatgtgttccataaaaatcgagaaagttttctccatatcatcccaatttccgtctccaattctaaaaaatgtctttgctaaactttgacaaaaagggttcatttttttcgagtcctcctttggctttttctatttgtatcaaatttcactgatttggtattgttcatttgttatgattattagtgctcggaattatatggatatatttcacgaagtttaaaatgaattgtcttacttggaataacagctaacacccgaacgtttgtaaaaaaaaacttttgaatgtatgaattttgaaattttgcaggatggtagccctataccgaggtattttcctgcaaaatttcaaattctgacactacgaaatgaacaggataatcaacgtttttaattcgtgaaagttatattatataaatccgagctctactaattatgcgctattgccaattaaattaataattcacaaaaattgcggtctgccgaaagctgcaaatttcataatttagttgtacggtgccaaaaagttttccttttttacatttatgttttccaatattttcctattcatttaatttacatatttttgctcaatttcctttcattgctctccgtaatttgctcttcccaaaaacaattttctcatcactggtgattcattttcattcattcatcggccaaaatgtccttttccaaatttggtagccctcttccccccaattattcaatcactttttgactttcatttagaattcagtatttttgttgaatgcgtttcaaaggccgccattctcagattcgtcgactcgaggcgcgttcattggagttcaatccgtacgcaatgccaagggacaacaaaaagcgatcggcggacggcaaatggatgacacagaatgaacgaatcaaattgccaccatttggacactttaccagcgaacagcaaatgcattttcgagaaattcaggtcgtcggaatgggaaatttcttgaaaaacgcggcaatttttcattttagtggcatttatttaatttaaaaaatttctgtagaaatcgtcggccatcaattgggttttcgatgagctgctcaatttgacggaggcgggcgacggacgctttgtgactttggaaggcgacgccgaattggtgctcagtgcgaagaagcgactggcaaaactgatcaccgaaattgaggtggcaaacaaaaggcttaagtcgtgccaaatttggcaattccctgccaaacaaattcccatttttctattatttttcaatggtcatattaggctcttctttcaggattcccatctccattcttcgtccgttcggctggccaattcgccgaccaccggccgaacgctctatcgaacggttgtcaaagtgccgtcgcccgcctggcgattagtcatcggaggcggtgggaagacaatcaaagggttgaaggtgggtgtcatcaacccaaatggctttgctaatacaacgaatgaatacttttaggagcgttttggcgtgtccatgcgctttttgggcgacaatttcgttgcctacccgcacttccgatcacttagcatctttggacacgatcaaatgaatgttcattcggctcgcgagcacattgagcgcgaatttgtggcgaaaaatgacgaatatttgggagtgcgtaaaaacttttccaattattaaattatttatttttaaaattggaaacaatcattataaatgggaattagcattttaagcaaaacacttcccaagcgaaagcaaaaggacgtaggaaattcctttccacgacggatgacccgaacaataacatcgatttgatcgatgcgaatgcatacggacacaaaacggagattggcggatgggaatcggacgaagtgaggcacaaagacagaactcgaattattttctcagcattctcccgatgattaataatgcataatgactcttttttttaataaaattaattatgttttacttcattttttctattttaaggaatcgtgggctgtagatgaaccgcatgtttgctctgatttcacaatgaatgaacagaaaactgatgaaacagtgtcaaattcggaggaggaattgctgaaatgggatgacgaagacaaagaagaagataaagaggaagaacaaaaggatgaaaagaagacaaaatccaacatttttggaggagagagaggacagaacggaggagacggaaacactgtgaaggaattgggaaaagaggcagagagtgcgaagaatgaagacagcggaattgtgggagacggagaggaggacgaactctttttgctcattgaggggaaagggacgcaaaaagacggggacgatgacgaagtcggaggaaggggaggacgaagtcaaagcggggagcaccagcaacagatcagcgccgaatttggcacgggcgaaataacaaagcgacgaacgaccaggtgaggaggagaagcatttgggattagttggcactcttccgaaacacagtctgagcgatggcattggcaattcctgcgtctcggccgcttcctccgccgatttctacgccgacgagacggtgcaacagctgatatttcagccattggatcgtaatgccttggcttgtcaattagaacgtgccaaagcgacgctgctcggcgatgaacatttgtcccgggagttggcgcgtacggtaggtgtttggggatactctcgtactgttttacagtacctatcaaaatgatattattgctcaatttcagcaagcccttctccgtgcccgggagcgcgagtgcgagcagttgcgtttggaaaatcagcgtctcaaacttcaattatcttcatcgaccgtagcataaagaaaagaaaacggaaatataaagaaaaagccacaaaatttgaccaacagaaagaaatgaagagaaaagattatttagaagcgattttagatttcgtttttccacggagttgcatttgtttgatgcctgacctttaagcccttttatttgttccctccggcgggtgtgtccgactttgtgtgccatgccttttttttgccgttatcaccttttgccatgtgtttgattcaatatattttttgaggagatttttccttaaaaagattgaattgaatggatggcctggatctaaaagcaccacacttttccatctcatcttattttcgaatttgtgccactagctttgtatttgcatgatctttgcttgtttacattgattgagttaagaaagacgagttaattgctctgtgcattttcacttaaaactgaagtgtactttgtgtatctctctgattcgaccgtgtcat

SEQ ID NO: 6852 - DNA, 2031 bp, Heterodera glycines
ctccgaatgtgtcattgcggctccaattcgtttcccttgggcgttcgattgcgcgactgcacccatctcagctgcgttcaatgtttcgtcgcatatgctgaagaacttttgtcccggatgagtctaaaatggcacccccaagtcggttacaccgtcggatgccccttttacgggtgcaccggtaaaagcgcttaatttttcgctttttaaattggcatttttccattgccctttttgtttcacaattccaacgcacttcagctgtcgtcaccgatgttcacactttgtatttgctggacaagcattaataacagcaataaaaacaaagcggacgcctcttcccccctctgtcccacaaaatttttggaaaaagcgcgccacaaaaaaagcgtttttaaagcagaaaaaagtcgtcgtaaatgaggaaaatgatcaggggaaataaaaaaatattggaaaaaatccattccggtgaaaaatacaagccatttgaataaatattaaccatttttcattgcatataataaaaattttaaatgtccttgaatttcatgaattttccccactatgtccttgcaaatcggcatacccgtccttggaagccgaccttggacgatggcagccctgagttagaacaattaatggtaatagtaccgatggtagtaccccttttttgaaaaaaagttaattttaaaagtcccaagaacaactttctaggggttttcggaatcgctgagcacgaatttggcacccgtttagaccaatttcgaaccccggacccgaattcgaacaaaaattcgaaaattcaaatttttaaaattcaatttatccgacaaaatcgattcatttgcacgaaggaacagcggaatgagcctattcacatggataaaactcagacttgcgaccaaaaattataaaacacgttttcaagatcaccaaagcgctgactccaaataaattcaggaaaatgtgtcgtaggcttacgaaacgaatcgaaacgacttacacaccgtttcaaaaaacgagatgtgtaccaataaatagagagtgccagagaaaaacattatctttttttctctaattttttgtctccttttggtgtactatctaatatttttattattaggaaaaacaacattccttctctccatataactttttttaatccatacaatctgcaccaaattttgcatatcgatagagaaaaaaataacacattcagtaatacatccattttatattttatacactctttcatgagatatattaagatttgtaataaaaaattattttgtgatttaatggcaaaattaaagcgaaatataaaaacagaggcggtgaaacagcggtggaaaaagcaagaggagcgaaggaccaaaatggcaaaggcgacgaaagcccgatgggccaagaaaagtgagttttttcactaattttaattcaagatcatttttttaaatttcagccgctccacagctgaatcccaatgccgaaattccaccgcaggacgaagcagggccgaggataggggcccgaagggaacaatttcgaaaaagggatttgaccggcaactcaataagaaaaattttggttcgcgctacagaaatggacgaacttttcacaatggaatggcccaaagctatttgtaggacactcgaacacctcggcaaaattcaaatttttttcaaaagtgttttgtccgattttattaagataaaatcataaattttaggcacaaattttgtccccaaatgacccaaggcccatcttctactcttccacttagtattgaaatgacatatattgaaacgacttagtattgaaatgacatatattgaaacgacatgtagccgtagaatcgatgtggaagaaattgaagagaaattttaagcaacagtttgacaacaaaactgaagcctacgacacattttcctgaatttatttggagtcagcgctttggtgatcttgaaaacgtgttttataatttttggtcgcaagtctgagttttatccatgtgaataggctcattcc

SEQ ID NO: 6853 - DNA, 2648 bp, Heterodera glycines
aagcataaaattcgaaaatcgtatggcagatatactcatgggcatcttgtcaatgagggtattattggtacaggaagcctatcaattctttgtccatgtacatctcatgtagtgtatggtagcgctgatctgagtccgacattcgtgatcagcgacctcgagacccccttaacacttattttcattaatttctgaaacacatttataggcatttgaaaatgtatgtgaaatctgtcccttaaactgcaaaagtttttctaggctaaaatccacttagatttttttttaatctaaaattctaaattttagttgaaaattcttagacttttttttttgtacgagttgccctgtgtacgagttgccatgacacccttgattcgaaccaaccctttgggactgaaccacccaaagggtaaaaatgctaaaggtgcatcaaaacataccaattgattcctctcggtctgtaaaatgatgaatccggaagaattttcaatgcgaagggtaaaagtttttcgggttttaaggatacactcttttggttgcatatacacgacagaaatcgccaaaagaggtgcgtcgtttgtccataatcttggaattttaataccgttccgtttagctctattcgtcttccaccggtgagtgaacaattctgcccaattgattttctcttcaaaaagtcgttttcttcgcggaatgcctgaaattactcataacgctgtttttcattttccgtgactgtgatttttcaacagaaaagtgtaaaaaggtgatgtgacaaatttattgtacaataaaccccccaacatgcagttgttggaccgcgagtacttctccaaaccgatggaacttttgaagatgagcgttccatcaattgcttacgctattcaaaatgtgtgcctctttggccttcactcgttttaacatttcaatacttttcagaatttggacttcgtctccctgtccaatttggatgcttctgtttaccaagtgatgactcagttgaagatcccttctactgctatctttatgatgctttttctgggcagacgcttttccaccaagcgatggattgccatttttctcctctgcgcgggcgtcgcctccgttgaggtaccaatactcagaagtagttcgttattttcaaatttaaattccgaagttaactataaatatgttttgaaatttttaaataaccaaaatattaggtactcatggactttgtatccacattttttttttttcgcatttttcaattttttttacttttttattgtcacaattactttaaatatcaaataaaggagctttatgtggttattggatacaattccacgatttgggtccacaaattaaaaaaaatgtccggtcctccaaattgcctacgccacaaaaaatcggaaatgtatgtggaaaaaagtgatctttgcgtgccaaatctcgttttgtgttgctgcttgaacttctgccacgtcgattcaattgtgttcgtatgttgaccagagacaggatccttgaaattctccgagtgattcactacgtaatgtgtgtatagctccggcagtttgtcaatgttcccgtacgcggcccatccgtcgctcacaattgttgtgcctgcgtgaatgtgctgctgaatgagtggcagcaatgtgtccgcgtctcgtctttccactggcacgatgaagcaacgtgcagtgccacgctcaactcctccaaaataccactgttgttgtcctggcaatttgccgcggtggtactttggtttgtttaagacagtctcatcaatttccaccgtcgtgccttctccgcctaaacttatcattacccttatcatttagtaaaacatatttaagcaaacaaaaaacggaaccgattttgattggatttctgctgtaaaattctgctgtcacatcgcgcatgaagtttttccaatcggtaactgtgtgcgtgtccaattccatttgaaaaatgatttcatcatttgaacagttgcgtgcccaatggtaggaaaattgaaaaaccttaacatcaattgtttcatgtaaaaaaagggttttttaaacttgtttaggcgacaaatgggctccttcaaaaaaagtgcctttgtaaaatccaattgttggttgtttgccgtcatgatttttcactgaagtgcatatccaaagcgggtgatgacgtcctttaatccatttgtagcgcatttccttgccacagtcgcaaaaacgggtggtgtgtagaagcttaagttctctgagccattcttcgaattcttcgtctggtagagccaaaactttgaataaagcatcaagttttaaatttttaagtgtttccattaatctaaagcaattgtgacaataaaaaagtaaaaaaaattgaaaaatgcgaaaaaaaaaaaaggggatacaaagtccatgagtacctccgcggcagtggagagagggggtccgcgcagccccgccaaagggcggaggcgacagcgaggaggggtccgtggaaggaagagggtccgcgccgacggagggaggggtccgtggaaagagggggggggggtccgcgtcgacggtcggcggaacagcggggaggggtccgtggaagataggggctcgtcaggggcgacggatagggaggggggtccgcgccgtcggacg

SEQ ID NO: 6854 - DNA, 2057 bp, Heterodera glycines
  misc_feature (75)..(75): n is a, c, g, or t
cagagtgccgaaaatcgcatgtgatctaaccctagcaaaaatgggtgtaagtaaaaatcgtaattacgctcaaanagcttctcaaacaattttagcgcatccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttctcaaccaattctagcgcatccaattccttctacattcgcctttatacatcccattatgaacgctaaaattatcagagtgccgaaaatcgcatgtgatctaagcctagcaaaaaatggtgtaagtaaaaatcgtaattacgctcaaaaagcttctcaaacaattttagctcatccaattccttctacaatcgcctttatacatcccattatgaacgctaaaattatcagagtgccgaaaatcgcatgtgatctacgcctagaaaaaaatggtgtaagtaaaaatcgtaactacgctcaaaaagcttctcaaccaattttagcgcatccaattccttctacaatcgcctttatacatcccattatgaacgctaaaattatcagagtgccgaaaatcgcatgtgatctacgcctagcaaaaaatggtgtaagtccgcatcgtcggacgtcggaatgatggggaggggtccgtcgaaaagcggggtccgcgccgcccggacggcggaatggtggggaaagatccgcggcaacggagagagaggggggtccgcgccgacggacggcagaatagtggggagggttccgcggcagtagagaggggggtccgtagaactgagggggtccgcgccgcccggacgacggaatggtgggaaagggtccgtggaagagaggggctccgcgccgacggagagggccccgcgacagtgaaaagagggggtccgcgctgcccggcgaaagggcggcggtgtccagcggggagggcgtccgcgctatttaacgcaaaatatcacggccccgccaactgcatcggtggccgactggttaacgcgtcgggccaaccacactctcgggttcaatcccgcgcggcgaaactcccgcgcatttaatgcccacagcccaaaatctcgcgcaacccccatcccatacccccaaatcccgaccccactccgtcccgcgcaccagcccccatcccgaacccacctttcccgacgcaccccccaccccattcccgtcagagacgcacacacaaccacccaataggcacggacccccgctcatcctctctcccttcagtggagaaaatcaatcgataattcaagtaatcgtatatagtagtattaccaactaagaaatactgggagaaaggtaattgctttgacaggatttagtcctgtccaattaaaccttcaaatcgaaggtctccaaatggctttggaacttcaccaaagcctttgcacaattttgccgttgaacatatctgggtgttacagatgttcaacgggagcacaattccgttatgtgtgctcgacaaattttggcaattctcttgccgaaattaaatgcaccgatggaacacatttttcgacaaaatgtgattccaatgcatcaatttaccaaacaattttggcttttgataaagccagaattgacacaaagtgccaaacaaagtgtttgactggaagcacttcttttgttctaagcgggacattacactatgtccagcctgaacaaatagaagattacagcccaaatcactctggaaaagtgatggatagccaatccagttggcataactggaattttgattggaaggcgaccctttggtctttgattggcctccaatcatcacttgccttcataatgattatttgtgtaggcattgtttgcctaacaattttcattaaaatttctcctttctatagactttggaaatttatttcctggtctttaatgagaaagagatacggtaacgtgcctacagtattggcaatactgtacttggccgggggaggatccttcgtatgtggaggtgactcacggcctaa

SEQ ID NO: 6855 - DNA, 4841 bp, Heterodera glycines
ttatgaaatgcaaacggtttgtttttattttagataattataaatagttgcatttttgagtatgcaatttgaaaattaaaattgtctcgttccttcgccagtctgttccacaacaacgcgtccgctgccgaccaattgtttatacccgtcagcaacgcggaaccccgcgcggctgtcacctcggcacgcgatgccgcaatgggcgcgcgtgcgctgctccgtcctctgctcacactgcaccccgtcaaacaagcggaagcgatgagacgcgtccatttgcattccgaggcgctgcgattggcggaaaaacgacggatacgcgcggatttagttgccacgatggaggagatgcgcgcacgacggaaggcagacgcaacgcgggacggagaggccaaatccgaagcatttggcacaaactatcagcaggagagtgagtattataataacatttatgggtcttttttcaccctcctcctcaggtgaaggcgcccgtttttccacgcttatgccactggacgaaaagggaagggaggaacggtcggtgccgtcctattgggagtacatatcactcgaggcaaagttgctgttctgtgcgcatcggccaaattgccccaagcacactttggagacgaattggcgacgcgcacttggcgaagtgatcggcgaggtcagcagcagacttgttggcaaatattaacacaaaatgctcattttgggaagaattttgggtaataattgaaaattataataaaaatggcgacgaatagttccaagatgtgccgtcgaatgaatttttaaccaaaaattgttatgcaaattatagttatttgatcggttcaacaccgacgcacaccatcgcggacgcacattgcatttccagcgcattcagtacggttatgtgcgagttcggcccacatacggggtggacatggtattggacataggtaagccagccattcggcggccaaatttcagacattgttccctccctcccatttgggtgttaccgttttatttggctccattcagccctttggtaccgccgtttccgtgccccgcgccgtgccgccacgctggcggtgcgtcggcacgcgtatgtgcagcgtcgcttcgggcacactgtcgcgcgcgttgcctccattttgccaataggtggcagcgacgcttcaaccgctggtgcgctgctgcgcagccctacgccaattcattttgtggtggcactgaagggccgtcccgacacttttgaacgatttgcacaaaatttgatggagctgcacagtgtttttggacgacaaagcggcacgcttcagctggtccttgtgttgtacaggtaaatgaaaaccaaaaaaatcacctaaatttttttaaacatcttaatttcaactaataatttaattggttcattaatctaattactatcaatgccattgatcaattatagacctaattcatatctgattttccttttttgtttgtttgtttttattacccataattgggtgcttaaaaaattttgaatttttaatgaaatttgttaagaaataaggcaattttccaaattgccaatgagaaaatttttaaagtttctgtttttatattcgatcgactttttcgctgacttttttttctctccctcatttttattttctccctcttcctcccttcaccccccccccccacctcgtacgatcgactgtctcgaacccttacgatcgactaagagaccccccctgactacccccttgcacaggtatacttcaaatggtcccccgttttcagctcttcattcgctgccgatgacctgcgcatcaatgcgacgctcacccgcctcgtccgcttcggttttggcactcgcacactgcgcatgccctccggcgctgtgttcagtcgcggcacggcactctccgcgggtgccgcactgctcccaccgggcgcactgctttttgtcaccgacgtcgacgtgctggtcaacgctgatgcaattgaccgcattcggctgaacactgtgcgaaattgccaagtcagtcgcatgagtgccgtggcaatgaatacgaattttctctttcatttccatatcataagggctgtttttacaaaaatatcagaattggaagatttttttcttttataaattaagcattaaaaaacatattcaggcatttgtgcctgcccatgtccaaaatcggatcaaacttaaatttttcaagctgatagcctaaaaacattaaaattaagatttggacatatgcacaaatgtcgggtaaccttaaaaaacttttaattgagttttaccgaacaaattttcaattaaatatatgcaattttgctattttttttatttggcaaatttatataagctgttttatatgaaaatgtactttacgacccttttactacctttattttcttatttttcttgtttaggtgtactttcccatcgtgttcagcgagtttgccccatggacctggcaaaatatcagccaacaagtcgaaactgttcaacaacatcagcagagagtactttcactatcaccaccatcaccaccactgagttcccatttttcatacgggcaacgcagaggctattttcggcattttggctacggcattatggctatttttcgctccgacttcgatgccatcggccaatacaatcgcacattgatgggctggggcctggaggatgttgacctgtttgaacgggtggccaagtcgcatgttctgcgtccgtttcgagtgccggacccgggtgagaaacattctaccgaagggcgtcaccgggaaagacatctaattaaaaaaaaatgccaatgccaattaaatttcgaatttatcaatgcgttgttaagggttggtccacgttttccaccccatcgattgtgtcgacagtgcgcagaatgcggcgcagcgggtcgcctgtgaagggacgcgggcacaaagtcttgcctctgtcgacttcctcgtcgagcagttcggcccgtacctttgacacccatcaaaaaccaattcgtccgcctttttttaaccgtcccctcttcttttcttctcatttgcgcatttctttaacaaacattccatagttttgtcctcttttccattatttccttaattttttggttgtttgtcccagaatccctttgttttgccgccttaactttcacttgtcccatttttgtctaacaattgcaatagcacccgcccttttgtttttgttttgttaatctcaggttatccccttctttcgtgccaatagtcccttcttttttcgtgccaatttacaatacttacaattattctatacaaatcattagtcttttccccatacaaagcattttgttttctcctttacaaaacgagttttctttttgttcgttaattgttgatttttaatactttttgttagtttttttatttatatagaaatgaaaaataaatgatatttttcgtgaagataaaagctaatttagccgccatattcaaaaggtccaactaattaattgttatgccgttttataatccgacatttatgaaaaatggaggaaaaaccaaaatttgacgcgtatattttgtcgggtttctttttcatacggcaaaaacatttcaccgctcacaatcagtcgtcgtcgctttcattctccgtcctcttcgcccatttgttgcagcggagggacgacggacctaaaaaagcaatgcattttgatgaaatttaaaataaaatttaccgttttccccacaggccattggctgtttgccaatttgagttggctgatctgaaattgatgggaatttgttagagcaaagttagcaacgatgggttagcatctgatcagaggccgaactttgtctatgagaatcatttccgatcaagaaatatgccaacagaagtcgccccgatcagaggtggcttgaggatggtccaggtcaatttattcggtgtctatcattgccgtttattgactctttcatccgctgacccaattgtcagtcccttggcattgattggacaccttctaccgtatcggaataaagccactacagtattccatttggacaataatgttgttgtcacttcacaatgcctctcaccgttttccccacagggcgttcagtttgtgccaaccatgctccggccgcttgcgcattgagcgggcatcctgttcaacaatgatatgctaatcggctttaattgtttcgtcatttgacagggcacttacatcaacgagatcactgaacagtgccaaatttgtcaggtcatcgctccgtttgccccaaaggcccacgccgttgctccacctgcgaaaaaacatttgaaatgccatcgtaagcatttcaattttgaatccaaaatgtcacaaatttgtcctcggaatccgacttataattttgttaaacaaaacaattcaaaaacccattaggagtaaagcttaatattggcttcgcccttcgtatcccccgagaagttcggcacagtgccgaaccatttgctaatgccaatcatgccaataggcaatgcttgcgtcattcttcgcacctttgcccgtcggtggacgcaccggcacacactgtgacgaggccgaacagcagcaaaagcgcggcgacgagcagcgcgcaacgatggcgaagcgcatggcgcggggcgaagagcagcgaagggacgaagcgggcggaggaagcggaagacattttggaattttgtgttggcatttaacggatcgttcgaaccttagcacttttgcacttggcttttttgcaaatttcataataaaccatttgtgggcaattcaatgtgcaaaagaatgccggggggggggggggaggggtaattgaaatattgggggagg

SEQ ID NO: 6856 - DNA, 742 bp, Heterodera glycines
aattaaaaaaaactaaaattatcaaagaaaccttgattcttttctaaagaaaattcaagaaaaaagggaacgcgtgcacccaatttaagagaattcatcaaaggggtataatcgattttttttttgaaaaacccgaaaaattaaattttttttaaattgtttggttttgcctgtcccttatacaagccaaaaatcctgggcccaatagagggagacaaaaaaagaggttgaatctttggcactatgtattttacggcaaaatttcaaatttggggcaccactgaccgtcaacgtttcgatggtccgatttccggtggtgaccacttttgtggccacaagttcgcccacatcatcggccccgttcacggcggtggtggtgccaccattcacaatagtggtggtgatggtggtgccgtcccctgcccctgcggcggtggtgcccatttgtgccgactgcggcgatgttgcggaactgcgtcgacgcgccggtggcacaggcggaggcgatttgagagaggcgcgcggaggcaaagcggcgggcacagcgtcagcagtagcattggccatctgatttttgtaaaaaaaaaatcaaataaataaaaccaatttacattaatttcgaatcgaattttagttttccttgtgagcgcactagttgcctcccccgtgtcgtctcccccggaagacaaattttaaaaaaatcatagaattttttttgattttttggggagtaaacgatggg

SEQ ID NO: 6857 - DNA, 3351 bp, Heterodera glycines
ccaaaaatctggattttttaaagaaaaatttcctgaaaattttctagatttttttttcaaaattttttgtttaactgtataaaattttcgttgggagggatatcttgtttccatcaaaataaaattggaaaatattagaaaaatccaaaaaaaaaaaaatttcttgcgagggacatgttttgtatccctttttgaggtacattatctgtctgtgcccttctcctcctcctgttctacctgatcacattgccatgttcgtccacctccgttgtgatgcgctgtgggcccgagctttgttcatgccaagtgcgtacggaggtggtcgtgtgcggcgactgcggcgattctcccaccatttgctggggctgttgctggtcctttttaaaaaattttgaaattaattacctaacgattttttaaaattaatgagttgttgctacaataaattttttcattaaaaatttttccgaaaagaacattttttcatgaaattttcttatatagaaaactttcaaacaagggcaccactcgaactgttaagtttttcgctataggcacgcaaaattaagtaattcataatacgaatcgaccctggactgtatccaattgtaccatttctgttcactttccgacttacaatagttcgaatggttcccgaccccttttttaaattcgctatgacagcgctctacaaaaaaaaacgcttatgttgttcagtcgagaaactctcgtcaatcaatgcaatttttaatgatgctttttcgatgctaacattaattgcaggcatttgctgctgctgcttgccctcttcgtcttggaccagtacatggatttcctccgcgtcactgcttgagggtgatgatgaactgctcgaggccgacgttgtggtggcagcagttgccgtcgccttttgcccgttctgcttcttcgccttcttctcatggtccgttttcttctttttgcccttcttcttctgcttgtccttggaggtgccaatttgctaaaatcaagttttcaaataaggaattcacattttccacctaaaatggtaatttcaaattcgaattcataccctcatttaaaatggtaaatttaaatttcaaattttaattcattccttctacccaatccatgattaatgaacaattttctatttaaatatgggacaaaaaacggtaaaaatctaatcgagaggaggagagagataaagagaaagggaaagaaagagagagtgagagggagagagaaaggagagagagaggtgagagagaaaaatggagagaattgtcagtgagagagagaaaaaagaaagagacagagagagataaagtacagtaggacaaatgaacccaccgtaccaagaaaaacatgatcagatttgaatggtcaaaattggtccaataaaaatggttcaaagcatttactcagcacatccaaaaccaatcatcaaactctaatcaatcaattagcacctgccaaaagcccccaagaagtgccattttggcggacggtctcttccgcttgcgactcagtcgcttcccctcctcatcaacagcagggaatcctccgttctgttgtccttgctgttccaattcttcctttttactcgcttcatcatcatctacaactgttgctgaagttgaagcagtacacgtcacaaattcggcaatcggatggcactttaactcttcattacggtgaagtgaatgcatctgttgctgctgctgaaggtttttcggttcattttccagcaattgttgttgcgtttgttcaacagcagcaattgttttggtggtcacaattttggccgtaagttttttgccatttgttggtgccgctttttgcacgtcacttcttccttcttccatcagtttgttctttattggtgccacaaattcgcccattggtcggcattttaactccgagtgccgactaagcaaatggcattcctcatctgttgttggcggacacacaacatgatcatcggaaggggatttcatgacaattttgacgttgtacttcttgcaattcgccggttttggctcgtcattctcaacatcagtgcgtttttgttcagcagcctttgtcaaagcaacaaattctccaattggatggcactttaactcgctttctcggttaagcacatgccattctgctgctggtgcttcaaattgtttgtttgtcattttttcggcctcttttgatgttgttgccccatttgtttgggttgtttttaagacaattttggcggcatattttttccgagacgtcgtcttcactttctgctgctgatcatcatcttgtccaacttgagttgaccgtttatttgccattgcaacaatttgctcgattggttggcccatgaactcatctttcctgttaagcaaatgcaattgttgcagttgaccatctcttgcttcttcattggcgttatgacgggacgaagtgggccctacagtacccttcgtgatggcagatgttgttacagtaatttttgccacaaatttctttcctcctcctccgtttatttggttgttgtctgctgatttggcgtcatcatcatctttctgctgtttatcaatgcatgaaccaatggggacggacaataattcgctggtggggcaaagttcgtgtacaatttgagcagttggcgttatgatgatttgtagcgcattcacattgccagcagatgctgttgctgcttgatcttcacgcatcgttgtaacggatttgagcgtgacaaaaattttggccattttctttgatccatgccgaacaatgttggcattggcagcgttaattgcgacattatcagtggcctcctcctcctcttttttgacagatttaatcggcatcacagaattgggcggcagattttggcaaattgacgcttcaatgtcggtctgtgtcagttgttcagccggcgccaacaatttgtgtgggccattgtagacggaaattggtggtggctgccattgatttgtcgtccgattcgtcgatttcaaatgaagaattgctccaattcgtgttgcaaatggcaatggctcgcctctttcatccgccgattttggcattttgacatcacgacagtacgcacggcgtggatacgtctccaactcgttggcacgttcaacacgttgcagcggctcaaagcacacagtggcagcagccaaatggtaatcctccgggttgagttgatgttgttcgacatgctcctcctgctgatgatgtttggcccaacagtcgtcgccacggaacggagtgacggaatggccggaatgagtgataccaacaaaatagcgcaacggaaccgactccatttctcgtgccggtcgtatgtgacgtaacact

SEQ ID NO: 6858 - DNA, 3021 bp, Heterodera glycines
atgagtttgctgatcgatggtggtggcacttgcgttgcggcttttttgctggtgggagcccatctcctcctcctcgttgtccatggtttattgccggacaacaacaatttggttggcaaaaatttggtcgatgctgcgttggtgggacaatttttgttggtggcagcggtagtgccattgtcaatgtcgtgccgtcgttgttgttgtcggcgccgctctcgctgccccaacaacagcaaatcgtcgtacagtccggtgctgtacagggacacgcactgctcaatgtgtgtgtggggcaattccgggcaatgaaaggtcaaatcaatttgatgattcgggtcgaaaaaattttgatggttgttgatgtaagtggccattgtcaccattttttaattcctatgtagttaaatcattggattcggtcagaaaatgaaaaataaataaataaattggcaccaaaatgatggattatgcaaatgcgaagaaaaggatgaataaagaaagcaccataaaagttttcaccgcacttctttttttgtgctgttgacggcacaatatttgcgccgcttttttgcataaaaaggaggaaggagcctgggggtggaaggcaatccaatccaataacaacagaggagcagacagtgcgaaaattagagagagagagagagagaggggaggggaaagaagacgaaataatatagtagaaatcaagaggaaagagagagagagagaaagaggggaaacgagagagacaaagagcgagagagaaacaaagggaaggaagaaagaaaagggagaggagggagagggagaaaagggacaataaagcagaaaaatcgattggacaaacaatgaattatttttatttatgcaccgccgcgggggaaaagagtcgcatcctccctcactcattatcatatgttgccccaggaaacggcacatataaaatacctatcgtccaattgaaagggcattggtaaaagtcatatacaaaaaagaatgctactgtctacatggtgaaatcttggttaaaaaaaagcgaggattccgtttagggagcagctcgttgcccccccccccacccgccaccccccgtatcattcccgaaattttttattaaataaaatattcaagaattaaaaaattatatagcatttttttcaaattttttttcataaaattttattctaaaaaaatttagaaaacttttttaaaaatttctgagtttgaaaatttaaaaaaaaatagtttctcgggtgcggggctggaggaaacatcccaaagtgccaaaaatgtatttgccaacacctccaatgccttggctttgactgactgacctcatggtaatgcaactgctgatgcgtgacactgtccctttgttcctgttggttctgctgctgttgttgtgacttttgtggcgtcgtttcgtccgcataattcaggggcgacgaatgctccgccggcccacttttgacgacaacttaagcaaaaaaaaaaaaaaaaacaatgaaataattcaatgaaaagtatagcagaatagtgtacggaaaatttttttttttttttgaggccgattcggagtaattattccatttttttttgttcgaaattgcgcataggactcggaactggccagaaatggatgccattttcgtgatcacccaccctacttcgaaaatctccgaaatactacatgttgagtacaacttttttttaacttgaagttgttgccgaaaagggatggtttccgcaaaactttcaaaaaaaaaatttttttttttttattggggtccaaacgacggacctcccctaatggcaaatgccaaaaaatctctttttagggtttacacaaaaattcaagaatgtgaatggagggtgatattcaaaaacatggcttgcctcacaatcagaatgcttattgataaaattgacccaaaatcaaacaattggaattgtctttgtgccctcccctcactttggtccgccgatttggacgacttcacatgctcatcaatggacggcgcttcgaacagttgggaggccatttgcgattgaatgttcgtccgtccgacgtagcgaaaacgggcggacccaaacccaaacaaataatggtggtgcttcaatttgcggtccggctgaatcagtctgcgaatggcatggagggggggggggggtatggattagaagattaaatcaaccacaacaccaatgggaaacaggatgaaacacggtaaattattattattatttaaaaatggcgcggacgaaacggggaaaaaaacccacaaaaaaaaaaaatttatttttgggaaaaaactgagtgtaacaattctctctcttaaacaacgtttgaatagattggttctgaaaatttacatttgaaaatttttgtatttccccagtgcataaacgtgaagtaacaacatttcaaaaactggacctaaaaaagtgaaacttctctcaatttttgatacaaatttttttaagtccccctttttgtggaaaaatttgcaaaaaaaaaaaaaaatcgaacagaaaaaaatacctgaagaatccatggtgttcaacggcacattcccacaacaatttggcatgttccttcccaccgaccaaagtgtacgtcaaagatgtctcctttttggggtccacctgaaaaaaattgggctaaaaaatgccatcaaattttatttgggggatggacccccaaatctggtgacaaacctcgcccgccttcaatttgatgctgaaatagtgacgacggtgtgagaatttgatgatgcccggccatgcaaaacgatggacacgcatttgctgaatgaatttcaaaatttattaaaattcactcgtttatttgttacgcatttcatttttgagtgttttatttaatttttttcaaataaataaaagtttttcctcttttttttttgcaaaactgctctgatcttcgctatataagacaaaagtgagaaaaccctacctcactgaacacactgatcccatgtgaactgatcccaatctgta

SEQ ID NO: 6859 - DNA, 3370 bp, Heterodera glycines
  misc_feature (29)..(29): n is a, c, g, or t
cttatgtgccacaaaatgcatgcagctgnttggaattcatattttttaaattttttttttgaaaattttgaattaatttttttatattgttgcagaattaattcaaaatgtatattagcttaaaatgaatgtcatagtcatatgttaaatgcataaatttatttcttaactttgaaatatccatttttttattttaaaatcattctaaagtccaaaatgattaattaaaaataatataaaaaattggatattataagtaaataaataagcaaaatgtatgtgtgaaaattttaggacaaattgatacagtttcaacatatgccaaaacggcgcgtcccattgacctcccagcaaatgtgaatttgatggtagtggttttttgttgcaaaagccaagccattatatttctctcacagcattccattattatctcttatgtgttcctttatttcgcattgattttcgccccgcggggaaattattttttatttttattaggaacagaaaatatttctaatattgtacattttgtcagtttaaacttgtgtcatatttggtcctaatttctattttgtgctttgggcgggacactttgacgcaaattctgtattaattcattagacggtaattaatgctaattagccttaatagttcattttttgttgattacagctggctaatggaccgatttaaccgcgctaatcaccaaagccaaaatgcggaacaaaggcggctgaaaaaggaaaaagcggagagagcaatgcgtgacattgaactgtacgaagagctgcagaaattgaagaatgaaacgacagcaatcagcgagacagtcaaaaagaggaaaagccattcaatgtttttggtgagtgaatgccaaaaaagtaattttaaagaagggattgtctaatgcttttaaagtgacaaataagtgcgctaaaaataaaaaacacgaaaattgttaaatatggataaaaatgtttaatttggttaactttgacaaaagttatgacgattttttgtcgaaaagtgctaatttttgctgtctttttccaattttttatgccctttttgttatttcatacatttttatgcattttttcacttatttcatgcttttctgtgcttatttgaaagaattttcgtgcctaaaagtccggtccctattgtttaaatttttaatcactatgtctagaataatagtaaatgatatctcttaggattaaatctatctttttcaaaaaaaaatgaaaaatatcgcggtcacagcccccaatgacaattcatcaaataaattgcctatctttaaatttaatgattaatctcttagctatgccattttgcccatctttgtatgtatgtattatatgatcttccggtcttctctctcccatttgtacgctcatttcgttccgtttttatcatatttaccttgagcaaatttcacgggcattgggtccatgtcaaacactcaaatttaaatctcggaactgccaactgtgtcattagtggtgccatagtttgagtccggcctctgattgatattgctcatggcattttgcacatacgagtagatatataagaaagatttgcagaccatttttaaatttctccaattatttcttcattttcttaactctttgttttccatctcatccttccccatttctgttcatattggcaatcgaccatttttatgagatttttcgtcctcccgttttggcattttcataatacctttcagtcattcagcttcctcaatccgaacatggttgcacttttctgatcacacacactggctttgattacttttattgtaattatctttcccaaattcggttttcctacatttctgatcacatacattggcatttggttactttattgtaattagctgtccccaaattcggtttttccacctttctgatcacattagtctaaattgacaatctatcattttgtatggcaattgaatgtcctattgttttctcatttttatattaagtttcaattattcattgttttcaatccgaacatgcaacttttttgttagccaacattgacagaatttgatatccacgaaatttgacatgttctacatatctgatcagtgatcatgttgccaaaattgacatttaatcttttttaatgtaagttctttgtcccttccttcctattttggcattctcctaacatctttcaattcttcatcgtccgaaactcgattatgcaactcgaacacgatgcatattttctgatcacatgaccaaaattggcattcgatcactttatttgttttgccgttttcataatgctgttcaattattcatgttgctcattcctcacaccaaatttaccttaaagtttgtggcattcgatcatttaacggcatttctatgtcctcctgttttgcatcactttgaatgttacaaatctctgatcagaaagccgaactttggtactcgattattttggggcgccttttctgcatttctgtcattttactcttattgtccaatttgtagttccatttctatttaaaatttttgccacccaattttaacgcttcttcttcacccaatccgtcatccaaaactaattagtaaatttcacaatttttgtccagttaacttttgcaattgttctttttttcatttttttgacaaaataaggcataatatttcgctaactcttaacaaacaaaaaaattatgtcatcaaatactaccgcacccgaagaaaacccctctggggccgaaccctcgaaagaggaattgtcttataaatgttcttttcatcaagaaacaaaacaaaagatagaagccgagtctaatgagttgtttactgagctcgtagaaaaggtgtactaaaaaagtccatttttacatgttttaatcccccaaaaattttcaggatgcacaaactgtggaactcgaagcacaaaatgcagaacacatcaaaacgatcaacagacagaaattacaaatgaaagagaaagatgaagacattgcaaaagtgcgaaaacaaaacgaggagcaaacaaaaatggttggcacacttcaaacggagatcaaggaattgaaggccaaagtggagttgcgcgataccaatttggagataaaggaagagataatcaaaatacatgaacaaaaaattggcggaatggagaaggcaaatgttcaactggcagagacaaacaaaaaccttcatgaagaaattgccgtactcacggagaccaatcaaaatcaagaagaattaattgccggacagggagaaacaatcaaaaatcagcaagaaaaaatttccaaattggaagggatgctgatcaccaccggccatgtggagcagagcattggcatgtgagtgtaaattgt

SEQ ID NO: 6860 - DNA, 2839 bp, Heterodera glycines
  misc_feature (19)..(19): n is a, c, g, or t
  misc_feature (57)..(57): n is a, c, g, or t
  misc_feature (73)..(73): n is a, c, g, or t
  misc_feature (90)..(90): n is a, c, g, or t
  misc_feature (150)..(150): n is a, c, g, or t
tagttccatttctatttanaattttgccacccaatttttacgctctttcttcacccnaatccgtcatccaaanctaattagtaattcacnaatttttgtccagttaacttttgcaattgttttttttcattttttttgacaaaataaggncataatatttcgctaactcttaccaaacaaaaaaaattatgtcatcaaatactaccgcacccgaagaaaacccctctgggccgaaccctcgaaagaggaattgtcttataaatgttcttttcatcaagaaacaaaacaaaagatagaagccgagtctaatgagttgtttactgagctcgtagaaaaggtgtactaaaaaagtccatttttacatgttttaatcccccaaaaattttcaggatgcacaaactgtggaactcgaagcacaaaatgcagaacacatcaaaatgatcaacagacagaaattacaaatgaaagagaaagatgaagacattgcaaaagtgcgaaaacaaaacgaggagcaagcaaaaatggttggcacacttcaaatggagatcaaggaattgaagtccaaagtggagttgcgcgataccaatttggagataaaggaagagataatcaaaatgcatgaacaaaaaattggcggaatggaggaggcaaatgttcaactggcagagacaaacaaaaaccttcatgaagaaattgccgtactcacggagaccaatcaaaatcaagaagaattaattgccggacagggagaaacaatcaaaaatcagcaagaaaaaatttccaaattggaggggatgctgatcaccaccggccatgtggagcagagcattggcatgtgagtgtaaattgtgccttttaaattgaaattagacaaatatttttttattagaataacatgcttttacaatttaaaattttgtttataatttaaaaaaattactccttttaccagaaacgatcatttttctttcaatggttaagttatagttagggtgccggtcttattttgtttgggttctctgaaatcctgatcataataaaatgtcaaaattttcaattaaatatgactataatttataggaatctgtcgcaaattcaaagtggacataaggtactgacattggcagacgaattggccgactgcgagcccaaagcggagttagataaggcggcaaaggacgacaagcaggaagaattggaattggagaaaaattggttggtttaattaattatggagttattaattaagcaattaattaatttaaatattagcttgattaatgaaatttaatttaaataaaaattatttggttggattaattgattgatttatttatggatattaattaatttaatcaatttaaattttttaataaaatttcaatttaaattcaatatggagatatttggttgattgattaattaatttatttatggagttattatttaaataattaatcaatttaaaatacggagtaattttaattatggaattacttttattgttaattttatctattaattatatagtgaaaaattttgtttcgggcttttagttgttttttagtttttcactttctcaaaagggattttttggtttttccgagccacgagtaaaaaaaggaataaaaaaaatttaaatattgaataaaagattcatcaaaatttatgtcaataattttgtagcaaattgccggcaccaacggaaagcgtagagggtaaccaattggagagcatccagagacagcaggagaaggatgaaggggggaagcaggagaaagggtaatttggctaaattaaatttattttacacaaatttatttttaattataaaaattaatgaaatttttttatgaaattttttttattgttccaaaaaggtgcattaataacaaaagataaatgaaaatattaaaattgtgatgttttaaccgtgaaaatattaaaattgtaatgttttaacaaatcaagatttagtacaacagatgaatgtggacaggaaaatcagcagcaggagaagggagagaaggacacggaagagagcaacaagtaaaaaataataaatattgaattaaaaataaaagaaaaattcattgaaattttttgtaaaatttttgctcattatttgtaagaaatttggcgacatcggaggacagtggcaatccgctcaaatcttccgaggaaaaccaaaaacagcagcagatggatgaaggagaagagaaggaagaggaggagtgcaaagagtaaaataaaattaatatttaattaataaattaacattcaaaatttttgtcaaatcttttttaattatttgtagcaaaatgccggctacatcggttgacagtggcaatccacccaaaaacaagcacacggatgaaggagaagggaaggaagcggaggagaaaaaagagtaaaaaaaaaaaaattaaatatttaataaaaaaacaaataaaataaaaattcaagcgaagacgaagaatggaggagggtaataagcacaatgacatataaaattaaatacctaaactgaataatatttttatttttgcaattagaaattctcaaatgtttaataaacatagaaagggtaattttcgatttaaaatttattaaaaattttatatgtataatttttgccaactaattttcagttcaaaagaagactatgaacagaacgaacatcagcagctgaagaagacagaagagaagaaagtggaagaggaaagcgacgggtaaaaacaaaaaataataaaatatgaaaaagtaaattatttatttattataataataccatttttgctaaatgcatttggcatataatttataggaaaatgacggt

SEQ ID NO: 6861 - DNA, 4195 bp, Heterodera glycines
  misc_feature (69)..(69): n is a, c, g, or t
  misc_feature (99)..(101): n is a, c, g, or t
aagcatcaccagttggcataaaaatgtatgctgacgatgttaaatatatatgcccatgaaaacgatgancatcaaatcagttgataaagcgatgagctnnnggaaaaatggtcaaaaataaatgggttagaaatttcaactgaaaaatgttttgttctttatttagggaaaaataatatgaaaaaagaatattttattaactcaaaaaagatttcagaatcggataatgttcgtgacttgggaattataattgactcgaaacttaatttttcagaacatattagcaaaattatacgaaacgcatatattagaattttccaaattttgagagtgttgaaaagcagggaaataaaaactctaacagcagcctataaaacttttgtacgacctcaattagaatacgctaccgaagtttggaaccctaatttaaaaaaagatatagataaaattgagcgtgttcaaaaatttttcacaagaaaagcacttagaaaatgtggttttgtgtacaaaaaatatggggaaagactaaaaatcacgggtttacacaaattggaagaaagaagaaaaatcaacgatttaacaacagcttttaaaataatcaaagggttcaccagcctcgatgctgggaaaagtttctttttctcagaaaggcccaggaggcctttacttttacgggtaaagcgccacacggccaaaactcaaaataattttttcaatagaatagtaaaaagctggaataatcttccagtggtagcggtgcaaattaataaggcaaaggaattcaggggtttactaaaagcaatgagttctgagtaggattttccatgttgccatatttacactatatttttatcacctgtgaatttttaacatttgattgaattatttttattcatttttattacggtattcattttgtatttttattttgatcaaatttatttgttgttttctttttggcaccataaagagcactcatgtgcctttggtttgctcgataaattaaataaattaaattaaattaaattaaattaaattaaaatgttcataagacaaggaaccaattctggatgaaattacagtatttaaaagggaaacattcgatggggtgaaccgtctcatatatataattttttgtttttgttttgtttgtggaatattcaaaatgaaaatttgggctgaatggtcagatgaaaatatgccttcttcaatagtacagtgtttaataagtttttcgttagaggttaagaccaggtcaagcaacgaatttccccttgtaggtccattggttgtattaatatatgagaatttgttaaaaaaagtcacaaaatatttcaccgagattactcattgttatatttctttattaattagaacaccacaaccaccaccacgttttaatatttttgattttctatgtgtttaatcgaaattataattttctacaatccatgggtaaaaggagcattcctcctttgtccatgtctcagtcagtaacaagatatctatttgattatttattatatttaaaaatatttcgttaattttattattaattgatctgatgttaattagacacgctttaacttgcccccgggagactattgtgtggccggaattttcagaatttttaggtgaatttgtttataagcgatccgatttcaagtcagttttccttatcagtgtcaatcaattgctgccgaaaactgtggacttcttctggaggatcacagcacccgcataaactatccattcttttccatccttctgtcgtttttcgacgcattgtaaatacagacgacgacgttcctccagctggaccttggtcagcgattcacggacccgaacattctgcagagagattggaacttcgaacagcggcggacttcttttgtcatgccaccaaagccagcttctggaaggcacgggacgacaaaagaactttcagcggtcgcggacttttttgggctgggtgataaggacggcccatccgataacaaatggtgccgcattcgacccccagcgagtcaaatataccgttaactgcggcacggtccatttcagccctctttgagggtgagttgtcggcctgttctgggaggcctatgacaacgacgcttcgctgtctctctaattcctctgctgagattggcagattagcacaagaagtgggagcggcggtgcggagctgagaaattgattgagtcagcaggtcaaattgggtggacagccaaagtggtgatttttactaaataccaagtccgctcatcacacattctctgagatggaattgtccgggttttgctgttcgttttcggttgcagttggcatttggtttcgttgtccagttttgtttaatttagcttaatcagaataaaaattcaattaagcatatgactagcatatttaagcatttttaataattaaatgatgctggttttcattgcttctcttttcactttttcgtataaaaaatatttttattcacgaaataaaaaccttttccaagccaatcgatattgaaaacttcggcacgacataatggacaattattgtgctttttaatcctgtgaaaaaggtattatttaaaaattttttaccatatttctttaccaagcatcaacgcattccgagtgaattggtgctaaataaattaggattaatgctattcgtgtggaattggtggtaaattaagatttttaaaatattacgaaaagaaaaaaagatttttagtaaatttttttagtaaataaacggtttatccgcgtaattatggcaaagtgagatgatcactaaaattccaactaaaaaattacataaaaaatttataatatcatatgacactaaaataactttttttcttgtaagtaattcaaagaatgcttttttaatttagcgagtttcatagttattcaaataaaaattttttgaaaatcacataccgtacacggcaaagtgcgtagcttatccccgatttcatagactcctaagcatattgagcaaccgcctctaccactactaccatcatttgggcaattgcactaccaccacttacaaatgtatgctcaggtattttgttaattatttccataactgcatttgaaacttaaaaaacagattaacactagtcttattttatttcatacttcttttctgttgaaagttagtcattgcatttctggcccaagaaaccggcaaattgacacgaccagccaattagggacaaagtcttggttggccagccatgtgccaattttcccagaaatgtaccatatgataagagaaaatacgataagaaaagctaagaagccaagagatgccagatcaacgaaccgcttcttacgcctgttcctcttatttttcttgtcagctgaaatagaattgaatattaatgagtaagattttaattattaaaataattttgaaaattaacaaatttttctcctatattaattaattatctcttttcccggcaattattatcatcaattacgttcatttttgatgtttgctgcgatatttaaattgtccactgctgtgtacataagcttcaacttctgcttctccgcagaattttttgatttttcatcttttttgtcctttttctgttgtcgattttgccttttttccgccaataataatttgattaatttggcaaatgatttaattccaaatttttcttttgattgaatttcagacactagaattttttccctttttgctcagatttcaatggacgataataacaatgagcgtaaattttccataaatgagtccgaatgatttcctaaaaacaattaaaattaatcaatttggcacaaatatttttaccagattttaaagtccatataaatccatattttgggtgttttcggtgttttcggtggctatttttagaaaattttcacgaaaattataaatattttcgccatttttttgcgaacttttctttttttttaaaatgaaaactttttttttcgaaattttggcaaaacttggaagtattttttatacaatggagaaaataaaattttgcatttttaagttttaaatccattttttggttgtttattgtactttttaagtttatttaagcaaatattgaataaacacacattttttggaatttttggtggtttaaaacatatattttagcagtttttagtccatattttatgtccatattttacgtttt

SEQ ID NO: 6862 - DNA, 4092 bp, Heterodera glycines
  misc_feature (1346)..(1346): n is a, c, g, or t
  misc_feature (3378)..(3378): n is a, c, g, or t
atctgatagaattttaatattccatttaatcaatttagcgtttaaaattgctccattttaggttataggcactgtcatcagtagggagcggattttagcattcgacccttttttgcacctatttcggcattttagaaaaatttcttaccaatttttaccattttgggtccctatttcgccattttttgcccccatttaggcccctaattggaatttttcaaccctaaaaatccgcttcatagtcatcagtttttttaaatgaattctgctgatggttatattcatgtaaaaaggatttatagcgactaaaaaagcacaaccaaatacttacggatgcataaatcaaaaaaaaattatttaaatgtaaattattaaagaatgcttatgtatcaggtttccaattatattattcccccattctcccattttcacctcatttttcatgtcctccgccatttgtgccatcattttctgtccatccattgaaaagcattcttttgggaagagaaaaagcggaaaagcaaaagcgatcagagaaaagcggcagaaaagaatagatttcattttgttattagaaggtgaatttgatatttgtcgaaatttcactacccttttataagaaaattcccatgggcagacggacaattatcggaactaattaaggcaatttgattggacagagaacattaatgagttttgtgagtcaaaggtgactctcactcagcagttgtgctcaaaattcatttttatgcatttattagaaatattagttgttggttggttgcaaattggttgcacataaatacttaaaaatcatcatttttatttatttggcaaaaaaagaagcaatttctttcttggcatattattaaaatgttttttttaatggcattggaaaggcaatgacataaaacaacgaaagaatggaatgggagttttttattttatgttattttctttggtgttattgaacggaatacaggtaaagattccgatctcatttaccaaattcgatttccagacatttttgttggccaatatactgatcaccgattcctgaaatattcaaagggcttagaaaaccaatttcaaagtgccgatcttaattcagatccttatttttgaacattgacttaaaacccaaacgttgaaaaaaaatttgagacgatttttacaattttttgatatttatcaacaccgccttaattcatatttaaattatacaaataatagccatacaaataacaataaaattgattattttattttgtctttaaaaatatttaaaatttgacaaagaataaaaaaagataataaaatatttatttttttcttcattattttanaattatttaagaacacacatttgttcgcaaaccattcgatttggctaaaatttattttaaacattatgtactcaaaacaatttacaaagtacttttatattaaatgttaaatgaatataaaagtattagaattcatcctttttactatttttattaaattaaattgtcattgactttcatttattcgttcttaaataatctttgcgttttaaaaccattaattaaaactttcgcccatcaattctttccccattagcaaaatgattttatttttttttttttgcctgtttttcacttttctccgcgctttccgcccaagaacataatattgatcaatcaaatttttattaaaattactaatgcacactaatccattcgcttcgtcagcaggtgcaaaacgggcggcctatgaaaacgcgccgtttttatttccccatttttaacttccaaaaacctttttttaaattataataaataaataaatgtttattcgaatgctatttaaaaaatgctgtattgattttttaaggctcaaaaaatgaaatgacataaaatttaataaataaaaataattttatttttcttatcgtctttcattgtgctatttatttgtgcaacaaattatatcaattatctaccgaaatttttgtgaaatttgtctgtgtgtttaatggacaaaactgctaataaccagggaagtgttattttaatgatttattatctctaattaatttcccatgcgaaatttttcttaaaaataaaataattattccaataagataaattttggttccaacaattgaaattaataaaagcgactgatcataatattttaaaaatatgttatttttctgtattaatgaacaaattctcaaattcttttaaaaaatgttactgccttttttaattatctttaagcctatttctgacacaatttttcgcttttatttggtccaatttccgtggctaaacaatttaacacttttaaattagcctaatttcagtacagtcaaattgtcccaaattaccattttaattgccaaataatggcttacccaataattaccctttcagaacccctcttaccgatgctttctccaaaaagtgacttggatttgcacactcggcggccttctgttcggctacgacacaggcgtgatcaacggcgcgttgccgttcatgcgcgacgagttggagctgaccgatctgaccattgggctggtgaccagctcgttgctgatcggtgccgcagttggcgcttttgtgtgcggtaaattgtctgatcgacttggccgaaagcgaacactgattattttgagcgtatttttttcattttaaatatttaagtatgtattactagtattaatataataatttatttgaaatgattaatcaacttaactaattaacaatattaatttaggtcatttttataattggcacaattggctcttctttaatgccaaaagtttgggtattctttttaaatatttatgttcaatattttttattattttaatttaattaaatgaatttaatcaaaataaaataattgaaaatatcgaaaaaatatttcttttagtctatccttccctttcgctttcttcttggctttgctgtaggcggtgcttctgccattgttccggtaagaatattaaattaactctattaaaactctattaattaatattattatgtaattaatctttttctattcctcaatttttattaaattaactattaattaatttacaaatatttttctatttttaggtttatttggccgaagtgtcgccggcgaagcggcgtggtcagctggtgacacgaaatgagctgatgattgtgactggacaactgttggcttatgtgatcaacgccattctgggcaacatttggagtgatcagtaaaaaaaagagaaattatttatattagcgaacaatttttcctacactatttttgggcgagaaatttcaaaaaattttatccgttgtaatatttaggtcagtgtcggtttttttaggttcataaatntaatcaaaatatttttttttcatttgctcattaatcttttttaatcaatattttttaaagatatttgagaatttaaattgcccacctttcttaaatagggtttttgataacgggttttttagtaaattttcgaagtacattttcccttccctaattcagtgtttggatttggcgtttgatgatgttgctggccgtactgcccgcggtcggtctgctgcttggcctgctctttgctgacgtgccggaaagtccgcgatggctggtggcccatggacggcatgacgaagcattggatgcgttgagaaagtcgcgcaaaacggaggcggacgcaatggccgaattggacgaggtgcaaaagacggcacgagaagacgagcagctgctattcatgtaatgaaaaaagtggcacaaaaaccccattaataaatgaaattccattttttttttccttaagaataaggcgcttatcggtacttttcggttttgtgaccccccctgaaattttcaaataaaaagtcatttctagggtaatttagggcgctgatcacgaatattacatttatttttcaaaattccgaatcataacccgaattcgaacaaaaattcgaaattcatatattacaaggaaaacatatttttaggggttttcgaggtcgctgaaaaggtcaagacatacattttgaccaaattcgaaacccggactagaacaaaaaa

SEQ ID NO: 6863 - DNA, 3391 bp, Heterodera glycines
aggtacatcgatcattcagtgatcgcatttctccgttccaatcagcaaatttttgacagaatcggcaccaatttaacatttgatgtgtcttcttcatgcgaacatgaagctaatctcagtttaatttgggatgttttggccagtcaaatttggccaatttttgcgccaaacattcgctatttgcactttccaaatggtgatgatctgaaccatttgcttcgtctctgctcaacaacaattctcaccgatctcaacaacctgagctttatctatttcatttgtatgtcccccgaggggtttggttgtgatttggatgggccaaatgcaactccttcttctggccaagcgttgaccaaatggctgcacattccgagaagcgatggccaaccaaagcggttgcgttgcggtgataataatccagaaaactttgaatggatcaacaatttcaaacaggttgtttctcctactttttgcttcaatttcactccgacctttaagtgatgatgaaatgccatacctgtgcagggggaggggtcagggacgaagcgggccagttccgtctgattgtgagccaagtttagagcatcataacttttgtctttgttgttgaccaaatcaaacaaagttggtattattcgaaagctcttaacaagctctatcggtttaccaaaaatcacaaagatatacagacatataaaaaagttataaattaaaatatgcaataattctgactttttggtaatattcatgttgcaacttttttatatgttgtccaatcgcttagaaatagcttatcgaaagcttctaaacatgtagggctttcgaatgatgccaaatttataaaatttggccaactgagaaaaacgttataatgctttaaacttggttcagacggaactgacccctaccggccagggaaagggtcgagagttagaccatttttacaattttcaagaaccatgacccagtgtcaatttttaaattttgcccggaatatttatcatttgtcctttatttgttcaggcgtttctctgtgctgccacttctgctgcctgctacgaaattcaatttcattcaggggtcggatcgaaaatttttttgaaggacatcgataagattttgggggtcaaaaataagaatattttgctaaacagcttcaaaacggttattaaattgtgctaagacggagcaggtagtgtggcgcccgagcaagcggtactaaaaaaaccatcaaaataaaatattatataactttgctcaaaaacaactaaatttttaattcttgatatcattccatagccctacgtattttctattatgatgtaaaatttaaaaaattatgttaagttttaagaaagttaagatgaaaaatgctcaaaaaattgtttttttgagcttcacaggtcataactttttgaaaattaacgaattttttggaaatttagcatgatattagaaaacacttagagctattgaaaaaaattcaagtttataaaattttgttgcttttgggcgaagttatgaataattttctgtcaaaaaacgtcggcgtcttacaactgtccgccgtagtcgagtggtggtgcgctggttttagcacaatgcataggtatataattgattcaacttgctttgggttcgaaaaaagtgcatagagtatagaaacagtgcctgtatttttggcgctgacaatgaaacgtcgggcgaaacaaaaccaagactcattttcaatagagttgtacgggacagggacctggacacggacaactgagtaccaaggtcccggttttgaccgggaccgggaaattcccggcttttttcccggttttcccagccaaaaattcccggtttttcaacccaaaaagtccctgtcccggttgtgcccaaattttccggtcccgaccaaccctaattttaagaaatcagaaaaaattgtatcactgatccgaataaaattaagcaaattttacaattaaggaaattattattattttgatcagatttgggcaccctccaaatcagaacattcttataaataaggacagatccgacccttgctgatctgattttatgtgcccgcgttaatgcaaattgtgccatttgaatttgtgaacgaacggaccaaggaaaagttgaccctgtggaaaaaatacgttgacaaaagctttgttacttggcagctgaagcgatgcccaatttttttggggacggcggcggttcaatgggacccaaattcgaacaatttgaacaatgtcgagtttttgctttgtgatgacaacaattgcattgggtattaattagcaaagcatttgattttaataatcaaattaagaattgcacttaattcaggccattgtgtccaacagcaacagaggatcaaatcaacgcaaaaggttgtctgccaatgaatcccgggcccagcggccagcgggaggaaaagtgaaagaattatttgagaaatgatcgatcattttggaaaaattgaaaggttacagcaggaattcgtagcatttttctattaatttttttttataaaaattataaatatttttatatttttattaattgcattgctattaaaagagtaattttgccatctgaactgttggaggaattgaactaagataaaaatatagagaaaaataggttgtggttttttgatgagaagattctgaaattttcttttaaaattcaaacaattttttttaatttcaaattttcgagttttaaaccggttcaaaaaccggttttttggcatttccgcaactcgagacatatttttccgtgcttagctcctcgagacgaatcgattggtatataatttgacccattttttcacggggcgttcactacagttcacccttaatttaattatcatttttgcctttttctcttctcctttcccagccccccactttttccccccttttgcgttaggcgtaatgacccaacccaactgacccctcccctcccccatttgaacagctatgctccatacacacaaatcatcaaaaaaaaaaaattttcagttttcaatagagttgagcgggaccgggacctgtacacggacaactgagtaccaaggtcccggttttgaccgggaccgtgactagtcccggttttttcccagccaaacattatcgggttttcaacccgaaaaggtcccgggttttgcccaaaattcccggtcccgctcaactctagtttcaactttttcttaaatattttcaggcggaaaaattaatttttaatggaatatgtaaaatcctccctcgtcatttcttctgtcgaaattggtgaaaatcagcagcagcaatcgccggattcatttgtggcaacatcttttggaaggcgacggcattgctaacactgaccaaaaagaataaaaatt

SEQ ID NO: 6864 - DNA, 1434 bp, Heterodera glycines
attagcaccttattttttaggtttttatttttagccacctaaaaaacctaaaaaaattttaaaaaactatttttcacctattttggcatttgcccaaaatttgttaacaaaaatgaaataaaaaggaaaaacagacccctaagaatcgaccgaaaattttttcaaaaaatatacccctaagaatcgactcgaaaattttcaaaaatatacctatgaaaaaagaaaaatttctcaaaaatcatctccaaaatttatttgtttattttcttggcgagaattttttattttgaaaattatctatctcattaatgatttggcataatatttttgctttttgaagaaaattttcgattttacaccccaaattcggaactttttggcacctattttcccatttttagcacctattttgggggttttttagaacctaaaacctacttattttggcagtttttagcacctaaaaatcgaagccctagttttaactagagttgagtgggaccgggacatgaatacggacaactgagtaccgaagtcccggttttgaccgggaccgggactagtcccggttttttcccggttttcccagccaaaaattcccggtttttcaacccaaaattcccggtcccgctcaactctagttttaccagtatagtgcgggattgtttccgttctcgaaatttccaaaaatgcggactgctgggatcattcagcaaaattgctcaaagcagcgaaaaagagggacaaagtaacgaaaaagggatgtcttctgacaatgagttacgaacagaacaacaacaatcagtcgatgaccgacaaaaaatcagccgtgattcctgatcagtgatcaccaactttattactttacttcatttttttgttgcctaatttataaattttcacttacaaagagccactttttagagatttatagaaaattagattctttttctcaaaaaaatttaagatggattatttcatgaatttaaaatatcagagcagaaaattactcttcaatcggaacaaataaatatttcctttaaatatgactttttttaatttatggtgaatttccaatgaaaatccgttaaatttaaagagtaaaataagcatttcaagcagagaatgtcatcaaagcattcctgaaaaagattttctgctgtttgagtcatgatgagctttaaattgatgatccgccgctgctttctgcggacaatggcctaaaagatttaagatggtagccctatctttttggggttttaaaagaattagtgaaaatatttataggaaaatattccaaaaacttgaaactaaaatttgaacaaaaagtctaatgccgaaattaataatttgtaacagaaatattaccaatccttgtaaaaaaaagttaatacacaattaaaaaaaagtatgaaataagctctagaggtcccc

SEQ ID NO: 6865 - DNA, 1415 bp, Heterodera glycines
  misc_feature (106)..(106): n is a, c, g, or t
aaagagcatatacggtaagtcataagttatttaattttggtttttcaactttcgaatgtactaaagccggagggggggggggcattgttcaaattgttcactcacncaagaaaattattggcgccatacaagaagaacaagactctgtttaaattgttcgaattttggtcttcccatttaaggatttgcccaatttggcaccgcttcattatgcacaggttaataattccctcatcttcgccttctttctccaatgtcagcttttcgtgggttcgttcattcaccaattcaaatggctcaattagtgctgaatgctccattccgaaactaatgatgtaactggcagaagaattgttggtgatggcacagagaaatgcctaaacaatgcgaagtgagcacaaatgccgcggaatacggataggaaattttcaaaaatttagccaaaaaactcgaaaacgtgtctaattgataacctatttaaaaaaaaagcttgggttttctgaaaaagatattttacaagataatgtgatgacctccttgaaattgctgacccattcaagagtttcttggtcattagaacaagtgcaaagcaatcgctttggctgtccaacttttgtcggagtgtgcaaccatttggacaatgcttggccagcggttgcatttggcccatcatcttcaagcaggtcgggcaacagattgaaatagattgaactcaggttgttgagatcggtgagaattgttggcgaaatgagacgacgcaaaatgtccaaataatgatttgaaatggtcaactggcgaatgtttgtcgcaaaaattggcaaaatttgccgggctataacatcccaaatcagttgggcatcgtttttggctgaccaaatataaaaattcaaagcgatccctttgtcccaaagttgttgattgcagcggagaaattcgatgacggagtgatcaatgtacctgaaaggggacaaataaattgtcatttagaaatttgaggctggacaaatttaatgcccatatttattcaatcagaacattgtaaaaatcaaaactggcgttttggggttgctgatcatgaatctgacacccattttaaccaatttctaatccttaacccgaacaaaagtcggttagaaaatcggaattggtcaaaatagttgtcagattcgtgaagggaccccaaaaacgtgggaataaattttcatgactaaaaattattagactaaagagtggcccttttaataaatttcaaaaacaaccgctttaaaaaaagaagcgcatgaaaactttagcaaacaacggcatttcccaaaatcaaatgttgcgattttcctcatggtacgagggttgggggggggggggaagatcgatcgtgaaggtacctaacagaaatgtttgaattacttaatacaaag

SEQ ID NO: 6866 - DNA, 5687 bp, Heterodera glycines
ccccatttgtgccgtgtcaaattagggccgagcacctgcgggaaaaagccaatgctttagaggcaatgagaagaaagaaaaacaattgcaatccaaaaaactttcaatgccgacaaatttttttaaattttcatgcaaaaattaatttattttttaatatggcacataaaaaattaatttaattgtaattttaaagcaattgaccaccgaccaggctgactttcatccgcgcatagtacacaaatcggaagaggcaataagtggcaccgatggaaagaatgaccaacgaagtgaacatcaacacgccgccaccgccggtgtgaaaagtgccgaactgaaaaagggcaaatggaatttgattgggtaattgttaaaaaaatacaatgagtccggccaaaaccgagcaaagaatcacagtggcaatgcaaaacaaagtggaacgggcacgagcgaagcgaacgccaacggacgaactgacaaaagaggagccaaaagatatgatgccacatttgggatgaggttgtaaaatgagtttgaccaatcaaaaatgattaaataattttaaaaacatgctattttaaatcagattttaggtaattgatttttcaaaacatttttttgctttttaaaaaaacccaggcccaggcttggatccaggcctcgagttttttcctgggtttttgtccaggaaatccaggtccaatatggaatccagttccttttttcaaaatgtcgaaatctagtgtttgtccattttttggtgattggtcgctttttttttatggctgaccattaaatttatgccttcccccctccctgaacttacacgcctttgcagtgcggacaatgggccaccgtgttggacagcgtgttgaagattatcacctcagcgcagtgcgcgcactgcacgcggcacgtgccggccggcgcccgcaccgccgtgccgacgggagaagaggcggccaaagtgatcacccgacgacagttctgccgagggcacgcaatgcgcgcggaggacgccttgcacacgagcagacagttgcaggggcagcgcacgtacttttttccgggcggtgcggcacggatgggcgtcacctatgacaaaatgaggggaaaagcggtgtaataggaaacggccgacaaaacaaaatggtttcaaatgcccaacctcgttgcagttttggcatcggacgacatggagcgtcgttttgccgtcaagagcaatttcggcctcacaaacccggcacacaaccattggacctgtgaaatgcggttgatgattggggactttggggtgattttacgcgaacagacctcggttcattagcggcgagtcttcgtcgtcctcctccccgacatccgatggcgacccattttggttgacattgcgcgcttggccctgtcccatcggtgttcttgggtccccgtgttggtaggacacaaaaccgcccttaaaaataagaaaatacgcaatttctaattttggtgcattttccggcaatttaatatgtcttatttaacttttacttgcctggacctccccttcttcaccggtgagcgggtcattgtggtcaatgggccgcgcctcctcacgcgacgaagtgcgactgtaagtgcgaggattggacgactgtaaaaggggcaatttctctgccgaactgacatcacgggacattttgaatgtctgcaaaatgcttttaaacttcaaaatttctcaatgacaaatagaaaaattgataaagccggagtgaaaaggggcagaaaacagtgggaataagtaatcagcagccacagatgtttattttctcattttttaaataaaatgctaagcattatgccaaaaatgaaaaatacgaattttggcttttaacgcgctaaatgctagacacacaattgattttattactttttgaagacggtaatcgacagtaaagctttaaccagtattagtttaaccttgatcacatttataagctctaatttaattttaacttccattttatttaaggtttattatttgacaaatttcccgtcagtggctgggcatgaaatgattgtgctgatgaaagtttgttgaatggtgacacaaggtaaagcattttggagttaatttctaagaacaataattacaaatttatttcccatttgaatgaatcgacgcctttcttcgtatctttgtgatctaaaagacaccgatacatttataacatatccgttaattcgaggcttaacccaatgttaatgcaattttaagctttgtaatgatataaatttgagccttcccccatttgtacaagcttatcatgtatttgcaacgtttcggctagccgagcgtttgctcagattattttcataactttagatatcactatttttgctcggtttgatacgatttatttgattgattagaatcgatcgattcgaattccgtttatttcacacattcacgatttgttggtgtaggcagtgcattgagagagagaaagattctacgaaatagacacacttccgtacgtacgtaggcagaacacagacttcacagaagaagagaatggttattgcttttgccactaattctagttgaattaaaagtagtcaatttttatttgtttttttttattgtcaaatggattaaaaagtactgctagaaagccaattttgttttcacatttaggagcacgtaaagttggaatcaaatggaggcagcaaagcggagttggtcgacggggagcaatatcgcaaactgttcattggtattgttttttttggaatagtcaggctccaaatatacccagaattttgttttatctcatttatgtttttaggcgggctgtccctcaacaccacaaatgagacgctcagtgatttctactcgcaattcggctcattggttgactgtgtggtgatgcgcgatccgcagacgaaacggtcgcgtggctttggtttcgtctcgttttctagtctggaagaggttcggtttctttaacaatcggaattggcttttcaacaaccctaagcttgtttgtttttaggttgaccgtgcaatgactgcgcgtccgcataccattgacaaccgcgttgttgacccaaaaagagcggtgaatttttcccgtccatgtttaaatgtaaaaaaaccaattttgccacaggtaccacgggaaatggcaggcaaaggcgagtcaaacgtctccaccaagcgtttgtatgtgtcgggtgtgcgggatgaacacgacgaggattcgttcaaccgatacttttctgagtatggaccagtcattaaggtatattttaaattcattttatgaaagtttggcgcataaatgtttactttgcataaaccttttcatcactgtctaattgtcaggttgaagtcataacggacaagaacaccaacaaaaaccgtgggttcgctttcatcacatttgacgattacgacccggtggacaagtaacaaacatcaaacccttttacaattcttttcttttaaatgcatattttttcttttacagatgcgtacttcttaagtcacatatgatcaatggggttttcgctgtgatgtgaaaaaggcgttgagtcgtgatgaaatgcaaaaggcacaacagagcgaccgggaccgaatggagcgtggcatgcgatcgggaagaggaggaggaggtaaacaaaaatcgtagacatgatcttaggctttcacgaaatctcaggcggtggtggtggacagcgcgggagaggcggtgtccgtggcggacgcgggggtggcggtggttacggaggacgcggcggtggttacggaggtggcggcggttacgccggctatggggacggaggagggtacggtgcggcaccaaatgcctggggcggtgcaccgatgggacagccggcggcacaacaatggggtacaaaatttcacttttggacaatgaatgaattacaacttttttttcgtttctcatggtgtccgagtaaattttatttttccgtttgttaaaatggatgggttcaggaggttatgttggaacctacggcactccgagtggcacttacggtggtcagcagcagcaagcggcgccaatgggtggtcaatggggtggcggtgctgccgcacctgtcgcagcgcaaccggaacaaatgggttggcaacaacagccggccggcggaatggcctctgcaggcggcgcacaatggggccaacaacagccggtggacaccaaccaatacggtgagacggcaattggttatttattggcacttttttttaaaacgattcttttcagcttggccatcaggcggtgcccagcagccccagcaatgggctaacgaccaattctgagctgaagatgcgcgatattgatcgactataccttgaaaatggatgaaatctttttggcactttgccccttttaaattatttttacccacttttttaacgttgtgtaccaacgtgaccatcgtcaatgcaactatttgtgtccatcagtagtcgtatattacaaatatgtatgattctctggtgatttcacgtattttcaatttaaatttgttaatttgatattctgaaaaaaaaatttgatcaacccttttaattgaattttttgagtttttgattctaatattatatttattgcttaatgtgagttgatgaatttgtggggcaatgaatatggataggataatttattatgagttcacaacaggagaacacagtaaaaattacaaatgattcaaaccggcggtgctccactgataattatcaatcggtcggccgaacgtgaacaaggccaccgggtccaaaagcagaacattgctgcggctaaggtacatcatcatttcaagtcttgtttgttcagtttcgacttaatttgtatgctattttaccaaaagttgtaacgaaaaacgaaatttggcgaaaagcgtagattatttgtctatctgccataatgaacaagcattttgcagatggttgccgacgtgattcgcacaagtttgggacctcgggcgatgctcaaaatgctgatggacccgatgggcggcattgtgttgaccaacgacggcaatgccatccttcgcgaaatcaccgtcaaacacccggccgcaaagacaatgattgaaattgcgcgcacccaagacgaggagaccggggacggcaccacctcggtgatcatcttggccggtgaatttttggcacaggcggaacagtttttggagcagagcattcacccgaccgtgatcatccatgtcagtacaaccgtacaatcaaatgaaaaaatacaatcggcgagtgggtcacccatccaaattcattacaaaaatgcttgattcagatttttatgtttataaattattgctttttgtagggctatcgcatggctctcgaggatatcattgagtggacagaggagaaattcaggttttattttggcgttgatgagtctaacactttttcatcgtcccctttcagcaaaccagtcgatttggcctccgagtcggaactgaccaccgtggtgaagtcatgtttgggcaccaaaatgttggccaagtacatggacctggcggtgaacatcgccctctccgcggtgcgcaccatcgacgtgaccaacaacgactttcgtgagatcgacatcaagcggtattgccgaattgagaaaatccccggcgctgccattgaggacagcaatgtcgtgaagggtgtg

SEQ ID NO: 6867 - DNA, 1036 bp, Heterodera glycines
ggtggtgttgcgtggaccgagcaaggacatcatcaacgaggtggagcgcaacattcaggacgcgttgcactgtgtgcgcaatgtgttgactaacccgcgtgttgtgcccggggctggtgcgctggaaatggccctttcgcatgtaaattacatattaatttgtcgaaggggggggggggtaatttttcgttgttggttttctttaaatcatattttctgtcgtcaggctttgttggagaaggccaagtccatcccgggcgtccgtgccggcccgtacaaggcggtggcacacgcgttggaaattgtgccgcgcacactcatccaaaactgcggcggctcctccaccatacgtcagctgaccgcactgcgtgccaagcacgcccaacagccggacaccaactggacatggggcatcaacgggcgggacgcgggcggcgagttggtcgacatggcgcagcccgagggcgtttgggactcgctcactgtgcgactgcaggccatcaaaacagccatcgagacggttgtgccaagacaaattacgaggggtatttcttggtggtaccgccacggtttcaggccattatgattttgcgcatcgatgacattgtcagtgggacgaagaagcgcgacaaagacgagaacggaggcggaggcggcggtgcaatgccgggtcccggagggtttgaataatagcgaagaaaggcgaaggagaggaaaggaacttcccaattcaacatatttaaagaagtggccattttgttggattgaacaaatttcgaaactccaaaatgctgttgtccgtttcatgctttacttatccattcaatcacaaattgaatttgctttgttttgcctaataaaatttgtttttgtttgaattagttattacaattgacttgctctggcaggtttttgccttattttaaaaaggaatatttattataaagtttgtttgtgcttaacatttattggcaatgtttggcctacttcagggtaaaggcctaaaatgaggcaatgaccaattcctcgattggct

SEQ ID NO: 6868 - DNA, 3368 bp, Heterodera glycines
aaaaaatcagaaatctcaaaaaaatcatatccaaaaaatagccaaaaaatcagaaatcgccaaaactcaataaacacaaacaagtcaaaaaaatttaaatttatttatttttatttaacacaacaaaaattgacacaatggtgcgggatgttgaggaagggggaggggcccattttattttaccacaacccaccgccttccaatttttctctttcttgttttttcaatttggcccaatcccaaacgtattgggcagcgtccgattttttgttgttgctgctgctgccacccgcacctgccgatttcgtccaaagttcatagtttcgccgcctccatttttcaatttgctggtccttttccattttccatttttggggtctttttcttcttcttctttttcttcttcccactctctttggagcaccatccattcaccagacctcttccatttcgggcgattttgttgctctctttgtcgttgttcttttcgttgccgccgttcagtctcccattgcctatgcgcttcatccatagccgcaaaatctgctgccgtcagtgccaacacatcaactccttgcgccgaaatttccatgtcgttttgttgggcttacatctaaaataatattaaatataagttagcgggggatattaatccaagtccccccccccccccctggaacccatacccgttcaaaagttgtaaaacggcagatgagttatgtgtatttttatcttcttaaatactcaaattttgggttgtaatgcatgacgtaaccctaatttagttcagattcaacaaacgaaattagtgaatggccttcaaacttgcaaaaactttttggtcttttgcacaagtaaggctcaaatattacactaaaaatcatgcgattctattagtaacgaaaatgtttcgttttttttgcaaaaaagttgcgattttattagatctgccgaaatactgaataaaaaatttctctttttctttccgtacgatatgggctaaaaaaattttctttttcgggtttaaataaatgtcttaaagcagttatcctaattttattatacaatattttcgtgtcaaatctataattttgcacttgttctcggaattcatttatctttgaaaaagaaaggtccgataaattctctgcttcttgacatttaaatatatttatttctttgtccaatttctaatttttgcatagctaatgcttggtttccataatcatgcataatagttttttaaagccaaattttaagtttttatgacaatatgtctcaattatggtacatttttccattttgctatatcattatttttttgttcttatatacccatatgctcccaagacaattgtttggagcctattttcataatttaacatttggctctgcaccctccgggactcgaaatgtaatctccgggcttccattaatgaatttgcgattgttcctcgagctttgttgcctggtcaaaagttttgcatctctcgaaatcacgccacgtagattcggcttttacgcattcactttaatgtaagcttactttttttttgcatttttttgccttttaaatttaaaatgtacaatttagaatgttttttcggccttttttattttccttatttttttcgttttttttgcggcactggtgtacgccgtatgttgcaagccacatgctcgcccgccttgccgatgcgattcggatgatgaggaggacccgaagcccgtcgattcagtgtcatcccacccgctcgattggatgccgaattgcaattttcagcagtgccaatttggtaatgagttttttaactgacaatttatctcaaatatttaagtgcatatttgactattttttacgggtttttttggcaacgatattttttggctatttaattatgcagtttgagttagcctaattaattactttgaacctacgtgaaataatagggtgattttttcaagacttgcttctaaatggccccaactaaaaaataattcccaaataaattggttaattacaaatgactatttaatgggtctttgtaaattaatgagttttttttgcgttttggggtgggtgtctaatttattaaacaatttacaagattatttagcgccagcacaaaatgtgccactgccacttctgttctctctctccccaccgccaccatattctgccgcgcttcaagcgttccccccggctttgatccgtccgttttcgacttctcccccgacttctttgtcttctccgcttcctcggccttctcccccttctccgctgcccgcgtcactttgccctccttctccttctccgcgttgccctccttctccgccgtcaccgctttccgctcattctccgcttttccccccatctccgcctttgccgctttccgccccttctcggccttttctgctgcccgcgtcgcttttgccctccttctccaactccgctttcctctccttctccggcgtctcctccgccttctccgctccacccgtcattgcctcagcctgaatggctggacgggtggggcgggcgccacttttctgccataggcggatgggaatactgaatgaagtacttttttggttcatttctctcatttttgaagaaaaaaaagggtgtgattttttgatttaagagtgtgggtcatgaaccgatggaagaaagaatgaatgaatgaagagattaaaggaggggagaagggaggggggtggtaatttgatgagatagaatattttttttgttgaattaataaaaaataaaaaaacaaacaaaaaaaacatttgtttatgaggacaaatgtccttatttacatatttatctttaataataaggcatttttattaataaagaaaagcataaagaaggagagcgggtgaatgaataatgaggagggatgagaagaaaggaggagtgaggaggtgaaagtggatgagagaggaggattagcggaaggatgagggaggagcatcagggaggagtgaagagatggaggaggagggatgagtgaaaaggggggggggatgaaggaacggggacgaggaggatgagggaggcgtgaggaggatgagaatggaggaagaggaagaggcaaagtgagacagatgagggaggctgttgaggaggaggaggattgggagggaggaggaggctgaggatgaggggaaagaggaggaggatgagggaggcgtgctgagggggaggcggatgaggtttaaggaggatgaggagggaggatgagggtgaaggagaaagaggagtgaggaggggaaggaggatgagtgaggagtaggagtgatgaggaagaggagtgaggagcggaaagaggatgagggaggagtgaggagggggaggaggatga

SEQ ID NO: 6869 - DNA, 3787 bp, Heterodera glycines
aataataatagttaaataataattataataatattactaaaacattaaataaatcaatgcaagactgtgagtactgtaacactcccccgccccgatacaaccgctttcccagttcatttctcgtcctatcacctcttttcttttatttttttacactaatcacttcgttaaatcgccattttttcataggaattcaaaaacactttatttcttttaccaatgatgatgcaagcctttaatcgatggggctccgaccatggccatcttttttgtccgccgccgtctcaccttggcagagtgatttatgtcggtggccaaaatttttccggtatgacagaactaataataaaataataataataatttatttgcatgctttttagaatatgccacaattctggcacgtaaccctgcgccccgtagagggattttttactttgaaataaaagttctgaagggagggtaaatatcaagtttttgtttttatttattatttttttaatgagactttcgtatttcagtttaatttggattggtcttgcttcgggagaagtcccattgaacaaagtgcctggccaaatgctgaactgctattcttatggcgcgggcggtgacttttacgggcacatgcaaatgtatgaacactacgaccctgcattacgttttgctgttggttacgtcgtgggacttgggctcaaccctttgaccaaagagctatttttcaccaaaaatgggcaccgccttggttctttttttcttttgaatgccttttatttttttaaaaaaccaatagagctgaacaacatgtatgttcaaaacgtgggaacccttttcccatgcgccacattgtcggagcccggtgactgcatcgaggccaactttggaccacacttcctgttcaaatatttctgatttggaggacatgtaaatgggctgacgcgttcccaagtgccatacgatatgttgatcggaaacactgcaacataattaaataaatttcttaattttttgaggacgttattgcattttgtatgtgcaaaaaaaaatatttattccactttcaacttatctttttttatcttccatttttagcatgtcaaactctcacgtaagcacttaaaaagtttattattattattattaatttttaaaaattcgattcacagaatttcgcagggttaaattctaacccgtcagctcaacaacacttatctgcattgctggaaacggtacagatccgaagttttatgattcattaatttttatccaatgtttacaagttgcggggttgcatagttacattggtttttcttctaatggtggtggtggttgtggtagtgtcggcgaaaacaataacaactttatgcacaatgcaccagtggcatatgctatgtcacaatcacgtaaaagtgaagcgcgaaaccatagcgtgatgctttgttattttattttattcttaaatttattttttgcctttataggtaatgatgccaaacgaatctttaaatgccgatagaacgacttgcaccgccttcctgcaacaatcatggcctctcaattcacggatttcgtagaattaacaaaaatattgtcgttttatttttaaaaataggctgacgcttcgtctgatggaagttgaattattgtctgcaacaaacacgtctggagggcacgaacgttatgctgtgtgcaatgcgctgctaacaaattctgaactggcgcgcgtccttgttgttgcatggcgtaatcgggcgcagcctgctgagcaagtgtttttggtgggtggaccaggatcattgtttcggcttaccaatcttgtgtggcgtgggactcgagagaggttgactgctaactacacgctggccattggatttgggtcttcaattgaattattacaggtttaaaaaaaaataaatttggattagaccaaatttattgttaagccaccggcaccgaatatatattcacagtttcatttgcaaacacctgctgtatcggaagcactaccagttcaaattcaatccaaccctgtgctgcatttggctcaacccagcaacaacgatgcggagctgattcaaagcataatgaacgagcttttaaatgcttcataaacacttgtttcttttatttaagtttttacatcttaaggacaacaatagtatggaaatgccacaaatcctcctgctatcactcaggcgcaatcgggaaatcatcaacaacaacaacaacaccaaccaaatgttcaattgggccaaatcccgactactattggcttggttgtaaaccaccagcagcagcaatcgctagttggcgcagaaatccagcaagggcaaagcgaggaaccgccacctggaccaatgacaaatcgtcatcagagccagcgccgcgagccaatacatggaagcactattgctgctgctgctgttgctgcttctgtggaagaagcaaacaccgtaagcattatgtttattaaatacttcaatgcagtatttttaaagaaccaaccggtgtttcggcgccgtcgaaacaacaacaacaattctggacgtggaaccactaatcgtgaaaatcctgttgaattggtgagaaacggttgagaaaacaaaagaaaaaaaaacttttaccaaatattttatttttcaataaattttgagcgacatgtgtatgtgtgtgtttaatattagggggcactgccaaccgtgagacgaaaccagtccgttgcaattagaacccaaccaattcggacccaactacgtcgaagaagaagggaacccattcctacttttgagattggagggggtctaactgctcaacaatgcgatagtattttgcccaacctggaagtgaaccaacaaatgctccaaaatgatgaaagatgcgttgtgtgccagattggatttactttgggatccttgaatgccacggaacttccttgccaacatttttatcatttaacatgcgctcgggaaggttgatgcgtcgaaatagatgtgctgtttgtatgcgttcatttgttattgaccccgaaaataatgcacttttgcttgtcctcgacaacgaaatcagcaatgatgaagaataaatcacatatttcttttttctttctttatttgatcaaataacagcggtgatgttgggtgcaccgtggtgtaatggtagcacgcgggtctataaataacccgaagtttgggttcaattcccaacggtgcacccataatttaaatgtcacatttcatttcattacattacattacagtacattacattgcattacattgcattacattgcattacatttcagtactttacattacattacattacattaaattacattacatttcattacaatacattacagtacattacattacattacattacattacattacattacattacattacattacattacaattcaatacaatacattacattacattacaatatattacattatattacattaaattacattacattacaatacattacattacattacattacattacattacattacatcacattacattacattacattacattacattacatttttttataaagttttttgttataacaaccaacattttggtatcaatactccattttagtattaatcattgtcattaaatttacaaaagctcgtttttatttattattattatttagtttagattttattaaaaaatgaatcgttttgaccaaaatgatttcactataacttctgttcatcaaatgcgcaatcgccctcggaacacaatggagaaattgcg

SEQ ID NO: 6870 - DNA, 4762 bp, Heterodera glycines
  misc_feature (1620)..(1620): n is a, c, g, or t
attattcttcctttttttacagagctatttggacccgcctccattacgcggaaagttacaaaagcacggcaactttgagccctagttgcgcgcaaatcgcaaccggctggatgagatcaaagccacggggcaagaactgatccaatctgggcactatgccaacgaacacattcaggtggggaaaagcataaataaaactttttaaagaaaaggaatgcctaaatttttgaaaatttgttaaagaccgaaaaaatatatatttcccgctccctaattaggactgctcattgcaattaatcgttttagaatttctaatttgtatcatgggcctatttctttttttacaattacgattacgccatcgctaaattaaaaattgttttctgatcatatagacccgtctcaacgaggtggaacagttgtggaccgagctggctgatgccagcgggctaaagggtgccaagctgcaggaggccaaccaggagcaattgtacaaccgcaacattgaagacgtggagctgtggctcagcgaattggagggccaattggccagcgaggacttcggcaaggacctgatctcagtgcaaaatctgcagaagaaacttggccttgtcgaaagtgactacaacgcgcaccaggtgggactaacgggaaaaatgatcaatgggagggaagggagaaaagtaaaggaatatagaaaaagtttcgagactcgactcgggttttttctgggaaataattggtatagttttatcgaaactggtgaaatctttgggttgagacccctatttttcttttctcattttgagtgaataaattgaatattttgttctaaaaataattgtttgccaataagatcaaaaatgtcaattcaggaggcccgactttgatttactagtctaaaattgtatttaataattttaatttttaaacatttatcactatcagagcgaaattttcgacatttcaggaacgcattgacgcgatcgggcatcagacgcgcgagtttcacgacacgggccacttcaacgcaccgttgatcggtaaaaagttcgaggcgttacgcgcccgcttcgaggcgttgcgcgagccgttgcagcgccggaagcaaaagttggccgagtcgctgcttggccaccagctgttccgcgacatcgacgacgaattggcatggattcgagagaaggaacaaattgcagcgtcgacaaaccgtggccgcgacttggtcggcgtgcagaacctcatcaagaagcagaacgcactgcacaccgaaattgctaaccacgagccgcagatggaacaggtgaggggcggggtgaaggtatactgtaaattacggtagtgagtggagcagaggttaacttccaagggcatttcgcttactgtacattacagtacaccatggtcttggattatcaaatagggaataccatgggcggattagttgttaatttccagtgaaatggcgtaaactgagaccgatagatcaagaaattaatgaattgaaattttgtttttatgggataaagaaaaaaggaagtgatgtcaaacaaatttttggaaaatttaacattaaaattgtgtggatgattttatcaacaaaaaatcatgtttttttanacacgtgcaggttgcacaatccgcggaacagatggtccaacgtggtcacttcttggcaccagacattcgcgacaagaaatgtgagacagaattttttttttttttacttattttgggctcggggaaatttcttgaatctcggagtcacaattttcgaactgataattgtcattctcgttttcgactagttaaaatataaatttagcccaactgcgcgaccaattggcgtgcactgaaaaccaaggcggacaagcgcaagcaggacttgcaagactcactgcaggcgcaccagtacctggccgacgcgaacgaggtgggcctttactttttttctcttttataccattaaaaaatttcaaaaaattttcctttaatgacacgcgcccattttcactcaattaattttgtctctttttcaggctgagtcatggatgcgcgacaaagagccgctcgtggtatgttattctgctttaacgctggaccccattgtgccattattttgtgaaaaattgtcccaaaaatggctaagatttgtcatttttggcgcaaaacgatacaaatccgttttttttccccggcgctgaaaattttgaaaaagaacactggctaaaaaaattttaaatcagtagatcaaaaaaaaagaactctttcgggtgcttggatacgggcctgctcttccttcattttttgatcaaccctgtgctaatggattttgaaatttcagggcagtacggattacggcaaggacgaggacagtgccgagtcgctgctgaagaagcaccgggcaatgatgagcgacttggaggcgttcaacaccaccattgacgagttgcgccgcgaggcgggacaatgcaaatatcaggagcagttggatggacagttgggcaaggagtgtgtggtggcactgtacgaggcaagtggcagatgggatggactgatcggattgatcgggtcaaatataaagtaatgaggtgtcaattattttttattgtggcactttgtgagggtagataaatagatattcattagttgatcagtcagaaatttacggaatttgctcatgaactgatcaggcaagtgggatttcttggtgatcaaacattggtggaaattattaatttttgaaatatgtttacgtagtgttgctcgagaccgataatttctcgacccagaaacccataaaacacatggcttttctcgaattatagctctgatccgttatttttgattagcattattatgtgccacatgtggtgcattttattcccctgattcgtttcttctctcccaaacctccatttaattctaaattccaattgttcatataaattactcctaccaaatctcagctcagctcttggggctgggtaattaggcctaaatgctaaggcaaattttcttaattaattgattaccattactatcaatcactaaacacttttcgtatctcttataaattatgtctttttttatttaagtacaccgaaaagtcgccgcgagaagtgtctatgaaaaagggcgacgtgctgacgctgctgaacgcgtccaacaaggactggtggaaggtggaggtcagcgaccgccagggcttcgtcccggccgcctatgtgaagcggattgagcccggctcacagcaccaccatcaggtgggaaagccgacatagctaaaacaaaaaatcctaatcttaacggacaaccccgtttttggaattttatgagcaatttaatgagagaaattcccaaaattttcaaaaaataaccctagcaaaagaatcaattataaaaataaattattattatttttttaaaaactatttcaataaaattaaaatgattcaaacacacgatcgatcagtggacctgtgattttcgagaatcttgaagccaacataatttcgatctcacttctcggccaaattttccataacaaagctgctttatttgtcaggcgttggccggccaaccgatgaacaccatcaatgccaagcagagtcagattgaggaccaatacaagcgcctgttgatgctgggcgagcagcgcaagcgcaagttggaggaggcatgcaaggcctaccaggtgagtaaacgacggttagatcatttttaaacaaaattctttgtcaaaatcttgctcaaagcaatataattttaatcttccacctgtttaagttgttgcgcgaagcaaacgatttggcagaatggatccgatcacgtgagacggtcgcctcgcagcaagagattggccaagacttggagcaggtggaggtcttgcagaacaagtcagtgagataatgaaaaaagaggcagagagagcgaggggagggagagagagagattatacatattttcgggtttttccacaaagtcctatagatcattagcagcaatgaaatgaaaaaataaaatttttaagggacaaatttgacaaacttgaagaaaacaattattaaatattttcgtcctccccccgtcccccccccatcgaaaatttctctatgttccttcaaaaatatgctaaaattttttaaatttatccaagcaaattaacgtctaacactaatgatcactcttactaatttcagattcaacgacttcaaaaatgatctgaaagcgaatgaggtgcgcttgcaggagatgaaccaaatcgcgacacggtaagaagaagatttttggatgattttttcacttttattttaaaaaatattctaattttccaaagattgtcccaaatgggccaaactgagacggcggtgcgtattcgtcaacaaattgacgatttaaacgcgcgatggaaagcgttggagcaaaaagtgcaattttaaaaatatttaaaaataaattaactgcattttaatatttatttaattttcaaggccgaagagcgtggccaacagttggagtcggcccatgaagtgcaacgcttccacaaggacgttgatgagaccaaggattggatacaggcaagctgcagcatttttagcctctctaattagaaatttaaaaaaataataatttaaatgtttcggtgtatttgcaattttaaactttatgccccatggaaatccgatttttaaatttacgccttcgtctagtgaaattgtcatgaaaatccacttaaatacaaaaaaaaaaacccgggaag

SEQ ID NO: 6871 - DNA, 1214 bp, Heterodera glycines
aacgcaccctgaggcggctgaacaaatttatgacctgcaacgccaactcaacgagcagtggtcaggactgacgcagaaggccaatcgtcgcaaggacaaactgctggacagctacggtgagttttttcttcgatcaacactgatcggaagggactcagtccgatcatcgaactttaatttgtttgactcggccggaaattttcatgatcgcgcctcatttttctgcatccactgaactgattgagagttttttgcaaaaatttcaagccttaggcttctccgaataagtgatcaaaattgtaaaaaaaaattattttttttttgcacttgttactgatcgggttttatgtttgccattttttggctttgaattaagtatggaactgggggctgatttataatttgcacacttttatttaaaaatttcattataaaattttaatttatttactattttttagattatcagcgcttcttgtccgactaccgtgatctgatgcaatgggtggacggaatggtccaattggtgtccagcgatgagttggccaacgatgtgactggcgctgaggtgggtagcctatcgaactcgcaataaaaaaccgagaacgctaattcgtttgtttcatcgttgttgtgttgcaggcactgcttgagcgtcaccaagactaccgtaccgagattgacgcgcgcgcgtccaccttccacgcgtttgagcagttcggcaaccaactgatccgcagcgaacactacgcggccgaggacgtgcgccaacgaatggacgaggtgaaaactgtataaaataggggggggggggtctattttaggaaacacggtatggcatggataaataaaattttctatttgtccggctcaatttttcgcttatttaattttttcttccgttctttttttaatcctttattttaaaaatttgcattaattttccgctttttttcactcctcttttttaccctgtctcgtgttatctacttctttttctctctgtctctgtttctctgttctcctctctattttctattattttcttctacagtattatttacagttatcgtatacaaaaatcattttcacttaaggtgaatgatgctcgacgtcggctggaggaggcgtgggtggagcggcgcaaggtgttggaccagtgcttggagttgcagctgttccatcgcgactgcgagcagtgcgacacttggatg

SEQ ID NO: 6872 - DNA, 1383 bp, Heterodera glycines
tgactttatgatttttaattaatttaaatggcaaaatggcacggcgccataatttataacacaatagcatcagcttttaaatttgaaattctttcgccattaatactgcctattagggatgtgtcggccgatttccgatatttttgggcccggaattccgattttcagttgccgagatttgggctgtcgtaatctcgatcgccgaacttttttgggccatcgaattccgactgccggttaacgcaattttttcagcagtcttaattcggtttccgaaactttttgagggcgtcagctcctatccctgctacctacggaaagcattttagttttttagcaattttatttattaaatgcaaaattttagcatctttaaaaaatcttaaaaaaccaattaaaacagtaaaaaccagtttttggtcatgctccaaattgttctgtcttattttttgcctattgcttcaggcttttctgtcccaagaggacaccaccggggacaacgtcgagtcgctgatcaagaagcacgaggactttgacaaggcgatcgcgtcgcagcaagaaaagctgaacaacttggacatgttggcacgacagctggtccaagcagggcactacgcggcaccggcaagttgcttttaacagtgccaataatggcaatgccaatggacctccctgctgagtccggagcagaccctcgcacattccccccccccccctttctcccaaaaattacaaatttgatctaaaagattattttaaaacgattttttttgcgaattttcccgattttttcataaaatgagaattaagttaatttttttttaatttcttaaaatttcaagcaccatgaagttaatggcattttccccattttccagcaaatcactgccaaacgtgaccaaattttcgagcgctgggatcagcttaaggcggcactgatcgaaaaacggtcaaagttgggcgagtcgcaaaccctgcaacagttctcacgcgacgcggacgaagtggagaattggatagcggagaagttccaagtcgcgcaggaggagacctaccgggacccgaccaacattcagcagaaacaccaaaagcaacaggtggagtcgggagttggggacaaaggttttggcgccgagactcgatttctgagtggaattttctcaattttgggcaaagtttttcgtaattttgatcgtttgtcgaaataaaaaaaaacaatttttagtattttttgtgcatttctcatgctttttaggacagcaatttaccccattattaatttccatcatttcacgtttccaccctttatttgtcttaatattgccattaattttaattgctttctgcaggcatttgaagctgaactgtccgccaatgctgatc

SEQ ID NO: 6873 - DNA, 949 bp, Heterodera glycines
atacttaggttctgattagtgctctctcgaagatcggtggaaacaattttttgcatctttaaataaaattttgcaaaacaaaagccccccgggcgttttttgtttaacaaattttaacattttgacaaaaatttattctttattgaaaaaatctttatgcatatgttatgttttcataaatgctgatcaaattctttatgccaattagggggtaattaagcttattaattaagtattttctgccgttctttcaatgctgaatcattgccaaaaacagtgccaaaagtgccaaattgaacaaagcattgacgacaacaacaaatgattgtcggtaggatgaagaagctggggcgtagaaagaactgtcaaaatatctgaataaatttaaattaatgaaaagcttaaatttcaaataatttcctaaccaatcaatatttggcgaaatgttttttcgtttttaaattaaaaaaaagtgttcccgagtcccgacggtgccgagcgtaatcaaatgacattcaaaagaagtctcggcgtaaattcagaaaaaatcccaattttttttttgggtgatctcgacctcatcaaatttcgagaccggactcggaaaaaccccggattttttgggtgtctcagtctcatcgaatccgcttcgagaaatcccccccccccattaatttaataacatttttagacaatgacaattatttttgcaaaacagtagggactcataaatagttaaaaattaaaattattttaaaattaaatttttaatttctcactcatcgccaagcgcattttccaggcgttcattggatgctgatgagctgctcctttcgcgctgctcaattctgctggcctttggcctgtcaaaaaataaaaatttttaaatttaagtttagcgccaaattttggcattttgtttttgctttttgtttgtcccccgacttgg

SEQ ID NO: 6874 - DNA, 3107 bp, Heterodera glycines
  misc_feature (3036)..(3036): n is a, c, g, or t
  misc_feature (3048)..(3048): n is a, c, g, or t
  misc_feature (3051)..(3051): n is a, c, g, or t
tttgtttcaaatttttcagattccctcttcgaaattttttctggttacgggcctattcacgggaatgggatgggatataacgttgaacggattaacgatcaaggatcctgtttactgtacctcggccttcagacgatccctttcctgtgccataatgcgacgcagcgcggcactgccgaacaccggctcgtactgatcactgtataaaaaggcaaacaaacatgctactctgactgaatgaattaacagcagaatgtgagagtaagggcaaatgatcaatcgataaatcctcgggttactgtaggaattgttttctctaccaattccagaccaagatcacccaccccatgttaccttaattagagcccggtgcatgacgggatcccgcgcgggattttacggaattaatcccgcgtgatcccgtcctgcaaaaatttgaatcccaatcccggcgtgagattttacggaatcccagtccgcaatcacgccttttttggaaattgctggatttgctggattaatcccgcgggctccggccccgcaaaaactttgagtcccaatcccgcagatctgaatccggatcttttgaaatttgcgggctctaattttaactaattatatatatattttttatctgctttacccaccggctgctcacgtggatgacatggacccgattgtgtcgatcatattcactttgcaccgtgctgttctgcaacggcaacaattttgaagacgaatttgatggctttggcatcgctgctgaggaagcagccgatggtgccaatgatggtgccgattttgatggtgtagttggtctgacggcggtggccgggctcttaattgaaggagttggaaaaaatggcaaaattttgcggtttttgctgagatttaaaaattaccgtatttactgaattattttcctttcccccccccccctgtaattgtaccccacttttcaggggtgttgtctaagaaatatagcccccgaaattatgagggtcgtcaatttaaaaaaaaagcatttttttaaataaatttaattattttttacatccattttttgacacatattttttacaattttttgctccttatgcgcacgatggaataatgagttcacagtttttgtgcttgttgaagaagtgagccgaaaatttgaaaattcgggtaaaaaataatttttaaaaaaatactttttcgatgacaaactctgagccgaagcgaaattctaaaaaataaaataatataaaatctcatttttggctgaaaaatatgtattaaaattaacttaaaaattgcgttccaagtgtccttatttgtccttaattttgagtttggaattttttattttttggaattttcagtttttatgattttttaaaatgttttggcgctttaacttatctttggtgccaaaatcctgtggtttttccctattttgaaaagttgggaaaacaccgtacttaattaagccaactccatcattacagtacacccaccatttatatataaattacaaatacagtatgctaattaaaccaacttacagtatgactgatgcttgttgttctttttgttgtggttgtgccgatttcttcagtgccatcgtcatttttcaccaccggatgttctgccaaatcggcaaagtccacctgccgaattgcgtccagcaatttttgctgaaattgcgcctgagacgtaaaaaattccaccccctaattaattaattttccttaattaattaatgtttgtttttgttttgcctcatttccgctcacaaacgcctcataaagcagcttcgaattttcggccgtgttgcaattggaacggccaaaacaccagcagcgaatgttgcctgaaaaatggcattttttgcgccctaaattttgattttgagtttttctttcgaccaacaggcctaagcaaggcctagggttttgaaaaatttgaaatataatgtttcattcacaaacaaaaaatttacggaagcgccaagattcactcattttctgaaatccatttttccaattaacaactgaattaaaaaaaaaattttttgctgcgaaattagcgaccgaaataagcttgaaatttttttttggttttttgaataaatttttcttactccgatattaacaattgaattttgaatgaaattttaattttactaattatttttccaccatggttttcatccattttttacatgttttcttacactatttttgttccttatgctaaagatgaaataatgagttcacattttagtgaaatggatttttggaaaattaatcgacccctcgggatttagggttcggatttcgaacattttaatttttctaattaatttgtttttccacctgaacgtttccgtacacagccggagccctgctgctccccaaattcgcccttcaacatacagacaaattggttactgtccaaataatcgtagaaagtgacggcatttcgctgcagggcaaaaaaaaaatatatttttttaatttctccaaaatttcccattttttacttgaattcgaattcggcagcctactgtatgagctggacaatgttcactgactaagccgaaccctaaacagaacttatttggttggtaaataaatttatatttatttattttgattaaatatttacaattaaaatgaaaatgcaattaaaaataataaaataaaaatttaaaaaaatttatgttatttttctcctaattttgagttcaaaaaataaattaattgtaatcaattggaaagtttttgcgactatcaaatttaaatattttaatccaatataaaattaatttaaaatttaaaaatttaattttattttgagctgaaataattgtttgattggattgttaatttgtgaaatttgaaattaataataattgatattaatgtatttttttattttcaatttttatttaatactaattattagagaccggacgggaccggggcccgccgggattttgccgggcagtcccgagatctcgcccgggtccatttttcaagtcccggncatttcaaattnccngtctatactaatttatgcccgatatattcaaatttcattcattttagtcataaaat

SEQ ID NO: 6875 - DNA, 1600 bp, Heterodera glycines
ggggtttctttgatgtcctcattatcgtcattcacagataatcagatcatcatcatcatctcttccgtaacatactttctgcataatatacattttgggctgtccgtctttgctcccacaaaccgcccgaaatctcataagaagtgaaattcctcgcctgtaaatatcaaaaacgtcaatggggggagttcgtcccgcaaatattcaaagacaccgccatcatatcattttgtgaaattgtttcccccccccccccccctcccgtcgtcgtccatcatcttttgcttgtcccccgggggtcggtccgtccaaaacggcacatccgtcgtgccaattccgcccttcccccttttccctcggcactttttcttcgccgtgccgtgccaatttgtttttgaccaacacaaattttgacacattctttttgctgctgccccggttagcgagaagaagatgtgttattataaattgtggagatttgggcaaagatttatgtgcacaaacgcggttattagtacataattttgaaaacaaaaaaatgaatggtaaaaacttataaattatttttaaaaaaaacatttattttgtttttattttggaaaaaaattaaaatggaaaaattttagtgaatattaagttaattaatataatcgagatgaaacttttttgaaaaaaaacagaatgaaaatagaaaaattggccattaaattttcgatcttaaattaatggagaatttttcgaatttttttataaaccaagttgttagcttaagtttggcatttaaaattttaaattgccagatttcaattaccaaaagctaattgccccaatttttcaaattttaatattttcccacatgaaaatcgagattttttggttcattaaattcttcacagtttccaaccaccccgtttcacagcacggaaaaattaattgaatttttttgaggcttcaaattggtccgttgggattttaaaatggcccccaaaacattggcaacacttttcacacattgttttgcccccgaggggccattggtcatttccatcggagaattgagcccacaaaaaaaagaaattgaattagcactttgttgaccaaaaatttcatcgcctcaaagcttttttggggattagagagaaatatttaccgggttatggtattttaaattacggtaaatgcggcgcattatggtattctatgtttttaaatccgtatttcctataatacagccccctgaaataaagccccccccctctgagggggttgaaaaatagagccccggaggctctacttcaagaaataggataaattgaaaaaaattttactttaaaatagttaaaaattgttttttgcatttaaaaaaattatttgtaatttttttgtaccaacgaataattttttatgaacaatctatttttaattatttttttttaaatatatttcttgcctgctctggacaccaaacattggatgtcagaagtggcacttttcacgaaaagtgaaagtgccaagcacaaaaatgaagcgtaaagccgtgccattaaaacaaatcttaaaaagggagattaaaaatatatttcaataaatcaaaaaacat

SEQ ID NO: 6876 - DNA, 7444 bp, Heterodera glycines
tctgtcccggccaaaggcggcactgacggaaaggcgcacggcggtccctcggccgccggtgcaaaggcaacggaaacgaagcccaagtcgaagttttgctcgattctctgaacccggcaataaaaaagagacgcggagaaacggggagaaaaatcggcgcctaagaaaatttgattgactttgtcttttttgacatggaattttgcacttttattatttttgctgtttttttttgtctcttttgctgcagctgagtgtctaactgtcgcgtaaaaataaatttgcttaaacatttttgcattggtgaattattatgatgggcataggtcccatcagaatgggcacaacactcaaacttgaaaaagcatcaaaagtgggaaaacaaatatatccaaggtttgaccgagcaaaataagagtttaattatttattttctaagaaaaatgggcggacaaaaaacaaaaaaataaaactggtgctgatcaataatcaatctatacgaattatgtatgaaattgtttgtgaatttgctaggccggaccataaaagtgccaatggggcgaacctaaaaacatatcaatgattattgtgtttaattaattattattttagactgtttaattttttgaatagtttgaactaatttgtaagttatggtttattattttgcaaaataaaattaaaataataatattaattaattattactatcatttgatactttttttaattcgtcccattgagtctttttttaggttcggctcagcacagtatgacgtaatatttatattgccatgtcaaatcggagaaggaattgtcgtcggaatacaattggcaaaataaaatataaaaaacatattggtaaaatacatattttaaattgttaaaataatatttaaaatatttttggtgaatttagtggcctcgggcagagagaagagagcgaaggattgaccagccattatttattaattggaaaatgacgaaaaaattatttaattaggtaataatgtgtgaaggaaggaggaggagaaggaaggcactttgggggaaaagagcgccaaaattatgtcgtttaatgggggggggggggcaggagaatctgtcaaaatgcacaacggtggaaaatggtgggaaaatacggtaacaaatggcgggaaaaaccgtactcacagaagagtcgagactcgattaatctcactttgaaacttaaaatgcaacccaaaatttgcatgagattgtcgcaaaaattacctctaaaattttagtcaaaaaccaaacgagacaaaaatctcgagcagtacacgtgaaggaatatcaccaagggaaatgctttttgcagattctcctgctgtttttgttgttgtactcacataaaaattgtggcattttttggaacccgataagtgcgcggtgttcaatttaaggggaaaagggacgggggcgagggataagaaatgtgaacgaatgtgttgtgttgcacagcaggagcagctggagacaaaaccgggagagatgtgcatggatgggcacattgtgccttcgccatcgatctgatccgactggtcagaaattgcgtcgtcgtcgtccgtcggcccgtccaaaaccccccgcggcagtcaatcagtaatcactttttgtgccgtgccgacggcgttgtctggtgcgagctggccggcgtgttggaccgggtggagcccgccgcggtcaccggcacagccatggaggagccgctgccccgcccggtgctgaacgttgtgctggagctggccgctgagctgctggatgccgtgaaaatctccggcttttgctgatgctgcagcacacccgggcctaaacatcggggcaaatggcaataaaaaagagaaagtgtaataaaccgacctccgagtgtcggctgccacatttcgtagccctccttgggcaactcctccctgatcatgttcagaattgtttgggaagtgtctgaagtgatcggaatagtaatcggacaacaaaactctgttgtgacaaatgcaattttgatcagtctgatccgttctcatccttttattgactccctttccctcaccaaatcactcacccggcttcagaaaggcgaacaaacacccgccaccgccggcaccggcgggaaaagtttccggcggtacagtcggtccatcctccaccaaaaaattttggaaaaatatgtaatgcggtaaaaaaaattgaaaatttgttagtagatctcacaaattaaggagttttagaaaattttaaatttagaatttttgatagttttaaaaaaaaggttgattggttaaattttgagatgatttttgttttctaaattgaaggcaaacaattttattcccgccccgttttattccggcagtttgaaatacaaattccgcccggcccgattatgttccgtaaaaatacgaaccaaaaatttctgattaattaataattaggtgttcgttaaaagagaattctcgtctcttttcttgacttttagcgcgtctcgttctcgtttttttctacattttctcttgtcttgtattttctttttcttttctcaatatccctgttgttagttttctcatatttatttttcattgaaaccaaagcattgtctaaaattggcttgtataataatccttttatttagcggcaataatgagtgaacttgccaataaggagaaaaagagccttactgccgcagtcagcgcctccagcattggtggttattccactctgctcgtttttgttgtgcttggcctcgcttggtttgttgggttcgcttctcgtctgtttgccattgtccgtttcgagtcgatcatccacgaatttgacccatggtttcttcttttcgttattgaatgttcaccaatttaattattcatttgttaggttcaattaccgtgcaactcattacatggttgagaatggattctataattttcttaattggtttgatggtaaatgttacaataattcatttccgtaaattactcctttacttatgctgttttcagaacgcgcttggtaccctcttggtcgcattgtcggcggcaccgtttacccgggtttgatgctgaccagtggtttcatccactaccttctttcttgcctccatattccggtgcatattcgagacatttgcgtttttctggcaccgactttcaggtcttctaatatttgttttaatgcttaaatggtttttgcttttcagtggtctgactgcaattgccacttatttgctgaccaaagaactttggtccactggggccggacttttcgctgcgtgttttatcgcgatttctcctggttacaccaggttggctgactcgacaaaattttgccgccttcaggaatccattctcttttcagtcgttcggttgccggatcgtatgacaatgagggaattgccattttcgctcttcagttcacttactttctttgggttcgatcggtcaaaacgggttctgttttctgggcagcactcactgcgctttcctacttttacatggtctcagcttggggcggttacggtatgactttaacaatctttttgagaataaattagtccatagtttagttttcatcatcaatttgatcccgcttcatgtgtttgctctcatcatcagtggcaatttctccaacaaaatttacatcgcttataccactttttacactttgggtcagcttatggccatgcaggtgttccctttttcgtcctttttgtcttttattgctttttaggtcccttttgttggtttccaacccgttaagaccagcgaacacatggcagcagcgggaatttttggacttttacaggtcaaaatgctataacgaaacgcatcactcagtgcatttggtacgctttcgttcgttgtttcagctcatcggggccctccgctttctgcaaggtcgtctttctcgcaagcagttcatcactctgtttgtcaccaccattctggccactttttgtgccggcattgccctgctgatgttgctcacttacacgggtccaatttatggattttattagtcatataagagtgaccatcatttaagaattcttttcatcattgttataattcctttaaggttatattgcgccttggaccggccgattctattccctgtgggacaccggatatgcgaaggtgcacattccaatcattgccagtgttagcgaacatcagccaacgtgagaagaatttaaacaactgtgagaataagtctaacaaaatgcttttcctttctttaagcacttgggtctcctttttcttcgatttgcacatcaccgcggctgttttccctgcgggactttggttttgcgtcaaaaatgtgaacaacgaacgaatctttggtgccactttttcaatatttgcccattgtgctatttgtccatttcagtgattctttacgcggtcaccgccgtttactttgccggggtgatggttcggctgatgctcacacttacccccgttgtctgcattctcgctggcattgcgttctcaaacatttttgagaaatatatgttggacgatggagacgcaagaagaggaggcgaatggcgagaaccgaaggatgtcaaagaaggaggtgagacgaggagcaaaacatttaggaatgcctttctgagatggctttttaatctttttctaattcctcgcccaatttagaccgccgtctctatgacaaagcgacaacaaaaggcgggaagccgccaaaggtcccccaggcgacgaccgcctctttcagtccaagcgcacaacaagaaactgtggaccacattgggatgaacacacggtacaggacatggtcctctgttccttttcggatgccttctctctcagttccatcgttttggtggcgttgcttttcatccttttgatgtacgtcgctcactgcacttatgtgaccagcaatgcctattcccatccgtcggttgtgcttcagtcgcacaccaacgatgggtaagtatttgaattggattgtcaaactattcacaaattgtagaggacgcatcatcatggacgactttcgagaagcttattactggttgcgcaagaacacgccggaggatgcgcgagtgatgtcatggtgggactacggctaccaaatcgcagggatggccaaccgaacgtaagtgatattcggccgtccaatggcaatgtccagcaatgagtcttttgcctatgaaatcatgcgtgatttggacgtcgattatgtgttggtcatattcggtggtgtgatcggttacagtggcgacgacatcaacaagtttttgtggatggttcgaattgctgaaggggaacatccgaagattgtaagtttttgtttttttcgagtcacttcattgatttcattggcataatcgaagattcgcgaaagtgactatttcaccgagtcgggtgagtacagcgtcggagcgcaggcgtcgaagacgatgctcaattcgctgatgtacaaaatgtcttattaccgttttggcgaattgagagtcagttggctttacttcctgatagcactgtttcaactttctgttcctttcagattggatacaatcagccaactgggtttgatcgcactcgtggctatgccatcggtcgcaaagactttaccctcgaacgtctggaagaagcgtacaccactgagaattggcttgtccgcatttaccgtgtggtgcagccttcttgcgcatctcgcgaaacattggatttttcgccaaatccataaaacgactatcatcttcaacgtcaatttgcttcttttttgctgttcgttccttcatcttcgtttttctaatatagtaatacaaaatcaaaagtttttgtaaacaaaaatgtgaaagtaaagtaataaataaaaagcctaactttaaaggctacattactcatcgtacctaaaacatcaacaatgtattcacttaaatattcgttggtttttattcattttgttctttgggttttgtacgttccttttctgtaccttttcgcaagtgtctaagtgctgacttccgttcttttttgtaaaactaaaaatggtctaaaaagtgagtaaaaacagcaggaaatagaaccttaacaattggcgctctctttttgtcccattccttacgcaatgtctcttctttttggtgccgacgaaatgaagaaaaggatgaacggatttcgggtgtgtgttcattgacaaagaaacattgccacatgtcaccatcgccgttgggtggtttatacaacgaaatctgctaattagagagcatttattatatttgaaataaaacatacatttttgagtttgggtgcacttttttctgtttcgttggtaagtctcgtttttttaaggaattgctctggtgaatcatccacaacatttgtatttttgctcttctcattttgttcgggataaatgcgtccgattgaagcaagaaaactaaatggctaaacaaatcccttttattaaacgatttgatttaacagagattactttgctattttgtgttgattcctcttcatcggaatcagcaaatcttgtttgtttgtttatcttcaattctcccgtcaatgatttattgataagccgtctcctctcatcaagctcattttttctccgagtaatgctttcaatccgtcgctcttcgccattttttatttgcgtaatttttgccattttagcacttaattgtataaatttagttattgggttgatgaaaaagttctggtacttttccattatgctgccacaccccaaaattttaaagcgccagttttgtgcaaaaaaattatttaggaggcataaaagccgcaattttagctaaaatgtcatcgaatgtatcgtcatcgtcctttaaagcaccgcaaaaaatatttaggaggcataaaagcggggcgctttccccttcttttttttaaattttggggtgtggccgcataatggaaaagtaccgagatattttcatttttcaagatatgtttaagagagaatccgagatcactacttatctatgtatgtacaaagaaagaatacaataaatgttttattcatttgtagcagtttagaatttagctataaatcataaaagttacatcagaatatctgcatatttactacctaatttactgcgattaaaaaagaagcatttttcattgtcaagggtgggggacgcactttcgaaaaagctgtgttcacggatcacgaaaaaagaaatgaaattcacattcgcagagtttgcactgacgctgtttcagtttggcgaaaaaatggtgcgaggcgaatgagaaattcagtgagaaaactgttcttttatgcagtcggttccaaattagagcgccaaaaagcgaatttttgaaaatttggattttcgactttttgttcgaagtcgagcaaatatgatcgtggaaatgaaatttggaaatatgaacattgaaggcattggcaccatttcaaatgt

SEQ ID NO: 6877 - DNA, 1611 bp, Heterodera glycines
  misc_feature (23)..(23): n is a, c, g, or t
  misc_feature (35)..(35): n is a, c, g, or t
caatttgtcacaattttggcatntagttcaaattntaataataaatttacttaattttctgaaaattgtccggtgccgcttgtcagctccaccgcaaaaaagctaactttttcaaactttgtcgcttggttcaaaatcgtgtaaagataatcccatgcaaatttcaaaagagatttcacgccacgccgccaccttcttcagcggaggctctttttgtctttttgcctctgtttttaattgttttgctaatttctcaacaaggggtgaaaaggattgacaaaatgacagattaatattgaataattcattttttcttctattttttcaattaaatttatttaattgttttttcaatttaattttccgcttttccttcgcttttccttcggtttgtccccattttgtgcttttgcggtgccttttcccattttttggccattgttccgtccctctgtccgtccgttcctccgccttttcttccgtttcgccgcggtccgtctcgtttcttttgtgctgcgcttcgacgggaatgagaaggccatcatcactcattcatcatcaaaattatattcgaattgatcgccgtttttcgctataatttcgataattacgcttaaatatttttattaaatttagaaagaaaatgctcatttattttatttggaatgaatttatattttaattgatatttaattgaacatttttgaaatgcaattaagaaaattgtgcgaatgtaatttcaacagtagaagatattataattgtataataataattttaaattaaaatgaaggcttttaaaaaaatatttaatatttttatgtaatttttggctgtttttttggttggtcattttattctgttgtttgtttctgtccttgacctgataaaacattggtttaactgctcaaaaaatgattaattgttatgagtgtgggggaattatttgttgtgaatccatccaatccgatcaaaaaatgaatgattatttatttatttattcattaaattgtttgttgctttggtcattttgatcaatcatttcaacttccttttattttttaaatatttttaattaattaatttaatgcccattaaaatcccattctctcccccgcccatttcatttcatcgataatcataaaatgtccacgctttttttgtatgaaatgttttccgccgattttatgtgtttttggctcggaaatcccttcggtaaatccctccctcggtttttcggcttttattattacaaattaattacatttttttattttatacacaagaaatccgcattgtcaaaatgttttattataatcgcattaagctgaagagaaaaacaaatattcaaaaaatgagagggcatcgaaagtcaaatatttacaatacagccgataatcacagcaaataaataaaaaaagaaagcatgcactttcatcatttaccttaattagcttctttaagctaacatttaaaaggggatatcgacatttaattgaaagaaaagaagcatttcagcaggcattgagcatttgatgattaattaatgaatgatttgttaattaatttcatttccgagggccgtcactgattttaatttattatttttgc

SEQ ID NO: 6878 - DNA, 4992 bp, Heterodera glycines
cgcaaaaattgccgcttgtgccattattgttgtgatcggtttctcttttgggtcactcaaggttggcatccattttcgccaaatttcaactttgcaaattcaattttttctaattaatctgcattcttttttaattatttgtccatctcgcgaattgctcatttgtcaggtgcccattccaacaacttcgcccaaccctttgccaacagcaatttcgagccgggcaaagtcgtgttggcattgttcagcggactgttcagctacggaggatgggacattctgaacaccggcattgaggacattgcacatccgcacaggtgaaaaatgcagtttaaaagatcaaacaattaaattattaatttctaaaaaattatcatcaatttaatttattctaatcagaacttctttttttttgctccttttcctaaactaatcataattagtgtaattaaacattgatttttaatatggcatttgagaaacaatacatttggacatttatgagcaaaactggttttaatgaaaaataattttagtaacaataatggagtatatcgcatggcgtcgttggtgcagtggtagcattgctgccttccaagcagtaggggcgggttcgattcccgcacgacgcagaaatttattttttatttttttttgactaattgtttaggacaatgccattcgccattatcgccggcatggccatagtaattctgctgtacatgacaatgaatgtgtcctattttgcggttctcactgtgacggaaatgagaacatcaaatgccattgccatggtcagaggagagaaaaaatcaaaaaattgtggaattttttagtaaaaaaaaacaaccaaaaatcaatgaaaattttaaccaaatcgaatttaaaactgcttatttttctagtgagaacaaaataatacatatttcaaataataaaaattataatatttaaaatgggtaaataaatataagcaaaacaaattcacggatgaatattttttcaaatttaattttacccaaaatgtcgacttctaaaattaagctgatctcgtggatattgcgctaaatctgccccaatttaggggccatgttcggatttagacattctctgagcgtgtcttccacggctatcttcagtatttgatgccttttttggtgtgcattgtgctgattgggttcggcatcttttttatttgattaatttgttttttaattgtttttagttcgctaaatgccactttattcgggggcagccgaatgttatgggccattgcgcgggatgggtatttcccctcattcatttcgtgtattaaccggcaacacggcagtccacgggcggcacttttcattttcgtatgcattaattaattaattattattttttgttaaaattattcatttttcagtccaagaaaatatgcctgttaaaattatttgaatgttttaggtcgttctcgctatgcttttcacgtttcttggtgatttggatgttcgtctttctctctctttcattttattttaaatttaattttaatttctcaatttttaggaactgattggatacgttgagtttacgaattgggcaagttttttatttcaaaatttatgagaaattcaattattcaaaatctttgatccctccaaataaaaatttttattattagcattgcttaatgatcattggtgtttaattgattcccaattaattatctccaatttgcaggtggtccgttgctgcacaatggtggccctcttctgcatccgttttggccatcgtgccgatcgcattcaccccgaggcgctccgagtgccattggtgttaccaattgtctatttttttgtgtgtctttcgcttgtcgtggttactgtcgtcagaaatttcaagtcggcttttgaccttactatatttcctaatcttaggaaatacggtaattggggggggcattttttggtaattttcttcacaggtcggcaatgattggactttcgttccaggcctttggcctcttcgtttatttggttttcatttggccgccagcgataagccgcttctccaactaccgtaatgtggcacatcagatcaacagtatgcaaagggagactttgaaaattgaatttctgttgaaaaaggcaaaatgtccgccgtcgctcaaattgtttttgacggtgccatcgaagtgaaagatcggcgacaaaatgaggacggactgttcagtctgatgactgatggggacaacgactatttggcgtcaactcacaaagaaaacagcatcagcagcagaagaaggccgaggacacgacggcatttaaacgacggcaaaaaagtgtatccaatggaaaaataacgaaaaatgaatgaatgaatcgatcaatggataataaaagatgaaattaatgataatggattaattaataaattgcgatatatttttttcatttgcctttgaagcttatgcttttgctatacataaaatatgttaatcttaagccaaaaccttgtttaattagtggtgtggtggaaaagagttttataaaggaaactaattaggaaaataaaatgtaattgaaggcactttccgttatacagcacccctctaaaaatgccaggctcccaaaaggaatgcacttttctaaggtaatttttcaagaatatgacatcaaaattgcaataatcaatgcctttatctgtgattttcatccatgattttgtctatgattttaaaaaagaaataataaatcatactttgtttgtccttctgggtttttataaattctagacatgtttctggattctctaaaaaaaacattttttggggaaataatcgacaaaagcatgtgatcaaatcatagataaaagtgttttgacgccagattctcgaaaaattcgtcaagaaaagtgctttcctttgttgggactatgacattttcatttttaggggaggggggggggatgcggcataacgaaaagtacccaatttagcatgatttttcgaaaattcctatttcaaccccaccttttttggcttccatctgacggggacgggtcattaattcattcattagtctcttccccatggtttggccacaaatgatttgcgctttttctcagccaacaacggttgtcggttccaccttttgcgcgagaggacaccgccgccgcgcttcggcggtgcctttgtgttccgtccgtccgccgccgctaatcaaaatttattattcaccgattagtttttcaattagcagcagaagcagcacatctctttatcagatcagtacgccgtacaaacgcaagaaaagcacggaactgctgatgagccattacgaatcattaaaaaaggtggaaggtggacaagtgctaattggcagcggaaccgtccttagatcattttcagtgagagtttgggacgaaggtgtgataaatgataaatcaataatgtcagattgctgtcccatctgagcattaatgggtgattaatgatagttgaatgttgatttggttggtgattgggaattgggacccttccgccctcgcctttttccattaattgattgaccatttatcaatttttcgcttttccccgccatccgcgcgaaatgaaagttgcgtttgttgttgttgttgatgtgatggaactgtctttggccatgccccccaccggttttttctttcactttatgtttttcgctggtggcatttgggccgcctcccaccggtgggccgtataaaaggcgcgcgaagagatggcaaagcatcacaaagcatttattcgcttctcctctcaaaaggacactcaacggttagtcaactccactttttcctccagtttaagtttaatttagcaacatcttctctaaactctctgaacaacaatgatcgccacaactcggtgtgtagtgcttcttttggtcggcgccaccatggcggacgccttcctctcggcatttgagtaagttgcacaacccaagcaattaatgccaatatataaagcatggtctgatcagaatggcctgatcaggtgataatatgggtatttagcaacatttcatttagtgttgcacccggcgcactgcgcgaccgacgccaatgcggttgcggatgcggcggaggcgggggcggcggaggttgcggcggaggatgctccagcggtggcggcgggggcggggccgtccaattagcggtcagctgcggtgctgcacaacaggcggcaccagcctcttccggatgcggatgcagcagcggttgtggcggaggatgcgggggcggatgcagcagcagctgtggcggaggatgcggaggcggtggcggtggcggtggaggcggttccgttcagctcacgatcagctgcggtgctgcacaacaggcagcaccagcctcttccggctgcggcggaggatgcggtggcggttgcggcggagggtgcggtggcggatgcggcggtggttgcggaggcggctgcggtggaggcggaggatgcggcggtggtggcagcagcggtggcggatcagtccaactcgcggtcagttgcggcgctgcacaacaggcggcctcttccggctgtggaggcggtggcggtggcggatgcggttgtggatgtggacgtcgaaagcgcatggccatgcgtcgtcgctgtgttcgcgcgctcggacgcttttgaattggaaaagaataacaaaaaatgcctagattttaacgctttttaattgaatgctttcgccgaaatccatttctagctaattagccctaattaatgttagttattataataatgcgtagacgcaattatttattgcctctaattttcataaatttggtgattaaatgataaaatccaacatacatatggtaatctattgtctaaaagttcacgtgcaaatggcaattaagctccctattttttaagaattggcaaattaagtccaacttccagttttaattttaaataatctctggctaactgttgaacaatttgagcctttatttctcgcaaaa

SEQ ID NO: 6879 - DNA, 2211 bp, Heterodera glycines
gtcagctgcggtgctgcacagcagcgggcaccagcctcttccggatgcggatgcagcagcggttgtggcggaggatgcgggggcggatgcagcagcggctgtggcggaggatgcggaggcggtggcggtggcggtggcggtggaggcggtttccgttcagctcacgatcagctgcggtgctgcacaacaggcagcaccagcctcttccggctgcggcggaggatgcggtggcggttgcggcggagggtgcggtggcggatgcggcggtggttgcggaggcggctgcggtggaggcggaggatgcggcggtggtggcagcagcggtggcggatcagtccaactcgcggtcagttgcggcgctgcacaacaggcggcctcttccggctgtggaggcggtggcggatgcggttgcggatgtggacgtcgaaagcgcatggccatgcgtcgtcgctgtgttcgcgcgctcggacgcttttgaattggaaaagaataacaaaaaatgcctagattttaacgctttttaattgaatgctttcgccgaaatccatttctagctaattagccctaattaatgttagttattataataatgcgtagacacaattatttattgcctctaattttcataaatttggtgattaaatgataaaatccaacatacatatggtaatctattgtctaaaagttcacgtgcaaatggcaattaagctccctattttttaagaattggcaaagtcaaacttccagttttaatttttaaatattctctggctaactgttgaacaatttgagcctttattctcgcaaaaaatgaaactatttttcggggagtgacgacggcaaaagtgcagtcctagtggcattggcctaggattggcaacacttttaacacatcaacagaagaagcaaagggacgaagaaaaactagcaaatttgatgaaaaattggaaaatgaaatttgatggggcgggaagtgagatgagaaaatgaaaagaaaagccataaaaacaaaaaaaaatgtgattggatgccattgctctttttggtgttcgtgccaatccccgcactccgatgctcttgatgaaaggcattttctgctctcctcctccgtgcggtcgtgcagctgctgctcagaagcacttgcggtggacaatggacgggcccgactcgtcgtactcctgcttgctgatccacctgagaaagggcaaaagagtgctcagagggggaaaacaacggacaatgatcagctaattgggcaactgatcagagggggaaaagcattggtgggtcagatcagcccaatgcaaccacaactcacatctgttggaaggtggacagggaggcgaggatggagccgccgatccagacggagtacttgcgctccgggggagcgatgattttgatcttcatggtggacggggccagcgcggtcatctccttctgcatgcggtcagcaatgcccgggtacatggtggtgccgccggacagcacattgttggcgtacaggtccttacggatgtcgatgtcgcacttcatgatcgagttgtaggtggactcgtggatgccggccgactccatgccgatgaaggacggctgaacagagccaaatcaaattgtgccgttgccataggcacgcgccctccgccgggcactcacctggaacagcgcctcggggcaacggaagcgctcgttgccgacggtgatcacttggccgtcgggcagttcgtagctcttctccagcgaggaggaggaggcggcagtggccatttcctgaaccaagacgggaggaagggtaattttggcatcaaattggccaaatgtccgacctgctcgaagtcgagtgccacgtagcacaacttctctttgatgtcacggacgatctcacgctcggccgtggtcacgaaggagtaaccacgctcagtgaggatcttcatcaggtagtcagtgaggtcacggccggccaagtccaaacggaggatggcgtggggcagggcgtaaccctcgtagatgggcacggtgtgggtgacacctgtgcatggagattgatagctatgatattatgccaacgatttggctgcataccatcgccggagtccaacacgagaccggtggtacggccggaggcgtacagggacagcacggcctggatggccacgtacatggccggcgtgttgaacgtctcaaacatgatttgggtcatctgaaaagggg

SEQ ID NO: 6880 - DNA, 2649 bp, Heterodera glycines
tcgggaaatgtttgggctttttccttttgtgcaacgttcccaccgaaggtactactacataatttaatcagtgggggggggggggggaattctacgcgattttaggataaatggctattcttttattgacatgatcaatccttcatggtgacctggaaagtcacaaatggcttgaatttggaaaataaaaataaaaattcctagaggaattttaatttaacaaatttatcgtcttgagtcaatactttttccatcgctgtacattaagttaattggagctgcaaatgttcggcaacttttcgaattgtttctcgactattctgtaaagaagattggaagcacgaaatgaataggaaatttttaaacaatgaaaagcacaaattgggaattggcttcagaaatttttcggtaggtggtagcagtctttatgccaaaatatggaaaaattaagaatatgatggacccgagcaaaggattttacgacaaaagtgaggacaaaatgacattggcaattgatttctgtgtgaaagaagtagaagtggaaaattcataacatattccgcatgtattttttcgctgtttttttatatttgcttttcatttcgcttttcccattcaaaagctttgtacataaattgtattgctggatattttccttttctcatctcaattttccgtccatttctacgaattttgacattcttttcattgatttgattaaagttcataagccctccaaaaccaagggtctggctacggccttgtcagattgaatgttttatgcaattgttcaaacatgaatggacggacgacgacgaacgaataaaaaaagatggcattttcttttttaaaaaatcaaataacgaccaatttaatcatttgccgccgacttcttccgctgttgttgctgtctctgttgaagatggtcatggtccgtctccaagaattggtggtacttctcgcgcagtacacggaacgcgtccatgtccgcgtacggcagccgcgtcaccgggtcaatgtaacgcgcgggctgtcccctgattgcgcacacgcggaactcccttggcttcagcctaaaccaccatcatatgcaaggaacgaataatgagtccgtccacaccaatggcaatccaagaaatgaaaatccgaaagggtgaaaaaacaatttctcaaaaattatcatttttaggcgaacaaacggccaggcgttttgccccattttcgatgaagaaaatccgtcccccatcttttccatttgccggactaaaaaataaaaataatttattggtgtttaggctgtttaaaaatgaaaaaaaaacatggaatattttttaaattaggtttcaattaaaataatggtaaataaaatatgaaaaacattcgatcccattggggattgaacccaagcgaaaaataaaggaaggtagaaggtttaaacactaagccacacatgcatattaacaaagagaaaaattgaaaggaacaaacaaagattggcaaatgattgaatggcacctgatcagcgaattcttcccgctgattgatctcccgcaatattctctcgcacttacaaattagtcagaagctatcacgctaatgcattaaaatgggaaaatcgatttcatagcaaattttccaaataaataataaaacatttatggaattatacaaaaagaatctacaaaagctaaaatggtgaagaagtggaaggaccatcggaggcgaaagtgtcagcagcagcagagaaactttaataattatcgataatcattttcggaaagaggaggggaaaaggggcggaggagggaaattgacggaatgaaaggtgtcctctcaaagaacccacagcagggctggacgcaactgattttcaatgacggaattccgtaatccgtaattacggcttttttagttacggctatccgtaatccatcattacggaggtccaaaaggccataattttgcgtaatccgtaatcttgaaaaaataatttatatttaaaaatttttatttaagataatccaatctaaagaattaagtgtaatttatgatcagaataaatcttatgcatgattttttgaggcgaaaaatcccaaaatatgggtcgagatcagggctgtgcgaaaatcacaaaaaaactttttcgtatacgaaaacgaaacgaaaaagtgcattcgatacgaaaacgaaacacgaaacgaaaaaattttgacggacgaaaacgaaacacgaaaacgaaaaaataaccattttcgtacgaaacaacgaaaaaaaaaagttttttgaacttatttcaatcataattaagaaacataaaactttaaaattgtatcctctaactgaaggaatgaagatcctagtaggtggaaaagctaatgtggctctaggacaggggtgtgaccgaaatttttttaaaataaagaacatcaatgacaaaaaataaggtttagggtcaaaaaagacaatcttgcaaaattggttcgaatcagttaatatataattttttcgataaaaaatgtattaaaatgctatgtttttcacatcctattatggattttaacaatttttggggaaggaattagcaactgctgaaaaaaaagattttcaaacgtttttttttgagtgtatttttttttacagttgatgaat

SEQ ID NO: 6881 - DNA, 1654 bp, Heterodera glycines
accctggccgagatcgagagaaaaatagcaaaaataggggcaaaaatggcagattcagagctggtcgaaaattttcaaatttttcattaattttaaataaactcaccctttttacgactaaccgtattcccggtatgcttgacacaaaattgctaattcgggaaccggaggtggtttttcgtgaataactcggccggatttgctctggccggtttccaaataaaatgaacttgaacaactttttgatctgcacccaaccgtgttattggttttttgaaatcttcgcccaaaaaacccagaccccctcggaaattttttcgttttcatttcttagtggtgttttttcgtttttattgcactttttcgaatcataaaaattggcacattaagcacaaaaagcccgaaatatgcaaaaaataggccttataaaagtcattgtagacactccaaaccaagcggaaaatgcgtttttcatgcttattggtgccccccttcttgacgtagtctctgatcctaataagagttttaaaaacagtatgaaaaattcggaaaacctcgagatctcttcattgctttttaactttttaaagcgagttttgatcctttttatgaggtgccctcgtccaacattttggagatttttaattgagtttcaaatgggtatttgcgctggaggggtctctgttcccaaattcatcaaatttttcctcgctgtcagaatcgagataagcgtcgtcgtctccatccgagtcgaaatcaagaaaagtgtcagttgagtcggggccattttcagataaggaaagggtaaggtcttcaaggccccgaattatttgggacgtttctggatgatttttgtgtcgttggatagttgaatttaagtcatcaataagggcgtccattggaaagaagaaagaggaaaaatggccaaggaaataggcaaaggacagtgggatcgggtgcccctcccccccccccccccaactaaatttacattttttggtgtttcccacaattgttttggttcgatcccttcattttaaaagcatcgaagacctcgatttataatattttttgtaatgtgtgatttaaaaattgtttgttgttgaatttaaaatttaaatttgttcgagttcgggtcaggggttcggtacagggaaaagtgaatgtcaaattcgtgatcagcggcccaaaaaaccccataaataattaaaacacaatttttacagtcaggcggattcgaaccaatgccccaaaacccatttttaaccaaccacgcaattcgtttcccttcctttccttctgtcgagaatgtgccccgaggcaatgaaattcgcatttttggggccttgtaactctttaggcaggcggaatgcaccgctaaaattaaaaattcataatagaaatcgaccctcgtctatccaatggtatatcgtttatatgcattttcctactcacagctcggaatgttcccttgttagcaaatatttggaaaataattgaaaataatgaatgcaataagaaaaagcctacaaatatctctgaaaataaacaatcccgatttgcaagaaatttttggaactttttggttttaattttttttttttgaaattctgagattttctattttttttgcaaaaatgaatttctaaatatt

SEQ ID NO: 6882 - DNA, 3004 bp, Heterodera glycines
  misc_feature (41)..(42): n is a, c, g, or t
  misc_feature (56)..(56): n is a, c, g, or t
  misc_feature (82)..(84): n is a, c, g, or t
  misc_feature (93)..(93): n is a, c, g, or t
  misc_feature (99)..(99): n is a, c, g, or t
ttacgactaaccgtattccccggtatgctgacacaaaatgnnctaattcgggaccnggaggtggtttttcgtgaatactcgnnnccggattgnctctgnccggtttccaaataaaatgactttgaacaactttttgatctgcacccaaccgtgttattggttttttgaaatcttcgcccaaaaaacccagaccccctcggaaatttttttgttttcatttcttagtggtgttttttcgtttttattgcactttttcgaatcataaaaattggcacattaagcacaaaaagcccgaaatatgcaaaaaataggccttataaaagtcattgtagacactccaaaccaagcggaaaatgcgtttttcatgcttatctgagagtatcatgtgcgttgaaagttgagcaaaaatattcactggttgcagttacaaatgaggtacattttctttctaatatttttcttacaattagcaaatatttggaaaataattgaaaataatgaatgcaataagaaaaagcctacaaatatctctgaaaataaacaatcccgatttgcaagaaatttttggaactttttggttttaatttttttttttgaaattctgagattttctattttttttgcaaaatgaatttctaaatatttttccagaaagtgctcagaaaagcacgaaattttattgtcatgccactttgcactcggtgtcctctcaaaggacccacaaaaaataatgttaattaaaaaataaataattaaaataagctatgagagaatacctgttattaaatttattcaaataggattatgagaaaactgctatatggccaaaaaatcactaatcttaatgagaaaaattttatatgaccaaatgttatgaccaaacatcactattcttactaatgagaaaatgctattgaccaaaaatcactaatctgaacaaattagaattaaatttcgtcaatggattgccccgaatagcctgaaagaagttctataaaaggctgaactaaattacaaaattcatttaattcttttttttctattatgatggctaagttttttccttcacaaatgggcggcaaactcgtttttgaaggccatatgcatcaaaaaaagaagcacgtagggaattcatttattggcgctgtgaccaaaacaaaacaataaagtgcaccggggcagcaaaaactatcgggatgagagcaggagcagaactccaattaggaaagccgcacaatcatgccccttctccaacacgatgtgaagccgctcagatcaacagaagcgtgcgcaacacagcattgtcatcacgtggaaatatgccacgcacagttgtgaatggagagccgtgccgactttaccccgctccatttggcatccgaggagggccatttgcagatggccgcactgttgacggagaacggatcagaggtgattaaggattgtgattagattgggaggcattctttttgtgtattttgtaatgcttttgagagtctctgtctcgagtctcggctcgagaaaagtctcggatttttcttttgtctcgggctcgagtctcaggaaattatcggtcacgaatagcactagtatttggcaacttaatgaatgccatttgcaacaatttcagttcgtcatttattttatttttttgtcagaaaaattttaatttaaattttaatttaaattttgtttttttgggttttttatttttataaaattacatcaatttttattctcatatttttaaattcatttcaatcattcagttcaatttcatccgtaatttccaaatatttcatttataaattatttttacgaaattttttttaattgacatttggtggaagaggttcaaaaaaataatgccaaactactagagaccggcatcatagaaaccggcatcatcgatttatcggtcgaagttttcaataaatattttacagtatttttaccccaaaaaacgatcgtgaaatttttggggttttcgatatcgattttttggtattttattgattgaaaaatatcgatcaaagcatttgttcggtctctagcgccactcactcactctaacaccctactaattttgtggttttggcgagatccgatctgctgatgagcacaacaaatcaaaaatgcataaacaattagtcaaaatgggataattagttagcgcatattcttttgtttaatggatccttaatgattttcttacagggatgcgatcgccaaaacccaaaaaccgggcgcgcgagttgaaaaacccggcaaaaacccggcaaaaatttgcaaaaacccggcaattttttaagccaattattcactgtaaaaaaggtcaataacatttaaacaatatatttatcaccacttttcacctgtttgagcaaatttggcattgaaagaatgtaaccatgagcgtttgggcacaaaatatttgaattaaatttgattgaaattaatgagtttaaccagggttgccagattaaaattttcaaaagcctcatttggtcggcaaaaaagcctcattttgggtcaaaaagcctcatttttacaaatttattcaaaacacattaaaaatgttcaaatattatatttttattttccatgatcactttgagcaattttttgttagaaataagcattttgtaaaattcttagcacgaaaatcgaagttgattttttgcggcgcttttttctaaaaaaaaacttggggaaaagggaggccggcggtgccgataggcgccgccgggaaaaattttgtgatttttaaacaatttgttaacagatttgaccataaaaatgaccaaattttgcgattttgagcaaatttttaagaaaataaaggatccctggagctcaaataaatgaattgaaataggaaacccggcaaaaacccaaaaacccggcaaaaacccggcaacttcaaaaacccggcaaaaaccaggcacggaccccaaaaacccggcaaatgccgggtttaccaggaaaaatcgcacccctgcgt

SEQ ID NO: 6883 - DNA, 2904 bp, Heterodera glycines
aaagattcaaatttattttgtcaaattaaattggttatttttaaggttttcaaatattttataaattttaaaaacatttctctctcaattcattaattatttttatattatttttaggcaaaactttttggtaaaaaaagatttccgttctttttgattttatataaaattcctccctaatattttatgacattttatccgttaatttccactcccgcgaaattaacagattggtaaaatttaattttttttttttaaatgagttttttaattttatatttgcgaataatttgttttcaataatttttatttttgcattactaatttattttattttatttgttttatttttcggttgccatttcgttttttgatttgctttaaaaactaaataaatcagtagattgggtttgccatttattatcttattttttataataatcaaataagaattaatttattgctaatgataaaacaaattatgcatcttttttatttccttttcaaattttaacttttaaaagctttttaattttgaattttgcttcacatttacttttattttattattagtccttcaaatgagataactatttcctctcttagatacataatattttaataattttttatatttttatatagaactttaagtgatttaaaattgttaatcttatagatttttttttcttttcattttttagaaagggatttttttattctttctaaaattctgttttaaacttttaaattaaattaatttatttttctcgtatttctctttttgtgttgtattccaaaaattgaattttttttttcgactgcttctttaaaaaatttttaaataaataaataagttaatataataatattaattgctgaattaattttgaagcatttatttttctattatactaaatatctaacattattttttgttttgtattattaatgaaacatttaattcatataattatgtgccaattttcattttgtttttttttttttgtcttaattctcgtccactatcgttcgctgattattttttattagccctctggacattccttttattttcgcatttattccaattaatttaaattgcttttttatgcctttgcccatttcaatatgaaaatttaacatttgtttgattttgttaaatgtgaaataatattatatttataatttcaattcaactctataatttttaagtttttctgttaatttcctccctatttttaaattgatttttgtttcccaaaatccctataaaattttgggtccaattatttcccttcccccaaaaaactaagttttaatataatttttaatattttcaacaaaaaattgaaaaatagatgacataaaaacaatccttaaatgaaattttcacattattaataaataataaagtaaaaaaaaaattatttattaacaatgaaaaataaaagaaaaaatgtttggaatgtacttaatagaaaaatgaattaattttcaaaaaaattaaactatattgttttattcagaagaacaaataaaaatttgtggctccttaagtttcagggggagtgcgcggcgttttggcgcctattcgatccccaaaaatttttttccgaccctctaagaattttttctgctacctaagcatatatttacggtaggtagttagttcatcactagggctgcaaaaaatatggaaatccataattttacgagtcccaacaacactttacgcgtcccatgcagggctggacgtaactgattttcagttacggccatccgtaatccgtcattacggcgattttttcagttacggccatccgtaatccgtcatgacgggggtcaaaaaaggccgtaatttggcgtaatccgtaatacgtaatccgtaattttcaaaatttttttttaatttaaaaaatttttaaatttaaaaaatccaatctaaaaattgttaagattaatttatgatcagaatatctgcttgtttttttgaggtgaaaatcccaaaatagtttttttcgcggtgtgcttttcccaaaaaactggggaatgtggggggggggggggtggtcaggcggggccgaaaggcgccgccggaaaaatttttgaaaaattttatgcaatttgctataagattttgtctaaaaatgactaagattttggagctaatatttaaaaataattaggaatttttggggcgggcggtgccgttaagcgccgccgaggaaaatttttttcagaattttaacgaattttgttaaaaaatagccaaatttttagcatttcctcttttcccctttgctagcctcctccccccctttatatatgttaataatactataaattaccaagaataagtcagattaaatcgaaatatgggtagtcttttaataaaaatagaaaaataaatttattttataaaaaataatcttgcaagaaatcgtctcgaaaaataatctaaaaagccagttacggatcaaaattacggaaaaatcccaaaaatccgtaacccataatccgtaatccgtaactccaaaaaggccgtaatttccgtaatccgtaatacgtaatccgtaattacgtccagccctggtttgtattgaccagacgaaccaaaaataaacacagcaaaacgataatgttgttggctgttgttccaaatatccaaaactctaggaagaaagtgtcggcgtcgtaaccctccagattcattggggcttcaatttgttgcatgagtctaattgtgtcgtgccgaaattgtccatgttgtccacgacgactgtgtaaataatcataaaatttccaacggggccatcctcgtgttttagcaaccattgttgcttgtagagtatagaacaggcaataatgtcattgaagatgtaatcgctgcagcagcagctg

SEQ ID NO: 6884 - DNA, 4702 bp, Heterodera glycines
  misc_feature (1738)..(1738): n is a, c, g, or t
  misc_feature (4665)..(4665): n is a, c, g, or t
tgatttgcccatgatatttcatattatttatcccattgttttaaattatatttattgaatttacgctttgttttaaatgcttaaatatatttgaattattttttaacccctcgtcttgtaagttattttttttttgttgattggttgttggattctaatgattttacaatttatttatttgtcttatgaaatagtaatcaacttgtattatttttattgtgttttttcacgttttaaaaataaggaattaattttaaaaaattcttattttggcatcgtttttaattaaaaatgcatttttctatttaatttcaatagcttgtttgtatgtgataaaatttttaaatttgttttggaacattatttaaggctaataatacaaattattattatttacattatgaatcactatttttatttatattaaattttgtctctgacaatttttttttaatttctctcaattgtttgcactgtgccaaaattttcattatattttagtaatagtcccacggacgctccccgtgagataactacttattttgcatatttttcctataattgtttgaaatgtttaaagaattaattatttaatttgcttatgttttttgcttttttatataagtttcattaaaatggttacttttaaactttccatattttatatgaacttttgctttgcccagaaaataaaattaattggataacttttttcaataatttattatttattatgtaatcttttaaagtgattaatttgtaattaaaaagaattatttttacaaattttattattttctttgcttatttctggtctattttttgtgtatgaaaaatttaaaatccttcaaatagttaattatggattatgttctgctaaatgttacattatgccttgagttcatggagttgccttttcaataaaaaaatttcagtcccatagaaaaatgtcaagtttctcaaattttgggaaagtttatatgaattttttcaggtttcattcgctttaattgcttaactcaaaaaattacatataattattctaatcgctctgtgtcatttttatcagtgcttaatttttcaattttacggcccaaccaagaccaggaaaccataataaaaacaaaaaattttgaaaaaaattcccatagtttttaattctcaattgctttttatgtatttaaataattcaaattattaattaattgaattgttacttttttattaatttgcatttaaattaacttatatgtcatacatattaaagcattaaaattaatttctttcaattgattataaataattttttcattcctccacctaaaaagtgctaaaaaaaatttatttgtgccaattaacgcttattttgcgatttttttggtttttttaggtgcctatttcgcaatttttgtgcctaaaattcccatccttatatgtaaatgatatttttagtctttgaactaattttaaattatttaaaactatctttatgctgtctgagagttttggaagtttattaaatagaataaatatttacttaatttttgctctttaatttagggttactccccgacccctcgtggggcaaaatgtcgggggccggggacctcggggggcgacatgtcgggggtcggggcggggaggagctcaattgtcggggatcggggaccccgatcgggtagtgatcaacgaaattatttaacaaaaaaaaaacaatttttctttttaatgctcgtanatcttccttttttcactttaataatctgatttcgttagaagctggcctttaaaccagggcttacattgttcttaattataagaatttattttttttgatcttttggtcccaaatgtttgaaaaaatgttgtaaaatgttcatattttgatactaaaaaaatgtgagtaaaaatgcactggtatgaattgagtttttttttggcaaaattaataatttttattcaaaatctgctaaatatatagccaaaatttcaaaaattttcccggcggcgcctatcggcaccgccggacccttaaaatccttaattttcttaaaaaaactggctcaaaaaattgcaaaaattggtcatttttggacaaaatcttacaatgtattgtattcaaatatcaattttttcccggcggtgccctaacagatttatcctaaaaataataatttttgcaattttgggacaattttttgcaaaaaaaaaaaattggagttttggggggccgtggtgccgataggtgccgaccaaaagtttttcggaattattaattaattaatattaagaaaattgttcaaaatttcataaattttcaacctttccccccttcgttgttgaattaactttttaaatttttacaatgctcggagtccccaattccccgaattagtgtcggggagtcggagggcaaaaagtcggggggggccggggacctcggggagcgacatgtcgggggtcggggcggggaataggccaaaaaaatcggggatcggggtcggggaccggggagctcggggacggggagcaaccctagtttgtccaatagaaatttgtaattttgtgtcctgattttctgtaactgaatgcagtaatttttaaaattacaatttttactttttgttcaatataattcaaaagaaattgcaaatttattttactttttatgtaaattacagaaataacaataaattatttcctatacatatttatttatacatttgattaaattacaaacaaaaaaagaaaaaaagagagtccaattttagataataattagttgttcaaaaaaatctaattgatagacattaaataactaattacactattgactgttaattggtttcaattacgcgaaactaaagcaattagagtagaatagaaaaaaacacactacaaaacttaagatgcaaaagatccaaaggaacattacaagcccacgaccaaaattgaaatggatattgcatagaaaaactagaaaaacatgttggaacaaataaaaaccaaatataacggcaaatactcctgtcagggaaccaatcacaatgctaacgacacatttgagaaaattcatggtggaaaatcgccgttttcgtcgtgccatcccatggggcttcttcagcagcgtgatgatggaggcggtgttgcttgtctgcagctgatcagtcaagcaacgatcagaatttcctaaaaaggggcatagttttcttgaaactagggttggttagatgaaaattttccaaagcaactcattaccctactacaaaaaataaataaaaataacggcgctatttattatcaaagttaccccggttttgaattttattaaaaactaaaggtggatccttttagtttaatttaattgaacttattaaaaatgtttgtttcttgaggatttttctgtggtctctgatcacgattctaaaatctattttgatcaatttttaaactcgaacccgaacttgtacaaaagtctaattgaaatttctcgtttttgacataatttttttttttttaaattgggttaggaagtcggaattgttaaaatatatgtcatatccgtggtcagtgaccacaaaaactcccgggaaataattaaatgtgccaaaaacgggagaccaacctgcaacaaatttgcggaagaagttgagcccattagaaaatgtgccaattattttggcaatttcctgtttattcccctcattgaaaagtgcatcgttttccgcaatttttccaaacttttccattaattgaggtggaatattttccaaaatttgcacaaatttttttgccttattcaccaaattattgtgcgctatcagcttaatgcttttgccatctttgaacattgaacaaaaatgttttcggtttttttctgcgcttttcacgacaaaaaataattgttcatttaatttattttcttggattttttcggaaatttcgcccattttttcgttacataaaatcgcaattccatctttttgcatccattcgaatgcagaattattagagcttttatcaaacgtaatttggggcaaattgttcagatgtgatcgtaaagttccgaataaatcttcagctgctggaattagataaaaatattttttaatatattttttagtaatagcgaatgaagctggtgcccacccccttttttaatttttaaagattgttttaaaattgtctaaaaacttggttgcaaggcttttcggagtcgcttttcacgaatatggcgtccacttcgaccaatttcgaatccctgatcgaattcaaacaaaaagtcgaaaaaatttagtcaaaaaaccattggaatatcaaaaatagtcatgtacagatatgaacataaaagcgagtttggaaaattttgagttttcgactttttgttcgaatttgagtgctgggttcgaaattggctgaaatgatgtcatatttgtgatcagcgatcccaaaactctaagaatcatgtttttagagaattttttaaaaatttagaaaaatacaccccctaagaaattgactttttcaaatttaataaatgatccccaaaatagaagactttgaataatttataaaggaagaaacttcaaaaatttctcatactaggcgtatgattgaatccgagctctatttatatttatttgagtatttcaaaatatgtcatanaatttttagttttaaaatcaaatgaattttaggaaat

SEQ ID NO: 6885 - DNA, 737 bp, Heterodera glycines
gggacattcaactaatctaatcaattctgtcttggttttttaatgtgttttctcattataatataatgatgggatcaaagaggggcaagagagtgggatgtttgccccactatttcttcgttcgtctcatttctttgatcctacattatatttgtttgttccatttggtcttctttctcccatggtgacacggcaaaaatttatttgtttaaagtcagacttttttgcgtttattcaaaggatcataatttgaacataattttatcttaatttgtgaaaatttttggaacttatgataaatggatcatccattttttcctttattattttatagaaatttaaaatcgcagttaaagcaccgccaaagagcagtgccgttccaaaaattatgcccacgttaatattttgtttgttgctaatagtgggcgcttctgcattgagcagccatgtgcctcagaacaataatcatgcatgtgcgccgtttttctttttttaaatatcttctctctcgcctttatgatgggattaaagaagggaaagagagtggaatgtttgccgcactatttcttcgttcgtctcatttctttggtcctacattatatttctttgttcaaattggtcttttttctcctaatgataatgatggtgacacaacaaaaaattttttgttttaaagaagatttaccaaaaaatcatagagtaaagaggcgttcaattagttccgtgtattcaaatca

SEQ ID NO: 6886 - DNA, 2577 bp, Heterodera glycines
agagattggttcgaaaacaatggggaaaaccctttgcttcgaaaattttttaattttttttttttgaaaaatcacaaatggcaaaaataaaaaaattcctatcttcaagaacaagattttcgatccctactctaaaaaagttgcatttaccaagtgctagtgacatgagatttttgatgcctgaatgagtaaggaaattgttaaaaaattacattttccgtgccaacaatttttggcaacgaatggcatttgtcaattggctgtggcggcagtcgctgatcataattattgaacatcttcagcgcgttgtcagtttcattcggtgccgttgtttctgtttttgctgaaactggtgttgagccatgggaactttggtgcgaaaaagtgccctcctcggaatgtacactttgttgggaagattcatcaaatcctcctcctcccgtcttcggtgatagaaaatctgtgctgctttcggtggccgacgatgcattgtccaacaagtcaacattcacacccaaaacggcatccgactcattaagcgaactgcgacggctttgttttgtttggaattttcgaagctgaacatgcagaaaaagcaaaaactttcaatgtcccattttaattgtaccaagacacgggcccgtatcattttttcatcttcctcattagcactcattctgtcgacagcaaagtgaaagttctcgagaacacctatctataaaaaacaataaaaggatgtactttaaaacggcattttgcccgtgcccgtggcaatctctatattttttggcattctgtttgttaaattcgctagacttgaaaatacaatgaattataaagctcattgtcgctgatacggtataaaaaggcttttttaaagaaagaaaaaataataaaaggaaaaatgatcgaatgcaagccgagattctcggtcacttactcattaatttgaatgtattaatttgtcaattattgtaagaaaaacgaaacaaagtcgaaacgtgtccacaattgtcttttgaactttgcagaggcctttgattaataattggccattgttttttagtgtccaattttggtttttcataattcaaaatttctacttttgctaatttatttcgtataatttctgttctgtcttcatgagtatgctctcgtgcagctttgtctaaatttagcggcataaagggggaggcgatgaattgtgaacaatggacgggcaagcaaagcaagcggcgatcggtaacgcttcggtaggacggatgggtggtgagaagggatttggccactgatcggatgaacttctcccatttcacaagccaaaaggacaaacgcaaaaaatgaaaagattgggaagatcgaattagtgagcgatttgaacgaagagcgatcagcgagtgggcgcagcgaacagatcacttttcgtcactcattccttcgctaattgttttgttcaaagagtgcataagcactctcttttgtccaacttttaatccgactcgctactgctgctcgagaattcctcgagactctcgcaagagaggaggccggcccaagttttgtgatttggctcaatggcaatcagacttttatcgtgctgaattgcaatgccgagttctcgaccggcattcccatccctagcaaatttcagtgtcttcccggctcccggaaaatgcgtcagtaatacagtatttctaaaataaagtacattagcattaggcattgtattacaaaaagtcaaaatttataaaattcgtctgaatttttacaattaattttttaaggatctttgaaatttatccaaatcccaaaaataaatatactgtaaatggattgttttgtaagcattccactgacccattttccggtcacgtcttccccccctcccttttcctcaccttttgaccattcgtttttttagagttgtccgttcctgatttgtcagccaaaaagtcccggtttttcaatgcgaaaatcccggaccggttttctaaaaattctcggtcccgtacaactctagtttttttctcgcttcattcatttttgcttttactccatgttagcagatgctcgtggttgtgccgcccttcaaatgatggtccctcccgcccatttctttctgtgttggcttttctcggcactctgtccggcattttgtcgcatgtcaaatgcaaaagtcgacctctgcgaatattataggtcattattagcagactaattaagcatttatattgaattattttctgctcctgctgcaaaattaggacgaggatttaaatatttttcgtaaatttcttgggaaattattatatacaataataaaatgctaaatatattcaaaaaaattttgtttttaaatttaatttgaaatcccaattgctcttcactcccatccattcagagccattaacaagctccaagaacatccggaatgtgtcgaagaagaaagtgagaagccataaaccaataataattataatacctaacgacctaatagtcattaaattgaattgttttgataatgttgataaatgctaaagtattaaattttattggcgggaaatcgatcccgcgcct

SEQ ID NO: 6887 - DNA, 1921 bp, Heterodera glycines
cctaattaaacccatttttaattacctaattaggtctgacgagtgcccaagcagtggccaattgtgcacacaatccgatggtctcttgtaattgataaaataaacctaaattatttcttttgcccgtcatttaaggttctcactgctgtcaggatgcgatgcagggttttggattttgaataaatttttgatcaaatttcattcatgttaatccccccacagggatccccgtgagtcacatcaaagcaaagtcgggccattgtcctccgccaattggcatttccacgctgcaggacggaaacgtcggctgttggctggacaccaactgtcccggcattcagaagtgctgtctcgagccgaaccccggctcacacgtggccgcacgccgaatttgccgggacccggaaggcgtcagcagtcagttgagcgcgaggcgaacttgggggttgggggagggctaatccgcatagagataacggacaaacaattagagagagagacgtgagaaaagtagcgagagagagaaaaaggtagagagagagagaaaggtaaagagagagggagagagagagagacccaaatggaaaagataatttagataaattaggacagagaacatatgaacgggattttataattgaagcctgaaatgcccaagcttcgtgacctgtctcggcatgggttgggctctatcccggccgaccacagtgggaatgaaaagttggacggctccattttcagaaggctcttcaaaaattcataaccatggtaccaaaaaagctttctatcctcatttaggtccatacatttttaaaaatttgaaagttaagcataattgtttttctggacaaaattacattcgtaaaacattgcctcaggtgaatcgatttgcacacttccactgggtaattatcgtgagcaattattgtttctatcattagtgctttgtttagtggtcggcacttgtacagctttcgtcactcgctattattttgatgccagctcgggcaaatgcaaaccattccaggtgttttttgatacaaacctgctcgagagtcaaattttcgagaatcgtttaaatattatggagactcgaacagctcaagcgtatccatcaactaccgtatccctgattatccttatcacccattacagtactctggctgtggtggcaatgagaacaatttccaatcaatccaatcgtgccattccacatgtggtcttctgggtaattcctattatttcaatttttgcccctcaatttgtcaccatttttagggataaaagggaccccgtcttgtccgggcgaggccaacgcggaactgaactgtttgttgccgcacgcggacgcatgccacacagactcggtaagctaactaattgcaagttaattagaggcagccgattttgatgccttttgaattctttccatttttcaataactttttactaaaattggttcattagtggaggtgtaagtgtcgtgaatttgtttactgtttgaccggaattgccaatgggcgggagatctgaatagcttaattcttggggtttttttgggtccctgatcttaaaactgacatctattttgaccaatttctaatccctaactcgaacaaaagtcgaaatgcaagtttttcaatttatgaacttttttattcgaattttaggttaggaaatcggaattgtcaaatacataggtttagtatgatcaggcacccaaaaaatgtttcgttatttagctgtgctgtgttaattgaaacaattaaggattgtatgggaagagacggcgggcaacagccggtaagcttaaaaagtcaaattgactgacttttgaaaaatttgaagcaaatggtagtgctgctcgagaccgagaccaaaaaaacgcgaaattgtctcgagtcgagattcgagaccgaga

SEQ ID NO: 6888 - DNA, 1399 bp, Heterodera glycines
atattcttaatcagtgcctaaaattcgcctagaaaaggtgctttcctttatcgggaccatgacatttttatggggggtagcaaaacacggaagtaccgggaattcttgttttagtaggcgaaatgtctgatattaggttaatcgcaaaataggcacaaaaatagaaatttacattaataaatttgcaaccctcaaaattcagaaaatcaacaaaattgggaggaactctgaatttgagtattatatcacgattaaaagggatgacaaaagaaaatttttaaaaaaatcgaattttagtttttaaccaaattttgcctattttcgtctttttatgcttaatgtctaaatgcctattttcgtgtctatttcgccatttttagcgcctttttcaggattttcggaagtgcttaacaaaaatgttgtaaaaatgaaaaatacacccctaagaagcgacccgaaaaaattcaaaaaatatacccttaagaattgaaaaattttttaaaaaaactgatcccaaaaattaattatctttttcttgataaaaaattttggtttaaaaattgtccctattcgaaaaaaactttaaaataggtaagtgaaatataagcaaaattaaatgcttgaattaagtttttatgtgttttgctatctaaaaagcgttaataaaaaaattttttgcactatttttgtgcctatttaatgcctattttgcgatttttttatgcctatttcgcgattttttgtgcctaaaaatcgcagccctacttattataaaatacaaaatttgtgatggaactggatggggggggggagagcgtgggcgccaccgggaaaattttggaaatttgagttcgatgtgttaatcagttcataatgacctgttttttgtgatttcgagcctcttttttcttaaagaaaagttttttgtcagtgtcgacaggaaaaatggaattccgaaaggaattttttgagaacaataatccaagaaacaagaagttttttttacaaattagagtaaacaaacaacaaaacaatcgcttcataaagccgcggatcgcagtcgcggattcaaaatctcgcggttcgcgcatggcggatttaaattgccgtgaatcgcggacttcgctccactcctgttatattcctttcctcccaataaaagttattttattaatttttatgaatatttgcaacaatctaatttatgtcagatgcatatgatttgcgtggtgagtgagtgaggcgatcgatttgctgcactttttttgccaacattttctttttgcataatttttatttaattttttctgtaaataatttattttacattgtcaaaatggcttaatgccaataccagtgtcgcctgttgcaaatgctttttcattctgtgctgtctttt

SEQ ID NO: 6889 - DNA, 1296 bp, Heterodera glycines
aacaaatttagggcaaaaagtacatcagaaaccaggattttcagttatttttggccataagtttgttcaaaattgacgaaaatttttgagattttgcaggcttatagaggacacttagtgatatcgaatgataccaacaacactcgatttggttgacaaacaaagttacagccaaaaacatgctggggcccaaacgtgccgggggcctaactgagcgagtacggataaagcggcactggaactcaccggcacactttttctcccgccctaccggtaccgtaaccccggcacctggcttttaaaagttcctggacgggacctggaattcccgggccggtcccgattccgctctactctatttttaagattaaaaaatattgaatttaaaaaacatattaaaattggggtacgttttggtttcacacaccccaaaattttaaaaatatgtccaaaaaatgcacggagttttttgacagcacaaaagactgggaaaattaagtcacgaaaaatctcaaaaaagtcaactaaaaatgataagaaaattattgacaaaaaagtcataaaaaaacgccaaaaagttacgaaaaatgcaaaaaaaaaatcataaaaaatagccaaaaataaaaaggtcctcaaaaattaggcaaaaatccatcctagaagcttcaaaccaggctaaaaacatgtttttcgtgcgtttcaggccctcaacagtccaggaaaaaaatatggatatccatataattctatgccctactaattagggtcggcccccttttggctgtctcaacagtaaaaaacagatttcttttgtcatttattattttgttgtcaagaggaaaaaattgcaaaaattctttattaattgatctaaacttagttttagtaaccaaatttttgaaatttaaaagcattaataaatactcatataatattaatatattattataaaataaggaaattaagtaatattccctattattataataaattttcaattcgtgacctagctttccaaaaatttcgggaccgggacctggaaagacggggaattcccgggccgctcccggttctgctctactctattttaaggcaaaatttggatttccgaaaagaaaataccgaaaaataaaggttaaaccggtgaaaaagcaattgaaatccggcaaaattttttcgtaattgatgaaaaacaatcgcctagtatgtttcctataggtatattgtttttaaagtatggtcttttttattgtaccggatttttgaagactttttgtattttttgttactttttag

SEQ ID NO: 6890 - DNA, 2400 bp, Heterodera glycines
tgttctgatcagttcgtccagctgtcgatcagacacaaaacaatggtcaataatggcacaaaagtgcgtcaaaaggcgctccaaaactttggtcacttccattcctttggtttgttggcactgtgtcgatgtgccttaattttaaaggtttaaaacgatcattcgcttgtcccttcctcaatgtgccacctttgcctatccgccgcctcctcgacaaatttctgatcagaaagcatcgcgtggagtgaacaatcgttctctcccgatcacttagtatgtgctcctgactaggcatttccatcctcctcctcctcgtccgccttggccttggcgtgcttccgttgtgctgttgctgcccctccctcggtgttgtccctcccccgccccctttggtcgtccgtctccccgtcgttgtcgttgtccatcttcgtccgccaattgtgctttttcttcccccgtcggtggtggaaaatgccgcattcgaatggcaccgttcgcgcagagaattgtcagcagcaagaacagcagccggagatgaaaaagagcaagacggcttaggagaagaagaaggcttccgtcgctttgcgactgtagccgaggcgcaatcaaaagctaaaaagagagagaaagatgaaaggaaaacaaaggagtactgtaggaacaaaaaatacggtagaatggccaatttaaagagggggggggggaagcttacaaaaattagcatacagttgtctcattctcaattgacctgtgtgcacttacttttgcccgttgctgctcttggagcagtcattcgtttgatcgttgttagtgccgttggctttgccgtcggtgggcgaatccgcaaaatgattgggggtgtgttctgcttctcttccctttcgcccgcttcctctcgcttctcattccgctctctgcgttcctcctgaatgtttttctcctgcttctcttcctttttgggctcctctcgtttctcttcctgccctcctctttcgtcatgcattctctttgtctgtttctctgtctctccgtcctcttctcttccccttctcttacgtgtgactctctttttcgtctgatcttcttctccatgtttttcttccgagtttcgtttcttcacttttctctcccttttcgtatctctcacacttctttctccattcactcgctttttctctcccgccctcctccccacactaacttcctcctccttcccctcgtcctcttcccttccactctttcgcttccttcctcttccctttgccattgttggcatcatccattcttctcccctcgcttcggccctccggtgaatttcttcccaattcattttcttccatggccatcccttttggctaaactcggcggtccctccaatgggggaaaggttcaaatggcatttgtccatacgtctgatcactctctccaaaagtgccgtcagcttccggttcagctgctgcctgactcgggatcggtaaatggccaactgctccaagtcgcgcgccttcctctccgcctcgtcgtccccgcctcttccgtcccacgtttttccttccttcccttcccccgcttcttctccttcctccactctcccaacggcttcttccctcctctttgcgccgctgctcacttccgaattggtcttgctcctcgttgtccctctcttcctttcctcccctcccttttcctcttcctccttcttctctctttctctctcttcctccgttatcttccgctgttgatgttgttgttgctcctccttctgctgctctcgttcttcttttctccttttatcctcctccttttctttctcctcatttgtcctcttctcttcccttctttcgttccctccttcttccagactatttttctgctcttccgccttccgttggatcagcgaggtcaattgttttagcttaaataggacaaataagaaaatgcgagggaactctgaactttgtaattaagcgtatgttataggacagcggcgaatgaaccgaaaagtgtcgtccccgccaaagggggagggggggggcgtgaaatgtgccgttcccgcctaaggggggacgccgtccgtccactgcctctatgacgacgcgccgagaaatgaacaaaatgagaaagaagttggatggtggccacgactaaggcaaaactgactgcgtatggcacgtggagacggggggcggggagagaaaaagggaccaaacgcgtgcggaagaatgccgaggggggacgccacgtaaattataataatccactaaaggcaatctgatgttgcccgcaaagaagaaagattaaagtgcgttctcaccccccccccctctctctatcaattctccctctttctctcaattctctcggggacactctcggtcccctctgctctctcgtggactc

SEQ ID NO: 6891 - DNA, 1822 bp, Heterodera glycines
ctgcgtgtctacatagatgtacctgttcccgcgaaatattctaggaaaggcattctgccagctcatgcagactcatcccggggtggaacaacggctgcgccgtccctctttttccgtcgtcttccgccgccggcactgttgctgatgtgccgggtccaaattggtcctgctgctccactacttcctcgtcatgttctgagtgtgtcactggcactaacttgggcatgtccgagaagtcctcctcctccccgtcctccccctgctgttgttgtcccaacatttgacgtcgttggctctgatcattcgccgtttctccgtcgccgttttctccctccgcaaattgctcaatgatcagagaaggtggcacattcagtgaagaagacaaaaataaggacgaagatgaggaagggttaaatgtagtgattgtaagagattcttccgtaagggatgagtaagcggaagtgccataaaaagaaggggctgaggagcacgaagaagggttcggcagaatgccgccgacggtggcacaaattgcggaggacgacgaaggcattccgcagtggataccgttgttcacagattcacaggagcggaccttaaatagcataattgaagcttaaacaactgaattgaaaaagtcagggtctgaaatgtagggaaaaagtcgcttttagggggtccccggcactttttagaaatgcactcttaatatcaaaatgagaacaccaaagctaattacaagcataatgcaaacattcggtattatttaaaaaaccaacctgagaagcatacggagaaaccattggcggagtgtaaacggacggaggcgacccgtcgatggattggatgccactgtccggtgtggacgaaatgtgcgacggaccgccggggtgggcacccatgtacgggtgccaatgggaggggtgcggttgttgttgggacggagggggcggcacagccgcggagccaccggcggaagggacgaaacggacggaggaatgatgcgactggccgaggaggggttgttggtggtgttgttgattgtggatgaaaatggcggatgggcaaagggaaggggcgacaatggcagcgggggacgcggcattctgccaatgggaagggggaataagccttattagcctgaggaagtgatcagatccggcaaaatctgatcaaaattaacttgggtcggccaagtttgatcataaaacgataaacaaagtaaaattgatcagatcggccgacggacatacggccaagtgatcaaaaaagataaataaggctctgatcagactctgccggaatcgtaatgccaaagaatttgtcagaatgccaactttttcggcgtcggctgtttgttgtttttgttggcgctgctcactttttaattgaccattttgttgttggaggtgagcagcatttaaagaggacgcgctgtacatgtccatgttggtgtagatggggtcggattggctacaaaaagaaaattaagttgttttgtgattttttttcattggctataatgcattcattgggaggattttggcggaatgccatcccataaaatgccgtcccacccatgcgccgtttggcaccgcgtccactcatttggcagataatccgttaaaatcccagccggacggaaaggaatgtgcaaataagaagaaatagatgaaaaaaaggaatcaatgtgcaaaattggcacaaaataataattaatgcaaagggggagagaggtgaagccggaataatcgtcaattaattaagacaatgaggcagagagaagaagggtaaataccagcggattaagtgggccaatgat

SEQ ID NO: 6892 - DNA, 931 bp, Heterodera glycines
gaaaggaaaaggcggtaaatggcaaatatttgtggggagtgtttgccttatgccatgcccggagggcacaaaaaagggcaaatttatctccatggacacaccgaagaaaaagtgccaaaaatgaggggaaggagatgaaaatggaacagatatggaacagatttagggggcgtatgagaatatataagttacaaatttgccgggacacattcccacataaagcgaattagcagctacaaatggggggataaaaagggataaattggaaatttactccctccactctcactctctcttcgtctccacacattctctctccctatctctctctctctctctgtgtcactttcccttgcgctatttctcgccacctgctgtgtctgtgctgttgttggcgatggtctgatcagtaggccaaacagctgtgcctcgttgccgtcctcctggcgactcttaaacatgcatggcacagcctcaaaactcatcctggcgatgacgcattgggaggacaattctcgggggtaaattcacacatttaaaaatgaaaaattgactttaaatttctctgtcgttgtctgtcgatattaatttcgttgtttttacttaaatattattaaataaataacaaaaataaataatgagaagtaaataataaatcattaattaaagtgtgcgataataattaaattaattatgtgagaacaataaaattatttaaacgattaggtaattaattaagtaattcgcccaatgaatgaaactaaaattgattttggtttgtggaaaagaatgtgattggattaggctgatgtaattagagagtaagtgatcagttctcggcggacccaccgatcgatcaaaacgattaatgtgaagggagggggggattaacagctgatatgtgataatagccatttaatgttgcttatta

SEQ ID NO: 6893 - DNA, 2589 bp, Heterodera glycines
  misc_feature (61)..(62): n is a, c, g, or t
  misc_feature (2482)..(2482): n is a, c, g, or t
  misc_feature (2535)..(2535): n is a, c, g, or t
  misc_feature (2539)..(2540): n is a, c, g, or t
ccccattcccatatttactcatcacatatatttgtatgtgcgcacattatataatgaggcnnatatcaaatgcagccattggattttggggagagaccgtcccctatttcactcctaagcttcaactgctggaaaatttcaaaaatcaaatcagtaaactagagaccgagatttccaaatctgccggaccggaattgccggatccagaaaaatccggtaccggatccgatccggctcggtctctagtaaaaacccaaaaagaaattatttgaaattcaatattgacagcacatttatgccatatttcatacgatttgtttaaattccataatttggcattttatgcaataaaaatttcatctatagcatatgcaataataaaatagaaaatatatatttcaaataaattaaaaaatagtcaataaatccaatccatgaattcataattcattggctgttgctttctgtttcgctttcatcagattgaccacaatgagtaaagtcagtgacttcgttagttttacgcaattcattgacattggcatgggccaacaattccatcatctgctgaaattaattacatataatatggcatatttgtaaatatattctataaaaatttcgaattaaaaaggaaaaaatatttttgcgctaataaggcagggatttttctatttgtagaaaatgcataaagccttctaatatattcaaaaatatgaaatagaaacgtttattttcaacctgtaaacattaaaagaaaatgttctatttttttcttctatttaattcaataaaaatttcgaattaaaaaggaaaaaattttttgcattaatcaggtaggaatttatatttgtaagaaatccactgttgtagaattttaattataatgactcattagtgttaattaaatttggcataatgtcttttttcgcgtttttctcacttaaaattgtattctttgtttttttccatctttcattccaatttttattatctggtaatttttattgttttgtgccgtccaattcttctgactttaaaattgatatttgtcaaattgtttctcatcggtatttgtcttttggaattaaagtgtttggatttgacagtggcctactctgtgtttggtataattgcgtccctgtcttaagtcagtagcaaaagtacaatttggcgctcccgaggaaacaggtacaaaagcggcgatttttaaagagtttgagggtgagatcgggaataaaaaaatttttcggacgggttttaatttggagtgtattaagtatcagtccggaccggacgatatttaagttgtgaagtggaaattgactattccggatcggaaagttaaaaaaagcgaaaaaaaaactccagcgcaccgaaaaatttattgtttatcataaaatttgagttcgggccgaaccttttttttctgtctacatcgccgtataaactattgacaccgggtcggtgcttagtttttctccgtcttctcgccgaatttttacatttgacttcgctggatggtcatcacacgcagtccgattttgacactggtaactgagcgattgaattctagagattgccgttgacagaaatggacatcagattaatgtcggtggaaatcagcagaactcgctgcaacgccaaaatcacagtgctggagaaagttttccccaaaatcagcaaattgaaaactcgccaatctcacccactgaactcgcgggctttaatggggaaaatggtgatgacagttctcttgttttagaaccaaatatgaccgaagaggaattgcgcagacgcttgttggtggtcagcattgaacgtagccagccgccagccaacggaaatgccggaaatggagaaaacgccgaaggtttgcgaaacgcaatcagggaaaatgatggacgaccgaattttggagtaaatggtcaaacatttgcccaccaaaggaggccgcatgacactttcttatcaaatttgatgaataatggaataggaaactttcctcaaaatttggtccatgtaccgcgtacttcaaccccaactcgaaatgttgaatttgaacagcaaataggaccattcccgtttgttgttgaccgcaacaacagagcaccaaccccacctttaaacatacggcaacaaattttccaccccatcccactgaatacacaccgcattaaccaaatgtcggttaacgcgcaacgcaacattgacgttcagtacgtaccaaataattgcgttaatgccccgccaaacgtacagcgtcattgcgacattcagtacaccgctcctaaccctgtcgccgcgccatcaaacgcgcaacaaattcaagcaggaagtagacttattcaaaacattccaatgcaggctcagctttggcagggccctgatggaaaaatgactttggtttacccccaagaccaacagcaacaagtgctgatcgagcaacctaatttggctcaaatcatcaaaaatcactcgncaggtctttcagattccggaacgaatcagagcctagacattccctacctatcnccanncgaatgtgcgccaagcacctcgaattaacttgatttggaaagaattccg

SEQ ID NO: 6894 - DNA, 3983 bp, Heterodera glycines
  misc_feature (41)..(41): n is a, c, g, or t
  misc_feature (56)..(56): n is a, c, g, or t
atggggaaatgaggacgacaattctctgttttagaccaaantatgaccgaagaggnaatgcgtaggcgctgttggtggtcagcattgaacgtagccagccgccagccaacggaaatgccggaaatggagaaaacgccgaaggtttgcaaaacgcaatcagggaaaatgatgaacgaccgaattttggagtaaatggtcaaacatttgcccaccaaagtaggccgcatgacactttcttatcaaatttgatgaataatggaataggaaattttcctcaaaatttggtccatgtacagcgcacttcaaccccaactcgaaatgttgaatttgaacagcaaataggaccattcccgtttgttgttgaccgcaacaacagagcaccaacccccacctttaaacatacggcaacaaattttccaccccatcccactgaatgcacaccgcattaaccaagtgtcggttaacgcgcaacgcaacattgacgttcagtacgtaccaaataattgcgttaatgccctccaaacgtacagcgtcattgcgacattcagtacaccgctcctaaccctgtcgccgcgccatcaaacgcgcaacaaattcaagcaggaagtagacttattcaaaacattccaatgcaggctcagctttggcagggccctgatggaaaaatgactttggtttacccccaagaccaacagcaacaagtgctgatcgagcaacctaatttggctcaaaatcaacaaaaattcactcgccaggcctttcagattccggaaacgaatcaagagcctagacatttccctacctatccccaaccgaatgttgcgccaagcaacctcgaattcaacttgattttggaaagaattccggatctaaatggaaatgagggtacagattctgtgcgccgctttttcaaaaaatttgatgcatacaccgacggatggccaaacgcgaaacgaatttcggcgttagaaagcaaagtttacaacaaagcagaaagagcttttgaggcagcaaagtcaacgcagccctaccgatacgagcatatccgcaaagatatgattcagcagttggaagaaaccgactcaaagcaactaaatgcttttgatgatcttatgttgggcgttcggagaagacaaaatgagagcattgatgagttggctggaagaatttctcgcctagtaaagagtgcttatccgggtttgaccaacaatttgtgcgacgaatattcgatcaaatttctgatcagatcgatgggaaatcccgatcttgcgttaaatttggaattaatccgcacaccgggaatgactcttgatcattttgtgtcactagcagcaagggctgaatcgacccaacgcgccgcaaaacgattcagtacacacccaaatgatggctttcaacagcgcgagcaacaacccaaatggcgacaaaattttggtggtaactcaagccaaaacatggcgaagggtcaaaattttgctggaaacataaatcagcacccccagcccaaagaagacactagaaatcaatggaaatgttacaattgtgatgaatatggccacctttcacgcaattgttcacgtccaagaacttttatgcaaaatcagccaataaatcagcaaaaaaattttgttgctactggtgcgaaccgaactcaaatccaacccccaaatcagaaccgaaattttcaaacaccaaaaccaaattcagctaatttcctaaagcaaaattgtttggtggtccagcgtgaagaagttttagccgaggcgagggtaaacaaaattgagttggcaccggaagtaagtgaattttatgaaaaattggaacggatcaccgaaagcaaaaatgaaatttttttgccaacaattggaaaggttatgtcgttgaaacttgaagtgtttggcacagaaaccgacgcaatgcttgacggaggcgcacaaatctcattgattagtagtgattttctgcataagttgctgattgagaaagcgattacgctggaaacattggagattttcaaaacgaaaacccaaatttttgacgtaaacggaaaattagtgaaatgtctcggcacgattaaattgcctgtcaatcgtcacggtttttatgaaccggtgaccattcctttgcacatcactaatgccccaattggtttcggtcttttaattggaaccaacgcacttcaggatttgggatttaagttgtatgatgaacgaaataaggcactggttgaattcgaaaaagttgaacctgaaaagaaagattttctgacggtcatttatcggacaataattgaggccggcacagttaagaatttagaattcagcgttaacactgaattcgaaggacaggaaattgtcgttacttcggacgaaacttcagcaattcgtgtagaaccgaccataggaatccccgaaaaaggaaaaattgttgtcccagtgacaaattcatcgtttttgcccattactctgtttgaaaaatcttcgatcggaaaagtcgaacgagtgtactcaatcggtgagactgaaaatttgttaagtagcccaattatctgttccacgaaatatgaacaaaatgctgcccccgaatgttacgagaaattcttcgaaagtttacaagtcagaattggtgaactgaacgaagcgaacgacaaagaagtgcggaaaatgatttgcacttttcctgaaattttcgctttaagcgatgatgacttgaagcagacaaatttagtcgaacaccaaataaataccgcggaaaattcgccagtaaaaatgaaaatgcgcctggtcccatacgcttatcgcgaaaaaatagcagaaatgctccaaaattatttggcaagaggcatcattcgtccgtctatgtctccatgggcaagtcccattgtgattgtcccaaaacgtgatggaacgttacgtttttgtgtggactaccggggcttaaattcgatcacccgaaaagatagtttcccgctcccaaatatcgacaatactcttttaatgcttggaggacgaaaatacttcagcactttagactttatgtccggatattggcagataagaatggatgaaaattccattgaaaaaactgccttttcgactgagtacggtctttacgaatttacagtaatgccatttggtctaaccaatgcagtggcaactttccagcgatttatgtcgcgtctctttgagggaatgattaatggctttctgttcgtttacattgacgatattttaatcgcatctaaatcctttgatgagcatctgaaacaccttgaagcggtcttttctcgagttaaagcagcagaattaaaactaaaatttgaaaagtgtcatttttgcacaaccgaattaccatttttgggccacatcctcacaagggaagggattaaaatggatgcggataagctaaagcctgtgatggatttgcctatgccaacgaccaaaaaacaactccattctttgcttggttttctgacttattatagaaaatttatccattcattcggcacgattgctgctccgcttttcaaattgataagcgaaaaagctgaattcaaaatcggagaacaggaaaaacaagcaatcgaagaattaaagtcaaaaatcattcgagatgttgtgcttcattttccggatttcgatgcagcacagaatgacctaactaggcagtttataatcatgactgatgcgtgtaagaccggcattgcagcaattttatgtcagcctgatccggagaaacagattaggccaatttattttgcctcaagacaatgcaatgtccatgagtcacggctacagtgctaccgaattagaagctttagccgtcagatttggtgtaaaaaagttcgcacaattcatcactatgattccgactcgggtcattacggaccataaagcactaatttggatgttcaggagtaaaaatgagacaggaaattcacgtgttgaccgttggcttcttgagttaaactctcgtttcatcct

SEQ ID NO: 6895 - DNA, 1546 bp, Heterodera glycines
caaagtcgatcgtaagaccccttcactgacccccccccccacccttgttcaggtatgatgggaacgtagttcacccaagcggggattgcgatgttcaacctgtaaattttccgactcgtcctttggcttgtagctttagcgcataacttatcttatatttttcttcaagtccgggattgtcacacaacagcattcttcccaaacggattatggtcagttttacctctctacgcaaggcgaacagtcacaaggcgtcccgtcaactgtcgatgcgtcgcagtcgcaaacagagccggacctgaattttcaagacgaggaggaaccgcttgtggacaatctgccgacacacgcttgcaagtgccgtttaccaggggcagacatcgcatcaacttgttaatttgaggtactgcggaattcacgacccttcgtcggtgggacagtgtactgtttgtggcaaatggttctgtaacggaaaaggcaatacggcaggcagtcatttgatcaatcacttggtacgagcccaacataaggaagtttcactgcacaaggactgtcctcttggagaaacccaattggaatgttaccattgcgggtcgaggtgtgccacgtttattttcaatggcttttttcattttaataaattaaggaacattttcattcttggtttcatcccttcgaaaactgattcggtggttgtcattttatgcagacagccatgcgcaacacaaaactctttgaaaaatgccaattggagtgccgaagattggaagccgctcatccaagagcggcaagttctctcctggctgataaaaattccttcacaacaggagcagttgagggctcgtcaaattacggcatccattatcaatcgtttggaggaactttggaaggtgtcgtgttgttctcttcttcgattaaattatgtttttaggacaatcccgaagcgacaattgaagacttggaatgccccggtaaatacacaacggaccctgaccatgtcttattgcgttacgaagatgcaagcatttacaagtactcttttaaaaaacggttttctctatttggagttttcaggcgaatatttaaccctttaatatctctggaagcggaatatgacaaaaaaatgaaagagtccatcagttgtcctgtcggtcaagttaagtgggacgtaaaatcggccaacaaagtgcatgccactttccaactgccaggatttagagatggaagtaggacactttgctccaacacattttacaccaaattcttcaagatatgaaacttatgatcggcgatgacttgcgtctaaagcactatcagacggtcgatgggtcggaatggagttgcatgggacggctgatcaaaataccggacagtatgtttcggaactcgtcagcctattttccatagaatgtcgttaaacttaagatcacagtgaggacttcaccttggaaatgtttgccagcagcaacaaattgccaacggataaacggaccaatttcatatgtgaaatatgtgtggaatttcacagtttcgacagtttttgaca

SEQ ID NO: 6896 - DNA, 5037 bp, Heterodera glycines
  misc_feature (5018)..(5018): n is a, c, g, or t
ttgtcttgaaatgtattgaaaaactaaaatttaatttttcctcttctggggacagttctcgtcgcctttctttcactgcatccttccctgaaggcgcttcagtcgggagacctttttaaactgatgaaattaaaggttggaattgcttttaagaaaatcttttgcgttcatttcgcaattttccaacccaaaggaagaaataggcgaactttctcaagccgaccaaaatcgtttcatggcactgagaagacagaaggaacaagagttgctgtccaaggcggatgtgatttgctgcacttgtattacggcggctgatgtccgcttagtcaaaagagaatttcggtgatttattacaaattctgtggtcactaaatttgttgctttcaagagttgttcttattgatgaaagtactcaatctactgaaccggaagttatggtttctgtggttaagggggcgcgtcagctcgtccttgttggcgaccattgtgcgttatttggggagggtgatctgtcccgaaacgattgatttgggggggggggggcggagggatctgtccctgtacgattggtcggactttcaattcccttcatcaggtcaacttgggcctgtaataatgtgcaagaaatccgcaaatgctggtcttggacagtctttgttcgaacgtctcgttttgctcgggaaccgtccccttcggctacaagtccaatatcgcatgcatcccgccctttctgcatttccaagcaatgtgttttacgaggggagtttgcaaaacggagtcaccgaaggtcactttttgaacttctctctgtttttacttgtatcattttaggtgaacgtaaactcgacgaattttcttggcaatttcctgtgccggagaaaccgatgatgttttggaattgcaatggtcaagaagagctcggcgcatcgggcacttcttacctgaacagagcggaagcggtcaatgtggagaagttggtcacgcgctttttacaagccgggtttcgcccggatcaacttggaatcattaccccttacgaaggttgccagtgagtggaacaaattccaattcactgaaattcatgcaggtcaacgggcatatgttgttcagttcatgcagtcccaagggagtcttcacagcaaattgtacttggatattgaggtggagaatgtggacgcttttcaggttggccaattcaccgaaattgcattgaaaaatgtcacattaatttactgcggaataagtaaatttgcttcatatatttcagggtcgagagaaggatataattattgtcacgtgtgtgcgatcgaatgagtccggaggaattggtttcttgaatgacccaagacgtttgaacgtggcactgactcgagctaaatacggtctgatcattgttggaaatgccaaagttttgagtcgtcaggtgagcattttttacgtacatttgcctattctgatgatgggtctttttgtcagttgctctggcatcatttgttggcttatttcaaagacaatgattgcttggtggagggaccgttgaacaatttgaagtcgtctccgatcacttttccaaaaccaaaagccttgagtaatcagcatatgcccgtgagtgtttttgtctgacgatgaactttcttataatggccattatctcataacacaagccaaagttgtaacttaagggtgcccgttatgtgaacagatcgttaggcttcacaatgaaggaattgggcattggcccttacgccggattaaaaccggcaccaatggttcaacaacacccactgcagcaactgcaagacccccaggggatgtttcaccccaattaccctatggggcatcgagcattaaggcaaggattgacatttttaattttcttaaaaaattcgtttattttattaaaacttaagaaattttgaaaacttaattttcaggggaggggcgggggggggcgaaattctacacccatttgagaaacttccaagcgaaacttccattcattcatatgttattctagctcccaacttcctgtccccattcacatgttttcgtcgttcgtacctgctccgccaccaattccgccaatacctccaccacccgtgccgttgaacgccatccaattgtctggagttaatggaatgccaaagaagaaaggccgtcgtccgatcccatctcgctcaaatgccacttatatttcgcaggcgtcccaagacatttaccaatcaaatcttttgagcggaggaggcatcagccaaatatcccaatcaagccaactttctcagccttattttggcgattaaaccaacttccgatggatggaaagagaaaggggtcgacggagcaaatgacggaaatgaaggattgctgttgattaatggaaatcacgcgataaagatttcatcctcattttatatgaattctctgagtcaagttaatttcgataaatccattgcagttttgttgttatgtttttttgcacggatttcttagtaaagccgttcatttcgcttataatttatttatacgtcccctaaattcatttttgatgaagcctaaaatggaagtttccccgaaaagcgattcgaatgcatttgatccgaaacatcggaaaaagacgtgcacaatttcaaaacaaaggtcaatcgttgttaatctctcacaataagtgttaatcttttgccgaaatgtgatgattttagacagcccgaaaaagggattcgccaaaattatgagctgaacaaattcgaacggaggaatgattcgctttttgggttttacaaaaagcaacgcatcgttcccgactcggaatgggaccgtttctgtgagattttggccacggagttgccctcgtcgtttcgcattcaacgaagtcttccggagagggattgccttgccaatttccttgagcaacactttttcaagcaaatcgcttccattgcggcgacttcggagagtgacggcgttggcattcatccgccaaaatctgtcccttttgtgccctatgcctaccagactaaaatgccgcgctcaatgcttagacggcacccaattctaaaggaattccacgagtttttggtcaatgaaactgaattggtgcgtattaatgggcattacaatggtaaaaacgtccaaaaaatttaggggaacatgagcagacaggagacgtgcagcatggtcccaccacttttgttggatgttcagccccaccacaggtgaacaggaaggggcctttgcaattggatgcttgggaaagggcaacggactgattgtgaaggagtcaatggcaagtcgtacaaaagccagtgcattcaatgtccaacacgtacacatcctttaatttatttatttttaattagaaagaaaattcattttgattttttttttgttaaatttctaattgtaagtccccccccccccacccttcccaagtcggtccctctgtttttgtacattttgttcgcctcttcgtttgcttcagagtgctggacgcctgcgctgccccgggcagcaaaaccatgcaaataattgagctgatgcacgagcactgtcccaacccagccagaagggttccctttcccacttaaatttttcgctgtctgttcagaagggtttgtgctggccaatgactccgattacaaacggtgctatttgttggttcggcaaacgttgaagcgaatgccaaccgcaaatgtggcggtggtaagtcacgacgcctcccaactgccggcccttttggacgccaatggccgaccgatgcttttccatcgggttctatgcgatttgatttgcaggtacttcccctgtccacagcagtagcaattggaatttttttaatttagcggtgacggcactctgcgcaaaaaccccgaactttggcggagttgggacccactgaaaagtgaacacccgcaatttacaactgaaacaaagctttaaaaggtgtaaatttgcacaaacttcaattacaaattgcgcggcgttgcttggaactattggccaacgacggtttgatgtaaatttgtgcattttaagtgaataattttgaattttgaactcccttagggtctattcgacttgttcattgaacccggtggaactgaaaagcatggaaaagtaatcaaattaactgcattaagctagaagatgaagctgttattgctcaacttttacgtaaatccaacggaacagtggaattggtggacatttccgaccgattgaaagagttgaaaagaatgccgggcatttccgaatggaaagtcgggatttaagagcatgagtggcatttttcaccgcgttgcctttcaggtgtttgacaaggagatgaacgaagttcgggcagttgacgatgttcgtgcggaatcgaaacgccttttcaaaccgtcgatgtttcccccgactttggaggaagcttcgcaaatgcatttggaacgctgttttcgaattttgccccatttgcacgactcaggaggctttttcgttgctcttttgcgaaaaaagggaccaaaatcggagaatgatttgcaacgacaaatcgaaggaacgaatgctcaaatgaaaagtgggccaccatcatttaggtagttgttgagaatcttcgacagaaattaaagtcattgttcaagaaaatcgactgcaaagcgagcgcgactttcgaataaggaggaccccttcattttcctggaggaaaatggccaacgcgacgatcgcttcgtctccgaattggacacgcactttggcatttcccccagcgaactcccccactccaaccttctcctccgttcccataacaccgaacgaaaaaaggaaatttactttgtgaacgatgccatccgcgactttcttcgctttaatgcgaaacgctttcgaattgtgagttttatttgtttattttggatttcgattcgaatggcttttctcctttttcgcaggtcaatgcgggcgtgggagtgctcaagcgaattgtgtctgacaaagtcgcccaatgtccataccgactgaaacaagacgtaatgggcggngatgggtaattaatgggtg

SEQ ID NO: 6897 - DNA, 1710 bp, Heterodera glycines
  misc_feature (1697)..(1697): n is a, c, g, or t
ttgatatgaaaagcaaaaaaaaaggtcgtcgctagaggaaattagaggctataatacttagagtttaaaaaagtcccgacaatcctgctggatccgaaaaaaagtctcggtattgatcgggtcccggacggggtcccttcgaccccaattgtccggtctcacccttttacatatgcgcagttttgtgcctcaattgtctgttcggcaccggtactttcgttttcactttgttttttttctgcattacatttttcctttgtgccgtttttcccattggtcgtccctcctattccccgtatctcttctccccccccccctcagcaggtgtttcttctttcgtccagccttggcaacggtcccccccccccccctcccgttgggagtggtagctgttcgatttccatcgaagtacgccgaaaatggattatggtgcagagaaagggaaaatccataaaaatagaaaggctccgctggccgcgtgccccccgcccccgtgccgtgccgttgccacactccccacgcttttttctccccgatgccattttcctttctctctttgcttcattttgccaaatgggtgtggaaagtccaccaaaccgaactgtgggagaagtaagagcagaattggcttctgtcggttcgactcgttgtgcgattgattccccatcccccgccgttttttcgcttttaaatgttaagtgtgttctgctccgtgctttagcaatgaaaccgattggttgtgcttttcctttgtcctcttcctttcatctgtcctcaaatggccgtggtccttcgccttcaaaatgtttcgctgttaaattgccttttttcgccctaatcctttgtcttttgtccgtccctttctgcgatgggctcaaatgttctgattgttcgacaagggattgcatgggttgtgagggcgattactgtttgatggtcagttgggcaaaatcagtgaatggatgccacggattagacattcaaacaacgaagaagtattacaattcagggataatcccaggatttctgcttgggtctctttcagcaacttgatcatatcactccatgatgatctggtcaccccacatggaaaattcgaaaaaattacttctaaattttttagactatacacacaccttagaaaaagcttctaaacagattaagctttggaatgataccaacaattttggatttggttgacaaagaaaaaagttatagccaaaaaccgctggggcccaaacgtgccggggcccaactgagaagaaattgtatttttacagggattatatgtaattataattttaaaacccaaactgttttaccattttaagtctatttggattatctccaataaaatcctattaagctgtttcgaccgtgattatctttctcaaatttttatctcgctcacttcgttccggttaatgaacttacctaatcaatcagttaatcaatttgattaccaaacaagcactttaattactaaagccgggttaattttgaatttccgaatcctgtttgaggattcagtttttaaatttcctcctttttgttgactagtcctgcaaaatcctgaaaatcccaggtttcgaaaaatttacggtattccgggcagggatactgtacaggaaacctgtctttttactgggctctatttattaccatcttcatccctgtccttctgtgctaattgctgngtccaatcatgca

SEQ ID NO: 6898 - DNA, 1924 bp, Heterodera glycines
tagagatcggaacttttgtgtcttcctggattttttcgtctcttcaaatgcgcgtgctctctccgctctctcgtaaggcagagacgcatatagttcactgtcactcactgtccgctgagaccgtaagtcagagatgcatacggtcactcagtggtcactcgctgcgcgctgggatgcgatatcgatctctggtgcaaagagtgaccagtgcgtgaccatatgcgtctctgccctacgagagagcgccttcactgcagcgcctctgaagatacaatacttgtccaggaagacacaaaagttccgatctctattttaaaccattttttaaaactttttttttaaattttcatataaaaataattaaaatcccgatgcatataaaatttgggaagggactgaatgcgggagggggtgagtcagtgttcaaatttgcgaaggagttccagtcatggaaacccttttttttcggcgcgatttttctaaaaaacttttaggaactgatgggaagggggtggatccggcggtgccgataggcgctgtcgggaaagattttgaaaatttgagtgcgatttggttaaagttttgtaaaaaatgacctattttatgatttagagccaatttttttaaaagaaaaattaagggttttgtcagctctgacggggtaaaattggaattttgaaagaatttttgagaaaataatacaagttttcaaaaaaaatttcatttaaattttgaatattcaaaaaagacattgcttcaaaaaattttagaaccaaaaaatgcgcggcaccgcgcaaaaaaaaaaccccgcggccgcgcattcaaattgccgcggccgcggatcgcgcaaaaaaaaaaacgccgcgaatcgtggatcgcacatcgcggcgcggtcccagccctgctacgaatactgatacaaatttgttagtaaattgtttaaaatattgtttagaatttgtcggaaattgctcaagaattcttcaaaattctcttaaaattaaaaaaaaacctttctcccaatattttccgaccttcgccgtcccctcattgtcctctaagtccaccgcctccaactgttgtcccccgtagtgttccatgatttgcgctttgaacgcgtccaacactttgaagccgtctttgatgcacaccttgtttgccagctccaagctgtaattgttattcccattttttaaattcgttttctcttttgtacaaaaaaatcccatccctacaaatcaatagcttatcaagaaaaagcacaccgagccatttcgttaaacatgttctcaccgatcagatcacgggtcttcccatatgtagctttttcacaaatttggtgattttctgaaattatataatggaaaattctgccattgtggtttttttctattttctaaacggtttttacacatttcataaaaaaagtcagctacaaatcaattaagataaaaaaacaggtgctaattaatcaaaataaataacgaaaatttagtgcattctccaaaaatgctaaaaaacaaaaaatcgctcccttatcattttaataggttttcagattgacttcgaagttttttgttaaattatctttatgctttacatttttcatctcttgctttttcacattttgagtaaatcattgacgattgatggtacgagaaatttaaactcttaaaatttaataattttttttaataactttttgttaaactttatgcccttcggaaaactgctgattaattttaagaatttatcggaatttgcataagaattcttaaattctcttagtattaaaaaaacaatttctcccaatatttttcgaccttcgctgtcccctatttgtccccaaagtccaccacctcaaattgtcctccgaacgcttgaaggcgtcctgctggatgtacactttgttcgccggatccaa

SEQ ID NO: 6899 - DNA, 3204 bp, Heterodera glycines
agttcaaaaagtaaatgcatatgtggcgaagtggtttttgtaagatagtaaagggacaaagggtggtggttcgagtccgttgtgcaacatgaatatttttatttatttttaaaaggtttaggggccatacatgaacgattctatttttcgtaaattttcttttgcctaaaaatatcgttttttcaaaattgaaatgccaaaataaaaagaaaattattaaaagaaattttttgtttaaaagttatgggtagggagtccaaaacagtctttacctttcatgttttcaatgtttataaaacggaataaatagataaaccagagcccgaatatacagacttttttcataatgatatgattttttctgtttctcatctatgcttaaattggcatattttgccacataattaaacgtggcatttaatgcgtgcagcatctctctttctctcgctttctctatattcaatgtatttgtgacagtctaattaatatggatttttttgtgtacagaaaatttttttaatatgcttagatgttttcagcttgcccccctccaaccatattacaacgaaagaatgaacggatatgctggggcttacttatacttgacgacattaatgtcgttagaatattatgctaatgaatacttggaaagatgtcggaaatgccaaccaaatacacaattataattatgtttatcacccgtgctgggttgttgcgtaaaactgccaattttacagtttttcgagaaaaactcgtcatatcttttcttaaacacaacccaattaaatagtcttgaaataatccgatagccctttttgatttgctcaattaccacaaaaaatatcatttcattgttttagaaaagttatggcaatttttttaatctgttggtcgcaactttctgaaaattgaagtaaatttttaaattttatgagatttcatgctaataaaactcaatccaagagctatcgtttgatctcaattttatttgatttagttattcttaagaaaattattacgaatttttcttgaaaaatttctaaaattggtatttttacagaaaaattgggcaaaacttgtaaagacgagctcgacaacaattcgccagtgattatggcctaccaagaaattgatattgatatcggaacaaatccgttgaaggtcggccagtttggcatttgtatacttgacgacattaatgtcgttagattattatgcgaatgaatacgtggaaaaatgtcggaaatatgcctatttcacaattaatgctgtttattatacccgtgttgcgtcgttttgtaaaaattgccaattttagttttttcgagaaaaaactcgtcataatttttcttaaacacaaccaaataaaacaatgttgttatcattaagaaccagggctgtcaaaaatatgcacgaaaaatggcctaaatatgcaaataacgtcgtgaaatatgcaccaaatatgcataaaatcgcaaaatatgtcaccaaatatgcacaaaaaacttgaaaattagtggtacaaatcaattaaaaaaatttattcctaagaaattttatcggttgtttttacaattgtaaatcaaaaatttctcaaggttttcggcagtgaaactcactgttgacccactcgcgcatccattgagatttggatttaatttccgacataatcaattttttttcaagagatattcaaatcggaaaatatttgacgaaaaatagcaaaatatgcaaaaaaatctgaaaatatttacaaaaaagtgcaaaatatgcaaaaaaatctgaaaatatttacaaaaaagtgcaaaatatacaaaaaatctgaaaatatttacaaaaaatggcaaaatatgcagaaaaccgcaaaatatgcataaaagcttaaaagtcccgacttttatacgtaaataccaaaaagatgatgtttttcctactaaataggtgattatggtgaagtgatgtactatccatcattggcgaataataggataatgatctttattgcgtaaggacaaagaaatacatcattgtgattccccaactcgtaacgggaaaggggaggttggtcgggatccggatccgacaaaagtggaaaggggagttcaaagggaagagtttatataagcggagtcataaggggcggggagagtacaaagggaccgccccccgtaaagcaaaaatgtagaaaagcaggaggggccaaactaactaaagagtaacaattggtcatcgggggccccaaaaattgaccgtctcggtcaaaacacaaaatcaattaagctaagaaaggagatgatggtttaatattttttgattaataaaattgttttattattattattattattttatttttttttttgtaaatattaaatattaacagggcggccaagtgtgcttatttctaagatttgtgcttattttgaggggtcggatcttagaaagctaaaatgtgcttatttctaagatttgtgcttatttcagcattacgtgcttattttgtgcttatttttgggtttgaaaataaaaagaaaattttgaatgacagttttgacttatagttttttattgaagcgaatacttgaattaattcgatttttgaaaaaaaaattacatttttattttattttttgagtgaaattcacaaaatgccaccaaaacgtaaacatgtctacttggagagctacgaaaaagaattccggcacataaaaaaaagtcgaaaaggcgaagaatttgccctttgtgtcgtctgcaacgatgatattaatctcctttccattgggaaaaccgcaatttctctgcatcaaaaaacgggaaaacatcagaaagcggcaaaagcagcaaaccgatcaattccattgcaggaatttttgccaaatacttcggctccatcaactgaagaccgtaaagttctggctgccgaaggttaacaggcttatttttgatcaaaaattttataattaataggcactatcgcgtatcacactgcacaacattgtcaatcttttcgctcggtggactgtttgtcatctgacggaatgttgcgcacaatttttcctgattcaaccattgcgaaaaaaataagttgcggaaaaacaaaaacggcaaaaattctaactggtatcgcataaatacaaaacttttttcaattattgttaaggcgtgttggctccatattccgtgaaaaaaatcgttgaacgactg

SEQ ID NO: 6900 - DNA, 3945 bp, Heterodera glycines
  misc_feature (2223)..(2223): n is a, c, g, or t
  misc_feature (3875)..(3875): n is a, c, g, or t
aaaaaaggcaacggatatttgagattgaagggagagcaatgacatgagggcagtgatttttaaaatgcccggacattttaaaaattcaaccaaacgaatgagggagctgaaaggattttgtgaggaattggaggtgcggaattaagtaatgaaaaattctaagctgttaatttaggttgaatttgaacgcttgaatcgacatgggccgacaagatggacatcaatgaacagcgtcttgggcaaaattattcggatggaatctgtcttaatcgcctacttttcaaaacctgacaaatgtccggcacttctttacgcttttttttcgtttttttctgaacaatcatttgcgatcattcattttttacaccacgtgctaggcctatttaacaagacaattgacttttttcaggttgttttactaattttaaatgaaaattctgttcataaatttagaaagaaaaagccattttgcccgaacttttgctggaaatggacaaatttagagcgaaaattgagcgacgaaaacaagaacggttttatggtgccgatttggcaatggaaaaagtcgggaagtgcacacgcgaagcgttggaggaacaatttcaagtaaaaattaatcggttttttattaaatttccaatttttccagtctttttacacctcggttttggcatatttgaacaaatggcatcgcattgaccgatttccggaaaagttgcaatgggttgcgctggcatcccgcaaaattccccacgacgatgcattggctctggctcgacaaattgcgcccgagttaacaaatgacttgtttgacgatgttagcgaagcaaaccaaatactgaattcttttccaaatgatgaatttcaaaaattaacccccgaacagaagtggaagaagctatttgaagcaaatttgccgcatctgctcaagctggtcagcattgttctttccattccggtctcgaatgcatttgtcgagagagtgttttctctttgcggctcacaatggactgacacgcggaatttgttgcaagtcgaaacagtcaaggcgttggtccaaacgaaagccaattttgatctttcttgcccacaaatgtaccaaatgctaatttccaatcacaaattgttggagaaaatcggcggatgggaaaaatacttttgataatcactttcaattgtttttgagctaataaaatgttgttttaagtcgttttttcatgctttttattgcgtttccttcgcgctactatcagttttagaaaaaatcttatttttggggtccgaatcttagttttagcctcatctgtccttattttgaaaaaaaaaacttggccaccctgttctaaccccaggtttccaaataggggattttcggtggtcgctgatcacggatttgacacattcatttgatcactttcaaatcctgaacccgaattcgaacaaagtcaacatttaaaaattcacatttatgtatgtgaattgtctatttttgatttgaatttgtggcatttacttaatctagaagggcctggaataagtgccgaatttggtacttaggtatgtcgtttacagcccataaaaataataatttttaaatcaatttataaacatttccgctgatcacgaatctgacatccatttcgaccaattttgaatcccggacccgaattcgaacaaaaagtcgaaaattcaaatttttcaaaaaatcattttacggtgcgaaaattacaaaagttcaacaaaatgccatgaccaaccacagacaaaatcaacgctcgcatcgatacaattcatgggtctgtatcgttttggcgccgccgttttggcgccagcccaagttttcggactataacttttttaattgttaaccaaatccaataatcttggtatcattcgaaagcttaacatgtttagaagatatttctaaggtattgcttcgcgattagacaattaccaaaaaagttataacatgaaaattgtgaaaagtcgaaatttttgaagtttttttttcataacttttttccaagcttgaaaatcttttcgctttttgtaaggctaatagagcatgtgaagagctttggatgtcagattcgtgatcagcgaccccgaaaaacccctagaatgaatcaatgaaacaacagaatatatgttattagtacattcacaatacacagatggcacatatttaggcattggtaacacatcatgatgatggcattttgngtgaaatatatacatacaaatcggatggattttgacggggatcaatttcattatacaacacataaaggggagccacactctctatgatgggcacaattatccatgctttttaattagtatcctctgcaaaaattctcatccattccgatcgcctcttttctccatgccgttgttattgttgttgtaccacgcgtcacgtcattcattcactgtcgtcacgtcgttcagtcactgtcgctgattgatgaggagctgctgctggtcgcattcccaccggtcgttctgttgttggcattcgtcgtcgtcgtcaccgcgccgcccaacggtctgttcgtcgctgaaaaacgtgacaattaattatctatgttgctacaacaaaaatgccaaaaaaaaactgttacgttcattcgccgtcgtgcccgccatgaagatttctctcagctcggcttccgtcatttggccatgaccgggcacatccaacactccttgcgtgatggtaattctccgctgcgcacgcgcactccgtccacgctgcggctttctcggacgtccacgcccacgcttcttggccgacttggaccgcttctttggcgttgctctgcgcgccacaatccggcgacgtcggcgagatgatttcctggcggacgacacacggcgcgacactcggcgagacgcgttcctgacggacggtgaacgacccgttgccctgttgccggttgctcttctgctcgcggaacgacgacccgtatgtgttgaacggctccgactacggccagcagcagcggttgaagcagcattggtggtcgtacgacgagttcgctgaacagggggaggtgggggataaatgaatggtggcagaaaaagcgcatgaaaaatgaatgaaaatggaggggaaagggatcaccgatcttgaagaagtcatctcgtcgatgagggaaaaggagctgttaacgaattggaattgtgttgtgatagcgcaacagagagagagggcaaaaaatgtgtaagcgctgaaattaattgcaaaaaattcaattaggagggataaagccgactttaaaagagagtgaaagcggtaaatgccattttctgtgaatttgaatgaattcgaaccaaaaaaggaagagtcgaaatcagagctgcgatagatttacatttcaaaaacctaatatacaaaataaaatctcggaattttatgcaataattcacctaatacctactttggtgtaggctttcgaaattttttgaaaacactaagtaagggtctctttaattttctattaaaagctcgaaaataaatttccaaaaaaatggtaggacaattaaaaaaaaggaagaatggtcgaaaattgacagagcggaagagtgaatttgatgaattcaaacaaaaaaatgagcaaaaaacttaaatttgtcctatttatacttttttgaaaaaggactgacaaatttatgaaattttctgcgtatttaagcgatgaattccccaccaaatgcattcattcattcaattgcattcacccattgtttctttccatcggtcgaatcgtcttcctatacaataaataattcccgtcagttttttttttcatttttcaaaatgaactgaattttgtgcccttttttcaggatggtcagagcaacaacggccnagacaagggcatcagcagcgcgagcacggagcatcaaaatcaatcgtcgaaatgccaagaaggcgcgtgc

SEQ ID NO: 6901 - DNA, 3663 bp, Heterodera glycines
  misc_feature (3599)..(3599): n is a, c, g, or t
ataaataaaattataaatcaaaaattttggtcaagacaaaaataaattgtggaaatttttgaaactttggacaaatagccaaaaaatgtatccgggtcaaaaaaatctttcttgtatttttgttaaagaattactgaattttatatgaagaattcgaaatatattttaaaattaaaatattgaaaatccttttttatcaaaaatctcaaaaattttttattgaagaatttttttacaggcagcatttagtttatttaggctggttttttcttttcattttagtcatttcttcgaattcattattaatttttcaattttaagatttttaatataattttttctaaaaaatttttcaaaattaatatatagacaaaaataatgtgaataaataatatgacaaaaaaaaaaaatttttttttatctgttcacacacaattgcttcttttcaaagatcattaatttaataagaaaatgcatgaaatcttattttgaaattatttaattgtaacatataagtgtatacaataaataattttgaaatatataaatacgatattgacagggatgcgatcgccaaaacccaaaaaccgggcgcgcgagttgaaaaacccggcaaaaacccggcaaaaattttcaaaaacccggcaaaaaacccggcaattttttaagccaattattctctgtaaaaaaggtcaataacatttaaacaatatatttatcaccgcttttcacctgtttgagcaaatttggcattgaaagaaaataattgtgaacagtgacgagcgcaatggtaggccagtgttaattctgctgcgagacaccgtttttcttcagaagccttaatcaattgaattagattatttaatgagtccaaaatgaattaccgatttttgtttaacaaaatcggtcaaaggcacgtttctgttaaattctgccaaattttttttgtgcttggtggttctgatgtggtccgtgactgctttttcaccctttttttgatagtcctccgccaggctttttgtgagaatatttcttcctttttggagatgtgacctaaaatttaataattacaaaagtacatttgctaaaattcaccccaaactcatcactcgaaattgaaacggctaaatctgaaattgcttcctcagcgcttgaaatttgagttgaaggtgattgttgaaatgtaacattggaaatgaaatcagaaatagatttttgggacattctgcagactagaaaatgaggatcaaaaattaataaaataaaccggaacaattaacgaaaactatatttggatctcaattttggcaaaatgtttaataaaattcaaataaatgaattgaaataggaaacccggaaaaaacacaaaaacccggcaaaaacccggcaacttcaaaaacccggcaaaaaccaggcacggaccccaaaaacccggcaaatgccgggtttaccaggtaaaatcgcacccctggatattgaataatttaatattgtattacaataatttaataaataaatgtaatatcatttgatatttccaggatggataaaaaattgttttttgtataattttttttactgagtgtttttgtataaaaatgattgcttctaaatttgttatattttgtcttgaatttaattagttgttcttggtttttactattttttacttcctttccttaattttatattttttcaagttgccgccgaagaattctcatttcaattctattatagtttaaaattgttttctaaaatattgttaaaattttttcacttatatagaagaaatcacaatgaaagtttttagtgtattaaatatttttgattttaaactgaaaaaactattatagagataataattcatttttttagcgaaaaaggttatttttataatcacatttttttagtaaaaagctgccttagtttattttattaggtaatttatgttttattcttgtgcggacgtcggattataatttattgtttgtatgtacttagtaattaataaatgaatattttttgttgaattgaccataaatattcttttagaaattgtaaacaatttttcaaatttatcttctaaaatttttcaaatgttcaaatttttattatccgattgggtttttattttaattttttataaagaataattatatgtatatttacttatgtagaaattttaatagtaatttgttaaaattgctgaaacagaattgaaatttttgttcctttttttatatttttatcaaaaatattttgttaagccaatttatgttctatttttgaatgattcattctaaaaatttaaatagttcaattttaatcgaaattgaggcaatctttattcatttataattatttatatatatccgtttaaaaattttttattcattattatttttattttaatagctaaataactgacattaaagtaaatttcatttaaaatattttttaaatcaaataatttaatatttaaaataagttttttaaataatatataagtaagtttataaaaataatttaaatgtatccagtaaaatttgtccactattttggtttcatgaactaaaatgtaacatttggtattctgcggaagttgacgaaccattgcttatgtaaaaattatatttcctatatgcatggactgagaaaaaaaaaatgggctatccttaaataaacttaatttatgttaactttattaaatatgtttttattttattttctatcgaaaattttcttgattgttaaataataaaataaattctatttatttctctaaatttttagttttttcctcatcatcctccctatggtttttcctaatttttaaaagtgaatttttgagaaaatccaccaacacagttttccaaaaattttgcacaaaaatcccatattttcacggacccccccccccatccgcccgctctctcccattttctcaaaaaaaaaatttcggaaaaagtggtgtaaaaaaggaaaaaatgatcttctgtctctaaaccgcaaaaatcttatataataacatttttaaatgtacttgaagttaatggaatttttgtcttcatttccggtattttcttcttttatattcattaaaattcgaaaaattttaaaattttatcaatcaattatttactcaaatactttgttattacttttcatcatgggtaattaataattgtatttgacagtttaaattagactaaaaaaccacctttgtgttttaatgtcatttattgtttctgtataaatttgttgttgcaattttttacttggaattcgtcaattaaattgctttttctaattttgatgagaaatattttaacatcctatctttgcttaatgaattaatttaaaatttcatacaattcttgttcacggcatcctgactcaaatcttgattaattagaggttcaaatttattaatttacaaaaaaagaagtaaatgtaattttggagtaattttatttgtttgtttttttaaattctttatttgcaacataacatttaagtgtatataataaatatttttataaatagatcaaaaagaataaattatttatatttatttatcatttatatttcataaatanatcatttattattgtattatccatgaattattattttaacatttaaataactatttcatgctga

SEQ ID NO: 6902 - DNA, 2172 bp, Heterodera glycines
ttattaataaatattattattatttagggtttttaaacttttatcaaaaaattatttttggtataattcttttgatgtttgttttattttatgtcggtaatttttagtcaaatcattgtgttttcttatttcatagatttttatttagtttaaaatcttgtttttgaaaaaacttaattttttatatatttttcaaaaaaaaaataaaataaaattctttaacagttttaaaaatataatttactgtttatatttaaaaatatttaggaaggtattttaaagtgattattttttctgctaagagcctgttttgtttaatatattttaaaaattagaaaattttaagggaattttcgttttttgtttgttttatagtatatatttaattttttatttatttttatgcttactttttgtgtctttaaatgaatatataaatttttcaattttatacaataaattttctttgattaatcgattttttgtttcacttataaacgaaatttcgttggaaaataaagaaattttgtttaatgacatttgtcataaattgaatgaaatttcattctccaaatcaatgaaagttttgcttaaaaaaatcacaaaatgataaacatttaataaaattatttttaaaaaaattttattcctaaattccttatttcaggaagtaaatttttgaaaagtgggtgactacgaattttatttttgaaaattataattttgcaggttaattgcttcgtaaaaataaaattttgtacatatcaaataaatattgttgaatggaaaaaaaagaatacgagattaaccaaaaaatacgagacttaattctattcttactaaaagaacattttatgaaatataattcaaaaatggttcaactgcatcaaatgcataaaaaatggaaattaaaataaagctaaaaatatcttttttaacttcaattcttttaaagttgtacaattacattttttgtggagcttaatttcttttaacaaataattaaaaataatcatttaaaatatagcaaatattttatttatttgggtcttaaaatttttatttatttgggtcttaattatgtttttttgctattcaagtcaattaaatttattattttttgtttttgtgatgtactaaaatacaattcttcatatatttttgttgcgagtgatcattgtatttgtttatttatatttattttgttacaattctattaagatatataattttttaattagtaattaataattactctatctttttacgacatcggatgtttgtctccgatcatcattttgatgcgctttttttatttaaatttatgcatcatatttcttttattactatttttaatttatttttaaatccgagacctttaatttggaatatttagcttaaataacaaatcaatataagggaaaagtctttttattatattaactcgtccacagatgcatgaagcggaaaaataaattttttcaaaaatataatttttaataatatttatcttcacagttttatttgatctaatttattttcatttgatatttaatgtattcataatattttttgtaatgtgctgcttacatcaggctttataaataaattaattaatttataacgattaatttctatgaaaattaaatcaagcaaaaaaaattataatgtttggttatttgcatttcttatttgatgaaccaatgccgcttttattcaaagaaatatttacaaatttgtagtaaattttttaaatcgaaatatcaaaattaatatttattttcatatttttgtatttttttatattaaaaaaataagtatttcaaacattattaaatttttaaaaaataattatattactgttaaaatggttaataaattttttatcaaattaatttaatttcaaaattaattttgtatttttgagctcttatattatgatttcattgtttacttaatatgattttttaatatataaattttaattttatagggaaaatagtaaatgctatgtgtattttcaaggaatgctaatagtcatttttattaatatgcatgtatttttatcaaaataaattgtgttattttcttaacgttaaatttttattacaataaaaaaaaaaatattagtagaaaaaaaattccaaaatacggtagggtaatttttattta

SEQ ID NO: 6903 - DNA, 3051 bp, Heterodera glycines
accagcagccaccgttttttaaccattaattaagttcttttgctatacaaccaactttctaccatgaactcattaaaatttgcattatattattttaaataataaccataaaaataagacactattaattcctaaaatgtgtaaaattccaaaagaaccctaattattagctaatgattattaattcagatttgaagtaaaattgcataatttttgatagcattgccagtcacaaaaaaagtctcacatttttatgaacaaaaatactattttagaaagagcaatcagtagaaaagcatttatttatatttaataaagaatttataattatatatttgttatatcaattcatatttttaatttttaaattatatttaaaagaatatttaaaaatattttattttattcactattttttaaagtaatttattttaaaacttaattgcttttgttaataaaaatcgtcagaattggatagttcaaaatttttcttattttcttaatctgttattttcccggcaggtgaccccctcagtctcgggtaaatttcggtatcgaacatcacaacaaaaccattttatcaaagtttaaaaagaaaaacaaccaaaaagaaatatcaaacaaagtgcacaacttcctttcaataaaattcaaagaataagatgacaggattcatttaaaaaaagaataacaagaatcacagaatatagaaatagaattataattgcatctgctcatggggttataaaacaaaaattacccaaaatgtcttggcaaattatggaaccattcatacacacgcttggcgaagttttctttctcgtttttgtcctttccttcttgtttatttttcgtttgtttggacttcttatttttatgatgagaagggcgccgtttgccaaatttattttcttcactttcgcaagatgaactactgctacttctaggtttttgttgtgaaggcggtcgtaaaatagttgtcgttgttgaggactttgaggaaattgaagaagttatcaatgaagaagaagaggatgttactgtatcagcgtatgctgacgactcttcagtggttgatgctgggtcatcggatattgacacttcttcgttagccgatgctgacgactcttcagtggttgatgctgggtcatcggatattgacacttcttcgttagccgatgctgacgactcttcagtggttgatgctgggtcatcggatattgacacttcttcgttagccgatgctgacgactcttcagtggttgatgctgggtcatcggatattgacacttcttcattagccgatgctgacgactcttcagtggttgatgctgggtcatcggatattgacacttcttcattagccgatgctgacgactcttcagtggttgatgctgggtcatcggatattgacacttcttcgttagccgatgctgacgactcttcagtggttgatgctgggtcatcggatattgacacttcttcattagccgaagcagacaatacttcagtggttgatgctgggtcatctgatgttgatgcttcttcattagccgatgctgacgactcttcagtggttgatgctgggtcatcggatgttgacacttcttcattagccgaagcagacgactcttcagtggttgatgcttgatcgtcggatgataaattgtcagtaccttgattgtttaaatatttttatttgctttatttttttgctatttttacctgttaaaactgtcggattttgtcccgtaattctcaatacaatcgttccgtccgacaatgtttcctctgtaacagtcacactttgtcccgttattgtgagggttattgattttccatcgtttaaaagcgttatagcctgtcttttctttcggatttgcacttcttgttcttttatgttgtcaaaaattgtaacagtatcgccgctatcatttttcgatgggaataatgatgacaaaatcttgaaaaattgtatatattttcaattttagctaattgataaaattaccgggaatgatttgacttcgcaaatgtgtagaatgattaaaattgacaaaatattttggagccgcattttgctaattattcttttattaaaaaatttaattgataaattgcatgcatttttcgctttttatacgcactttcttttactttaaattttaatacgctttattctttgtttaaacagacaatagaaccttcattaaattacataaatttatttattcatctgctctttagtgacgatcgcctccgctttggttacgttgcatccgttaatgaaagctacgcaaataaaaaaaatgatttcaattttattttacttggaacccacttttttattcacgtgaatttaatttgaaaaaattcatcatttttagaactttaaattcagtcttaaaaatgacaaactgagtattaaaaattggaccaattcccggcatcataatttaattaaattcattttttagaacagtggataaaaacaaaatgccgaaaatcaactaattaagcataaatagatttttatcttattttaaaattgatttttgatttgcatttttgaaaaaagatttttatgacaaaatttcaaataaaattacaataaaatgttaataattaatatatacaaaatctcaaaataatttatattattaatttatgaccacccaaaaaagggtgtggcacactaaggcaatgttgctctgagtccaaaattacatagttggggaaattaatgatcgatgtcgttggaagcccaaaaaagtgctataaaaaatgccaaaaaataattttaaaacctttcattgaaaacttttatcaaagcaaataccaattggaagcaccttttcataaaaacatttgaccatctctgtatttttattagagttgagcgggaccgggacctgaacacgtacaactgagtacaactgagtaccgaagtcccggttttgaccgggaccaggacttgttccggtttttcccggttttcccagccaaaaattcccggtttttcaacccgaaaaggtcccggtcccgggtttg

SEQ ID NO: 6904 - DNA, 1100 bp, Heterodera glycines
ctacctttagctgttgttttaactctttgagccttcttgtgagcagttgttttcactctctattaataaagaattattagtttaattgaaaaaatttgctttcaatatccaatttcaaaattgttatggttaaattaccataactatgatggttaccctataattgagttaacagtatttgaccatcgtgcatgtttgctaaccctgccccgacccacttttaaaattctgaaaaatcagcgaaacaagataaaaagctctaaaaaattttagaaaataaagaagagcatccattatcgctcgctttttataaagattttcaattaagaaatgtctcaaaaataaagttcgcataatctttatatgtattttgtttgaattgtcatcatttttggctttttttaatcaatgctttggttttgctaacttttcttttttttaatgagaattttttataaattttgggaaatttggagatattttttagcttccgaaatgcccaaagcttcaaatcacattcattcgaccttaatttgctaatgaattttctaaaattgtgttttttgagtaatgttcatttttatagtcttttaacgtcaaagcacacgttttgtcctatttcggtattcgctttctcacctttcgtcccgttatttccacttccgcatcaacttcatagttcggcacaggatttgcatttgttttgctccgtttgttcaatgtaaaaattcgtcttggtgtcttagaaaataaaatttctattttttaattatttttatttgttttatacctttaaaactttcgtttctatttcctcctcttctgcgctatagtcattttttatttttaatgatccatcttgataagattttatacatttagattcaataaaattaatcatttaccgtgctgagaaaaaggcttattttgcatgttataactatgaagcaaaggttgaatcttaaattagtttatttattttttatttattgtacttctatgtggccttagattccgtgtctgcttcataattgggaaataaattattcgtgtgctttgtgtccatgaagtgtcaacgtgacgcggcgtgttaatcaaga

SEQ ID NO: 6905 - DNA, 2334 bp, Heterodera glycines
  misc_feature (58)..(58): n is a, c, g, or t
  misc_feature (80)..(80): n is a, c, g, or t
ctaaaaattaaaacgcttattcaaatatccaccactgtaagcatatttgaaagcattntaaaaaatttgttctaaaaatntaaataaataaagcttcgaatttctcactatttcggatcgctgaattggtgctcttgttctgctgatcaattaatgattcaaagttttgcagttgacgaactttcatagaaatgttacggtccaaattgtacagttcgcgctcttttactgtcaacttcgagtcgatagttttggcccgattaccttcgcctaaagataaatgttctcatatttataaatggtttcgagttccaaaactttggaacggaaatgagaaaatattccagacacaaaatcatataaaaaaatattatttttaatctgttaaaaatgatgcaatttttggatttaaacaggctcgataccggtttaaccttttgccgcgcaattttttgattacttagtcatttttaacacataaaaacttacaaagtttgttttgtgattttgagtctagaagctaggaccaatatattcccgaaagagtttttgaagctttataaattcctattttctaattttcttaagcctctgatttcaatctatttacgattacgaatttttttagtccctgaattccgattttgagattttttaggcattggaattgcttgtttattacctctgtcattcgttttgttttctcctcctcctcctcttcgcacttcctttttcagttttgcaatttctttttctttcttttccaattcctttttcaactgttccatttgtttttcctttttctccaattccttttccaaatgttcactttttacaatgtgtcgcacttcgtttcttttcaactcataaatttctgtttctctctggcctaactctttttccaacttttgactcttttctttaaaaatctttacactttctttgttgtccaactccttttgcatattctttttaatttcgtcaatttgtttttcctttttggccaattccttttccaattgttcacttttaatcttataatgcacttcgtttcttttcaaattcgaaatttcaacgtctctttcccgcaattctttttccaatcgctgactcttttctttgtaatttttggcattttgcttctttttcaaatatttttgctcaatttttgactgtccattggcagcattagcagttatttttctggatgtccataaaacattattgttttccagctcattttcatgaattttgtaactgttattttccttgaaaatgccaaaagttttcaatcgttttggcgtgcttgataatttgttgtccttgaccaaattttgtagccgtattttttgaatcactttctgatcagtgattcgtaaattgtctctttctctttggctcatctcttttaaaataggcgaaatacgcaacacttctttaatgtcacctaaattttttttccataaatcgaaatttcaagtcgttcatcgtaaataatttcaatcaaataaaaatgaaattaaaaaatttaatgctgctatattaagagttttgtcagttttataaagcacttaatattgatattattattgtccatgaaaaacgtctaaggtaagtagggcgcccaactgaatttggcgattttgagccagtttaaaaaaagtttgggggtctggcggtgccgaaaggcgccgccgggggaaaattagaatttttgtccatcacaaatagttttcatggaaaattggggtgggggtcggtttagtctgagccaattttaaagcatttttctctgctggtcacatttcataaatttgacatcattagaaagccttcgcttctaattttttttttacaaatcgccgagcaaaagtttgccaaaactacaaaatgtcttttttggtgcaaaatgtcgctccaatttgaaaaactgtcgatgaaattctatttctatgcttctcatatgcatgcaattaaaagcaaataaaattgggtctttattaatcatccttgtccacctttgtcttcaagcagtccagcacgcttaatttcctcataaagtcgggttcgcaatgcaactccatcgctttccagctgcttaaacacggcatccagcgaatcggcatccaaataatattttgtggcactttgctctataaatgcggtgttcgcaaaatttggctcgtttaaaagcttttccgaaataatatttgccaattcgctcagctccgttcggctccaactcaccagacgctcatctataaacaatttttaacaaaatattgctcaaaatgcaacaaaagaggcgataatcgaaagacgaatttgaggagt

SEQ ID NO: 6906 - DNA, 4414 bp, Heterodera glycines
ttgattgattaattatttaatttgcaaatgctttttaaaggtggccgaagtgtttgaaaagaacggcacaagcgatgaatatttgacggagattcggatgccgttgaaccagggcattgttggccatgtggcaaccacaggacagatgatgaatgtgcgcgatgtgtacaggtaattaatgtattattagggaaattagtggaggaccaccagataattaattgggttgatcgaaacagttgtttccaggcatttataatcagacttcatttgaaattgatcaatgatcagtgtaggtatttctgatcactgatcaaaccatacacaagtgaattgagcattgattgacaacatccccgagattgattacatatttatgtatctctttggattccttatcatttagccatcccaatttctacccaaaagtggacgaacggaccggcttcatcactcgcaacattttgtgcttcccaattaaggactcctcaggtactgaattagccttctttttcacggcgaaaatattattaaaaaatcatacagtatcatcaaatctcacctatttactgttgcagctacagtagtttaacatcgtagtcccgtccctcattgtcaggcactttggtcggtgttgcggaactttgcaacaaaattgggcgtgacgcttttacgcggcacgacgaacaaattgcggcgacggtaggttgtaattacagtatttaaaaggctccttcgggcaaatgaaaaattagagtaaccgattaaacttttttacagtttgccgtctattgtgccatcagcatttctcacgtatgttgtcctttttgtgtcattgttctcctcatccaattaccgtttcctcccccttttacagtgccttctctaccgtaagctccaagaggcccaccgtcgttcgcacataacggccgaattgctggtccaaagttccaccctttcggtgagttttgcaatggcacaatcaatgccctgagaataaaattcaaatttggacaaacttacaagccaaggacgggttctatttcttgaattttcaaaatacgttttaaatccgcgatcttttccagcccccgagggcattcttctaattcccgattttaatttgtgatcagatccttttgtgatgattatcccatttcttttggccattaactctgtttattttttcctctccacagattgctcctgaggacattcttcggctgaccgtccgcgacattccttcgcccgattcgttccactccgagtcaaccaattccattttgtgccccgttccatcggaggtgccgacatttacgtggaggcatccttgtccatgttcaaaagcctgggcttcattgaccgatatcggatcagaagacggacattggcgcgctttttgttgatggtgcaaaagggttacagaggtgaggaaggggggggaagcaaaagtgtgggaatatttggatcaaaaatcgaaataatcttgttgaaagaattatatctttgttcgcctaattacggttttacctttccttccatcccacaagttcaatcagtactttccccctttcccaatctgttcagatgttccctaccacaattggagccatgcctttgccgttgctcatttttgctttttgttgctccgaatgccttcggtgaagtcatctttgcaggagttggagcggttcgccctgctggtcgcctgtctttgccatgacattggtgggaatatgggcatgtaattttcggctgattctagtctgatcaaaaggggcaaatcatttacttgtttcatatttgacacttttttagaccaccgtggcaccaccaatgcctttcagctccaatcggttaattgttttgatcaaactgatcattaactaattgattccactgtcccttcgttcagaaaactccgcttgcccaactatacagctctgaagggtccgtgctggaaaggcatcactttgcgcaggtgcgttgattaggcgtcgcttagccgatcaaagctaaacaaaccatcaacaaattatttattgtgccatgtttagacagtgagcattctcggcatggacgagtgcaatatttttgaccagttgaatcagaaacagtaccagcaggtacatacagtaccgctgtattttgattattgagactgatttccatcctctgtgctttgcattgaactttcgggtgatctgtccaatttccaaccatactctgatcagttcccacctggctaaagatgtggattactcaacttcagatcatggactgcattagggaagtgattctggccacagacattgcggcccatctgcgcaaagtggaacgaatcgctgaaatggctaaaggtgtttttttaaacagctgatcacttttcttactctcatcaatcaaatcccttccactaatcaagggtttgatcagtcctttccttgctttgcatccgctgatcacttcttctcacaattctctcggatcagtgatctttatcatgatcactctcatccaaattgttcatcaatcacttaatttatctgatcagtctattctctcctcgactgatcaccttaccccgttgcttctgatcaccattttcccctgtccttttgcagttggcttcgactcgcgatcagacgagcatcggtacctgttcacctgtctgctgatgactgcctctgatctgagtgatcagagcaaagatttccggcactcaaaagccatagcggagaacatttacaaggagttcttctcacaaggcgacctggagaaggaaatgggcaatcggccaattgagatgatggaccgggaaagggtgagttgatcgatcggagagaaagtgccaaaaaacgacacaatgccaatcccaccattttcccgttttaggcatgtgtgccgaaaattcaaatcgaattcatggacaccgttgcgctgccagtgtttaggtattatgacttggtcttgtcgactttctcgtatgttgtgacaaccgatcgcttcccagagagagagaaaagagagagagagaaagagagaaaaaaagaaagaaaagagagagagagagagagagaagcgatgtggagagacctaaatagatcacttcattttaataatggttaaacggcgtctccctcattgcttaaatatcttgccaatccgggattttgatggatgtccgttcccgcccctttcccttatctccctcttcgtttagactgcttgcgaaactccttcccgatttggtgccgacccatcagtgagtgccagtcccatcttgtctgattatctgatcactttccccctccccttaagggctttgctgcacaatcgccgctgttggatgaagcttgaccatattctgcaggagcagggactgccgctgacctcgggaggcttggaatatttgcgggaccaaaatttggaggagaaagtgacaaaacgggtgacagacgacgaacggaagggggaggacaatgtgtccaaaaatggacaaacggacgacgacgacactttgggcattccgatcaatgtgtggaggcgactgagcaacggcgaagcactgggaggaggacgaagaggccaatcgcaggacgagcagcaacaaatggagcggcagtggtcatcgggggccaaaaagtattcacttggccgctgacagccgaagtgatcggaatgatcagtcatcagcagcaagagtggccagcttgtggttgatcaacagcagggaggggaggaagcctgatgggattatcttttgatcagttcggcacacgccgattgattaattgatcgatcgacgaatcgcctataaaacgccggctttctctgatccgggcagaagcgaatgcgactggcagaaacacacttgatcgaattgtggagctcgacgtgtgtagctgtggcagacgatctgataggtggccaagtgatcaacttcacacagtcattacgggtgtttgttttccataaattagtcaatcaaatctctctcctcttcacattacctaattgtttttccttttttgggtttctttacattattttacactattattacaacgaatgtcaatgtttttaaattttcaaaaacagctgtaaattttatttttgcgtaaatgttgtaaagtaatgatttgcaaatacataaaatggggccgactgatcactctgatcaatttttcgttttgatcaatacacgtctgagcaatcgtttatccatcgctctacacacgttcatcatcgcctcctttccggcttttttgacatttttgcccagtacgaaaaaagatcggccgcccttttcagtccgccgtcgatgggaaggcattggcgcggatgtgccggatcaacgaccattcccgggggacaagcgcagtaaaaagagccttagagagggggggggggg

SEQ ID NO: 6907 - DNA, 908 bp, Heterodera glycines
  misc_feature (27)..(28): n is a, c, g, or t
  misc_feature (37)..(38): n is a, c, g, or t
  misc_feature (40)..(40): n is a, c, g, or t
aattagcagatttaggatcatcaaacnncattgctgnntnggtaatacagccacaattttttgtgttcggcgttgtctgaccttccgtgttacgcatccgtgggaacagccgccgttgcgttgtgccgtacattcattgacatctgtgcaaaaatgggtgaataaaatattccataatttttgagtttggttaaggagcttaagataggactgatcgcttttggacatccctgggctaaaatacaataaagactcaaataataattacataatattagtggtaaataattaagtaattgctcagccagcgggtctctcaattagcatttttttctgtctgccctcgccaaccttcgcaaatgttgcgactattcgttgtgaacccctcggggcattcccccgcagcatttgccgactttgcgcatgcacattccttctgctgctgctgctgattgtgtgcacatggcgtcactgtctttgtttgttgtccgttcccaccacaagggcacccggcacaattggactttgccggcgcaatggcaaagattgtgccttaagaaaagtcaaaaatagaagaggtcaatgccaagaagaattggtgccactaattgtaagctgaacaccaccatggatttggcaccaatgttaagaaatgggtatgaaataggcacaagagtcgagaataagaatgtttattgatctcgaaagtcgataaggccaaagaaatcttcgttttaaggcaaaatttaaaaatgccgaaagtccaatgcgaagtttcgttgggtgccctacaaattctgccaatggcacacctttgcccagccaaatgctgtcacattgtccattgctttgcacttcgcttagtgtcaccgctttttccatttggcgtgatttcaaaacgcacacag

SEQ ID NO: 6908 - DNA, 990 bp, Heterodera glycines
attccaaccgcattctcagattaatcacgcctatacgaattgttctggaatttttttctcggcgcgtttgtatgtgaaaagattggaaaaatggctatctctttttctgctcaacagtgcaaggaattccaaccgcattctcagattaatcacgcctatacgaattgttctggaatttttttctcggcgcgtttgtatgtgaaaagcttggaaaaatggctatctctttttctgctcaacagtgcaaggaattccaaccgcattctcagattaatcacgccaatacgaattgttctggaatttttttctcggcgcgtttgtatgtgaaaagattggaaaaatggctatctctttttctgctcaacagtgcaaggaattccaaccgcattctcagattaatcacgcctatacgaattgttctggaatttttttctcggcgcgtttgtatgtgaaaagattggaaaaatggctatctctttttctgctcaacagtgcaaggaattccaaccgcattctcagattaatcacgccaatacgaattgttctggaatttttttctcggcgcgtttgtatgtgaaaagattggaaaaatggctatctctttttctgctcaacagtgcaaggaattccaaccgcattctcagattaatcacgcctatacgaattgttctggaatttttttctcggcgcgtttgtatgtgaaaagattggaaaaatggctatctctttttctgctcaacagtgcaaggaattccaaccgcattctcagattaatcacgcctatacgaattgttctggaatttttttctcggcgcgtttgtatgtgaaaagattggaaaaatggctatctctttttctgctcaacagtgcaaggaattccaaccgcattctcagattaatcacgcctatacgaattgttctggaatttttttctcggcgcgtttgtatgtgaaaagattggaaaaatggctatctccttttctgctcaca

SEQ ID NO: 6909 - DNA, 1186 bp, Heterodera glycines
aaacacctgacaaatgagaaaaatttacgagggtcattatggtaattaaggatttggttttctaacggagtttaattgccgaatttgtgttttatctgcttaggctattgtcaaaatcaaggggcttcttgtccaatgcaaatagcattattttattccgaattaaaaataattggtaatttttaattaaatgaattggaaattattcctaaaagtgaatttttcattaaaaaattaatttaaaactaattttaattaaatcatgcttttcttttattaattaattagcctctagccgaaaggaatttagccatttaataattgcatttttggcattttttccaaaatgcttccgaattttgccactgcttttaccccgccccaccggttttgccgtttatcagctcaaccatttccaaatcggtggtcgattcggccatgctcaaattgcttccgccggcaccggcgccgacgctccaccgttcgatgtcccttctgagcaggctcaagtccacgctgttgctgcgcggcggtgcgttcaaatcgccgccgctgccgataattgccgcggcgcttatcgcaaattccaatggcattgccgtgccgaccaacgaacgggcgggcgagggagcggcggatgcggccgaggaggacgagttggagcagtacagcagcagcgagttggagccggaagtactgccgccactgccgccgaacggagggccgccgggcggcttaagcgtgtccatgggcgaccaaacgacggcaccggagacagaagcgcagtgaacattctgaaagggaagaaactgatcaaaggaccgatcatcacaacagagggcgagtaattgatcaaattaggaaagaaaattaacaaaacaattaattaagtttgcaatgaaagtaattagtataatattacaaataataataaattaaattaaattaaaaaatttgaaaaatcaaaatttacgaatgtgtataaaatctcattctgctgaattggtcactcaccgtgttgacagtggaaaaagtaatgtcaatggaagaaaggtccttgtcaaattcgatggaagaaaggggccttaattaattagtttaatttaattttaattgcaacaataatttgaattatattttaattcgttttgcaatgctttccattccgtttgccatggcattgtcc

SEQ ID NO: 6910 - DNA, 6194 bp, Heterodera glycines
ccttcgtccgcactttcggtcggcggagtttcttccgcagaattgtacgatgaaatgacaatgtccggcgtgccaatgttgcgacggagttgctgctgctgatcatgctcctggagcgggaaacagcagtgatcagaagtgacagttattattaaaagaacgtaagtgattgggggagaaaaaagatcaaaagtgatcagtgagtaatcggagggaaagtaggcgaaggagaagcgattagagagtgagagaaagaggtagagagacggagaagatgatacgaaaagtgatcaggaaaaaagcacccaagcatccaatcagttcgtgattgatcaatggttataacacgatcattttaatcaaatgcgtgtgtctgattaaaatgagtgatcatttatcaacagccgttcaactaactggtcgctggctaaacactactagcttttgggtgtcacctgctggtggtgttgccgttccgtctccacttccacgcgcactgtcgtcgccgtaaacgctcgtcggcgtgccgtcgctggcaacgccatgccgtcgccactgtcaccgcactttttgccgctgtcgctgctgttaagccgaatggccagctgcttcaccgcacattcgatctcggtccgcagtgtgctcgcatggtattccgcttggaaaacgcagtgcaaactaagcggggccgggcgataatcaattaattaatgacaaacaattaaaagttaatgagccagcgtctggattgcctttatcccgggcactttttgggcctaatctctaagctcctgccgaactcaaataaaaatgccaattttccaacaaaactgaccagttcaattccagtccaattttctccgctgttccgttggcccctttcgtcaaaccaccgcttttcttgcgccgtttccctttcggcttcttctccgagtgtcctcctttggtcggcattattttcgcggtcaaaaatattgacaatttcttgtttgtgtgtgccaatcgttcggcacttccgtccgaatggattcggccgcggagatcggcagcggtggcgcactgagtgccgcaggtgccgttggtggtgaacaaaggaaagcgcggtctgctgaatcggggaaaaaagttaacccaccggtttgatttgtccgggagggatgaagctgatcattctgatcagacacaattaaccaccggtttggtttgtccaagactgtgtatgtgatcagccccaccgccaagtgccattccaccctatcccctaaagtctgtcccgcttcggcacacctcaatttgcgctgttgctgttcgcactgttgcgggtcccaggacaaactcgggcccaaaagcctccgtttgtcccgctcattctgtgccgcttttcctcctccccctccttctgcggttggcgttgtcttgctgcgctttctcgtccttttcgagctgttcctcctcctgctgttgctgcttttgttgttttcctcctcctttttcccctctttttcgttctcccaatttccttttgccttttttcctccctttttttgctcttccctttgtccgtcttcttcttcttcctcttccgtttggcctttcccttccctgttcatctgctgctgtttctgttccgtctcgccaagtccgtttccgttgtccgttttaagcattttctggttgttatttttctggtagtttttcaacggatgctccgtgctgttggcccacatccaatccggcgtgttgcctccgcaatagccatgaactaaatgccaaatgccaattcaaattgatgaaaaatgacccgatttaatattgccaatttgattggtcggaaaaggtatttgaaattgaaacaaatattggatttgaccaaatcccaaatctttttgggacaaaaatgccgaatcggaccgaaagcaaatgattgatttgtggggaataaatgccaaactaatgaaatcgcttcaatagcaaaaatggacggattctcgaccaacccgagaagcattacgcgaatttgacatatgtcccaccagataatggtgtttttggagacgaatgtgtgctggaagtggacgcacgtgaagcgacagtgccggccgaatgcgttgagacgcgcgaaattttgcgcattgccaaccgtgcggcagagatgcgcttgcgcatggcgcgcctcgcagctgagccgtgccagcccaagctgaaatcggtggcgtatgatcggccgatgccaatgccaacagtcactgaccgcttctggcactgttgctcggtgccgtcggtggtgctgttgcatgccatcgtgctgcgccggctctcatccgtgcttgccggcacactctcgaagcgcattgcccgtcgcgagtgacatacgccggtcagtgttcggcatcgcaacggcatggcacttgcggagcagtcgttgtgccgaccgccgaattcaatggcactgccataaaaaggcgggttgccgccaccgaccaaaccatttggttgccgattgtcaccagagaaggaagcattgtcatcatggtgttggccattgttttggtcatcgctatggttaacaggcgaaggggtggtggtgccaatggcacgcatctaacgggaaaaaaggctattgaaatggcaaagaaatttgccagtttaatagcctacgcggaacgtgatcccgcgcgagattttgcaggatcccgcgggatttgcagggttaatcccgcgggatttgcagggttaatcccgcgggatttgcagggttaatcccgcgggatttgcggggttagtcccgcgggataccgtcctgtaaaaaattttgagtttcaattccgcagcgggacccgaaaatctgaaatttccgggacttagaatttaaatgcacaattaccaccgccgcgatggacgagcgtcgcaaattgcgcaccaaatgggcgcccgacttgcgcaggttggccatcgcgtccggcaaacggacgtggaaggaacgacgggaatttgtactgttcgaatcgacgggcgaagtggaggaggaatgggcagaagaacacaacgcggcgctgaaccgggacataagcagtgatcagacaaagggtgaacaaaaaaacgggtgggatcaatgctcaacgatcagcataatgatcaatcagcagcttaaaagtcgtgatcaaagcaaaaagccatgctcaaaaataatcagataagccaaaaaagatcaaaaaggttaatcaagaagttttgttaaaatgataaggactaatcacagtgaaaagctcttagagggtgatcagggagcttaaaggggaatatcgacatggcaaaaagtaaattgattgatcagctcgtatttaaagcgcagaaatattgatcaaaatggttgatcaaaaagcgttgataataatgctaaagattaatgaacacttggtaagctcaaagggggtgatcagagtgagcaaaagcattggtcaccaactcgggtctgaagccgttctgctcaaagcacagattgggcgttgctgttcggctgtgcattgggctggaagtgctcggcccaaactgatcagcgatttcgtcgaagtcgtccatgacgacgtcctcaatgattgaagactgtctaaatgggcttaattgatgatggcatggaatgccaatgcggttttccgtgccattctccccctcttccccacctttggcatctccgactgttcgcgttggatttggcaccgccctttgtcggttttttccccccttttttgacacttctgccgccgtttccattggcattctcttccgctgctgctgctccgtcggctgtttgttgtttttcgtccgcttttggcgttttgtttgaacattttggcgttgttccggacacttttggcggcagtgccgccgtctctctgccgctgaccgttcccagtgaactgcttgccaacgatggaatgtcggcagtcattgtgcacctaaaagtgatttgggactgaatggtggtgacaatttcaattaataattggtcaaaaaattacgaatgcttgttaattaattatttatttaattaatcagcattttttaatcgatgaatttatttttttaactatttacttattttatcagctattttttataaggggtaaaaaacgcaattttgtttatcagctgtgatcaatggatttattcattaattttaaggtatgatctacttttaatccgtttttttatcttgattattaagaaaattttcaaaaaaacctaaaaacaaaaggaaaaataggggacgaaacgcaaataacggcaaaagaggggacggacaccccggattttagggggataaaaactaaaaatggatttctagcgataaatagggagattaaaatgaagaatttcattttacgtgctttctcatcaaaacaaaacatcagaaaaaatagtttaaaaaactgaaaatcccatcaatatttttatcaattatcatttgttatcattttatcattcactcactttttgtccatggcgccgcacttttttgtcctctctttcgtgctgttacttctctcggccccctttctgctgaaccgtgccaacgattgcagcatttcgtgtgccctttgatttgcgaattttaaatatattttttaaaattaaatatgtcctttaaattcaccgaaaattttggacaattaatttgttggcctcgtattccttcagtttgtgctgtcaccgcttgaacttggtgtgaatggagaaaatgaaacgcagaaggacatttgaaatattgtgcttaattggaatattaaagaaatgcaattattttaggaaattattaaaaatttaataattaatacgcaaatggatgctgacgcaaattgaagtatgttttttgtttgcccgtgaatttttaaaaaaaaggttggttttaagaaggtaaggctaaaggggggaaggagaagcctttgttttgtgccaagggatggcaaagaatacaaactcgaaggtcttctccccttcggggatatttgaggcataaaaataaattgaggctcaaaaatcaatctaattatcataatttataattttccaaagatttacaaaaaataaaaagtgacaataatttaatcagaaaaactttttcaacatcgcacaaattaaaagttaattaattatgtgaaaaatggcaaatgaactcccgctgtttttttgatgcattttaattatgtgaaactaatttcgcgcgagggtcttgaaaggagtcgcaaattatttgggattgtctttaggggtcggcatgattttttggctaattggcacattttgacatcatcattacgtgccattccatgctatttcgaggcgtgtcaggctttttgtcatgtctcggcttggcctggcttggccgtggctcggctttgcattccatgtcatcttccggcttggcattccatgccataccatccgtgtctctccatgccatgactcggctttggcttggcttcgctttgtttggcttctccctgtcccatttttctctctgtctttcttttttgtcccttttttagcatttgaaattgaatttgccccgacgagaagcgaacccgtcgcactttgactttacactttcccttttttgccctttcgcttccaattttattttattatcggcgcattccccgcggcgcttttatcgctcggcgatctttgccccattcggcgacaaaaccgcacattccgccgtccgatcgcgaagaaaaataatcccaaatgaaattccaaagtccaaaaggaagaaataaaaaataaataatttaaaaaataaaaaagggcaaaaattattctgaaaattcaatggacgaataaatttaaaaaaaagaaaagaaaaggacacactttaaaatcaaagcaaacaaaggggaaaagcagcacactttattctgaagagattgtgctcaattagcacaaattgttataagtgcaaacggaagaagacaaaattcacgtaatttaaatgaaaaattaaaaaatataattatataaattgtaaaaaaattattgaattaatgtaataaaacaaccaattagattgttaatttatcagcgtgcgaagacttaagcaaataaattgccaataaaataatgccaataaaaaaagtgttggattaatttgagaggcgacgattagcgaatgaaagaaagaaagagtgggtggt

SEQ ID NO: 6911 - DNA, 2074 bp, Heterodera glycines
ccccaaatgtttggacaccaatatttttatcgttgaattcgtttcttttttgcattttattataaatttgtcaatcgtttcttgcataatcataaatttgcatcttcaaaagtaaccgagaaaccatgatcagctcactcattcactagggcatatatcatcattttgaataaaaaatgcctatcattataaaaaaaatgagtattgaaacgaaataaaaaaacataaaacatgaagaaatagcagacactatgagtcagacactacactaaatttaatgaaaattaaatgcatacagtgcgccaagagaaaaaagtgataaaacagtgatttttaagaaatttctaatgcttatgacttggtcaatagtaaaccaaatagagccattttggtctcattttgaagagaaaattctgaagaacatgtataactatcgttttttgcatgccaatatcatttttaacctttgaaatgacggtaatttattgaaatattcactagggtcaaaattttcctcgggtcagattttcttcaaattttgcataggcccatagtttgaccccctctatcgaatcacagtttattttttagctgtctagtttttaactcgagatcggctcttcagtttttactagggttgagcggtaccggtaccggtaccgaccggtaattaccggtttttttggtaccggtaccggtacaggttttttcaaaaatcaaagtatcggtaccggtttgtctagtaccggtaccgccggtaaaaatttgcactggtaagaatgggggtctggatgagaaaagagtagggaatggtgaagaaggagaaattttttgagaaaaaaaaaattaaattatttattttcatttaaagcatttgttcatatgcataagtggtcaagtggctaaaccttctgattttattatttctcgcttgggttcaattcccactgggatagaatattcttcatattttctttacaataattttaattgaaattttaattaaaaaaaatattccaactttttttctttcattttaagcatcctaaaaacccaaaaattaatcaattggtcttttttttacaaattctgttaacaaatcgcattaaaaaatacaaaatttttcccggcggccctatcggcaccgccggccctccttgttccccaaaagtcttgagaaaaacgtgccgcgaaaaaagcggtgttgaaagcaaaaaaggtcattgatttacattaatttacatggccggagatcccttcgcaaaattggaaaattggccgataagtcgcttctcttttcctggcttctacagtaatcatagcgaaatgaaaagcgtcacttcgtgaagctttaaaaaatgaattgtaattttgtttttgtttctgatcacaaaatgaataatgtaataaaacaataaataaacataacatttatagcaattttttggaattgacgggtcacaaaggatgagatcggcggaagagtttgaacaaacaaagagtggacaaatggcaggcagagagaacaattgagaatcgaatgaacagcttattgatttattgaaatgaatcaaatggacgtcagtccgatcggcggatggtgtctttgatgagtgccgatcagttagcgagcgaccggtcaggtaaaaatcacttcgtatcggcacggcaaatcggtgacgcgtcggcactcgtagttggcaccccacccaatgccgacactgatcgtgagcagcgaaagtgccgtcgcattttgtgtcgttgtcattgatggtatcacttcggcaccaaccgcagtatggccaagggaggagaacagcgtgaggtcgttgccaacgaattggtgccgatggaatggcgaagcgacggacggaaggggcggcggcgcgtggtcggcggcggacccaaccgccgcggggggtgcacaaatgcggtgcacgcgcacgcaatagcccggggacagacggcgaatgttcggcacgagcgcagagtcggagggcggtgccgcggcacgggcgacgttccgcgaaacgcacatgaacaggggctgatcactgctgaaagaggggagggt

SEQ ID NO: 6912 - DNA, 2827 bp, Heterodera glycines
ttttccaggcttctacagtaatcatagcgaaatgaaaagcgtcacttcgtgaagctttaaaaaaatgaattgtaattttgtttttgtttctgaccacaaaatgaaaaatgtaataaaacaataaataaacataacatttatagcaattttggaattgactggtcacaaaggatgagatcggcggaagagtttgaagaaacaagagtggacaaatggcaggcagagatttttaattgtcgttctcactctcattagggccaactcattttgttgaagcaattccagcgcggccattgctgcttgttcaacgagatttgccacctgcgcatcatttacttctaagccgcgcatctgtaacaccttaaacaaaagattcaaatgactaatgttaataaaaaatttccaatatgtatgttaccgctggtgccacgaggtccccttctcttattgcaatagcgtgtgcggcttcgtgcaacgaggtgacgggtcgttctgcactccttcttctactgcctgcttgaacaatctgttgaattttttctttttcttgccatatatttttcgtccgtcgggttttccgtatgggggcatgctaaattcaaatttaaagacattactgtaattaaaatgtagatccgatgaaaacggtaaaaagaaccagccaaaatgttcagggcgagtttaaacagaacagaaaacatacaaaagtaaaaaataggtttttggaaatgaaaatgaattacagtacggttactgttggcatacaacgtagacataaaataacaggcagagatcaattcccttcgtactggatggcaccagcggtttgttggaatgtcgagtcgaatcgctcacagttcggttgagaagacggtcagacatcgccaagtttgaccatttgcctaaaaccttgccaacaccgtgcgcacctgaaggtctttccacagccacattttgcagcagagataaggcattgacattggcctgaaatgcagtcgatagtaatgagttaattaataattatccctaattacccctcccctctcggattgtttacttgtcaatttgggggattagtcccgcgtccgggttcgtcagcggttgtgtaagcaattgccgccgtgacggactcgcggcgatcacttgcgactcgccgtcattttcagccgacaatcgccgccgttgtcgccgtcgtcgctccgttgtcgccgtcgcattggccatttcgtccgtgtccaattcggcgtcactgctgctccccgttctgggcgaactgctgattattgtagtgttcagcggccgaagtgaaatggccccggcggcactgtcttctggcggtgaagtgtaaacggccaaacgcctaaagcgatggactaattagtcaattaattggttaattagtggttcgccagtcagtcacctgctgaatttgctgtcccttctgttcctctgctgcagctgctgttctcgatgtgtcgaatatcgcctctgataccctccggcactgccgggcacagcggcggcgccgtccgtcgtcggaattggcaccaaaacgccggaggcggacgaagtcgccggctgatggtgaattgaggcgacggtgggaaagcgttggcgttggaagagaatacggtcacgctccatttgcctcaacaaaatgtttaaatgatttcatggcaattaaacagcaatttaaatttttgtttttaaaaggtgtggcataagaatggttgatttggtctgatcatccgatcactttttacagttttcggctttatttgccattcacttgatcgaatgccgtggccgcgtgctgacaatggtcgccgaacagcccggcatcatctccggctcctgctccgcctcttctccgctgctgatgctttcctcgcgttcctcaacaaggtccatcggtggtcccggcgcgcactgtttgatgttgatgccgcccgactcaattgccttgcaaatcgttgggatgcactttttattgggaacattagcccagggttccagttagcagcagatttcgtggcaaatgaggattttttgaggctatgattaggatttaaaaattgttcaggaatcgcatgatgaggggaaatgataattgatttccaaattgaaggaaaaccacggcagttaaacccattttatcgaaattattattaaattcataaaatgtaagttttaaatgttcgccacctttcgcagcacatccaagtcttcggtgtcgaatccgcgcatgaggttgagaaaacggcgcttcgcctttcgctcgtcgtcagtgaccttgtcaaatgaagagttaattaaaatatatttttattttaattgtttcaaatgaatcggaactgatcactactgatcagtgcgtgatttctattcgaaatgcccaccaacaatcgccgccgccttaattaggccaataaaattcaatcaaaaacaaatttaagaaaaagactgaactcattcccatttgcttcgatcaaagtcgcactctagcggatttgtttcaaattttagtcacatcattatacttacaattaaaaaattaatcaaaatcgctactttaggcatatattcctgggttctgttggccataatttaccttcatcgccaagctcagtgtaaatgttctcgggtagccgccgctttgaagaaacgaaaacgtccaccgtgagcggcataccaggtttcccctggaagcagtttaacgtcatactcaggacgggtaagtgcccggcaactcccctcgctggggtggtgattttgttaggaaacatttatcaaaggcctaaaacaaaaaaaaaggaaaataagaaaa

SEQ ID NO: 6913 - DNA, 3109 bp, Heterodera glycines
  misc_feature (3000)..(3000): n is a, c, g, or t
  misc_feature (3006)..(3006): n is a, c, g, or t
  misc_feature (3072)..(3072): n is a, c, g, or t
ttacaacattgtcgtttggttccagtcacatatcacatataaagaattttaaatataaataatttttttgacaattaaaattattatatgtttattttttaattacagatgtatacttaaaattattttttattccttttctcgggattccgtttcaagcgctgttctccgttgttcatatcacaggcccaagttatggaatattattttaatttaattttgaaaaaattttcataatttgtttattattattttttttatttcaagaaagatagaaattttcatagtatcgattattctttctttaggtttttcccatttcaaaattttgaatgatttttcatgagttggttcacggcaattaatttttggaaacttgaaattgtattttaaattatttcttataaacattttcaatttttcttattttatattattaatgtttcattccagtttttaaattatatttatttattggaataaatttatatatttttaaactatttttagtatttcattgtttatttaattgaaatgttttatttccgacgcaaaggtcggttgtatattctttagccggtatactgttaaatttttatttattttctattcttatacatcaggttttcttttatcttaaatctataataatttgaaatgatttttctattgaatatacaagcatttaagatttgtttttcttaattttatatatgaattggttatttttactatttcaatttttaaattcaattatttaaatttttctaagcttttgttaagtttttttattaaactatttgttattattaataaatatttatgagttgaaaaagtggtgtatgcatcggcacgggaaacgtccagacagagcaacgagctgcacatggaagtgcttcagccacaagtatgtgccatggatatgatgaataggcagaagaaggtccatttttgaagtcaaatcaaaaaaaaattgaatgagctataataaaaatgtaaataaattattataaagtatataagtaaatgaaaagcactttaaattgtaaatgcattaaattttgtaggatcacacgcagattttgagaattgagaaaaaaagatatttaaattcaaaatctccaaatattacagttatcattttttaatgtaaatgagtatcgttttgcgttacacttgtttttattaccaaataaaattttggaattaaaaatatatattttttaatttataaaggtctaaaaatttatgttgttattcctggatgatcctaagaattttaatttatattctacattccttaaatataaaatttcggtatttaaatcgttttattcaaaatttttggtgtagcaaaaattatttttatgcaaaatgttgatcatattttcgcaataattaagctttaaaactttaaactacattttgacaaatattaacatctttttaattttacatccgcattaatatttattataattattcaatgttttccaattttttacattctcttgcctttaaagtttctatctatagttttactttcatttcctatttttcacattatttactttaaggatttttagtgatcactggagttgtttatcttttgaatttgttattttttctgtgaactttttcttgatacgttagacaatttattagattttgagtatttccagataaaaacatctcctctttatttttttcatataaaaaagtaaacattttgtatatttactgtatctttctgaagaaatattttcttatatttatgtctttgaaataaaatcataattttaaaaatttgtttgttttattaataaatattattttttaatttatctattttatgattaattgctcattattttcatttaagaaaaattatgctaacgattatgtatgcatttgaggtacgcatgttgcagtagcattaattaaaacggattaaagccacatgtaagtggataaatgattaattactttaataattattttatttcaaaaactttatttaattaattagataagattaattaattttttattgtatttcatttttaaacaaattataattattgatttataaaattattatcatctagaaaaggaaaaaatgcgacttacaaaaatatataaaaaatattttaattattggtttatgatgcgtgatgaaaataattgttcttttaaatgaatcacataaaatgtaatattgccttggtctttctttatttatattgcagttttttaatatctctatttgcttatattattatattttaatttttttaagttaatttttatattattttagagttgtcgtgatgctgctaaccaccacgttagagactttgggttgagcttgatggcattgagaaggaacagatagagcggcctggaattgtagacatatgattgaatatttggtttcagttttgcctttctttcgtttatttatgaattaacagatttctataattaaaaatgctttattatttaggtttttaaaatctctgccattccgcgccggcagtgcccgagtgaggaagataaattatttgtttatatgattaataaaatactaaatattttctgtttttccttttaatctagaggtcagcgtgataatcccctctctcggttattgaacttttctttttaatatgtgttgtaaaatttattttctcgatattttctgtatcttgagtaaacatatgattggatatttggtttcagttttgcctttctttcgtttatttatgaattaacagatttctataattaaaaatttaatatttcccaaataaaactgatttagatgagtaacaaattaagtcctcaatacttagttacattttttggatatatatttttctctatatttttaataaacgtttttccttttaatcttggcgtctacattcggtgattcttccaccaaataaaatttttattttatttttgatttttacattgttgaaaacccctaaattntcttanattaagtattttacatacattttcctttgttttaattcttatattttaatttgttttattatttanttatataaatctttttatttttatgcatttattctac

SEQ ID NO: 6914 - DNA, 4522 bp, Heterodera glycines
attttggtgcttatttggcgatgttttgccgtgttgaattgcattgattttgggctttggcgcctccaaaatttttgcttccgcctccgtttttagctgtgtatttaagtcctcaacgactttgtcgaataatttggacgttttcgtcgtctttgagtcctccgctgtgagacgtgcgaggatgtgctggcgtaatttggcgtcgcttgatgacttcagcgacgtgaggagaaccaggcatttgaattcctcttcgtttaattccgaaaaacggaatttgcggagggctgcctttagtcggttcacaaaaacttcaaaactttcgccgttctctcggcacactcgcaggcattcatagcgatcaatcgctaaagatggcggatgtgagaacaatttaataagacgagatttggtgtccgcgaagttgaatttggtgaattcctccggcaggcagtagcgcttgtattcgccgaaggcggccggattgagctttgtcatcaacaatttgactttcgcttcatccgccatattggccgctgcgcaatccaatgcgaattggaatcgctccaaccactcctcgaattcctccgcattttctgttgaaaacggatgaatatccggcaatgtgatgttttgtgccggtggagttgttgtggatgtcggcgcgctctgctgtttgatcgcttgcgttaatttttccaaaatttccgcgagcgttttgtccattgttgatttggaggattgacttagacgaagaaactgcacatagcagaaccgcacacaagattagtgattggttttttgaagatttctgcgaaatccaaaaatcaacacgagatttttgaatttccacaattcgaacaatttcaacacgagaaaatattcgaagtgaagtcctgaagaacgggcgtcgccaatgttgagccggttgattgctcaacaattatttgtggaagtagaacaccaaataaatttattaacacaaatggaaaataaataaacaaataaatatttgtcggagggacggagcaaattgggggagcacaaaatagcaaggaaaataacagaatgaatcaggatggacgaagggaagggcatgaatgaatgggaaaaaatcaatatggggtcaaaaagcccaagagagggaattgcaaatatttgaattatttgcctctctaacaatggcgctgagaagagatggtttattccgttttctttgacgaattccttaaattcgttggagctaaactgggtgccgttgtcggtgaccaaagtttcaggcaatctaaaacgagcgcaaagtgaacgtaattgttcaattgttgctgctgatccggtcgaacgcatttcgaacacttccggccatttggagtgcgcgtcgacgatgatcagatacatctttccaaagaaggaaccggcgtagtccatgtggacacgtttccatggcccttcggcttttggccaagaatgtagttccgttttctttggtgccttcgcttcggtggcacaaggctcacattttctcaccattgatcaattcccggccagtacatatgctggcgggcgagacttttcatttgtttggccattggttcaggacgaatcccttcacttcctgaagcaatttatcagcttccgtggccttgacaatgtcctcgtggacaactggaaattgtgcgtaaaggcattcacagttgccaaattagggctttccgtaattgttgccacaataaattcatcttcgggcactggcgcttttgcaattaagcgcgaaagagcatcggcttgaccaaaatcagcagtgttttggtattcgatctcaaaatcatacgccaaaagtatgagtgcccagcgctgtaagcgatttgctgtacacgctttaatgccctttttgttaccaaaaatggtcaacaaaggcttgtgatcggtctgcaggacgaagtgtcttccggaaagatatttgtggaacttctgaactgcaaagacaagagctagtccctctttttcgatttgggagtagttcatttcggcaggcgacaaagagcacgatgcatgtgcaattgcctttaagctgccatccggaaaacgatgggaaatcactgctccgattctgtaatcagaggcatcggcagaaacaatgatgtccttttccgggtcataatgggtcaagagttggtccgacttcagcacttcaatcactttgtcgaaggcattttgacagtccgttgaccagacccatgccgcgtcctgtttcagtagctcgtccaatggttgtcgaagaaatcgcatgttcttcacaaactgttggtattgattgatcattcccaaaaatgatcgaagctccgaaacatttgtagggacgggcatttcagaaatcgccttagtcttggatggatccggtcaccttgcatttttgtcgatgacgaacccgagatatttgatctgcttctgattgaacgagcacttgtatggtttgatccggaatcaagtttccgattcgtttgaaaacttcattcaaatgttttcgatgctcctcgtgtgaacgactaaccacaatcatgtcgtcaaggtaagcaaacgcgaatggacaaagattagaaaattatttaattaattaaaaagtattatcaatttttttcaatgctcccacagtgacattatagtttttatttttctatttcaactgcttaataatattattttttattttaaaagccaaattaaatttttagttatatttaagcagctttcattaatgcattatataaaggtgatgctcgaacctcgcggtttttgatatttttcgtgttgaaaaagcttgaggcttgatggggtttgtgtactcctaaaattatttttattttatttaatattgttttcttttctacatatgagaagatatataagcaatatttcttacccaaattcggattttttaaattacttgcaagtttattctttataaatccaatgatttttatatttacaatttttaagaaaattgtcacctttaaatcgagtttagcttcgttagtatattaactagtttatttaacattaaattaaattttttattatggtgtttatgtttattataatttattaacaagacgccatggttgactttttaaaatcttatatttttactgattaaatcctgaattttttattattatagctttaattataacttaacttaaaataaattttgtaattaaaaattcatatttattgtttatcaaaactctgaatatatgatcttgtaatgagctgtgtgtgatgaacgaagttttaatcaaagtttaattgaaaaaataaagtacaattagaattttatgattaattttcaaaaaatttttactttctttgatttgtttctttgatatcattttatttaatctttttatttattataatattaggaatttattatatcaatctttgttgtgtattttatgtaaatctcagatttgtgttggatatgatggattttaattattatttgaatcagcgccaatacagtagaaatgatgttcctgttgtttttggacgccatattcttcagtcaatattctcccccgctgttttgtttcattcattattattttattattttatcatcattttcagttctaaattatttctgttttgctccttccatttttgccttcctctgactccgtcgtcatcattattttatttgttttgttttattatttatttctttgttatcatttgtctttctaaaataaatttaattctgttgttccttgcggacacaacaatttgcttcaatttattatttattataactatttttacgtgacatttttcgtgcaattgatattgaatgatcaaatttgcaatttaaatttattctttttgatatttttaaaataaaaatggcagttctgtgactcactattggttttatttaaatacttctttaaaaaataatctcgtcccattttccaaacagattattgttgtatggtacttgtgctctttgtatttcaatttcttccttcatttttgccaaaattttttgagtagtgattattttttcaaatataatttaagcaatttcagttacatcacaaaatcagccaaaaatttaatatttgtgatacattaaataattataagaattatttatcagaatatagaatttcaaaaatctaagcgctctaatgatgcaattatgtttaattaattttattacattacagttggcacggtttttcagtttatatgcccataagattttttgctgatttttttcatgataaagaaggattttattcattgattaaaatttatattaagtttaaatatgaaatcagcttccatccccttaaggattagcgtttggattattatatttatttttagtttaaaattgtagtcgaagattgcctttgcccctgtacaatgtaattcaagtatttattttttactttaattattttttgtgtttttttagttaagatttgatattactaaaaaatatgaatttaagttg

SEQ ID NO: 6915 - DNA, 6310 bp, Heterodera glycines
ataggcgccgcccttacaagattgagaatttttaccagatttttagcagatttccattaaaaaattctttattttgtggttttttgattggaggattttcccccaaagcctcaaaatttgtcaaaaagccacaaaaatcctcaaatcctcattttccaaaaaaaatcctcattgacctatcaaaaagccacaaaatgaggataaatcctcagatctggcagccctggtttagatgagtttggtttaccccgcattgacagaaaaaaaagttattgcctaggaaactgaggacggtctttattggacctaaagggcaaaagagccaactcatactttggtataacctataatcagcaaataattatttcattttagcacaaacaaattatgataaatatcgtcgattaccgagattcttgtgcttcaacagatgaagaagatgatttattttttcaccgcgtttcttcaaatcaagcacaggaaaataacgatgatgattctgagtccgaatttatcaagtaattatcccagtcactgatgttattttcaataaaatttacatttagaatcttggaaatgtgtcgaaagcatcgtgaattttctgctgctaaaatgggagaagacagtcaaaataagccgcgttctttaaataagcgtgataaggtctttgattccgagtattattctttacctgcgatcgaccaacttaatatacaagtcaaagaggagactgaattcaaaagatttggtgttgttgattcgcacataaattttttaggtgagttttcatttcaaaagtactttttcatataaagaatttaagcgaagataaagcctgacaaggatacgccacatcttggatatgagacaattctattcaatcacgacaaaaagccaattggagagatttttgaaatattcgggacagttactgatactttatatgcattgcgattcaatgacgaaagtgacgctgtagcgaaactccctgttggtgaagtaatttattatgcaaattcggacaatgccatgacaaagcccgtcttcccaaaggaattggcaaagtatttgttagtgattgcaagctgttgacttgcatatttatttacaggctaaagaattgggaccgagttcggccatcgggtggcggctcatccagttccgaagagtttttcagtgacgacgaagaggagaagcgtcatttggcatgcaaaggacaaaaaactcgaggagaccgaaaagcaacagaatcacctacaagtttttgtataatttttcttaggtatctcattttggtattttatgtttagctaatgtcataccttcgaagcggtcgaggaatggaaagaatcggcctgagaagatatgcaatttcagtcacacaaatttccaacgtcaattatttgccagaccatacacaacattcgctcagcatcactatatgcacatgtatccacagttttcgccttaccatcaaccatttggtgttcaattgcctcctcatccatgggttcgtccacctcctcctccgccagtttatccactcagtgccgcttctacatcccaatacttttcgcaagcacaacctacttttccaaattttaacaatcctttcaatcaaggttatattccccaaataactcattccaatgctcaacaaaatggcaaacacaaatagaggagttattgttatttgttttttttcctttgttaataaattctttttgcattgtgtttccaaataacaaatgtaactaaatacattgaaatatttaataatggatttgaatgtacccatttatcacgtgaatgttttatctttaagtttaatttaattgttgccaaatgtcatcggactctgatgacgcgagtgttcattccgaggttgaagaggaactggaaggagcggttgacaacgaatcgggggatgaaggtgatgcagctgtggacggagaagaggaggaggacgaagacaacatcggaaaagacgtttcacggaagaggaaggcaatgtttttaaaagcaaatgttgattacgacatatgtgttcaagatttctgtcagtgaagaggaaaacgaagaagagcaggttgaggaagaggacgacttcgacgagaacgaattggcactgaacaaacctaaaacaaagaagaagcgcagagttagggtgggtatagggagggggagggcagtgataagcagggacaataatcaataatgctcatcctttttatcttatttttacgttcagcgtcgagcgactgcgcgcgattttatccaagatgatgtcgaagtcgacgacgacgatgaagacgaggatgactacgatgctggggcggacggcgatgatttgtttggagtggacccgaatgaacgcgcagaagctgaacgttttctacgagaacaggaaaagatgaaagagaaacgccgcaacaaatacgcgtatttgtagttgacagttaatccgttctaaaggattgattgttcagagacatgaccgaggaggaaatggagcggtacttccaggaaagacatgcagcacaagtggcgacacaccagggcgacatggacgaggacgcatatgacgacatcactcagaacggactgttgccaagcacgaaagacccgaatttgtggattgtaaagtgtcgactgggcgaggaaaagacgacctgtcttcgtttaatgcgcaaatacttgacttttgtcaacaccgacgaggtaagttattgtaaaaaaagcacaggtttcctgttcatttgtttattggatattttggcaaatacgactgatttataaattgtatttaagcctctccaaattaaatctgtcattgtcaaagagggcctcaaggggatgatctacattgaagcgtttaaaatggcccacgtggccaaagcaattgaagggatttcggcgctgaaccaattcaaaatcacggtaatatcggcttattattaccttttttcattcccttcatttcaaagatggtcccaataaaagaaatgtccgatactctccgcgttgtcaagaatattccaactttaaagcccggtgcatatgtccgtttggtatgacactcttaattgtatttaattaatattctcatcaatgatttgcagagcaagactctttacaaagacgacctcgcgcaagttgattgggtggatatatcacaaaatcgagtcaacctcaaactcatcccccgcattgattacacgcgcttaaggggggctcttcggtcacaagttagtttttgacgagaaacacgttaaaatcgacattataatttaaatttaggacgacagaattatgaagaaaaaacgccgtccattgcctgctccattcgatttggaccgtataaagttagcatattcggaattagttctttgttcaatgtattccttgggttttagatcaatcggtggtgaagtgacaaacgatggcgacttttacattttcgaaggtggccattatcgcagaggctttctttacaaatcttttccaatgaatgctattgtaagttagtgattttgattggtaaaacgatctatgtttaggaagtcgacattactcatccaacccttacggagttggagcggttccaagattccaccgacgacttaaaaaaagaacgtcagccagttttggaatttcaatatatttggggaagagaaaataattcattttcccattttagtggagaacactcacctaagggagaagcgccatagttttgctcctggtgataacgtcgaagttatggacggtgaactggtgaatctccgtggcaaaattcaaagcattgatgggcagaaagttgtcatccttcccgagcatgaggatttaaatgtaagcgattctaattttcagaattggaattacttttcctttaaggaacccttgactttgaatgcgagtgaattgcggaagtattttaaacctggtgaccatgttcgagtgattgccggtcgttacgagggtgacacgggtctgattgtacgagttgaggacaacgtagtcatcatgttgtctgatcttaccatgggagaggtaattagctcagttgcgattaccatttgtctttatatgctattcgcagatgaaaattttgcccaaagatgtacaactttgtgctgaggttgcgactggtgttgaacggatgggccaatatcagtaccaagacctggtgatgctggataaagaaacagttggagtaatcgttcgtttggaacgcgaaaatgtggaagttttgagtatgcatggcaaaatacttcgtgttaaccctcaaacgattgaatgcaaaaagaattcgcggttcgtcaaggcacttgattctcaaaagaatacaatccaagcgggagatacggtcaaagttgttgagggcttcctggcggttagtgctgtctttttgaacctaaaaactttaaataatagttattttttagcgaaagaaggaaactgaagaagaacgtcagggcgagatcaagcatcttttcagaaattgggccttcgttttttcacgtaaatatccacaaaacgggggaatgtttgtttgcaaagcgcggaatttggcattgattggtggaagcaaagcgtcggagtcacaaatcaacactactattttggataacagtcaacttatgagtcctcgtcctaatccgctcgaaagtcctcgcaccattcacggcggaatgactccccattccgggtcaagtgttgttggtgcacaatctgtccgtggcgatcatggttttaaaggtctttttctagatggtcatctgttcttgttaattcagatttttttagcaccaagtgtggtcgggagcatcgcaacatcagcaaccggagttggtcggcaacatgtacgtcggaacatggaaataatgggcaaaactgtgcgcgttctggctggtccaatgaagggttacattggaattgtgaaagatgcaacggaatcgactgtcaaggtggaactgcacaccatgccaaaagtgaagccctaattgtttcagtttggatcgataaatctttaactttagacggtcaattttgacatcaacaaagtgatggaggttggtggtgccgtcccgagggaattgatggacactgctggcgcaatgactccgggaacggccaccattggcgggcgaactccgatgtacggaggagcgcagacgccaatgtacggtggagcagcaacgcctatgcacgactcatgtaatcaatatctttactattctaattcggaattcgcagagttgtttcaaagattctgatcttttaatttagtcggtgctcgtactcctcattacggctctatgaccccggcttacgacggcagtcgaacgccttcgcaccaaccatcttcgtcttgggaccctggtcatacttattttgtttgatcttaaaactcaattttcgttcactttagctttggccaatacgccggctcattcaactgctcattttgacaatgaatttgacacaatgggatttggcggaggagcatcaacgccggcaggttctgtgagaagccgacttgggggagcgaatactccaatgggtgcgtgaggatttaaggtcttctgaatattgtttgtttttatcaggccaaatgacaccgcgagatatgttcggcgattattcttcaagcccttaccccaacccaagcacaaatggcaatatcattttttggtatttataacagatatcctttaagcttcactgcatccgtcgaaaacgcccattggtcagtcaccggcacttcaggaaataatgcgtaagaccactaaaactatccgcgaatattattgcatgcaatgcttcagccgattccgaaattcccactggttcatggtgtatggtcgacctgtgcgtcaatgttcttccgacgtgtggaaaggaccaacttctcggtttagaaggctcaatacggtcaattagagtaagtgtatttaattagtaatgattcggttgattcttcgtaggagggcgaatgttgtttgtatttcgaggagcttgacgatgacttcactattgagcacgaacatgtggtgcccattcgaccggcaagtggagaccaggtcagttgttgacaaaaccaaatacaaaaataaaaaatctcatgtctttcaattcaggctaaggtcatttatgggcatgatcgtggggtgtctggctctttatcaccacggaaggggaggatggtgtgctgcagggggcgaacgggggcaaagcttttattcgatgtccgttctttgtaaacttgttttgatttgaatttgataatccgattttattggttcaa

SEQ ID NO: 6916 - DNA, 3806 bp, Heterodera glycines
  misc_feature (194)..(194): n is a, c, g, or t
aaaagtccgagggcattaaaattatttgggatgggaaaaacagtcagcggcttaaaagcttttctgattcattgtccttgggcggcggcggaaggaggggggggggggggtattttgtgggtacggtaaaaaacaagtcgaatttgactgcactattaaactttttgtcaaaaagcgaggggataaaaaacatntaagggaatgccagacttaaagaaaaaaaaattttaattggtggctataaagtgccacttttcgctgccttccctccattgctttaccattgattgttccgcctggcgacactcgcatggccaatcggttccaacggcgtcgaactgttaattatcaattggaaactgagcggaaacggcgtcggctgagtgttgttggtgtgccggtggagaacgaagcgcatagaattgacattcatctgaagcggaggccttttattatttaaatggtcaattaacagaatttggcatttttcgacaaaagtgccatttgcattaattaataacattttcattttgtttattatcagacatttcgctgttttcacctctaatgctatcatcagcaacaaatcatcaaattcaatgcacaaaagtgttttcttcgccttttccattttccaaattcgacgaatgaaagtccaatgccaacacattcaatccatcggcaaattgaatattttcgtcctctccacgacggagggacaacggacggcgggggagagaatggaccaaattgccgggcaaagggaggaaggacaaacgattgaaagtgcgagaagagagcacaaaacggagaggacggaagcggcgaagagaactttttagggaaattgagtaattaattaactaattaatgaataagcagaaatatgcaaaggaattctcaccctgttcacaattagcggactcaacttgctgactttcgcattggcaagtgaatgaatcgcttccctcaggtatacaaatgcctttttcacatgtcttccgggcattttctccatggcaaacatttgaccttttatttcgcgcacttccaattaacggacacatggatgaagtggttgcattgatctgatcaaaagagagcaatttattgtaataaaatgggcaaacacctaagccatgaattggtctaatctctcctccaaaatggccaaatcttggccaattatttcgattccatcgatggcaattcgtcgctgacagccaacgaatgaaaggtccgaagtccgaccagcagaatgacggagaaggtcaggcaaaacggagagatcaccgaaaatgacgaagggtgagaaacgaagagagggcggactgaaagggggtacggtagagacagttggggaagagaaagtagcatactgtaagagcaaattgttttcttgctgaaagtggacatgcactagataaacgccatgactcttttgagcacattcgtccccattttcgtcctccgtttggcactccgccaattccaatggcacccgtcccttcgtccaaatcagttccaaatgccaccattctgtggcattttgagagggtaaaggcatgaaatgcaaataacagaacacaccgagcacatccaaaacgccgaattgctccgggtccggcattctataacaaaattttaagcgaaaagtaaaaaaatagaaaacaggaaacctaactctcaactgttccggcggtacgctgaaaaagtgggcgaagcaagcccgactttttttgatatattccatggtgaattctaaataacaaaatgtgtctaggcaagaaaatgccaaagcttgggtagaaacaaccaggctaaaaacttttgaggaattctccgagattttccaacccggccattttttggactaatttttgggcagttgcattaaatcaaaccatttctgattgatcattacaaatcctattatttgagcattttttggaaaatccaccctgtcgatgggtttgtctctaccctcgtaaaaaaccaaaaaaaaacaaacagtaccagtgacgggcaatgtcagcacagtgtccggctgctcatagaccaggtcgtcgagtatttcctcaattgggtagggcaatttgcacagccgttccgctttgttgacaaacgcgtcgggctcgggctcgtcaagctgactcagatcatcaatcttaagcagcaaagggaaaggaatatgcaagtgcggggaatggaaatcctaatccgtttggaccttgttttttcgacttcttttcgggtagcgttcctcaacaaaatccctcggatcccattcaattgaagaagttgtgcttgaatccatgtgtctatcaaaatctgctaacaattttgtcaaggttaagaaaaattaagtcgaataggtctcaaggctagagaactcggacattacaaacagacaattcgagagcttaacatgtttcgaaggtgaaaattcaaaaaatcttgtttttatttgctcgttatgggaactgagcgtttcgaccagaatttttgtatcttaaggcctatctctgaccgagaacgccccccccccccttctttaaagctacatgcatttcgaacgagtttttttgcatgggaataaaagaaatgaagataatactaaagtaatgggaaaacaaatttatcgcttgaccagccttttacgagagaaaactttttcccggaagggaaaatgttattgtttctaaaaattttcagtttttttagagacttgaattagaataattgcaagtgcgcagaaagagacattggcataattgtgataattattaaatttgaaaataaataataaaaattagagaccggcgcgggacgggatcccgcgcgggatcgcgtccgcctttttttaaatgcgggattttgctggattaatcccgcgggacggtaggggtcaactccgtctcaacatcgttcaaaaagctataacttttttctttgttggccaaacttcacaatcatggtatcattcgaaagccctagatgtttagaagatatttataagctatttctcagtgattaatcagctctcaaaaaagttgtcagttgaaaaccgcaaaaaaggcagaattttcgaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggccagacggagttggcccgttccgtccttatgcccctttgtcggaaaaataaagcagcttgggattcattttggattttttggtaaataattgtgaatttaagagccattttattaaaaaggggagatttaaaaaaataataattctgtggtcacagaacaggaaagaaccaaatcatttacattggccctttctgtgttgaccaattctgacttactaccaatttaactttttggagttgcttaattagcctaatgattgctttttatcgcttcgaataaagcgaatgaaagcatttgtcaattatcattcctcttcttctgagctgctcccttttaaataatcattcattccccgtaatattcacttgtcattaataatcactcatttggacactttctcccccaaaagggccttcccaaatttcggctaattcggggctttatcttcttcaaattcttgcagggcaagaagggaagggacccaatggcacaacaaaaggaaattgcacgccatgccggtggtcatttgttcatatggaaggaaatttggtgggg

SEQ ID NO: 6917 - DNA, 3501 bp, Heterodera glycines
ccccctaaaatggaaaattttcaaaaaattttccccaaatattaattctttctttaaaaaactttattttattttttatttttgttcttttcaaaatgtattttttacatttatttatttaataaatttagtaacagcggttaggtaacttaactgggagacgggaataaggcccctgttctgtgacccaaaaattttttttaaatcaacaaaggcgcgcccagttttgcaaaatattttatgaattccttatgccggtaggggtcaactccgtctcagcaattctgtaatttttagtaggctaatagagcctgtgaagagctttcgaatgatatcaagattgtttgattcggtcaataacttcaagagttatattgactcaaagttggctcagacggagttggcccgttccgtccttatgcccctttgtcggaaaaataaagcagcttgggattcattttgcattttttggcaaatattgtgaatttaagagccattttattaaaaaggggagatttaaaaaaataataattctgtggtcacagaacaggaaagaaccaaatcatttacattggccctttctgtgttgaccaattctgactttctaccaatttaactttttggagttgcttaattagcctaatgattgctttttatcgcttcgaataaagcgaatgaaagcatttgtcaattatcattcctcttcttctgagctgcccccttttaaataatcattcattccccgtaatattcacttgtcattaataatcactcatttggacactttctcccccaaaagggccttcccaaatttcggctaattcggggctttatcttcttcaaattcttgcagggcaaagaagggaagggacccaatggcacaacaaaaggcaattgcacgccatgccggcggtcatttgttcatatggaagggaattcggtggggtcattcgggcgtaagtcacccaataatgtccatccactgaatactttattctttcaaatgaattttacgaccaaatccaaattttttttaatgagttttgtttaatattttcaattttattattcgcattgtcagaatacaaaattctaattatattatatttattatacacgagacgagtttgaaaaattttaatgaaaaatgactagaaagataaattataaaactgaagacaaaagtaaaacagaatcttgtctatgttttggaatattcggataatctattcgagaaacacaaaacgagccaatgaatcataaaaccgggctaattgggtaggaaaattcgactcgtaaaaatgggtagaaaataagtataaaattttggaatttgcgtttaagagagatggacaacaaaggaagaaaaactaatcaaaaattggattggtttctcctttccttccaatttttgaatttaactgcccaaaatacaatagaaatatatgactataaagttgagaaatttgttgaaaatccgtaagggtaaggaggttttcgtggtgtcgtcagatcatcgctttttttttgtttgtacagtgtcgggtcaacaaattgcgaaatcggcttttattgcgtggaatgggaggagctgggcctaatcagctgctgatgcgctcctccgccgacgccgtaaccgttcataaagccaaccgacggacttcggctttcgtccagcacactgacgcccacttgcaattggttggccttgcaaacgcaacgactttcacgctcctgaaaaggagaattgaaaagaacagagggaaaaaagagaaaggggaacctgcagcaaaaagttgagtcgctccaactcgcgacggaggacggaattttgggtctgaaaaggacggacaatgacaaggcgaacccaacccgaacttgcccacctccagagcgttcttttcttgctccatagaggtcacccgggtgatcatatcgtcatgctcttccctggagaaaaattgaaaaaattacgaattaagcaatgatcgaaaatcaaatttgagactaaaacaccccactcacaatcagaaggtaacaaatgtaccaattgttaatttcaaattcccctgctgccccgtgactcacttcttcctctttcggtaccgtaccgccgcggctttgttccgttccaaaattgtctgtcgccgttcgtccgggagcagttcgctatgttttttttattatcgttggcgtttgtgcgttctttctcactttataatcgaccttcggcctcggcctccccgcgttgaactcacttggctatccgcacttaaatagtcgcattttcaattgctaaatccccgccttttcattaccttccaccataaaatttggtgtatttgcgagttttctcctttccccccgtcggtgccgcattatggaaactgtccttgctcatgtcgctggatgctttggaagtgaccgaatcgggccctttcgcgtacggactttgctgggacttcaagtttgaaccaatttttggtgtttagaataaagaatgaacagagccattaaaaaacaatttcgtaaatcagtccccatttgtcaaatcggtagacgtgattggtttttgccctttccccacttacaattgaaatttggggcgggcagaccgactgctttatgccttcgccggctttccattggtcatcgcctgatttgccgttaagcattggcgatatttttgacggggcgctaagactaaaaatgtttttttatttatcaaattcatagtgcctaaaaagtctctccataagccatcgttcactcactctgtcagtccattgccgttgagttgggatgacggagaaagtgccgaactaagcagcgacccgcccgaccccccgggactgctctgcgcactgaacgaaggattgctttgtcccccgccggggagattggcgggcacggacaaagtggcggagcaggaagcgtggtgaagggcgagaagagcttcggagggaaaaatgggcgaatggagttgcttatgagcagacgcagctgagcaaaggcaaattgggaaaaatgagtgatgggggggacagagcgtcgcttttgccaaaccaacccgaggaaatgtttgcctggaggtgcaggtcgggagaggacatcgttttgccttgagccgcgaccggcgtgaaggaggaggggccggcgtggtccgattccaatttgaagttggggatggagctggtcgggaccaagtgactgtgaacagcagcctcttaaacaaatttaaatgacgaattttacaaagtatttaaagtttaaaaaattttgaaaattgtcaaaaccttggccggaggaattggcggaatttgtaagtgccgctttgagtccgttcagtccggcaagcagtgaagtggaagaaatgaacggagaggaggagccaacggaagagctgcccaagtggtgctgctgacaatgagcagcggagcccccgtttatgtgctgcatgtacaacacggcgttgagcacgtccgaagtgcacggcgtctt

SEQ ID NO: 6918 - DNA, 1208 bp, Heterodera glycines
aaatatagtaaatgcaaagtcaaaaataaataatgacatttgaatgctactaagaaaggtctccatggttttcaccgacccaaaaagtaaaaacgagcaaaattaatgaatactttcattttctacctgttgtactttgcgggaaaggtcaatggtttttctcaactcccccctcaatgtcagccgtgagaacattaatattggagaaaatgccgggtgaatgagtgtttgtcaacgaggacaaagtcgagggcaaattcaacagagagccgagacctgcgatggacgagattttcaaaaaaagaatatcccggccagaaaacctgaagtggttggcagtgaacccgaagtgccatcggcagaggtcccactttgtggtccttggccattgatttgcaaatttgcttcgcgaaacttcagatcgaatgggttcacggaaaggcatttctgagtttggcattcaattattgaggtgaatatcatttgtttatcacctgaattatttccgcggtcgagggcacttctgtaaaaagatttttatttatttttattgttttgggggacattgtttaaaagatggacctacgcgactcgggggtcagcgaggaaagaaaccaatcgaatttaccgctgctcatcaaaattcaaattgtggggagaaacaatgttttgtactacagataggtatttttattgtagcgcaatctaaaaaggaaaagaataataaatttatttttcagattaaaaagtttaaagcaaaatgtccggataaaatttaaataaaaaaaggaattttccaaaaaattgattatttatgttgtgtgtactttattttcattgctaattatggaatcgagaagaatctggtgaacgtcggtgtattatattaaggagtgcggcgagaatacagaagggacgggggaagaggggggggggcacacagtcacaacaaattattcaacataaatgagcggggagaacggcagttacggtccctccctccccccgcggggctaaattgagcgtttttctctctcttccattgccactgcctttccatttatttctcccatcaatacaatcatcagacaatccgattttcctcttcattcacacctcccccgtcgtcaccctctcgcaaattcgtcccttccctcctcctccccatcacttctcttccctctcttctcctctattatcccttaaat

SEQ ID NO: 6919 - DNA, 5696 bp, Heterodera glycines
  misc_feature (19)..(19): n is a, c, g, or t
  misc_feature (743)..(743): n is a, c, g, or t
cttacataagctaaattantttgaaaatttaattacatttataaaagccattctggaactcgtcaagatttttcaggctttaaagcccattattcccgtcggaattgtttaaatgtaaaacatgatacaaaatgccacaatttgtctccccctcccatcgtccagtatttgcgctcgtaccacgaaatgatgcgaccgttgccgcgacgcgagcggctgtcctccagcgccagctggggtgccgcctcgtcatcagcggccacaaccgcgctggacggcatgggcggagacgcgagttggtccagcagtcgcggcagcgcgaacagccgcggaagccgggccagcagcatgcacaccgcgccggagacggaccaccagacgctgcagctgggctggcaccgggtcaacgacaagcttcgctacgactcgcgcgcggtgcttggccgcggctgcgacggcacttttgtgtaccggtgcgttgcttgcgcggatggcatcatggaaattgtgtttgctcgagagtcgagaccgaaggattgtttttggcattttgagcccgaataagttttcttcggcctcggcaactcggcatgctgtttattgagcctagctctcgacactgtcagggaaccgaaaatttcaacactttttccaaaaaacatttgggaacctccactcggaattctgtggccaaaaaaaattgagaatcgggaacgagaatcggtatgccatgtcccaaacangggaattttgggaatccgggatctgggaattgccatttttcgcattgtttttggttatcaccggtactcaagactgggaatctcttctcaaggttttgatcttgccaaaaaagttgagtatttttcactggacaataatgctgaaacccgagactctcgagcattacgcactaattgcttttccactaattggtgttatgtcgcccaggggccaattcgacgggcgcgacgtggccgtgaagcgggtgcaggcgctgctgagcgcggacaacaattggcaccggatcatcgaccgggaggtgacccatctgcgcgagagcgactcccatccgaacgtgatccgctacttttgctcggtaaaagacgatgcttgcaactcactgattgatcaattaaataaatacgattataacataatcatctgtctacaaattttttttttaaattctataaatttatttaaagaaagtttccttaaaatgtatgaaattttttggcattttttttttgtaaattataaaattcataaaaaataattactttacaatattcctaaatttaatctttaaaaactattatatcttttgattttacaaaaattttataggtggcacaagtgccaaattgatttgttaacaattttttattttggaagttaaagtttggaatttttcaaaaatctaaaaaattatagggaaaaaataatcaaattatttcacatagttatttttttttatattttattaaaaagtaatttaatataattcttttccgaatgaaaagttgttaaagaattatttttaaaaattttttttactctactcaaattttttttttgaaattttttccaaaattttttcaggaatccgactcctacttcagctacattgcgctcgagctgtgcgaccacacgctggaggacttcatcaaccaccagcggggcaaaatggagcgacggctcaagctggaactgctgcgccaggccacggacggcatcgcgcacttgcacagcatcaaaattgtacaattcatttgtttaattttcagacttggaaatttttacaaaaaaacatgaaatttttgcttaagaaatttcaagaaaggattttttaaaattttctagcgttttttggaaattttttttgaaaaaactgaaattttcttatgaaaaattttcttaaattttttttatgaaaaatttcgcacattgatcaaacccattttcatgactccgatcaatccaatcggttttcccattttcaatttgtcatcttttcaggtacaccgggatgtgaagccgaaggtcaatcacacaacattaaatgatgcggctgcaatttccaatttcattttttgttgtagaacattttgatcaacggcgtggccaagggccccccgcgggtcaaaatttccgactttggcctctgcaaaacggtgaagctgggccacaactccatctccaaagtgtccggcgttgtcggcaccgaggcaagggagaaaaacactatctgatcagagctgatctgagcaggctttgtcggtctgatcagtgccaacagccattgttgatagatcatttgtctttgaattttataagtgaacaattaattaggctcacatttttgtcttttagaaaggttctgaatgcccaaattttactttaaaaataatcactgatcaaatcaattttttagccaatcaatcaataattttgccacaaaaatctaacaataatcccatctttagggttggatggcgccggagctgtgggactcgacggcatctgtggtagaaaaaatcccaatcaaaatttcagaaattttaaaattttacaaagacctatgccattgacgtgttctcgctgggctgtgtgttctattatgtgttgacggagggtgaacacccatttggtgactcaaatgtgcgcctgtacaacatctccatgaacaagttcaacctgagcaaattggatggtgagcggctaactaaaaatggatgaaaaaatcacataaaaacgttatcagcaactgtgatcatgatcactgatcagtgttcggtatgataattgatcgggaaatgtttactgatcgctaaacatttcatacccgtgttttgatcagtgttcagaacccagatggatgaaatggtcacttgaaaaattaatcagcatccgtggtcatgatcagtgaacaaaatgatctttgctcagaacccatttcatatccgtggtttggggtcagtgatctgacttgatggttttgattactgatcggtgcatcatcatacccgtgatcaggatcggtggtttagattactgaattggaacccatcttgatcggaccattactcattactttttatctgatcgtttgatggcttttttccatgtctagtcattatattacataaaatgtctgacttaagttgaccaattacagattctgatcacacagcgcgttcactgatcgcttcaatgcttcggcttaacgctgcgttgcgtccaacttcgtcaatgttcgttcatgttcatttgttttgcgtggtttctatttttggcatgcatatttcagcttggtaactcatccaattttctgggagcccggcaaacagttgcaatttttgctggtacgttatggcatttttttgctgttgtattagcctatttggttcagtcttcgttttaagccaaactaaataatttttggaaattcttggtagctttcggctgatcgctttgttgagatccgataacccataggctggctgatcagactaaaaattacccgggcattaatttttctataaatttcattatcatcaggcatggtttttctttatatcaggtttttcggtcattttaagcaagaaactaatgaatgatcaatagagttaagccaccgatcaatttttttttgccattctaggtctcttctgcttgactttttttaatgaattgatcaaattggcatttttgggtgggctgaccaaactatcaatgctcatggcattaaatctggttagatcagactgaattaagccactgatcagttttggcttccttgatcaaatttcccaatggcaatttttctgtaggaagtgagtgatcggattgagaaattggaatcgcacgatctgatcatgcgccggttggagtggcgtcgtgccgtcgtggttggcacttggctgaaccgaattgacgaaccgttgaaaattggtacatttttaatcttggcttttcgtccgccaaaaattgacattttgtcccacccaaacacaaaacagatctcttgaagcagcgctcctaccagaacaatgtgcgcgatttgttgcgtgcaatccgcaacaaaaagcatcattaccaagtctggcaccaatttgcactcaaattttaattttttggcattttgtcactatttaaaaaaattttgccaggaactttctctggagctgcgcactctgcttggccgcttgcctgacgagtacattgcctatttcacttcaagattcccagaggcaagtttttttaaaaaaaagttctatttgacaatctgttgaaatttgaatattcgactcgaaaaccgtttttggggttaggggttcgttttctttgatcgagtctcgttctcgaactctgcgagaatctcgagtagcattaccattttattgtcttcatcgcatttgttggcatgatgttcatcaattgtcccacacttggcaaaacttttgtcaaattgtcccacatttggtgacattttgtctgccagtccttagtgactttgttcgacatctgtccaacaacttaaaaatgtttgtacaattatcccttagtaatattttattcccatttgtctcagctttggtggcattttatccaattcttcccctaatccataatgacattttgtccaattctttcttcaatctttggtgacattttgtcccattctcccccaacatttggtgacattttgtccaattcttccccccaacatttgatgacctttgtttggcacagttgctgatgcacgccttcatggcgttgacgctgtgggcccatgagaatgtgttccgccgcgacttctaccccaccgatcagctcgtcgagttcttcgagcgcgagcgcgacacgatcttcaaaacggaccaatcgccgcacgaccgtcgccgccgcagttcgagcccgtccaactggcgcagcgccagtgccgtaagaatggcaatcgattggaggcggaaaagcatgcccttgcttgatcccgaatcaatgggtcatggtgatggtctcgggaatttctctttcccgggactatttgacaaaggcacatggtgccggggaaggacgtccagggaaaggacgtacttggatttcggatttatagtaccagcctcaatggtgaagattttgtcgcatccaaattttcgacctccccccggatgagggctttattagaggggggcactaatagaggggctgggatctctattagaagaaaagtggtaccgcagtccgagtttggatatcccatttctttttagcatgggttcaattttcaacccaccctcccacttttaggtgggctttatttgagagggcggcactaatagaggggttgtgtggctctattaaaaggatcccttcctgatgcttttgttcaacacagtccctccccatccatcagcagttgtcccgagcgggaacaccgacacggaatggcgtcggcgccggcacaattgtgccaacaaattatgccattggcaacatcacggccgatggcatgcatcacccggttcgcaatcagttgcagcagcagcagaaacttcccttgcagttgcccgccttcaacccgttcatgccaccgccacttccaccggtggcaccaccaccagcagtgccgaaccagctcatcatcacacgggtgggtgggctgttgttgttttggggatgagtttcag

SEQ ID NO: 6920 - DNA, 1571 bp, Heterodera glycines
ccccccaattccatggcatttctctgctctctttgactctccccccaattccatggcatttctctgctctgtctgtgtttttccttaacagatggcttatctttctgtctgtagtctcttttttcctattcttccgctctttccgttttcttattgcccaattttcagcggccattttattggcacacagagggaactccgaaggaaaagaaagaaagaaaatgcgagaagctcgggcaatgcccatgggcacttttggccggaaaaggacaccaaagcctccagcaggcggagcccaattccatggcatttgtatcgatgccttccacccgaacaaacactttttactttggccatgcattgccgccattcaatctctttacccagtaaatattagtgatactcaagaccgaagatttcccgagaattgagacatataaaaaaaccgagacttttctcgggatttgaattcagtccctcccgaagccaaggatctgacaatgcacttgagtcgagactcgagaatctcgagcatcattaatcaatatgaatcactcatttcattttgcatttccaaagcgattataatactttttgttttttaattcatttttctttttttgtctcccccccccatccgccgatgtttccttttttccctcaattaaatttggtttctcacaattctccgcttctcgccatctgtcaatttaacttcatctcatacttttctccctttgtttttcctctcaccaaaaatgccatttttcctcattcagggcattttttgatggcattctctcccccccccccccctactctctgtcagaccatcatttgtactcatttatttacaaagtcttcttatcaactcgagaattgttctcccccccccctccccctctttttcatttcctttcatcttttgtcaattatcgcaataattaattaaatttacctaattgaatttttaatttctccacccgtcttttcctccttccctttcttttttcaccattccctcactacccatcctttctttccttaatggatgaacttgtaatggatttgtgagtgctgctggagggatccttaggccgaggatttgaataaaattgttaaagcagtttccgtacaattagcaatattattgaataataattatcaatatttattagtaatttgtgattaaattttgaatattttgtacttccatcagcagaaggcgaaacattcaaagcgaagcccacccacgcaaattcacttccattttcatcccaccatctttccccccccccccaatccgccatcactttttatacatttccttttcttcagttgggtgacagaaatttagtgcgcgaaaaagttggtacaaatcgatgcattttgaagaggaattgcgcaagaaaattatggcgggggcataaaaaggggaaagatttggaggacaaatcgacgcaatgggcgggtgagggaatgcgaaatgaattcggttgggttgtctcctttctgttttttggtcttcctttgtttgatggtatgtaaacaaataatcattcttttgctgg

SEQ ID NO: 6921 - DNA, 2780 bp, Heterodera glycines
aaaatgatttcgtccaccgccgtgcctcgcccccttcgctcttcgaatcaacaaaaacagcagccaaacgcactgaccaaacagaacggtgctcatcagcagaagacgcctatcaaagccagggaagacagcagaaacagtcagaaaatccaaattgggggataaatcaaaaatgaattgttatttaaagggagcgacgcattgggcgcacagaaaccaaacggtcattcgccgcgtacgccgagcgttccgccggtgaataagcgatacgctcacgtaaaaaggcaattaatcactttcatatccattgactcgttggttattcttcagcaaagtcgggtcaatcactgagtacactccgtcgcccagtcgcgtgaagattttccacgagtctgtccgagtcagcgccactcccaaagtcggctcactgcaaaatgcgtcccatgtgcccggttcggagggaggggagggggcgttaattggctgtttttccaaataaataaactatttacatttagccggtggaaatgtgacgatcgagaacaaaaaactcaacttccgggaggcagcaaagccacgggtggaggacaaatcggaagtgccaattccaaagagtgagaaaaaggtaagaaaatgggggatggcatcgccaacaaaagggaaggaatgttttgacagattgcgactcaaaagttggaatggaaagcccagcccaaagtcggttcgttggacaatgtgaagcacaaacccgcggggggcaacctcaaagttttaacagtttcactttcatccctttaaagagtgggccgatgtttcagatattccacgagtcggtgcgggtgaaatgcgagtccaaagttgggtcccttgacaacatcggacacgtgcccggcgggggcaatgttaaggtggcattaattagtccaaacaatggcactttccctcccccttcgctttccttctcttacccccttcccccccccccccccgtcctcattagatttcggattacgcacgcagtgtttccggcagcggtgatggctccagacgtgacacttttgattcgggccgcagttcatcttccgccgacctccctaaaacaaaaaacgttgtgctcagtccgcaacgttcgccgcgacccgtggaaatgattctgacaccgaaggaaattccgccgacggacgacgacgaacaaaatgacgcgaacagaggacacattggacaagcggaagaagggggaggagagaaaaggaacggagagagggcgacggaagaggaaaccccgcaggggacgaaggaagcggaaacggggcaactgatcaattttggggactgatcagtgagaagggcaaaaagcccattccgaaagaacaatagtgacgatgactgatttttctgttcgccgcctcattttgaatggccccatctgtcaatccatgcccaatcaatctcataaaatatttagtaattcatttttgtagattcattctgttttctgtcgattaaactatgaacatttaattttctaatatagttttgttaatgagttgggctggcatttttggaacttaaaatcggtcaaatattgtcagaaacactcaaaacgatttttgaaattgtcatttatttgcgcctttgtctaaatacattgattaagctatttaacactataaaaatataaaacccgtaggagggaagggaagggatggacgacggaagaatgatgagagatggcggggggggggggtgggatttggaagtgatcggttggaaagaattaaagacggatggggcggggattaatttgggtgtccatgtgacagatagaatgaaaggggaggaggtaagaaaaggggatcattcttttcggcatttgttaaatctcagattcgtgatcagagtatttttaaccccaaattcattgataacttttttaaaaataatttaaaaaatcgaaaaaaatcaatgattttcaaaatctgagtttagattcgtgatcagtagggccgcgacttttagtgacgaaaaatcccgaaatagctaactaaaatagtgacgaaaaagtgacaaaatagtgaaaaaagtccgaaatagtgacgaatagtgacataatttttagccaaaaattgaggaaaaaataatttttattcactgattgcagttgcaaatgagtagggctgctaattttaggtaagaaaaatcgcagaataggtacttaaaaaggttaaaaaatatatcaaaataggcatcaaataggtataaaaattccaaaataggtaaataaaaatttttattaacgattttttagtggaaaaaagcaaacaaatagggtaaattttggttctacatatctctttgtaaacgaaaatttaaatatattaatattttcttagataatattgacatttaaattaaaaattttgtcaatagaaaaaaataaataaattttgggataaatttttgagaaatttttccaattcttagggtgcatttttgaaaatttttttggtcgattcttatgggtattttttgattttattgcatttttgttaagaattttttgaaaatccttaaaataggtaaaaaaaatgccgaaataggtataaaaataggtacctaggtaataggtagaaaaccccccaaataagtaaaaataggtattataaaagtgggtgtagaagctccaaaccaagctaaaaactcgtttttcgcgcctatctccgtctattaagtgtgcaaaaattttaggtatttacctaaaattagcagccctacttatt

SEQ ID NO: 6922 - DNA, 1287 bp, Heterodera glycines
  misc_feature (1166)..(1166): n is a, c, g, or t
  misc_feature (1268)..(1268): n is a, c, g, or t
cttggaacgactggcggagatttggatgttgctgttgactagcgggggaggtggaggaaactgcgtctgtggagagcgggaaggcggcgggagatgggccggcatcacgggctgttgctggtgatggagggagaccatgggtgggcggcattcccatccctccgggcccagtgggaacgaagaaaggatgacgcatttgaagcggatgaacgccctgctgcgggtgatttccctggaaacaaaatgacataaaaatatttctcatcattaaaacaagcaaacccacatggttcggcataaaagaaggcgaatttatgaaagaccgactggcagaagaaatttggttgttgttgctattgactagcggcggtggtgggaattgagtttgtggagagcgagaaggcgacaaatagggagggaacaaaggctgttgctgctgaacatgctggtgatggtgaagaaacccttggctgggcatcggcggcaatcccatccccccaggcccagcgggaccgaagaaaggatggcgcatttgaagcgggtgaacgccttgctgcgggtgatttccctgctaaaagatgaaatgaaccgcaaaataaaaaataaaagtaaaacccactgaattcgccagaaaaacgggtgaactgagaaaagaccgattggcggcgatgtttgagttgttagcaagcggtggaggtagaggcggaaattgtggctgtggagaacgggaaggcggcaaaaaaggcggacccatcggttgctgattatgagggtaaaacccggcagggccaggcatcggagacattcccaacccatcaaacgaaggttcgtagaaagggatgtgctgttggatctggataaaagtcgagttgacaaattctgagattctatctatcacccacttgtttcggtggaccaattgaacccccgccactgcttgacgcgttgttgctggaagcgcaacgactggtagtctcggcaaatttatgcgaatcgtcggccaatgctttgggctccgaaacggcgccttctcccatccactgcttaagtcggctggttgccttaacagcaaattatgattagcttcactttttcccttactaaagtcatgggcagagaaggaaggacagtctcgggagaactgttgtgctgttcttccaccgttnttgtgatgttgacttctgaaaatttcacagatagatttgtacgaataatatccgaagtgtacctttctcactttgaatgtcctccctcaatcccatcagctncatgatgtcaaaagctgat

SEQ ID NO: 6923 - DNA, 2046 bp, Heterodera glycines
aagttcatacaaaaaacaaagaagaatgtatcactcactctcgacttctcattactcccatgcttggaagttgttgcagttgacgtccaagaagttccgttacccccaatgtttaaagtgttttgactcgaactgccgcggttggtacgacaagtggcctcgagagcagatttttgcttaaatagccaaaataaaataattaaagaatctaaggtattggcaaatccctaattatcatccccggcccactcgctcagttctgaccgctcccccattccaaatgcacccacaaagtccggtttgaagtccatcccattgctagtagtcgaagcgcctctccgcagtcgagccgccttgatgttcgcctgttgtttgtcagtttcctgctgcggcgtgatcactgttgctgttgaatttcctgaaacgcttccgcctcctccaccgctcccagcggaagtctgactggccgctttccgcctcacacgattctccactccctcacatttccatttgtgctgcagccatttgtccggcgagaataacccatcatcactgaaatgaatgcttgaattttcaattgctgtttgtttttactcttatatttagacaatattaaacccctcttaatagaaaatttacttgtcaaaatctttcaataaaaagacaggtcgtgtccgacaataattgctttctcgaatcatcagcaattcttccttattgtagcagcgatatgttgtcaattgctgtctagggacatccattttttctggacccaaatacttggaattttctttcataacaaatgaaagaagttagtatatatggataataaataatgtcttaacgtcaaaataaaagaaaatacaattttaaaaatggattaaattaattgagataaagcattaaatcaaagggaaagccaaacagaagaaacagatgaattttggattggtataagaaatgtgatgaagatttttgaaaatattttgcttttaaataaaacgccataaaatttaattaataaaatagaaaatgaaaaatagaatgattgagattgtttgacgacgtcattcaactaaatccaatcgataaacttaaaaattgggaggcattttctgaaaaaaaaaattcgaaaaattgaattataactttttgtacaagttcggtttcaatgttcagattggtcattaggcaaagggtccctccaaataacacgccctcaatcaacttataaagttgtatttagagacaaaaattatcgtaaatggctgtcggaaagaacaagaagatggggaaaaagggagcaaagaagaaggccgtcgacccatttacgcgcaaggaatggtacgacatcaaagcgcccgcaatgttcacacaccgaaacgttggcaaaactttagtgaaccgcacccagggaacacgtaaatgagcgtttaggctttctcaaaaattttttggtttaggcatttcaagtgactttctgaaaggtcgggtctacgaagtttcgttgggcgatctcaacagcacggacgccgactttaggaagttccgattgatctgcgaagaagtgcaaggcaaaatttgtttgaccaatttccacgggatgacattcaccagggacaaactgtgctccattgtcaaaaagtggcatgtaggcgtatcttatttatacaaagtgcccggaatggaattaaactcctattttagacactcattgaggccaatgtggcagtgaagaccaccgacggtttcttactccgactcttttgcattggctttaccaaacgaaatgccaatcaaatcaagaagacgagctatgcaaagacatctcaagtaagacttatccgcatgcgaaaattttaatctgttccttagaaaattatttctaacttctcattatacatggaatttaatattctaaaattgctttaggtacggatgattcgtgccaaaatggtggaaataatgcaaaaagaggtttggtcgtcgaatttattcccatgttatgttgtgtcaatgtcttctttgctttgttaggtctcttcc

SEQ ID NO: 6924 - DNA, 4856 bp, Heterodera glycines
  misc_feature (1649)..(1650): n is a, c, g, or t
  misc_feature (4763)..(4763): n is a, c, g, or t
cccaataaacacataaagcaccttttatttgtcatttaaagcatttctgacaataaaagagaaaaaaaaattttgaaaaaaaaatgaccaaaaaccgggaaccaaaccaccataatattcaaaaattcttaaaaatctgattttttgatcccgagtgcactggaatttacgatttgttaatttcctcaccaaaattttaaagatgatcatgggaggtgaaaaatataatatttaatacatttttgatcgaataaattgtaaaaataaaagatttgaagcaattttgcaaaatgttctgattttcgaccccaaaatctgattttttggacccgatgttctgattttgaaaatttttcgatcacacccctgttttataatcataatttattgtggcgctaatttcttcggtaactgattgtgagcgggtaccaatatcacgcatttagcatcgccgatttggtccccaccataattcccgcagttaaatttaggtaattgcatttacaattgtaatataaatgtcttatgcttttgttcgacaaccgcacaaaaattcggtgtgccttatgggatggccaacgacaaattcggtgattatcagacaaaggcacggcgctgaaactgaacaggcgcgcatttattggccaggaagtgggctcagaacgaagagcgaaattgaggaggaggtcagaaatggcattgatacttaagttaagcaatttactctttccgtaataaaaatttcagtttaaatgtgcccgcgacggcaaatacccagaagagaatttggaagattggtcaatcacaggcaaacggagtttgactcagaaggcgcttttccattacacggaccgtcgggcgggcaaaggctattccgactttggtttcgtttcctccccattaattcccaaccgaattcgactctttcagccaccaccctttactacggtcgcccttacatttggccgcccgttcgcgaaattaaccgatggcactttttcatttgtgtgacctttgccctggttattctcgtcgactgcaaatggtgagcagaattggttgttttacaaacatgcggatttttgtaaaaaaatttttttgtacgtaatcgaaaaattctgaaattttgcagacaaatagcacattaaagtattatctgcaaaatttcaagtctttctaagaactacatactgacaacgaataagaaaatcagctttttcaaatttcttgataggctaatgacttaaattcccatccctattcataagatttcctaaaattttcctgcgcgccgggtcttattttaccatttattttttgaaaatttgaacccaaaatgtcgaaaactaaaattccggctttcactgtttcatgtttcttcgcccttttaggtttgtttcgtccttcgaattgtttcgtccgcccaaatcggaagccgcgactttggaaggcgacgcggtcgaatttgaggatcggaaaaaacttcagcttcgacgaatggtcaaatttagtttaattcccttggaaataatcagtcaaaatgatttatttcttaattaggagaggcgaaataataaaatatttgcaacaaatcaaaacacaaaaaatgaatgtttttcgggttttgtttaaattttaagtgtgtgtanncacaatctaaatatactgtttttcattttatggagtcaatgtcaactcgtacaataattattagtttttcaattatttccgttggagaaggaaagatggggattgggatgcaaattaaaatgatttgttaagagattttgtccaaaaattgttcgatttttcactttcgtcgtacaaaataatacgaaaagcccctctcgttgcctatgtttttcgtacttcgccttttaagcccaaaatgcgtcagaaagaggcggcggtgacgaggcgaccgatcgctgtgccattgggcaatccccgcacaaaaagaaacggaaagtcggctttcgcgaacagcgcgtcgtccaatacgaagttagacgccgaatgttcgaactttcgcatggacgcgtttcagaatcggattcgtgcctattcctcgcccgacaaaatctttcgatatttcgcgacgattaaggcattgccgaccattcattttcgttgcatttagtagattcggtttagcttcactacgaagacggctctttcgacattttcatgacgccggaggatttcgttcggtcactgaccccgggggtaattcagccgaggaaatacgggttggacaagtacaaagtgtacaacgtagaagaggtggtgaaccgatggggggggggagtggacgagtgagactttcgtcaggtcaaagagcatttgccctcgggggacggcgttttcaattggatgagcgactctggcggactgatcaatttcggcgactatctttttctgatgacccttttgtccagttcgttttttcgtcggaatgccatttcttctccctcttttgccgttgtcagcttcacccagcgaattcaaattggccttccatgtttttgatcagaacggcgacggagtgttggaccagcaggtgaaaagggaagaaaatagaggaaaaaagggatggaaaataataggaaaaaacgaatgatttgaatgtttacgggccacttattactcactgctgaataatgacccccaaaataaaatgagttttgttttgaaggagttcgctcgggtgcaggaattggtgctgagtcagtctaacattggccaaaggcaccgcgaccacaaaacgggcgccggcgcatttgtgaagacgaaaaattcagtgaatttttaaaggaaaagcgaaaaaataaccgagtttaaacccaatcagatgctttccaagcatttcttcggcgaaaatggacaaaataagttggacattggcactttcctccaattccaggcgaataaattattttctttttatatattttgcattattttagcagaatttccacggggacattttgaaaatcgaattcgaaagacgcgaccccgagacggggccccgagggaatcatttccgaagtgtgccgaacgaagccctccccctttttttctttaccctccgcccctttttagctgtcctttgccgaattgctgatgatccactcggacttgccagagaagcggcaaaagcgaatgctgaagagagtgcggagacggcaaaaggaattggcggacaaaagggtcaattaaaggggcagcattcacaattatgtttaattaattaatgagtaattaattaattgtttcttatttgttttgccattgtttccttttgagggcgtttcctttgaggaggtggacagtttcttcgccttcatttaccacattgacaaagtcgacttggccctccatttttacaaattggccgggaaaccgttgtccaaacaacttttgcaggcaaagtcaaatgattttaattgattaatattgtgaattatctcttttcagagggtcgcccgcaaagtgacgggcgtcgacctttcggaaacggtcgtcgacgtcgtggtcactctgttcgacgaaaatgcggtgggcaaaggcaacggacggacagacgacgcgacgcattcaatcggtcgaattttaggacggcgaactgtcgcagggcgaattcgtggccataatgaaaaagcgaatgcaacgaggcctggagaggccgaaggacaccggccttttccgactgatggacgcgtactggcaatgcgcgacgcgattcgcaagggacgacggacaaagttggggacgaaaatgacaaagcggagacagatgagagacaatggagcagcaggggtagaggaacaaagaggaagacaatgcgaaagagaggggaaaagatggagagagacagacatgcttattcttctgattcgataaacctttgctttcatctgattgcttatttatcacttttatcattggcaagataaacgatgaatgtacaaacaaatggaaaacaaaacaaaaaaatatccaaaatatttggaacgttaacggatgaatgtgaaatacgctttttgtctgctcttatccgatgttcagcagcgtttgccgtaccgccccctgcaccagtttctccgcgtattgttcgtccaatttgaaatacgtttgcactcggatgtatcggtcgtggacagtcagtctaaaccggcggattggcaaaaatgccgaaacagaggccaacaaactttggactgcgcagcacaacgccacgcattgagggcaacagaaggccaatttggagaatttcggtcagcaatttctcgagaaattccgccccaaataagccgaggtcggcgaagctgctcttcaaatggaattcgtgttggaagtgccggggcgaaaagccgatggtcctcccccctcccccagttcatcctcttccattctccttcatcctttcctcccctccccctctcccctccgtcttctcattcatttgcccacctggtcaacatcgcgcacattcgtgctcaccaatttgaagtccaaattctcaacggtggcatttccgaggatttgacttcgctaaaaacatttgaatgaatggtgccgaagattgcgttggtccgactgacttcgatccaaaggttcacattggaggtcattgtcgtttccgagcgcagcaccaattccctccgttgggtcgcattttcgggtcggacgaactgaacgcggcaaataaattcacagaacggcacattttcggcatttgccatcgcttttttactcaccanatccattttcccgtgaagtcggaagcgtgccctcccccctcataaaaccataatgggcgcctttttggcgctgaactgaatttcgacctgaac

SEQ ID NO: 6925 - DNA, 2053 bp, Heterodera glycines
tttcgcaaattcaaaaatagttcaagtgattagcaaactgcttcctgacggccggggaattgttggccgagagagcccaaatattcgccgatgcaaaagcccgaggagcaagtcgtaagcagaacatccttcagttgtggcgatgactgagaaaatgagggggagggcaattagggcttaattaccgtaagagaaggagggatacggtagccaattagggggaaattacttcagggccaaccaccacgtccatatatttttgtttgaatgcgtggtaaagcatcgaattggcgacaaaatcagtcccaaaaaactcggccataaaaacgcctaaaattgaaaattgtgaagaataaatgttttttttcattgccctgcgcttgcggaatgataacattcggaggggcaaatggcgtttccccgaggccatcgtacgaaatttcgccgtgcgatttcatcagaactgtccccttgaaatggcaatgacttcattggcaccaaattaccgtatttacggtattagaaccaccgggggttttatttttaacctcccctcaaaaggggcgttgtaattcagggggggggggttcaaataccgtaaatacggtaatagtattttctctccttccctgcccgccctctctctctctactctctcatctcttctttctttctctctgctctccatcttcgcccctctctctccctctgtctttacctgactaacgaaagggtcgtcgatcagtgaaaagtcgagcaccaaatttctgtccctcagctgagagacaaagttgagcagtgtgaaattgcgtggcgcttgcagtttttttgatctgtaatttatttatttttttaaataaaattaaaagtcttttggcacatttttatctccgaatttttgctttggtcggggctaattccgaagtttctgccgattaagtccaaattgtcctcattgatgcgcaccttacaaattagggacgaatgttcgaaaattggggtcctttcgaattctttctgttgctcactttcagtggcatcgtcgccaaaacggcattcatatcgccgtttattacgccctcaatcatttggcaaattcgctgttccaccgtcggcttaaaacaaaaataaatgaaaaaagaaaaaaaatgaaaaaaatgaaaaatcactttaaaatgggcgatgagaaaggctttgaagacgtctgaattgaaattgaaaataaagaagcatccgacggaagaaaaaggtcacttatgaaaaagtcggtgatcactccgctgttccgtacgctcaaatcgacgtaaccaaccgcggcacggcaaaaaatcatttgcacctgaggcgctccgatcgcgcttcttcactatgggcagaatgcaaaatgtaaaaaattcaaaatcaccacttgcaaaatgagtgctaatccgttgctaattgtccaattagcagcaatcacttacctaagcattcggacagaaattgtgaggccgagatggccgagcaaagcttcgaattcgcctgaagacaaagggccattcaatggtttgatcgttcgttggttagttcaccttggattggcactgtcggcagaagaagggcaccgttgagacgggcgtcgaaattgccattcgatcagaaaaagacaaattggcacaatgaaattgaaaaatgaattatcagtcacctcaaatgcattttggacattcgccacgtgaaagtgtcgggagtgagaaggtccaaagtgtactccaccgggggccaatactttgacacgtaagcattgaaaatggacaccaaaaaagggggggaaagtttgccaagtgaatttgcaataattacttggcccgcgtcgatggactcagtgatggttggcaaactgaaaggacatttgcaaaaattgccaaagagtggtttcggcacctgattttgagtatttcatcgttgaccactttcatgccaatttcgcgcagataagccaaccccgtgggcatcaaacggacaaaaatgcccacagtccccgcattggtgttctgctaaaatgccaaaatag

SEQ ID NO: 6926 - DNA, 870 bp, Heterodera glycines
  misc_feature (854)..(854): n is a, c, g, or t
ggggcggagagaagcggcggcggaagagcggacagagcgaaaaggaaaagcaaaggcaaaagcaaagggacggcggaaagggcggggaagggcatccgatcgaagctcagcagaaaggccgggaaagcattggctgatcaaatggacagaacaaattacgaatggcagcgcaaggattggcgggggacggagcggagaaagcgccgatttttgagtttgggctggcgcaaaagatggcagaccaaccatcacaagcagcggcagtagcagagaaatcccctctccccgcagcttttgtttggcggggcagaacccgttcctccgcttctcccctccggcgaatccctccgctggacggagcagcgatcatcgacttcacccaacgcgatcctttgaatggagcagggggagggaggatcacgcagcaaagcacctgctggtgaaggggaggagcaaaaggtggggaaaatgggggaaaagagaggggataaatgggggggggggtgaatggtccacccaatccgaagggacggacgggcgatgatccaacggcgaagaaagtgtccattccgtggtgaaacgaccgacgcaatcccagcgcagcactctcttcttaagcccagcagattttcctcaatcgccacaattttccaacataaaaaggggggggggaacaaacgaggccaaaataaaggaaatgagcagagggacaaagaataattattgaccaattagaatttggcaaatgggcggcgggtaatgagaatgaaattaatgaaaagagattaattgccgcgggaggggggagaataacaaacaaatagaaagaagaattattattattattacaaaantatagcatccaaaaat

SEQ ID NO: 6927 - DNA, 3109 bp, Heterodera glycines
ttctcctcgatcggcataatataacatccccgcttgggcttatggctcacactacagagttggcaataagtctctccacattcatggtccttcttcgggttaaatcgataagtcttgtcacagataacgcaacgcctccataatttacaagtctgatgtccctgatgataggtgtagcattcccaattataaaagtaacgtcgacacttcgggcattcaatcttcactccactctccttttgacacggcattcctccagctctattgcagtaataacatctcgcccggcaatccatcgtatgataaacatcctgatcgtaaaaacattcacattcaacgcagaacttcctcccacggttgaaaaagcaaacatatttctttaatccatcccagtgaccattctccaaaaatatcggcactacattttcgcgtcccatagggcccttccacaaaacacggattgatttccgtggatcagctgacttttcaaatgccaccactcggtactttccggggtaaatctcatcctgaaaaatccattaatttatcactttttcatttaacccaccaaataattctgaaccctcgataagtgctccactccatagctatattcgttaatatcaattccacaattacgtaaaagctcagtagctgcgtccctctgtctcataatattgttcataaatcgattaaatgcaaaacggtccataattaaataattcatcgacgacgccagtgcgtaaaacaaacaaaatttatccacattcgaaatccttaataaataattataattttttctttttttttctattttcctttttttcttttttttttctcaaaaaacttaccttatccgttggtgttccttaaatccgaaatcaaatttatgtacattcctcggcccgtctccactgggcagtgtgacgcaagtaattttcatcataataggctccgacaacaaaagcgttttcttattttcatctccgtccccgctctgccccaacttattaatctcctgcataataacatccgcattgttctgcgggtacgccctgtacggtacccaaaccggggaagcaagcccggcacccgttattgccactccaaacatccgcactttccgcttcatcctttcttccgtagtcttaaaagccgccttaatcattgtgtcgattgcgtccctcatcgcttcgtcagggcgtctcacatccgaattgatccgaaattccgtaatgttcttcgtaaatccaaatttttcgcaaatcgtcgaccattcgtcaattaatttataattttccatttcttcagtaaaattgttcctgaaaaattattgattaaaattgtaataattgtatcttatatattattggaaatttgtttttaattgcttaccctatagctcgaaaatcccattttttggtcgacggcccgcctttttgcaaagtcccattgcgttttgaagtcattttaattaaatttaatatttttaaataagagcccacaatttttattttagcaaaatccaacttttggttgaactgaatggagaagtgaatttgggcggcttttatagtggccgcagaatggctcgtgtcagctgacacctggcatgtgactgtttttcattgacattgaggaatatttcgttgacaaatgttatattttcgatgcaatggcagaaagtcacgtgtctattgcgaaatatgcaacaaaaaaaagtcacgtgtagattgcgaaatcggcagggaaaatgcaaaataaaaaaatttgattgacaggtgacctaatttggtcccatattgcgaaatcgtaaagtcacgtgcagattgcgaaataatggaagaaaaataaaagaccatcaattatttcagaaaaattcaatttcattaatttaaatgaatttttatttattcaactattgtacaattaatattcctatatcttagaattaattcgaatttcattgacaattttggtacttatcgattttttttcacgactcggaatcgcggcacatcgacggagcggatgagagtggcggtgtcattatcgattaattttatcgattaatttgtgggcggcgacatcgatgtggagggtagggcggtgtcattatcgattaatttgagcggcggcagcatcggcggggagggatgggttgggcaaaaaaaaaaccgcacggttttgggaaatcggatttgggtgggcggcaacttcaaagtggtccaatagattttggttctgggcgggaactttaaagtggtccaataggtttgggttctgggcggcaacatcaaagggatgcacccctcccataggcacgggtccacgggcggcaacatcaaagggcagcacccctcccataggcacgggtccctaggcggcaacatcaaagggctgcacccctcccataggcacgggtccctgggcggcaacatcaaagggctgcacccctcccataggcacgggattgtgcggtaaacacccgctcggaacccgctcgcttttggtactctatactactgatgagagacgaaagataaaaataatttattatttttaaacgaaaaaattgtaagttaatcatttgaagcaattttgcatattttttgacctcaaaatgcgattttttgaatttgatgttctgattttgtaaaaaatttgacagatcaatggataaattggaacagaataacccttgctttttctcacaacttttgtttttaattaggcatattttcattttgttctctgcaattttttcctaattaatttacttaattaaatatacatttatgattttttccattacctaacatgatcctcttatttccttttcagtttttatttataaacaaaaactttacgaataaaaggctgacccataaaattaaatgaattttacgctttattctaatccaaaattataaattatctgtttcattaatattaatataatttattcaacctatgtacacaccattttctacaatgtttctttgtattgatttggatcaattttttacgccgaggggcaaagcgatgaataaatgaaaaaaatacggaaggatgggaacaacaaaacattacactcttctgacaattg

SEQ ID NO: 6928 - DNA, 2717 bp, Heterodera glycines
ctctcacacaatttcgacaagtttcgaactcaacgaacccaaattcgaacaaaagcattattaaaaataaatttgtttttctcacctccaagtcgaaaaggagagcttgggcatacgcaaagaaaacattgcgcaattcggagatgggaatttgcaaagatggacgaataaggccagggatattgtactttttggctaattagggaattgaataattaataaattaaatttaaaaataaatccaccggcgtaatttttatagtttcacattacccgatggtatttgaatatattcaattttcggctctgttccagtttacgcgtccaatcaatatttacgcgtccaatgagtgaccatcctcacttttttaaatcataacttttttattacttggtaatccaaaattcttggtattaatcgaaagcttaaagtttagcgtatttattaatacaagaaaaaaacaaatacttacatatattaagaaaaaatttacaatgagaaacccgaaattcataacttttcgcatatattcaagcatagttttttgtcggttgcttttattccagaattttgctatacaaaaacttccccaaattttaagctttcgattagagcacaattttctcccactttttttctatccaaaaatacaaaaatatctttgtttattaatacgtttaggtaatttatcgtacattgcatctatttttcaaaatatatttgtttacgtttgcatttagtcggatcaatttttttttaccgatggcaaagcgatgaaaaaatgcataaaaacagggggggggaaggagcacaacgaaacatttgcatgtttttttttgctacaaatttcctcaaaataatcacaaagcccaactgaacataaagttttgctgattttgtgccgtggtttttatttcttgccaattttgaaattgccaataatttcaccgcatttaaatagataattaaacgaatgatggaattgcttatcatgtcccaatcagtgcttgatcggatgaagcatttgttgagcacgggtgaggacgcggatgtttattttttggtgggcgacggagacgcaaaagaggcgagtcttcaaattaaaaatttaatttattaattataaattgggtaatttagtgaatggtaatttttgttgtgttttttaaaatttaatcctcttaagcttgtgccagcccataagctcattttgaaacacgcttccgacgtttttgaggcgatgttccgttttgatgccaaaaaggaaaaagcggaattcggtaaaaacattactgaatgacatttacaatttagtctctgcaaattaccctaattaaattttcaattagccgccgctaattacattaataattttcaattagcttctgctgattgtcccgtggaggtccccgacgttgaagcagcagcattcaaagtgatgttgagcttcatctatacggaagatttgagtgatttgaatggagacaatgcaatggcagtgctttacgccggtggatttaatttttaatttaatttattaattgttgaattccctaattagccaaaaagtacaatatccctggccttattcgtccatctttgcaaattcccatctccgaattgcgcaatgttttctttgcgtatgcccaagctctccttttcgacttggaggtgagaaaaacaaatttatttttaataatgcttttgttcgaattcgggtttgttgagttcgaaacttgtcgaaattgtgtgagattcatgatccaagtgtaagcaatttttaaggatttttccatcaaatgtttgcgttacatttgtcaaaatgcggctgacttgttcggatcagatgaatttttgcaaattgatcagaaaatattgtgcaatcttctcgagagtgatcgtttgttactcaacgatgaatttgaaatttggaaaactgtaatttcaatttaattttctattttcattttataatttcgatatttttttctatctaggcactccgttggcgcgatgagaaatgtcgtcagaatgtcgttgaatgctcctcgggacatcgtcgttcagtacaatctccagcaaagttcacaattcgttatattaatatacatgatgaggaagatgtaaagtgattcggtcagatttatgaagtcaaataccgaaatatgcacactttcactggttgtacaaggcgttttgcactagtatcgtctgccggttgcggagggaagctcagcagcgagcagttcaacatgacgagatacccggcgagtgcacatcaatcagcgaccggtggtgctgaacccgttgaagccgttccattgccaacgccggctgtggtggcgactatccgtggtcgtcaacacgttcatggacccggaggatgggccagcctcacgtctcgccctttcggcacatgccattggcaacctcagcaactttttggtgccattgcaaggcgacaaccggatggagggtgtaccgttggagaacggcgagtacagcttccggctgcacgcccgggaccggatgggccaggtgggcatcggctttttgaataccgtttttatatgcgagagttggaaaatgacgagaattttatttgtttttcattacccctgacgtgaaatgtaggtgtcataaagagttaattaattgcgatttttttctctaaaggaatagttaaataataattagtaaattctaaattaaattt

SEQ ID NO: 6929 - DNA, 2136 bp, Heterodera glycines
  misc_feature (94)..(94): n is a, c, g, or t
tctgagagccctgattataaccccattttgaggagggttgaccaatagaatcccatcctcgaatattaccccccccccccaaaatttatttttnaattactaggtgcctatctaggtgggattttgatgttagaacaacttgggaaattgcaaatttaaccaaaacattttttttaaataaataacaatcaaatattataaaagttcaacatcgattgcttcgtcactttcgtcttcgcctaagtcgatttcttccaccattttcaacacttcttcttcctgtcggcgttgcttcaaaagagcaagcccgtttggaattgctccgtgcggctaaaaataaaattttcagaaaacaaattaagttagtacgcaacttaaaaacatggattttgaggtttccagctgatgatgttgccttttcgccatggaccatccattcgttgtacagcttccgaattgcttctttgaagggcgcgttccaaccagggctgcacgcaattgcggattgcggattgcggattacggaaattgcgggctttttggacccccgtaattgcggattgcgggttgcggatttttgggatttatccgcaattttgatccgtaatttgactattggattatttttcgagacgatttcttgtaagattattttttataaaatgaatttttttctatttttatttaaagaaaatatgtacatttgtttaaattcttatttctttagcaatttaaaaatgtcaaacttaaatcctggtaattggtggtattattttgagcgtcaaggcaaagcaactgctaaatgtaacccccagtccatctgccttggagacaagacaaaaagccgaagttgaagtaaatgaatatttgctggatccaaaaattaaatccagggccgatccatcattatactgggaagtcaattcacaaaaatggccaatgattggtgacgttgtacggaaatttctttctccacctgcaacaagttcagaaagtgagaggcttttctcaacggccggtctaatttcagatgacttgcgaaagagtttattaccagaaaatcttgcaaaacttttgtttcttcatcacaatttgcttttaaccggtttctcaattgaatgattttgcttttataaatttgctttttaatatgcttttaaattgctttaaaagatttataggattttttaaaataaaatttaaaattattaaaaaatttttttttttaattgcggattacggaaattacgaaaattgcggggtttttggacacccgtaattgcggattgcggatttccgcaactgagaaaatcgccgtaattgcggattgcggttttccgtaattgtaaatccacttgcgtgcagccctggtgggcggtgacccggataataattaatgctgaatttcttctgttttcttacaaatttttttcaaaatgccaatataaatgtatttttgggtatcactaaaattatctacctcctatgcattttttcgtttgtcgaactaaatttccggcaaagtcaatcaacacgtgccaaaatacaagattggccaacaatgagaaatctataaatattcgtcaattcgtcggactttaaaaagaattggtaatttttggaattctttgtaaaaaaaatttatcatatttttccgcaaagaatgttacacttaacgcgggaaacagccaaattgagctctgttactttcttgatcaaaataaaacatttaattttgtcactaattttgtaattttttgaggtaaatattcccaataagtttagccagaattacgatttatcccagtttggtattgttgaaaattatcgcttcaatttaattgtgatgtcagacagtgtgactgcctactttttattattcacatttgcctataatggacaatttttaattatttaacatttgcctgtaatgagcaagttttagttataatttattccattattagtggtgtgagcatttatgactagtggccgtttcaaagtatgagaagaaattaaatgcttggttaatcaaaaaattctaaaagtaataaacataaaatttcgagaaatttttacaaagtctaaatattttaataagtaaggggtcatatatttttgatataaatttatttt

SEQ ID NO: 6930 - DNA, 993 bp, Heterodera glycines
gcctaaaataaccgtcaataatcaaaattttggggttgacctgaatgtatttggtggtgcccctcgggacaaccgcggagtgaaaggccaagcgtcgaagcgttttctttgcgtcctcgctaatatggcagcggaaactgtcccaaattaagagactggcgccgaaatggaaattcccgaaaatcttaatattttggtcataggaacatacacggactgatagaattggtcgggatttctgtgggatctggaatcggaatcccgttttcccaaaatctccgggattcacctggtcgatgttcggtcgggatcccgacttgggatctctctgacgccagcagttgtccggtctctgatatgaaccagccttgcttcatcaaatggtacaaaattttatgccttctttccgttttaatcttccttttttaaatttttgttgagaatctccaaaaaaaataagaaaaaattttgcagctattctatataatataatatttattattttccattttcgtgcaaaaattgtaaaattatcgcttctaaatttcattggcatacgcatgacaaaagggcaacatgccataagccaatgttttactgatgccacagtgattatatttctattactaattcccagagaaaattcaacaaaaaaaggttggcaaagtgttggaaaaatggcaagctatggcccactttcgataaaatgccaaatttggagaaatttcaacgcaatcgcgcaatgacaatggcaaaagtcatgctgtcaaagccgcacgcatatggccctttttggctataaatagatatcaattactattgctaaatgagtggatttaaattaacaatgtttattttgcatttttagttgtcaaaaatatggtcttatttgttattaaacatttgcaggaaggggtatttttctccagaaccgaaagcccaaggggcctatggggctttcaaaatgggttttttacctcctcattctaagtc

SEQ ID NO: 6931 - DNA, 1364 bp, Heterodera glycines
tttcatcggtttgttgggttttaatttaaaacatttatttttattctttaatgagattagtcagtttcattaaagatcgttaaaattaaaaaaattaaaacaaaaccaagatttttgtgtaagcttttttaaatatcaaatttaaaaatatataaaaagaattttcagagtacggactataagaacactttgtttgtcggcggttccggcattttgaacggcgcgtgtgatgtgaacaatgacaaactgaaatatttgatgacattgaagaatggcgtgaccatcaaaaatgccattcttgacacgcccggtttgggcatttactgcgagggcaattgtgtgctggaaaatatttagtaaaaatttaaaaaattccttactattttctttaaattcaaattatttttttaataattctagctacaagcgattgtgttaccatgctactgggttcgggtataagagcaccagcacttcatacacttaccaagtgattggcggtgctggccaaggttcacctgacaaagtatgacaaatcagaaccaattagcaataaattcaaaaataattttgatagatttaattcataataatggtttccttgttttaagtatttcacccaatcgggcaaaggcactaccatcatcaagaatttttgcgctgaaggtttaaccccctctctctctaaaaataaatcgaaaaaatttaaataattcatgttttaatttcattacaccgttcaaaacgtctaattattttttaaaaacatttttcgttttaattaattaaggcaaatacggcaaattgtggtgttcatgcgggaattgtccgttccaaacggctcgtaccgtacaaatttccaacaccgtccttaaggggcccggactttcggttgtctgtgagttgaaaatcttatgaaaaatatttattttaaaaaaaatagaaaatgctaataaattcatttttagcgcttaattccaactacggtgacaaaatgtcactttcgggactgactttgcatggccaaaaatcagcgagcacaaaaacgtcatacatttgccaagtaaaacattcaaaaatgttaattatttaattaaacgagcaaaactcaaccgtatcttcccggccaaaatacgacactagcagcagatcacttatcaaaattttcaattcgaaaaatctcttgatttcttcaataagaaaataaccgcacttttttgatttgggtttccgaatttttttattactatatttcccacaatatttcatatttttgcactaattaaattatataaagaattcaaactttaggagtacaaaggcctcacttatatggcagccatgagtcctcaagcgaattatga

SEQ ID NO: 6932 - DNA, 700 bp, Heterodera glycines
tcaaaaatcaataaatttttcaatttaaggttgaaaattttaaaaatatgattatatgtcgtgttttccttgtgtggcatcctaatgatctagaagctggcttgatatagcaaaatacaatattcaaggccaaaaaattcttgatttatgtaattatttaataatcatgaaaacaaacaagggttaaatttattgcacgtaaattaaacttaattaaaaaattgaaaccattaaactttagacatacaaaggcctcacttacatggcatccatgactcctcaatcaagttttacgccaaccgaatcgggcagtggcacatgctcgtacagtacctcggcaattacaatttccagctaatttggggaaataaaaagaattgatggaagaaaaattgagtgaggagagtaaattgaggtgttaaatgattttaattagcaataattcaaaaaattaattgtcggacgaatataacaaaagataattttgctattattaaaagttcaatgatcaactcgatggtatttatttaattcataagtaggaacacggatttatattggtgctgggacgttagtcaaaaaccatcaaaatgggcgttagtcaaaaaaccatcaagagaataatttttgacagaaaattattcataattttgtctaaaatgtcaaattttataatatagatattttttgatagccctaa

SEQ ID NO: 6933 - DNA, 5027 bp, Heterodera glycines
ttcagaaccctttctgaaaaatatttaagaattaattcttttaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccccgttgaatttgttctttttagctttgaaaatttcattttcttattattttacaacaattgctatccttaaatatttcatcctccctttcccatttttgttttgctcattaattggaaaagaaaatgttatttaaaacaaatttatcaagcaaatacttttagaaccatttgttgtaatatcgaacaaaaatgtataaagcgatgttgcgttaaaggaggagtgacttacaaatccatttaccaagcaagagttatcaactaataagtagtttgtttttgatgagaggcgttacgcacaaaataggcaatcgtcatttgttcaagtgatggacgagacaaataaattttgaaccgagaacagaacaaattatagactcgagcatcataaattacaattggaagaaatatcaaaacccaaaggctgtcagaatcatcaaaaaatatcaaaattaattttgtctgacaccccaaaaagacattaaaaagactaacaatgcatggggaagaaattcattaaaatattgcagcggctttggaaagaataatgtccgaaattttctttggagtattataattaaatcgactggtcgaatagggagaaacagagttgagctgtgttgtttaggaaaaacataggacggaaaggaacatacgcaacagcaaaagataaattgtgagaataaggctatatatgcatatttatctgttttataattcccagaaagcaaatgaaaataggcaaaaatagcgtcgaaaaagctaataaaaagggataagttataatctataaaatagtcagtgaccacaaaggccatagggactacaaacaaagggaacggaaaataaaatcatttgtcattactgagattacacggtccttttttaaggtcgagggtgaagcgcaattgcttttattgtgaaagatcgcatcgatgacacactaagacatcttaaaggacgataaattttatgagttatcatgtagtcctattccttctcaattacctgggcatttgttggctcgggagggtggaattccttcccgttgatttcgttcccattgatctgtgggtcgtccggcggactcggatgctgcttcaaaaggatgcgttcatcgcgttcttcctcatttttcgagaagatagtcagcgatgccatatgggaaaattgatcgttggcagaaataaccttcaagagaagatttgtattaaaagatatggaatgaaaagctgtaattgcctgtccagggaggcaaaaggtcccttctttgtcggcactgccactttcgtcgagttctttcgagaggttcgtcgaattacgcgggttcgcctgagaatttgctgtcatttcaccgtctttctgttgttgcttttggaacttatgcaggtatttcgcgttaatgtccttaaaattacaacagttgttttcaaatgctttttgcatttcgctcacctgaaccaaagccgaggcgtccctttgggggagaagcggattagaagctgaaatcggcaaagacggagttgtcgaagggacaacagaactttccccgttcacctcaaacatttgtttttgttgaataaaatcaattttcacttccctaacatttgtcattccattattctgcgcatttggcgggccattagcttcttggcgagtgcgggcgagaagttctttgatgtgtcgacggcgttcctccttttcttcctggttcgggatgacgatgagcacgggcggtgtggtcgacttcggaggcgttattatgggctcattttccgtcaatggaacgtgctcatacatcgaaaccttgagtagtttaaatgaattttttccaaatgaatggaatttattaaaacttcgccaatggaggaactctcatgggcagtgtaaaaggatgtgttggtggcagttagagtcggagaattctgcttctcctgttgcacttcatttatgatattttggtcagcagtcaacattccctcgttggattgcacttcatttatgatattttggtcagcagtcaacattccctcgttggattgcacttcatttatgatattttgttccgtagtcaacattccctcgttggttttattggtggcagttagagtcggagaattctgcttctcctgctgcacttcttttgtgatattttggccagcagtcaacattccttcgttggtttgaatcattccttggttggccatttttcgctgttttttgatggaattcggcgtttgctttgtcggttgagccggtggcttgttgaaattgttctttctgttgggtgttgtccctattccgtttcccaaagctccaacaacgctgcgagtcattatagacgatcctccagctcttccgtccagcgataatgggttttgaaaacgcgaagttgtcggtgcggtattcgatggtccctaaacagtagaggctcaaaaagtgctgaaactttgatgggtcctttttgaagctccaaatagttgatttacatgactgaaatatcccgtcgtttggccgcttaccccccccccccttttttcatgtgaatggtgaatcactgtgttttgacctgtgcaagtgatggggtcgaaccacgcatgcccatgggagagtttctcgagccaccgctgtctcgttgctgctgttgaatgttctccaaaaaggccaacttgcgtggagtgctgctaccgaacgcataaacaggtttcttcgcctgattcaacgtgacaatacgcgaagagccatgatgggtacgtttgagaagttcctgaagaaaataaagattaaaatttttgtttttcccttgtgaaaacgcaccattttccttgcattcagctgttccatttgtgcacaacgccggtccaacaccgccttctgtctctccaactcacgctgttgtttcattctcgcccggtccctcaactcggcttctttcaactgagccgcacgttccattcgctcatgttgctcacggatttttacttcacgcctaaacataacaatatgaatatgtctacgctaaaatcaaattttgactatcgccctaaaacttacaatttaactacaaccaaattcaacccacttggctcgaagttccctttcaacggcctccttccgcttaagcacctccaatgttttgtctcgtccaatataaagacttctggtcacgcccccgtccataattatgactgtacaagagatgaattaatttcgattttatattaattgaaaggtaaaatgatgtatggaatgaaccaattaaaaataacaatcaagaaaatatgcactttctttgttggggataaaattcgggaaaagcaacaaatatcaacaattaatcacaatgccggtcacttcctgcccgtttttcgcagtttatccttccgttttttaacctttttgggcactttctctgccctcttttctctcttttcatccttaacggtttctttcctcgccttccgcgcactcgacgactcgcccctaacccgaacatatttttgataaacagtcttcttattctttttgagctgtttgtcgtcgttttctccctcatccgaaacatcactctgttcttcgctcgactcaaatggttcttcgttgttcgtatcagaatccaacccatccaaatgttcatcattccctgaatgcttttgtttatcaaaacgtgtatatgtataataccacagaaatcctcctcttccgattttttgacatccatcgttcgtccaatagtcttttgaaacggattgttcagttcaatccctcttttctccatttcatagtcgcgttcgtaatgagtaatgttgtcgagtttgtgtggaatataagccttcatgaaaagcatatcgtcaggaagtggcccatccattcgttcattttggagaatttgttcaaatgccaaatcatcgatcagcgggtcaacaatcgcctgaagtgtaaaggtcctggatacataatcattcacaaaaatagttaatttgtaaacaacacctcaaaaagacgtttcattccgagtacagcggcgtctttgctcttgaaaaaacgggtgacgtttccaatgtccatcctgagaaactccaacgagtgggggtgatcatgttcgacggactgagaaacatcaataataacaagccgttggttgtggagaagcatattgtattcggacaaatctaagttccacaaaaatgctaatgcaaaagaaaagtgcaatgaccagcatggacaaggtgacatgttctgtacataacacgcataattttgacacagtccaagtacagcttgtcaaccatgtccggacacagttcttctactgcgttcttcaacaaaggagccgcacatccgtcttcaccaatgaattccattacaagaacatttccctttaaaggatcatttcgacctaattttaataattcgttaggaccttcaaaagaacgggttttggcactggcagtccgacaagaaacattcgctgcaaatttctgacttccttttcagcccaaactgccaccattttgcgagggttgcgacgacaataaccagttcgatagctaaataatcattttgtcataaaattgagattgaatgtaaatggctgtcataccgaaactccccggtcacatatctgtctctatctttgaaggtcaaaatgctggttttatatacttttactgcccaactcccgcttttc

SEQ ID NO: 6934 - DNA, 1336 bp, Heterodera glycines
  misc_feature (149)..(149): n is a, c, g, or t
gaaaagagtgaatcaaaggttctcagcgctaagagtcaacttcaatgtgacatttcactcgaacaattcgacgaaggatttggccaacttttggattgttcttctctctccaaaaagatgattaaggtgaaaaaattcaaattttactntaagataaactcttaatattttatttttgcacagaaaacaaaggaagatgacaattgcaaaaaattactgtgtgctttgcattgtcggtacaattgctttggttatttgaagaaaattgttgtgctttttgaacgtgtttgtctaaaatacgaacaaaggaagttggagccgtcctttctttttgaactttgtgttgagtctgttctgccgacaaagaaccaacaacagattttgtcttgtgagtgccattggcaaatattaaaacaataaatcttctgtttcagctctcagtttacgccaactttgtcttctcaattgcttggtcaagttggaatcatcggggtataaacaacgcatcgatttcacttaccaagaaatcgcaaaaggtgtctcatattattttttgtattagtattttattatttaaaaaatttttcagggtatattaaattcacaaatgactatgagaaatcgatgcgagtgtgcagttttgtgctgtatagagacttggacgaattggccgctagtggcgcactgagtttggcgaagggatcggattttggacaaatccaattcaagtgagaaatgttggcaattgtgaagatcattggtcccaaaattttttaatttaatttttttatcttaaaattttttaacacttttctgggggtgttttgaggagctgagcacgaatccggcctccatttcgaccaattccgaatccctaacccgaactcgaacatttttcgagaattaaattttaaaatttcttttaaaacatggttcttagtgttttcggggttgctgatcacgaatctgccattcattttgaccaatttcgaataccggacccgaactcgaacaaaaagtcggaaattcaaaattatcaaaattcatttttatgttcgtatctttacagaatgaccattttttggatttgaaatggtttttatctaaattaacaacaccgaaaacgttaaaagcaatgttttaagagaaatttgtaaaaaaatataaaatttaatttttgaaaaatgttggagtttgggtagggattcggaattggttgaaatggagcccggattcgtgctcagcacctccaaacacccctagaaaagtttttaaaaatttttcaaaaaaaaaaattaattaaaaaatttcgggaccaataatcttcacaattgcc

SEQ ID NO: 6935 - DNA, 4659 bp, Heterodera glycines
ctcattatgtgccgttgtccacaatttcgcacatttacataaacggaggcattgagctgtattcggtgggcgatggatgaaaagcattcaaatctttgatgttaattttggattttcatttcaatttttgcatgctactgaatgttgccaggtgtcctgggagggtcggacatattctgttccgtacgctgccgacattcctggcaatttctacccgggccgacgcctttacgtgtcgggagtgttcaaaaaacgggccaaacagttcacactcgacctttgtaaatgccaatttggcctttttattgcaggaaatgaatttaaaatatttttgaggtgccgatgccaacattgcgcttcgtttctcgccaaaaatcaaagcgccaaaggcattttaatttgacacaatttcatttgtttgagattttaatgcattgttttttaactgtgtgcagaaagtgacttgcaactcgcgggcagaccaacaaaagtgggagggcgaagaacaattggagcaggaggaggacttccctttcaaacggagcaaagcgttcgatttgctcgtttactgtgaggattcgaaggtgggcaattggggaggaacagcagcatatgatggattgggaagggatcggcggatgggatggataaaaaggacaaaaagagagggatgggtgggggaggggggggggggcgtcggatgtccgtccgtttgattcgtttgattgatggacccctcgcccatttcagttcatcatttatgtggatgattgtctggtcggaaaatacacacacaggtgggtggagaggagatttttcgtgaaaaaacaaacaaacaaatattagtaaatgaatttttaaggataaatccacggaccatcgacaggtcaatcactctcaaatcagtcgttaattatgccatggaattgtctcaaaatataatgtgtccatttcagactttgtatcgaaggtgacattgtcttgcatggtgtccatttgaaatgatttgaaacacttacttaattaatacttaattaatccaatagccataaatcactcacacttttccgccacatattatttgtatgtatttgtatgcaaaaagtatgggtttggaagggatatttcacttacatttctaaatattcgcctcttatcatattcgtattttttcggattacaaaagataattatcctctgctcatcattttacaattttcatttctatatttgttttgttatttttcatttttacatatattttatttccccttggcttttggccgtgaaaatgttactaatacaaacacaagtcatgtaccaaaatatattcttcttattgcaacttttttgggtttttaaacttaccatatttacagtaaattgagaatacaaataaatgaaagttgaagtttgaaatgatcgattgttggagcatgacggagacggactgaattttgaccttgcaaaatttgcaatttttgctgcggagtttgggtggtgcaatgacgggttaagaaaaagggcgggtgaaaagggagaggtaactgaacgaaagtgccctcaaatgtgcaatttatggagatgaatgggttggcgggtggcccttctctgggtggtctttgcgagttaacatttctgccttttcctggtcccctgcggggtcattttccgccattccgtccaatccgtcgcattcattcggtggcagccgttttattggcgtagtctttggtctccgccccttccattgggtggccctgccatccatccgactgaataaacaacaaaacgtcgtccaattgataggccgcctccactctttctttagccaggcgctgataactttttattatcatttaaaatatgtatcaaacattttgtcatctcataaatttttcacaaaatacataaaaaaaataattaattaaccgatttgttttatttttgtaattatatttatgcgttgccttggagttgtaaatatttaggtaatatttccacaattttccatttctcccttcctgcaaaagaaatgtcgaaagaatttcgtcgattcgatgatgtacaacttcgacttcgttcatttgatgaacgaatgtccaaagtcggcaccttgggtgctgctttattattttaaaattaatttcgaattttaattcccttctttgttaagatgtacctcccgcacaaattgtctcctccactgtccgtccaatctctgccaaatcgacaaatggcgacagtgccgttttggtgccctccacaacgatggcaccaccgtttgtctccagcacagccgcaacatccgttgagagacactcggcggaatcatcggaagaagaggagacggacaaacgtcacagaaagggcaaaacgccattgagaggtacggacttccaagccaattaaatcacaaattgcgaaaaagcaatttcaggcaatggcggactgagcatcagtgccgtttgggagggagtgaagcgaatgatgggcttcaccgccgactgccataacggtttgtacatttttccaaccaaaaacgatatatatgcatttttatattataaaatgaaaatcgactgggacctgctctaggacatggagttttcctggaccaagaggccagacaattggccattttggtttttctttcgaggggctggcttctctgggttttttcctaaattgccgttctccagtaaacgccccttttctcaattgtcaggcggttacaaaaccatcggcggcgattgcatttgcccccaatttttcgagggccatgcctgcgagcgcattgtctgcgccaacaacggcacgcgcgtgcgagtggccgcgttcggcggggaggaggtgtgcaagtgcactcatccccagtacatttcgggcaaacactgcgaagtggtgcactgccaaaacggtgggaaaagctcatcatcactgggaaaagcgattttgcagtggacgtattttctctttctttgccaggggggcgccttctcaacgacggcacgtgccattgcgtggacggatggtacacgggccaattctgccaggtccgttgttcagctagggccttttgatgggttctttttattagggaaggttttcctcatttcttttccattttgtcttttccctcttttaaagccaccctttctttttcagttttacacttcctcgtggctaatcgcctttggcattccgttgttggtcatcgccgccatcgtcttttgctgtgtgatttgtcgcttggatttgtgcgcattgcgccgtccttcaccgcctccgtcaagccgtcacaatcgaagttcgagctaaatagtcaattttctttttttaacttttaattgtttccttggcttggcttaggacccaacggacgtcggagtggccaaaacggcacacaatcggcggccgcacccgcggggacgaggcggtgccgaagcggagaaaatggcagagggaatcggcaccggcgcgaacaaatgccattccgtgggccattagcgacgaatgggacggaactgacacagcaacgcaaccaccaccaacaacagcatcaaatgttcatgcaggtgaacaaaatcggatgggaatgaataatatggcaaaggacaaaaaattatagcaaaatttgctgaacgatcgtcaccaaaaccaccaacagcaacagtacgtgcttcgactggaacaagttccggtgtacaacccgcgccttttcgccaccttagaacagtcaaaaccgttggagccaccgccgccgtatgaacaggtcgaattcgaatttttctgggtccattcaaaagcgtaacagggaatcaagaaaaggggaaagcgaattgtaagggtcaaaaattcgacaaaatgtaatgttttcaaaaaatcaccgacaacgcctttcaggtgtcattttactttcagtttgccaaaaaaaacttagatgtaatgggtttaatcaaccgctgttttcttatccaattggtgttgcttatttcactccttttttaggcaattcggtgtccacaacaccaacaacaacacaaccaacaatgcccaccaatttattctcctgtacaaatgaacgaggccaacaatgaaaatggaagggagacaaatgggaacgaaatgagaaatgctgacggaatggacagagcaacacaacggcaaagtgatgacgaactccttgaacttcttcggttgaggaggcaaccgacggatggcgacggagaaagaagaggaggagggacagatggaggaccatgacaacggccaaaagcgaaggatggcacaacaacagaaaacgatggcacgggggaaataatagtccggtaacaccgtcatgactcatctttaggaagtttttgtctacctcaggattcgctgtcaatgaatgaattgctaatttttaaacatttgcatcccctcacaatttaaccttctcatacaaaaattggggggaggggatcgccggtgaaatttttcttaaatcgaaatctcaagacgatcattttttggacaaaaaaaggttgatttacatattaagaaccccttcggaaaaatttggttgaccccaacctgcattttttatatatgaactttctgctaatccaattttacaagcattgtgattgtcctttactgtctgttaaatcgatt

SEQ ID NO: 6936 - DNA, 2041 bp, Heterodera glycines
  misc_feature (58)..(58): n is a, c, g, or t
agtgcttaaaatgccattgaacaacatcaaagtgaacagcaacaaaactcacaacgcncagctcttggccacgatagtcgtacataacattggcaaaatatttactggccgcagccaccgaaatttgcgtaccctcgcgaagttcgaaaagactgaagtgccaaagggtcagaaataaaatatgacaaaaaataattggatggggcgaactggcaaaatggccacagaaacggacgcacttgcaatatttgctcaccacccgcgtccaatactgacagtccgctgcaccgcctgccatcgtcgcgaccaattggtcgttgatcggaatgattttctctaccgttttggagcctgaattttttggagtcaataattatacatacaaaaggagagtctcagaccaaagacggacgattaagacagcagggggggcgtagcgaaaggagaggaaaatttgtgaaaaatcctggctgatttcataataaatccatcaaatttaatgagggcttactatttcgtccaaaaataactaaattatgtggtctttaaggaaaaattttgacattatgaagcccatgccgatgccattttataaaaacaacaaaacaaactgatgtaagttccgcccgttgcacgcgaatcgaccgccacaataacgccgcctttgtcttgcggtgtcttcggcttgtacacaaaggacagtgtggtagtgcccttcagaaactgcgccattggaagccgactgttcggcccaaaatgtttgcgcacaaatttttttggctaaataaacaaatataagaaagagcccgagggatttataaatgttaagaattatttaccttaatgccgagcggaggcattacaaatttgggaattgcaaggtcgtccatttgtaccaactgttttaactctttatcatgactattttcgttgtcgtgcaagtcgtgataaaacatgacggacgaggagaaatttacttaaaccaatcacacaattaaaccctaaaaaagtacgggcaggaagaatgaataaacaaacgaagcactgcaaaaaatcacacaaaaatcaaaatcatcttttatttaaaaatctttaatatggcgttatgttgtttttccgctctaaagaaagaaaagcgtctctttttgccaaaagcctttaatcttaaattcaaatcccattttaattattcttttagcgatccatgaaacgtcaaaaatcattagcacaccgacgaagatcacaaaaggtttccgtttcaacggtgctgcaaaaaccgttgaaggtttctttctctttggcactcactaagccggactcatccagctccgaaaattgttcttccgatgagccttccatttgcaagaaaaaacgacggagtcgccgggtcaaagtgttgacttttgtattattaatttcgtttgttttctttacaattttaaaacttttaagctaccagtaaagcaggttgtcattccgtcctctgtcaaaaaggagacaaaaattcaatcgcttccaaaggaaacaacaaaaagtcaaaaacccaaaaaggaaagccaaacgcagccaaaaagtcagaagaaatctcaaaaggaacatcaacaacctcaaaagaaaagtcaatcgcctcaaaaagaaagtcaaacgcctcatccgcctccgatggaggggccgtcggtctccgctttggtgccgaacactgcggactgcaaaaggcgcgttaattttggcaacgtggaagtgttcagatttgaatttgcgcaagggcacgacactgtgccggccaaaggaggcgtctctttgggtatttttaccttttactggatactccttaataattgatgttcatacgcaattcccatagccaaaaaaattttggtgaggattttattcttaattttattatttgttcccgaaaccttttacaagaattagtagccgcttttcgccaaaaaagagaataaaaattgccattttttcctgtaaattttaattttgcatttcagaagcaggggaatcccccctggctacgggcctttcc

SEQ ID NO: 6937 - DNA, 1230 bp, Heterodera glycines
aggaaaatattaacaggtcgctggattatattatctcatgaatctgtgtctttatctcttagatcaaactgtggtgctattttcggatcagcagtaagtaattagtgctgcaaaatatcaataaaacattatcctatactaaatgatcataatgttgacaaaatcaatactgatcgccgcggttagtctctgttccgtgcgccagtttacgtgcatttttatattttggaaaatcatatgattttttgagaattaataatgagtttgtaaaggcacttttaaatataccagatttatagaatttggtcaactgagaaaaaagttatggttttttaagactccttggcacggaaacgtgcgcatggaactgagtcgatccgtgatcaccggcatcgatcacgcccatgccaaatctatctttatcaaatattgatcaacggcacaatagaatgatccaaatcaatagtttacttgatccctgccaacacacagatgccgtgctgtgctgatcattaaagcagacccttccccccccggctacgggcctgctttttttacagactgtcgctgacgagtcgctccaagtggcggaaacgcgttcccagtgcggctgtcgatgtgaggggcaaaagtgcgtgccggagcagtgtgagtgtgcgctcagcggcattcggtgtcaggtggaggggcgaaatgaatccatcggagtggtgccattggcactgcccacaccattttggcaccatttgtttcatctcccaattcactgccttcaggtggactacctcgacgagtccaacccctccaactcgttcccctgctcatgttcggcctcctcctgcggcaaccccgagggccgtgttgagttggacccgctgcgcattcgcaaccacttcttgcagacactgatgcgactgaaggcggcgaagaaaatggtgccgcggcaatgggggagggaaaaactgaggatgggaaattactcaaaatcggacaaagatttagcaaaaattgacggattgtgaagctggaaaaggccgagtgaatggagacaatttttaattgtattaagggaatggacgaaagtggcgaagtgtcttccccgcaacacatccttttcaaggaggaagaggaggaggacgacaaatcggagcagggcacagagaaggagaagaaagggcgaatagtccgaacatccaaccgacaaaaaggggacggaaacagtgcaaatgg

SEQ ID NO: 6938 - DNA, 1212 bp, Heterodera glycines
gtattttcgaatgataccaaaaaatcagggtttgttggaacataaacaaagttattgtataaaaaaccgggattgtcaattgattggacgcataaaagtccattggacgcataaactgtactagagccaataaaatcaaaggtaaaacgaaccatcctcgcaacgcgggcctagcttcaggcgttgactcgggcacagaagaaatgtcaatgtcgattttgaagaaaattttttgacgatctgaaaaaattgcaatactaaataaaaacagcgattcacccaccgtcggcgaacagttcaagatgattaacgtactttcgcagttcacccagcgccattcgtgtgtaacagacgacaaccgttcggttgtagaggtcacaattatcatcatttctaagtgattcagactttacaagacaattaggttgaaaaaacgaaccgaataattaaaacagacatcaattctttttcacaaacgcttgtttaatgtatcacaataaagaaataaaatgtttactggtcagagatcacaactaaattatacaagcaaataccgtatatgtatgtaatacacgtaatttaagtaagcagattatgcgagattagtgtaaaatgcgtttcaaacatgcgataaaataaagttagaactcaaaaatgtttggctgtcaacttttttacgatgccttggaaaggataaaagatttgtgtaaattttaaatttaaaaatatagaatttttatttgtaaataaaaggccaagtttaaatcttatttaaaagatgcaaaatgcatgcacaatgggcagggttcccagatctgaggctttagcctcattttgtggttttttgataggtcagtgaggctaaattttcaaaatgaggctttgaggctttttgtggctttttgagaaattttgaagatttttgaggttttttttgaaaattcgtcagattttttataatattgattaattttgataagttggcataatgttatgtttttggccatttttgtggacaaatctgttaataaattgcattaataattacaaaatttttcccggcggcgcctatcggcaccgccggaccccccccccaccccttgctcccaaaagttttttagtaaaagcgccgcaaaaaaatcaacgatttttcacgctcatcagaattttacaaaatgcttatttcgaacaaaaaattgctcaaattgatca

SEQ ID NO: 6939 - DNA, 3839 bp, Heterodera glycines
ccccccccccccccctgggaccgtccctgagggggggggggggaatttcttaaacagcggaaaagaaaaacacttgcggtgtctatttcaattcccgtcgtatctccgatattatgtcatatcgtgtaaaattttgtttcaattcccatcatttcacgacgtctcatcgtatttaggatcatcttttataagatgggagaaaaatcgtaaatacgacgaaaaatcgtgaatatgatgtaattctgtttcaattcaatttgcatgatgtgatgtcaaaatcgcgtatctgacatcatggaaacacaatttaaatgatttttttgttttgagaatttattattataaaaaaattaaattgcttaaaattaattaataataattttttaatgaataaattatttttaatcgagttgaataaggggtaaaatactgtatattaaaaagaatatgataaataaatttgggttcaaacctactagttgcattccataatttagaatgtatttaaaaaattgttaaaatcatcaactaccaatcataaattgaaagaattcaatctctgcttatgtaggccaaattcagcaattgattcaaatttttcttctgtgttccaacgctcaatcgatgttttggccaaagagtcagcaacatttgaagcaaattccttgttttctctgttctatatattttaaccgttttgctgtcagccaatttttgcctataactctttcgccaaccgccgttgctgccagcgccgattgtcccatcttttgtggattttctccgtcccgttcggccaatttatataaatcaaaatgctattttaatacaaattttaggaatgacggataataatagattaattgttgcccaattagtttccgataaaaaaaaatatactttttggtgcccttagcccagttttaacccgtaaagacaaggagcagtgttgggaaagtattcgtaaagaagcaattgccggcgtatctccgatatgatgtcatatcgtgtaaaattttgtttaaattcccatcatttcacgacgtctcatcgtatttaggatcatcttttataagatgggagaaaaatcgtaaatacgacgaaaaatcgtgaatatgatgtaattctgtttcaattcaatttgcatgatgtgatgtcaaaaatcgcgtatccgacatcatgaaagtgaaaatcaaattgtgtaataatgtaaaattaattaaatttaaatggaaattattattattaaatatcaatgaatattatttttaattttaataaagaatacactataggtgtccaatatataaaccaccctaaaatttgagttctaaaaatttacataaacatgcaaaataggaacaaaattaacttatgtaaaatagcaattcgaaataatggtctacaaatttatgacataatttacaaagttgatgtaagtgacttttttaatcagtatcaaaatttcggttgacacaattaaaatataaatgtgtcataattagagctcgcaaaaaaaggcaccaaaaatcgcgaaaaaggcaaaaaaaggcataataaaagtcaacatagaagcctcaaaccaagtggaaaatgtgttatttatgcttaatatatcgaaacaagtgcgcagaaaaaaaggcatatgcctcaaaatgcgagctctagtcataatttagactaattgaccaaattttttaataaaattattgataattttaaagattttttgaaaatttttgtgaaaacctttgagcttctgaagaaattctcgagaaaaacacagtaataatcattcacataattaattatccttttgaattttatatcattagaaagaggagacttcactgtataaaacaaaatttttttataatttatattaaaatttaaattttttgtgaattttttaattttacatgacgggaccaaatacatgggttgcaccacggatgaatttacgatttcttcccttagtttaatcgtatatatgatgtcggatatacgatggtcggttgttaattgaaacaaaatatacgacatcggacgttttttccatgatgttacgatgatcgtatatacgacatcgggacgatgaattgaaacagaaatatacgacatcgcatgttttttattgaaacagaattacacgatgcgatgtcgtatcggagatatgacatcacatcggagatacgacgggaattgaaataggccccaggaatgtttaatggttgagaaagaaaaaacttattgtccaaaaattcgtccagagacttttcggctggcgaaattttgtcctgctgcgcctgaaaatatagcgcatcacaattttaagttaattttaaatttttaacatgaaaattgatgacagttaatgcaaattaattcatgaaacaaatatgagtaataaaaagttcttttttcaaaaataatttctttaaatcactttaaatttttcgtcgagccaagacattgaacttattataatatgcattaaatcgcttatcattcgattgaaaaagcttttattttttggtaaatggataaacataaaaaaattaaaaggtggcggcaaactacaaaattaccaattcagaacgaagttctggtacttttccgttttgggcatacaattcaaagtttcaaaatttcaacaaaagctgcgctgaagggacaattatatgccttatttttaaaacgaaatggccctcaaatttatccttattaaaaacccaaatttaattggacacattttaaaattttgagatgtaggcccaaaacgaagttcttatacttttaacctaaactacgatactttaggctttcgtgggggaatttataggggggaaacggcgggggggggggggggagacggaaatgcagtgcatcccgaattggtggtgtttttaggacgatcaccgacaggtggcccatgaaattgcggtaagcgcttgctgtcgttcgataccaagtgacaccacccaccagtggcggctttatttagaataattttttaagcctaattatgttttaattttaacagctccgaatggttaagtcttatcatccgtttcgaagtgacagtgataaaggaggaaaaaatcgatgttgattgggcagggcttttgattaattatgagtagggtcgcaatttttagtgatttaacattttttgctcaattgttttggcgaaagaagctcaaaaaacacatttctggattgaaattttggtactcgtgggttatctgcctacagatttttttctcaaaaattcatctcctaaatttatttatttttttgacaatttttgatttaaaaaattaattatctcaatactgatttggcttaatttttttactttttaaaatagattttgccattacatccttaaattttaggatttttagtgcctattttcaatttttagtgcctattttaggaattttttagagcctaaatactacctattttgacagttttatagcctaaaccccatattttcaaacaatgtacacatatttggtaattattttgtttagaaaaaattgctaaaaagtgcttttccgccagtaggacttataattttgaaaaataaaccgtaaaaattttaggtgctgaagagcaaaactctttagcattcccctggagaattaaaataattccagtaatttttgctatttaattttcttttgagtgttttatgtgtaacttgaagaggtctccaatgaaagtttgaaagttcccttgcgcccatcaaaaatccccgttcttctcctattcatataaaaaaaaaaatgatcataccataaatatcaaatcatcatacaaaagattatgag

SEQ ID NO: 6940 - DNA, 1006 bp, Heterodera glycines
taataaataaaatttgtttaaaaatcccttagattgtattttgtgagccaaaaacattggcgagattgttgggtatttgttggctcaaccgcggtcctcaatccatctgaaatatcccttccgtgtgtttaacatttattaaataaatggaataattgataaatgcttttttatataagaatagtaatatctgaattttgtttacattttggcaccagaatttaaaagatttcattttgacaatattttgtaaatattaatattttatttttaatttaatttaatttaatttcgtataaagtattatttatttatttattttattaatctccgatagactgaaataattaaaataaaaccttttttattgcaatgtttgtctgcttctcactggctttctcatcacaaacaataaaaatagtttatcttttgccaaatgcaaagcttaaccgatttcgcggggggaacttagggccccagaaatttgagcaccgagaaatttgggcatcatattaagtaaggattttctttaaattccatatattaataagaattttactcataaattggtcaaaaatcattcatattttactatatgtagccttttaaagaaaattaaaaagagaatttgttataattttgaatttttaattaatttttaaattcgaaattaattttggtttttttggcttgcacaaacgaaatagtcgggtcgcattgactcaagtgatatcggttcgtctcggtttaaaaccaaaaattaaggaaaaatagggctccaaatttcccagatcgcaatggattgatttcaccgttattttttataatgagctcacaatgtgctttcgtataatataccaaattttatcggagttatacaaatttaatcgcttccgaaattaacagccaatatcggtccaaacttacgctggtctcaagtggcagttcgggaggtgctacggactatttcgtttgtgcaagccaaaaatggaacattatttgcttt

SEQ ID NO: 6941 - DNA, 1083 bp, Heterodera glycines
atccagttttttcatgagacaattatgaaaattgaaagtctcacactttttttctgagatgtcaaactgcttagcatttgcttagaaaaaacttctcctcattaatagctttggaatgataccaagattgtccaatttggttggcaaaaaccttcaaaaatgattttcaaaaatcgttattttttaatttttgcacgaaaaataattaaaaattaatattcatgttgcacaacggactcgaacctccaccctctttccctttactatcttacaaaaaccacttcgccacagatgcaaatcttttttgaactggaagcccaaatgactcggtgtgtacaattattctcaaattgttaacctgtcgaaccttttttgatttgcgcttttcatgtgctcccttagggaaagtgactagagcatcaataacagaaaatacagaaaacaaaattattagtaagaaaaggttggtggagtgcggacagaaagatcacggggatcgcgcatcgcagattcaaattgccactgtcgcggataacggttgcactccattcctggtaagaaaatggcacaaatacaaattattttatggtatataagtgaccggtcgaagtatatgttgacaatctaattttattttaaatttaaatatcgaatgaatttaattaatgaaacaataaaatttttaagtggttattatcactgaagaaatcccttactgatgaaatcacttcagacgaattcacatgttaccaaaaaagcagacttcgattttttgttctaaagcgatttactaatgtgtggaacagtcctacaaactgtggagaattggtttgggcaacaaagcgtaccgatcagaattgccgcgggtcaaaaaaatttcgggtcggccaaaaaccatcgggtcgggattcgggtttcgggacaagaaaagtcgggtttcaggattcgggtcaattaaaatttatatatgtttaaaaatcaatagaaaatttttatcaaataaaaaaatcgataaaaaaattttccgcggcacgctttttcctaaaaaaaatttggggactaggaggtctgtctggtggtgcc

SEQ ID NO: 6942 - DNA, 3496 bp, Heterodera glycines
taatcggcaaattatgcgaaaattttattcaaatcaacaaaaaaaaacaataaatttacaaaaggtcagtatcaaaaatcggaagtttttgatcatcgtgattttgtgtttctttcttgtcggctgttcagttttcgctttcattttcctcttcgaatgtttcgttgattgccgtcccattcgccattctgtccaacccattcttctgaggctggtcacccgccggatcccaatggaaaaactaaagtaataacaattaatacgactaattgtcagcaaaggcgccaggctgattgtgagttgtccaagttaatttctccgacttgcaatacctttttcacatcagcgcccaatccgaccgtttcaatacgaatggatggacaatgtttcgcgacgaatgcctccaaatgttcggccgtctcaaacgctttttcgcaagtgaatgacccaaacaaacacaacaacagttcagagagatcgtcgcgcttaattcgcaagcaaataatcaccatggaaaggcaaaaacctccaaagtgcgacggagaaacatcacatcgttggtcagagtcgccattcgcagaaagtctctctcgaaaaccttagtaaaaatcatgaacacataatgaaaccaatttgaatttttgctaatgtctctttatttactagtaaaaattgaattgggtagctaaaaaaaatcatttttgtattagacgttctgtgaaattgtataaaatctacatttcctgcttatctcgtaaaatgctatctgcaaaacatgcaaaaaacatcagctcaccttttttttgggctcctttgtaagcgtctgcctttgttcttcgacccgacggttggccattatgctgtccaaatgtgctgacaatgatttgctgatttaaccaatattttgagtactaacaaatgtaagcatttatgcctgcattccatttattttttcttcacaaaacaattcatttgatttgccaattcgtcgtgaaatattccgtcggctaattcagtaaattttttcttttcctcgcccatcagttgctggtaaagtatttccatctcttcttgactggtctcccctttcgccgtttgctcttccccaagtccaattggcagtccggcattcagaattcgtctgtccaattcctgatcatccagcgaattgaattgctcgagcgttgacgcaatcattttggagagatattccggttcgtcgtcggaatcgaataatatttcctcatccgcccttaattttgactatgcattttcatttatgcgcatccttttttgagtctccaaggaaactaggaaaagcggcgctactttgcaaagggttccgaattttattaaaataaagggaggaagattttgaagtgccatttgttgtacgatgataaatgaccattaaaaaatgttttggcatataattaatacaaaaatatgttgagaataccaacctgactgctatttgaggattggccgtactcttatcttttttgccaccagaattctgattttgctgcgccatatactgttcaaaagtcattactttcgttttcttttgtttgtcatctgttgggtttaattcaaaagggtcatttgaaagtaactaaaatagaatgctggtcaaattattttaaaaattaactttacttcgttatgcttttcacattccttgcggtaaaaatcctctgagcattttatgtgctttttacatcgaaaacaccgaagagaacaataaaaagatgaacattgtgggcatttataaagatcgagtttttcatttgggcagaatgagcagcttttaaatgaagacgagtccatcttaaagtcttaaacaatattttgtgatcactaataaatgaatagtgcgagtatacttttgcttttgtacataatgaacggcttttagtactctttattagagcccggacgggaccggggcgccgccgggattttttccaagtcccggtcccgttcccggccatttcaaaattccgggctctactctttattgtttgtattaaatacgaatccggtctaaaaaaaataccaacaagcaaaacagcatgtttttattttatactcacgattagagaccggaattttgaaaatgccgggaccgggcccgggcttcgacaattagccgggcccgggccgcccggtcaaaaaaaaagcccgttttaccgggcgtcccgggcccagtccaaaattttggccgggcgcccgccgggcccgggcttttttcaaaatttttggaattttgattaacaaaatttaaaaaaaaactttcttttttattttagcttagaattatatcaagccatgtaaatcgacctattttgcttttcaaaaacttttttaatggcgcatttttttgaaaaaaaaattgaggtacaagggggtacggcggtgccgataggcgccgccggggaaaatttttgaaaatttgtgtgtgatttgttaacagatttacaccaaaaaatgaccaaattttgaaattttgagctaaatttttgagaaaaaaaataatatttttgtacaaggcgacgctgaggaaaaatcttgacttttaatgaaatttattaagaaaattggtaatagtacggatggtacccccctttttcgaaaaacaaaattttgaaattttttttcgttaaaagacaatattaagagggttttaagggtcggagaatccgaatctgacattaattttgacctatgtcgaaccccgaacctgaattcgagtaaaagtcgaaaatttcaattttccaattttttatttttggtctaaaaatgacttacatattcagaacaaactaaaattggacaattcactaataaaaaatcatttcaaccatttttagaccaaaaatcgtcctccgtctcgccccactacttgctccgtcttcgcatgctcgccaaggcgggcgctgcgcgcatttagaaatagatttctggcaattagaaacaagaggaatcgactgattaatattttattgcatttttgtgcgttttaaggctttggacggttcagtcccacagccattttgccacttcagtcctgggtctgtaactcaccaggaaatggtcgcccccgaaaaattctttcattataggcctagaggagtcgaatgatatatcatttatatataaattcaactacgtcagtattcttcacttttacccaatttctggtcaatgtcaaaaaattcctctgatctgaacaatgcttctgcattttgacaaatataaagcaaacattggtgggaaaaagcctaaatatttatctttaaagatttagacaaaaaagccaatttgtgtctttgggtcataaattttaacacattaattaattgcttggaaaaatttttttgcgacgcgattttttgaacaaaaactgaaaaaagtatcattactaattattaagcctatcattagggggtgctttgctcgaagttcgaagctcaaaaatctttaagttttcaaa

SEQ ID NO: 6943 - DNA, 598 bp, Heterodera glycines
ggcccggcaaaagcccgccgggcccccgggcccgtccggtctctactcacgatatctcaccaatgagtactaaccgaggacgaggacgtgtgtctttatcgagtggaggtttcgaccttcgtatttttagtgtttttaaatttttagaccattctcaaacttctgaatatgatggtcgtggacgtgggatgtattcttttcaccaacaggacgtgaaaggtgaaagtttagtacaaattttggtaataataaggctggttcccccttttttcgaaaatattttttaagttttcaaaagtcatgaaaatatgttttcaaagcttttcggggtcgctgattacgaatccggcatccatttcggcctgttccgaatcccggacccaaattcgaacaaaaattcaaaattttcgatttttcattagcgaccccgaaaagccttgtaaacatgttttaataacttttgaaaacattaaaaaaaatttctaaaaagggggggaccagccttactatggctctacttcagtttatgcgtccaatcgttttttatgcgtccaatcgctttttatgcgtgcaatcaaagttttgtgagtccaattaa

SEQ ID NO: 6944 - DNA, 2411 bp, Heterodera glycines
  misc_feature (2342)..(2342): n is a, c, g, or t
  misc_feature (2355)..(2355): n is a, c, g, or t
  misc_feature (2368)..(2368): n is a, c, g, or t
atgcaagtgagtttcaaccattttaaagaaaaaaatatcaattttcgatttttttagtggattttgactatcatctggagaatgatgtccaaatgtcgccgaatttggacattgacgatcaacaaccgccggcctgggccgcaacagcagaagcgggagtccaatgcgcgacacaaacaacggaagcctcaacccaaaccgactggaacatccatgcttttgggaacagtgcactttgcgaggccaatttcaagctacaacgtcgtgttgcacagctgcggcaacaattggctgagcattttaagcggtggcgggcctatgcatgtcactgagtttttgccacaatcaccacgccgcgacaacattttcatggctcttgaactcctggcaaaactccaatcatttgccgtcgctgatttgctttctgctgatcaaatcgctgatttccgcgccactgctgatcaattccgtgttcacatgttggagcacttacgccgccactgttcgacttcaaaatttcatcatttggtccaccatgcccctgaatttgctgaaaaccatggattttggtgccttctcagtgagcagcctgtggagaaatttcacgcgttgttcaatgacgatctcgcgcgcaaagcaaacaccaaagatctccatgatattttgatgttctgtgctagagaatctgccattcgaaacgccatttttgattcaaatgaactctgatcagtcttttgtagtttttttataagcttattatttatttttgttgttatttttcatacatttttcaattttttatatttaataaataatttgccctcacattacaataaatgtttagttttgctgtaaaaaactatattttctaatgagtttttatgattttaaaacatttgatcagatgaaaatataatttgtttttcaatttgagtgtgttggcgttttgttttacgccaattattttttggcaatttctttcgttttttaccgtccatgacttgttttataggttttcggggtcgggaaaaccgattctggcatctgttttgacccaattcgaaccccgaacccggattcgaacaaaaaaattaaaatccatttttccacgaaaattcactttgtcccaactataatttcattgggtgaccatttgtacacgtgcgcttggcgtgaagaagcccgcgttcttggaaaaaaacgatggcgtttcatcatttaggccaattttgaactccggatcaaactcgatttcgaataaaatgtcaataagtcttttaaaattcgcattatttcgaattcgtataaaaagaccaaattttggttatgaaatgtttccgtattgattttacgcttgttaaaaaataatttatttcaatcaatctaaacacataggtatacataaatgattaaatggacaatatggaatatgcgcaacactatacacaataaatacatacatactggttcgacttcatttcctgatttttagattaagctcgtcaagagctttcaaatgataccaaatttgtggggattcgatggtttaaaaaaaggtagagtgcgaaatctctcaatttttcgagttttgaaccggttcaaaaaccggttttttggcatttccgcaactcgagacatatttttccatgcttagctccttgagacgaatcgatcggtatatcatttgaccctttttttcacggggcgttcactacagttcacccgtgaagcggctatatgtaaaaggttggaggattgaaaaaaaaggaagaaacactggcgaagtgcacctgcgattcgcgtgacttctgatgtcgtaacatgtccaggaatattgcgcattcggctacgctgaacaacggtgtttttttgagcagggacattgagcaattgcgtatgtcgatgagcagtgtcgaagatgagggaagcgacggaagggctgatgaaatggcaaagttgcaaaaatggctctgtgagtttgttttttgctgctatttataacgaaatttatgcgaccgaaaaaatagaaaataataagccgaaaattgagtatataaggcggtcttttcaacgttaaggacacatttcataacggacggacggctgctagcaacgcgcgatggcagtgcccttcagccttcaagtggacggccttatctacagagtcagaaactccacttacgggcaatttcccttagatgtaattgttttttgcttttcaaaatcgtcattattcttcccttccctttttacaggtgacggagcacgacttacgccagctttgcgatgccacgatggacgtcttccggcagcagcagacactcgtcaggattcaccgcccngtcacgtctgcgncgacatccatggncaatttcacgacctgctgccgatcttctcgacgctgggccccc

SEQ ID NO: 6945 - DNA, 3869 bp, Heterodera glycines
  misc_feature (57)..(57): n is a, c, g, or t
  misc_feature (73)..(73): n is a, c, g, or t
tgaaagtaattttggacttaccccccttttccttccctcaatggtctcacttaatcntaaggaaaacatggcncatttgccacggtttggtctgaccgtgttcgagttcttacaatggcattggacgcgcttattccgttggatgattttttggccgttagtgaggtgcacataaacgaggattgtcggcatgggattaaagttcgtttgttctttggagatagttatcgttaagcgtcagattgatttaattaataaaacattttttgatttttatttttcaactatatttttcgagctcataaattttaaggaaagttgtgccataattttagtctttcaatttaattattattgttctggtgcctaattttatggctccgggggtggcacgtacggatttaaattgcaaaagtggttcttgacacaactcaattgccaggcaatcgtcgaggacaacggattggtgttggaccaaattgccggattcattcgcggacggtcgttgcgcgtgtgcgacgtcgtgctgaatgagatgggacaactttcggctaacccttactgtgaaaatgtgaggagagcggcgctgcatcttcgcaacgaaagtccgtgagacactccgcctttctcccctcccctcccctttttttattcccctcttcccctctctcactcttcctataacccactctattcattcgttttctgttagttctgccacactttactcaccgggccggtgacattgtccaacgagttgccgaccaacaccaaagtgatggcgagcgagagtccaagagggacgtcgacgaaatgatcgatgcgtgtcaattggtgcacgaagcagtgacagacataagacacgcgatgctaatgaacagaaaccccgaagacgtagactcagacaacgaatacgaggaaggcaagtggaaaaccgacgcaaataacatttttatttgaattgttggttatgggtttcagaagggactcagccagcggattcaagcagtcaagcatcagcctctgacatggagaaccaacagcaaatcatgaggcaactgccggaagagtccaaaagagaaattcaaaaacaaattgacgtgtttaaagtgagtgaattgataatgacaaatgataatgtgcatttggtgttaatttttcttttagattacacaacgcaaatttgagtacgaagtcggaaaatgggacgaaacgggcaatgacataattgcattggccaagaaaatgtgtcagataatgatgaacatgaccgacttcacgaagtctgtttgggccattgaaaatatatgttaaataaaaaaatttgtttgatcagaggtcgaggcccatacaaaacgacgatggatgtgattaaggcggcacaagaaatttcggaaaacggaggaaaactgaacgaattggcacgtcaaattgggaatgagtcggtggagagcaacaccaagaaggacctttgcgcctatttggaaagggtcactctgttttgtcatcaattgaatgtcacaagcaaagtgcttaatcgaacaatttcttttgcgacccatcctctgctggttcaggtcaaagcggacatccaagtggtcggagacgaattacgagtcagcggattggaggcggccacttctttgatccaaaatgccaaaaatctgctgaatgccgtcattttgactgttaaatcagcttacatcgcaagcacaaaggtcagttttgttaaggcgaaaggatttacgacgaatgaaccgctcaaaaactttttcagtaccgacgaaaagagaacaccaatcccaacgtggtcgaatggcgaatggtggcgcctcagaaacagccgcttgtcagtgcatctgctacaaaagcgcacggagtgatccgccgtgcctccgtatggaaaggggcggcaaataagggttcactacgttccactcattgaaaaacttttcattagaaaaaacaatatttcataaaatgtaaaaaaaatgcggggtgggggaacagctcccggcaaaaaatgtaaaaatgaggcttattttaactgtatcaaattttaaaggaacggcgccaacctccgccgatgcaaacattaaaacaatttcacatatcgacgtgaatgaacggcaaaacactgagaaattccataatttaataatttatcaataggaatgcaataattcgtgctgatttgggataccctcttaaaaccttcggcataacaaagcacaataaacgagtcaattattgtaagtatttaaaaatttaaattcacggatcttaaaacccctcaggatttaaaacctatcttttttgaacaaggttgactcgttgtgtgcagtcaatgctcatttttcacttaaaaagaattcactccataagataattattatttttttgaagacccaaactctgaataatctgatatccaattgccttttgtaatttgttttttatttcaattcaaaatttatttaaatcgcagtaaaataattatgtgcgtcaagggcatatattgatattatttattcgaaaaaggttacattccctgcttattctctcttgtatgcttttattgagattattttcgttttagggaatggggggggggaggaaaggaaaatgtgtatttatttggttggggtggcgagtgttgggaagtgccgggtgagagaaggggaaaagggaaggaaagaaagaggacaaattcggttcattgggttcgagagagaaagagtacggacgaatggaggggaagagaagtcattccttctcgtttctcttcccttttctctcccccaccctcgctccgctgccgccgccgccagcgattggctgtgtcgctgacgtggaccaatgggcttgtgccccggcagagtaacgccggcgtgcgtttccgcggtgtgcacttcgcgacgctgcaccacatccaagccacacttttcgttctgattgctcaaatcactttgtgtgattgcgattggaaaagactcgctcttgacaaccaaaaaaacattacaatattatcaattttcagatttacaatctcttagggatgctcagttctttccccttattattgtccttggtcggcctcatcgccgtccacgccgaagtcttcttcaaggaggagttttctgatgacagttggactgatcgatgggtcacgtcgaaggtgattctgggcattagtgcttcgttttggtttttagtttggaacattcagagcaaggatgattccgggaagttcgatctgtccgccgggaagttattcggggacaaagtgcgggaccaggacgcgatgggcaatcagcgacggtacggttgtgcctcatctctaactagttaaggacgtcggacggcattatcatcgcaacatctgcaacgacactgattgctgtgttcattttgtgtttgaggccaaaatatagcaactcccgatcaccgcaaaaataatagcggatgaaacagcaaaataccaaattttacaacaaatcagtgcctttaccaaacaaggatggccgcaaaaatttgacgacattaaattgtctccttttcttccaaaaagggcacaaatacccgaaatcgaaggatgcctcgcctacggtgaacgaattatcatcccttcgtcactccggaacaacatcctcaaatcattgcgttttgcacatcccggcattgtgcgaatgaaagcaattgccaggaaccacgtttacttgcccggaattgactccgaaatcgaacgagtggtgaagcaatgtgaggaatgtcactcagccgccaaaaatcctacaaaagcgaatcttcagccatggaaagcagcaaacgaagttttcgagcgaattcacattgatttcgccggacca

SEQ ID NO: 6946 - DNA, 4664 bp, Heterodera glycines
atttattcaatatttttcgtgaaaattttgctaaaaaatttttttttttggaaaattttccggtttttgaggtcaaaaaggccaatttgtctgttgggggccgttctattagaggttttttttaaaaatgcccaaatatgcacgaaatgccaaaatatgcacaaatatgcaaaacatgcatatggaaagtcatcctagaagcttcaaaacacgctaaaaacatgtttttcgtgcgtttcaggcctcccacagtccaggaaaaattcagatttccaaaatttttgggcagtcggacttccgattgccaaaaatttcgatgaacaagggaaaacttcgacaatttattgggatttggcatgcttccaattgtatttatttgttagatttgtactaatttagagtatccaaatcttagaaaataattttattttttaaagataaaatttttagagagcaaataaacaaggcatacacagcaaagattaactaagtaacttaaatagtaaaaaatttttgaatgatgtaatttgagattttattttgtcattgtctcttttattttcgagagacttaattggcctgggacgagaatggcggaacacattgacttaatagcccttctcggccataactttctccgctgtctctcccccaccctcgctccgctgccgccgccgccagcgattggctgtgtcgctgacgtggaccaatgggcttgtgccccggcagagtaacgccggcgtgcgtttccgcggtgtgcacttcgcgacgctgcaccacatccaagccacacttttcgttctgattgctcaaatcactttgtgtgattgcgattggaaaagactcgctcttgacaaccaaaaaaacattacaatattatcaattttcagatttacaatctcttagggatgctcagttctttccccttattattgtccttggtcggcctcatcgccgtccacgccgaagtcttcttcaaggaggagttttctgatgacagttggactgatcgatgggtcacgtcgaaggtgattctgggcattagtgcttcgttttggtttttagtttggaacattcagagcaaggatgactacgggaagttcgagctgtccgccgggaagttcttcggggacaaagtgcgggaccagggcctgaagaccagccaggacgcccggttctacgccatctcggccaagttcccgaagaagttcagcaacaagggaaagccattggttgtgcagtttaccgtcaaacacgagcagaacatcgactgtggcggcggctatatgaaggcaattaattcaaaaatattggaacgaatttccagttcttagctcatggcttctgacatcagccaagagaacttccacggggagacgccgtaccatctgatgttcggcccggacatttgcgggcccggcactaaaaaagtgcacgtgatcctcggctacaaaggcaaaaaccagctaatcaaaaaggacattcgctgcaaggtgggcacttttgttgttcattttccagtgattcactcattcgttgcttaggacgacgaactcagccacctgtacacactgatcttgagcccggacaacacttacgaagtgcaaattgacggcgaaaaggtcgagagcggcgaattggaggccgattgggaccttttgcccgcaaagaaaatcaaggaccccgacgcgaagaagcccgaggactgggacgacaagtgaaccaatgggactttgacataaacaaacgatgccatccatattcagggaatacatcgacgacccggacgacaaaaagcccgacgattgggaaaagccggaacacatcccggacccaggttggacagtaacgagcggtctttgctagttgtcatatgtctgctttgagatgccaagaagcctgatgactgggacgatgaaatggacggcgattgggagccgccgatgatcgacaacccggaatacaaaggcacctggaagccgaagcagatcaagaaccccaactacaagggcaagtggatccaccccgagatcgacaaccccgagtaccagccggacgacgacctctacttgcgagaagattggggcgccatcggaatagacatttggtgactgacgctggaccgggtgggactggcgctttaatcaaccgaagttcaggcaggtcaagtcgggcaccatcttcgacaacattttggtagcggactctgtggaggacgcgaagaaacacgcggcggacactttcgaccagctgaaggaggcggagaagaagcagaaggaagcgcatgacgaggaggagcgcaagaagttcgagtgagttttgttggattgggtgatgggagcaattgtgggagatgaacacgggaaattcagggaggaagagaagaagcggaaggaagaagaggagaagaagccgaagaaggacgaagaggaggttgaagaggacgaggaggagaagaaggaggaggagcacgacgagctttaggacggcgcccgaccattggccttgtcactttccatcctcaatgattgcaccttcccgggttctccctcatctcttcttttcggttccaccttaataagcttcccactttacttaaatgtgccctccccccgtcgcctcttcaggtatttaatggcaatttgttatttaattggttcaagagggactgttcgatgattccttcgaccgcccacaatggtctctctcaccgcctttttgatatttctttctgaaagtgaataatgaatgaatcgctgactcccatctttcctccgtgcttgttgtttttcttttgttcttttacataaaaatatttattgtcccaatttgaaaataaattgttaatttgtttaaattttttattggaaattcgaaagcctttgcaattttcactttaattttataatgtttaatgtcaattaaacaaattgaattgtcactttcattccgcatttgtctgaaatgcgacgcaaaaaccgtccgtcacttcgcccgtgcaaaagcgttccgtcctcaccgcaaattccaattttttgggggcgcaaaaaacgccgaccccccaggggcccattgccgattcgtccgctcgtttcagaatggcctaaatattttgttaaaatgctttcatttgccccccccccttttcacttcttttgcctctgccatttccaagtgcgaattctgaaggggtttatttcatttggtcttcttaattggtttccgtgtcttctccctccgttaattacctcttccattattttgcccaatttcgcgtcgcattttcccttttctccgtccctttttcccttttctgtgcctttgtccaacaatgtcctcagtccgaacactttcttcctctccattcccagccgacattgcctttgggaacggccaatgcagcagttttgcacgggcatttgcggcgtggcgaaagggcgggacgattggatttgagggcattggcattggccgtacgattgggaagggaatgggaaccggtcctgctgctgctggggttgttggaattgttgctgttggaagggcggttggaagttgtaggcggagggactctgctgctggggcacgaacgactgacggagtgccgcggaagtcgggtaaataaccgggggaagcacggcactccctcccggcgctgtcgcgtatttcgacgacaaaaatggctcatccctcgacgctttcgactctttttcaaatgggtctttcaccgcttctaccgacttttctttcccaatttcatttgcaggaaatctttctttggccgaaattggcactgaatttaaaaaagtaacaaatcaaaggcgaaaatggcaaaaggaaaaaccgggcaaaggcgcagtccgcgaatattcgggcatcccaatttggtaggaggaagaaatcggcgatggaaacagcgactgttgcggaccggcgccgaacggttgcgaagcgtaagaggtaaacgcggagggaaagggcgacgcagacgcactcggaacacagcaggaggacggcatttggggttgagggaacggaagagaaggggagccgcagtaggggcggggaggcgacgggggcagcggcgaacagcacggggacggagacggcgggatgggcatggacggacacggacaaggggaggggggttggcattgtgccgaaacagagccgaattcggaacgggagatgagtaacagagccagaagaagggaggcgcgctgcatggggaaaagggactgggagagaaacaatggcagggaatttggtggagggagagaattgaggaagggacggcggggggggggggggggcaattcatcctttaattggacggtaggcataacacggcgcgggttggggggattaacgtgtgatttcggaatgaatgtgcacaagcaaagcaaagcttgagcaattcaccgcttaagggggagggggtagagattaatgaaccaaaacaagggataatgggaggacgaaaagcagcaaacactaagcatgacaatgaagcaaaacaattaaaatttaagtatcttttttagaaaaagaagttttaatggagccaaaaatggtgctaatagagggaaatggttaagttataataaatatatgcttctttaatcacaggaatctctctaaacattttgctctttctctggacc

SEQ ID NO: 6947 - DNA, 3969 bp, Heterodera glycines
  misc_feature (3900)..(3900): n is a, c, g, or t
atttttatacgcaaacacaaaaaaagaacgtgtttttcctattatttatggcatggaaaaggcaggaaaaaaatacatttgcatgtttttggcagccctgatatttaatatgcctaatatttttgagtgttaaaaactaaaaactgccaaaatatttaggttttcggttctaaaaacctcaaaataggtgtaaaagtttcaatttaggggtataaaataacaaaatttttgaggaaatttttcatttctcaggggtgtatttttgaaaattagacgaaatttatgtaaattaatctttatattcgggttcggggtccaaaatgggtgccggattcgctgcaaacaaagtgctggacacattaaggctgctaaatttcccgacacgaggaccaagactgagaatcccgagcagaattactggatatttgccgctgacccacaaattgtccaagccacgttttgtccaagccaagaattgtccaaaagagtaaaaacccacgaattccaaaagtctaaaaaactcataaaaagccggaaaatgggtctattttagggttttcggggtcgctcaatcaaaattcgaacaagtttagggctcctatgtgatccgaattccctctatagacccaccctcagcttcacacaaaaataattttattaaacattcaataaaattcattacgggacatggacaattgaatcatcaaaattttcaaatccttcaattttcctgcatatccctcaatttgagagtgccggcggaattggaaaatgcggtgcccgaacgatttcgtcctcccatgctgtaaatgaatctttttattgagtttaaacggtttaattgattaaagaattctgcctgaaggcgctgtcgaagtcgatagcggactcaacaaatattgaacaagctgctcacgtggactcacagtggttggccatgtaagagttgatggtgccggtgagccggtgccgaactctaggggtagccgcatagcttgttccgagttgatagtcgaaattattgtcccgagtgtagctaaaaattttaatttttgaaataaatgcataaatctaacaaacaatggttgcgggtgggtgaaaattgagtggattatctcaaaatgcgtcaacaccatccaacatctggcgctgtgtcaagccgatatatgttcgagagaagtaaaggaagaacattggcattccaggagaagatctcacccaaaattggtttttccgcgctcaaaggtcattgttgaaagttcagcctcgttcaaagtctgttattcaacattgccggaagttatcacggcatgcagttcgtcaatctccactccaaaatttacggcctcctcagttgggtttgaaatgctgacaaacaaagcttcttccgacttttttgtagactttcaagtttattactagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgggtttttagtccatattttggccattttttggaaattttcacaagaaaaataaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttctttttttttaatgagaattttttcgaaatttggcaaacttggaggtgtttttgatacaacgaacaacaataaaaaatatgcatttttaagttttaaaccccattttttagttgtttattgtactttttaggtttatttaagcaaatattaagtccatatttcgcgttttttagtccatataatttacaaccctatttattacgaatcatttgttcaattaatgaatagcaaaatctgaagacaaaaaaagcacatatttttaatcaaatttggagatttttcttattcgggtggggctagggttaggcaaggggctatataaatgtcgtattggtattcagcgaccccgaaaaccctaaaatagacccattttccggctttttatgagctttttagactttggacaattcgtgggtttttactcttttggacaattcgtggcttggacaattcgtggctttggacaattcgtggcttggacactttgtgggggcggcgcgctgtcaaaatgtccctgcgtcataatgtcccctaaggtttaaaaatacgaaataccttagaaaatttatcaatcataaaaaaacaataaaagctgctaaaaagacaatgaaatacttccaattaattgaaaagataacaaaaaacagaaatggacaaattttaaaggacatgcatggttgaaactaattttttcatggtcctttattttttctgggtgtccctcgatatgatgactaagagggaatgaatttcggcatcgtttatttcggttttttcgctaattttaattggggacattttgactgattttagcttgggggacattatgacgcggggacattttgactgattttagcttgggggatgtcgggaccaaacagaggcaaattcggcccggcaaaaattttggcaaaatagaaattgggacaaacagtagacaagcaggggaatgatgttttattccgactgaacccatttcaataacaattccacgacttaaatagggtgtcattcgctgattaatacatttttgtgtgagaaatgaataagaattgaatgtaaacaaacaaatattttttgaatagaacgacgaagagggggaacatttccaattaaattaaggtttttcccatttttaatgaaattgcatcatgcttataaaatttatcatttccattttatttctcgtgacgtgagtcgcgacactccccacagcaaagttgtcggggggttcagttgctgcaagtctgcctgtatgttgttgttttatttcttatgcctcattccgggttgtctgtgctgagaaaggcgggcggttgattttggttaatcgtaaaatctgtgaggtgatcagttgaccaggctgatcccttgttgcttgtgaagatccgctccgcggcggtggacagcgatcagttgaccagactgactcctctccgtcctgtcgcccttgtaccagcgtctgccacccgctgatcacaagcattcatcagtgcagaggttcccggccgttgcaccacttgtcgggaccaaacagaggcaaatttggcccggcaaaaattttggcaaaatagaaattgggacaaacagtagacaagcaggggaatgatgttttattccgactgaaccgatttcaataacaattccacgacttaaatagggtgtcattcgctgattaatacatttttgtgtgagaaatgaataagaattgaatgtaaacaaacaaatattttttgaatagaacgacgaagagggggaacatttccaattaaattaaggtttttcccatttttaatgaaattgcatcatgcttataaaatttatcatttccattttatttctcgtgacgtgagtcgcgacaaataatgaaaatattagatagtgcgccaaaaggagacaaaaaattagagaaaaaaagataatgtttttctctggcactctctatttattggtacacatctcgttttttgaaacggtgtgtttaacaagtgtaaatgaatcaaatagaataatttactgcggtgattttaacgccccaaatattgattggaacacaaataaatattatcaaaaaatgacccaattggcaatgctttcattgactttattganacaaaatcattattacagcacgtaaaagaaaccactcgagaaaagtcgatttttggatttgattttttt

SEQ ID NO: 6948 - DNA, 520 bp, Heterodera glycines
catgccgtacacactacaattaaaatcctaatttcattttttcatagcgctcttttaatagtaatggccgagaatatttaaatgttaatttgagttctagtcaacattaaactttttagaaatgaagtacccaccggcgcttggtcatttagaaaatttgcacatttacaaataatttaatattattttgctaaatataaatattcaggaaatccaagttacccgcactactcaagcaattgttcagttgtccaaacaaaactaacatgcaaattccccgaattccaagcccggaactatattaataataatttttaatgtacaagttgttgttgttgtggttgttgtagtagtggtagtagtggttgttgttgttgtactagtagtagttggagttgtagttgtagttgttgtagttggagtcgtagttgttgtagttggagtcgtaattgttgtagttggagtcgtattgttgtagttggagtcgtagttgttgtagttggagtcgtagttgttgtag

SEQ ID NO: 6949 - DNA, 3741 bp, Heterodera glycines
  misc_feature (3622)..(3622): n is a, c, g, or t
  misc_feature (3699)..(3700): n is a, c, g, or t
atttccttaaatccaaaattgttattggccaacaaattttttaattttaatttattttatatttaaaaaacaatatttttataaatcatatacttttttctctatagaattaataaggaacagacttatatagacaaaaaatcataaatctagatataatcagagtaatcgcataatatagaattcctgggaattagtgtaaacctaagaatttattgtcaagaaaaaaatattcttaatatgcgaattaaagaatccataattgagacaacctatttatttttaactgaaaaatattgaaaattttaagccgaaaatatatgaaaaaaagaaaatccatataaatccggtccctaaaaattaaagaatcggcagggtgccattgtcatataatttaaatagctgactgaccaataattaaataaatgttgctgaaagaattaattgtgcgggaaaaaatccactctaacccattaaagctgcttttggtgaaaaagtgggttgtcgatgatttcggcgaaagagcaatgtcaaaaacaattcataaaaagataagtcatatacataattaatagtacatatttgcgggtcgtggtcgttttcgcgtggggcgggtttttggactataacttttttctttgtcaaccaaatccaaacaattatgtactcgatagccttaatgtcctctattagcctgcaaaattgtgaaaaatttcgttaaggttcaaaaaagttatgtccaaaatactgagaaaaccagttttttgaattcttctggccataatttttttgaaccttagcgaaattttttaaaaattttgaaagccaatagaagacacttagggctatctaatgatactaagattgttggatttggttgacaaaaaaagttatagttaaaaactcgcccacgcgaaaacggcctggtcctcatatatttgcgggcagggtcggagtcagttcggcgcggactgtttcggcgccaccaataaatattataacttttttctttgccagttaaatttatcaaatctggcatcatttgaaagccctatgtttgtgcataacattttcatgcgaaaaaaatcatacaagtgaaaaaaagttatggcaaacggcgcctaaaaagccatgaaaaagtcaatagttgaggtttttggtcataactttctcgtgcaaatagcaaagtttttttgaaattttgcattctaatacagaatattaagaactatatgaatgctgccaaaaatatctaatttggttgataatgagaaaagttattagcaacggcgccgaaagggtcggcgccgaactgggcggttccctacggacaactatttctggaagaaaaaattttaaaaaatcataaagaaaaaaaaaaattgtttttctttgattgggtaaagcaatcagcattgaaatttatgaatctctggatttttccgaattttatgatatcatttataaatatggagatattcctttttaataaaccaaattaggtatataaattcttccaactaataattataccaacagtttcaaatacttaaatgtttctatcaaattagacactttgttgcacttttaattggcttaatggtatattggaaaatgtttttttcgggtgcggaactatttgttctgagctcggcttaaagatagcttaacctgagttaaatgtagcaaataatttggggttgtgtttgtataaatagataaagcttttgcttttcgtttcattcaaaattgttgcaactattatttaaattctatttttattaattgctatttctttataaatttttaatttttttgttgaaatcgaaaatttaccgactgccgataagtaataatttttagtatttaattcggcatttcatttattttttcaaaaaaataataatgtgttaagttatttagcgtatttcttctattaatagcctcccctctattagaaccccctctccaataaagctgttaaaaacgattttggagttatgccaaaaaatgttttctgttttttagtaaaaaggttaaagcgtataatcgaattccaaaaaaaaaaataaaataaaatttcttcttagaatgcgtatatggtttaataatttatagatttttaaatttatttaccgttataattgttttataagaatataaatttaattatttgaaaaattgagccccctgcggctctattagaggaaatgcttatgtaaatcgatttgcaaatatttgttacctaaaaaaactattttggagttatgccatcattttcattttctatcaccattattcttttcgtcacattgaatgtctggtatacaaacgcttgtatgcgttcaacagcgggaactggatcaggcactggatcaggcactggatcaggcactggatcaggcactggatcaggcactggatcaggcactggatcaggaactagatcaggcactggatcaggaactggatcgagtacgttatttaaattgtaaaattttggaaaaaacatccctaaaattaaaaaaatttgccaaaaattcattccataaaatatattttttaaattcgtctgatttaaaataataaaattttaattcaaatttgttaaaatgcattcaatttttagcaacaccacctcaaacatgcacagatgaggcgactgtttttgcaaatgaaaacaatggggtgaaaattatttcaaaattgtttaattgaaattttttttgattttaaaattcaattcagtgtgatctgatcacttgtcctgctggaagaacgtgtggcattctgattggatttgctaggcttggcaccggtccatttgaaccatttctttacccaaaatgtgtgtccaacccgttggaattaactcgtaacacggaacaaaatggcaacgagaaaatccttacaaatggcccaggagtaattaaaatcttaaaataaaaataaatatgtgtggtttaacgcccttgggcatttttgcattagtcattttgcctatgcccaaaattaagttttaaaatttatgcttttccaatccaaaatagcttaaacaatttctgcgatttaatgattatgccatttaaattgaaaaaatatataaatctgaagaaaattttgggtttgacgcaaatgtccggggctcttcccaatattttgaacaagactgtccgagattttttttgtatcattgcttttttcgaagactcaattttatttcattttttatctttattttaaatattttaaattatataaattattttattcttatgaatttttagtgtaactgtggcacgacacaatgtgccgctgggttccagtgccaagttcggagttccatcgttaggcttggcaatcgaccatttgcacaaataattggaggtgcgaatgaaaaaaagattttttaaagagaaaattgggcatttttttttgcgacaaaaatctggcgatatgtctcttaaaaaatttaaaattttgaaattattttccatttgtatttatttgactttttttttgtaattttttcaggattccctcaatgtgttggcaattatagcatataccaaaaccccttcacaatagttccttacggaccaggggtacgtttatttattanaattaaaaataactaaaatgattattatttttttataaaaatacaaaaattatttacattttcgattttcataattnnccgatttatatttaaatttaaattaatagtgtgctgaaatt

SEQ ID NO: 6950 - DNA, 3502 bp, Heterodera glycines
tttgacgcaaatgtccggggctctttcccaatattttgaacaagactttccgagattttttttgtatcattgcttttttcgaagactcaattttatttcattttttatctttattttaaatattttaaattatataaattattttattcttatgaatttttagtgtaactgtggcacgacacaatgtgccgctgggttccagtgccaagttcggagttccattgttaagcttggcaatcgaccatttgcacaaataattggaggtgcgaatgaaaaaaagattttttaaagagaaaattgtgcaattttttttgcgacaaaaatctggcggtatgtctcttaaaaaatttaaaattttgaaattattttccatttgtatttatttgactttcttttgtaatttttttaggattccctcaatgtgttggcaattatagcatataccaaaaccccttcacaatagttccttacggaccaggggtacgtttatttattaaaattaaaaataactaaaatgattattatttttttataaaaatacaaaaattattacattttcgattttcataattcccgatttatatttaaatttaaattaatagtgtgctgaaattccggcatgtttggaagggataacatgcgtgactgctgttggcatcgcaaaatattgaaatctgcagtgggctcaagtaaagaaaaatttttcaaaaatcttattttactaattttttttttttagtttttttggcccttttgtgcttgaacctggcgctttatcaaatatataaataaattcatttacaaaaatagatatttttaatagcagtttcttgttatataatatatatagattatatcaatggattcactaattatattttatgataccgaataattaataaatatgttcaactaattagcttttctgtcatgcccaattaaaaatgtcagtgtctttcaattccggatattatcatctaaaagattgaaatttgctttgtcggcttcagcttcatatttttcaattcattcataactccggcacgatttccatcacttttaggcaaaatgtccacaataaatcctttcttttcaagtttttccacattttttgcatccgacaaatttccaattttaaatggtggttgaaattctaaaattaattaaaattgaataaaaaatcggaaaaatattcaggcattttctgataacaccgtttgaaaagacttcttttttactcaatgttccttccttatctggatgattgtggagaatggatgacaattttgctataaaataaaaaataatttattaaattattaaaaaatttaaaattaaataattatttaaaataatttttgaattttgaaattattataccctcaaaactgttattcttcaaaatatttcgattggatgtcgcgggacgcgcaattgcatcaatccgttgaaaaagaacaaccatgaaataaaatgtaaaaaaaaaatgcatttaaaatataaaaataaaaatataaaactatatttattttaataaaaaatacatttcatttctataataaaaaggaaattaaaatttttaaataatgaggcttttgaaaaaaattattctttaaaaagtaaataattttttggttggcaaatatatccgaccaatttcctgcaattaatggattttctttttattattttaataaaaataaatgcatctttttcatatgccgcgtttaaatttttctctcaattttgacactgtttctccgattacattttccattttgattcaatttttctttaattgcttcaaatttttgaactgtttttcttttttgttgatcatttatttgttctttttcgctctttttgttcaatttttatcatgatgaaatgtgctgatcatgcaattttggtgaataagtgaaagtattttttttaggattgtttgggttttatacaaaaaaattgtttaaaattataatagataaatatttaaaataaaataaattttgatcagtgtgatcatgtgcttatttaagagaaatgtagaaatgctttttttgtatttaagtaaaaaatcgattttaaatttaataaaacatttaacgtaaaacattaaaaaagggtagtgtactggcatttcatggagtcaacaacttaaattgaaaataaatttactaagtattaataaataaaaagccgtttcaaattgaattataattttcatttaatattaaattaggatacccatttggtatttaacagtcagcattttttcttggaagaatttatttccaataaaaaaatattttcttaaaattaacataatgatattacataaccttttttcatgaaacctttattttctaattttaacaaattctaattattttccatttaataacattttttatacgaaatatatcattttagcctgaaatgttgttatctgatcaccaagatggattgatctgatcctttatatatatttttacaatcaaagaaaccttaatttgaggttttccttttttagttcagggcttttttccgccctttcattgaatttagttagatcagtaatattcactaaaggaaaaaagttattccagaatttctggaaaaattcgaattttcagaaaaaaattcataactcggttctgaaaagatattctggaaaaataaaatactacaaaaatccgcagtttttagctctattatataaattttatttggcatttttatcgcttttttaagaatttttataaaaataaaagtgattttgagattcgggcaccaaaggggtgagcataggatttttgagttggaaaattttttcaccaaaaatcttccaaaaacatgtctttaggggttatttgggccgctgatcacgaatacgtgatcagattttacttttgacatcgttaagacctcagaatccctgtgtgattggggattctgaggcatcattttttgggggggggcaaagttcgagtccggacggtgtaacattatttttctgtgcatttttacgttattttcaatgattttaattaatttaaaatattttgttgagttaataaataaaaaattatatttaaattaatttttttttgatgaatacattttataagtttaaattaattattttttaattgatagaatttcatgtatttttttaattaaatttgttaaaaaatattttcattttaatttaatgaatttactaatcactgttgtaccacttttaatcaaatttgtacctcttctaatcaaatttgtacctcttctaatcacagttgtacctcttctaatgactgttgtacctctcctaatcacagttgtacctcttctaatccctgtaaggtcaacaaattttgaaaaacgggcgcgaagcgcccgtatgagtttaacaaatttaaaaacgggagcgaagagcccatatgaaccaacaaaatttaaataacgatcgctaagcgcccgtccaaggctaataaaatgaaaaacg

SEQ ID NO: 6951 - DNA, 3366 bp, Heterodera glycines
attcaggtcacatccaagcgggagcgaaaaccaagcaggcaaacaagattggtactcaaaatgatagttatagtcgaataaaaaaaatgaaaaattaaatccttgaatccaacaactagaattttatttaaattacataattaaaatcaacaaattcaaaagaattaaatttctatttaatgttataattaacctatttaaaccgtaataattcaatctaaataaaatatgaaaacaaaactcgaaaatacaaattgtaaaatatgaataaattcttaattcaccatcaataattctaatgaagtttggaccctgcgttgaggcagcgcaaaaaaacatgggatgttgaattgtgtttttctcaaaataaatgaaggtaatcgatttcaataataaatttaaaaaaaataaaaaaatatttgtaggtgaaattaataataaaaaagactttaaaattaaaaatattataaaagacaattcttccactacttttctagttatatatttatgaatatttacaattaaatttttattcaaatatattaaaagttcgttatctttttatccattcgttaaatattttttctacaatttttataattttataaattgtcgatttctattcattttaatgttctgtttggtcgctgcttttcctattataatcattcgtcatctgttgattattaactttatcattttaagctgactaaattaataattaattgatgagaaaatattttactaaaattggcttttttgcattgcatttttaaaatttaattcttaaattatattcaactaaagtatcaaagttttcctcttctttaaacaaggaaatacatatgtaatccttacttttatatatcactttttgtcataataaatattaatgaacgtgatgattatttatttaaaattaattttaattttccatttttccaatattcggtctcgttgagtaaaattaaaagatttataattattttttacatttttatatttgatttcctagatcagtttttctcattttatatgaattgttttggatttgtttaagcaatgattcctcaaagaatataagttcggattttaattcaatgaaaaaataataaacaaaatccatttttctcaaaaatatcttttgaaacgttactgtgtcttttattttcctttatctttagtttcagtttttatgctatttcctgtttggggatatcttcattacaatgagtcatagttttttgttaaattatgttatattgttttcccaattataatttttaaattataatttaatgctttgttattaaattcttattatgcagaaatattctactattaaagtacattatttaataaaaaccgtataaagttatgaaattattcaattcgatgaaataaacagtacaataagttttgtatgcttatttctagatttgttatttaaatttattaaaatttctaagtaatctttttaggtttatatatcgaaaataaattattcaattaattttactatatttatggacgagctccatttattatttgttatgtccagagaagatttaatttccataatttactattttttatcgaaataaggtgacaatattttaaataatttagttttcaaagaaataaatctttttgaataatttttctaaatcaattggtttattaattattttcttttattagtatttttatttgtattttatttattttctttccgatttatgaacatttactcatgacaatttctcgcattatgaagaagaagatccacttaatattttttgaattttattttaatttaattttttttccttttttatattttgtgaatgaatatcgataacaaagataatggcgaattgttataattatttaatttactttttaaatgttttggtttatatataggtgaaaattagtgtactttttttaatttagtccaattcttaatgatgcaaaaatgactttttaaatgattttattttgctaattaatattttccactttacccaacatttagattattaataatatattcatttattcaaattaagattattttattgttttttaacccattgaaacttggcgagcattaaaatgttttttttattatttgctttaatttttatttgatcattaattaaatcaatcataaaagttgtttgataagaatctttttgaatttgtatttttgattaaatatattaacaataaaaattcatgaaatcaacagtcggttcttttcggtatatttaatccggtaattattttaaataattttttaccattaattaagattttcttttatttcaatctacaaatattttccacaaaaggggttgaatgaataacatttttaaatttaaataacacaattaaacgcttatagccttcacccatccgacataaattattaaaatagttgattttttattaatactttaaatttgttttaatttcccttttaattgaatttttatttttaggtaaatatatgaacaatattgaaagttggtttttgttcgtttaatttttgtattctaaatgctcttacttgcttttttgtctttgttgttttctttaatcatgttcaattgcgacgtatgctttgcggaagctgcggaagcggaggcggaatctcctttttgttaaatgacaaaaatttttttagttgtaaataaattcaaaattctaaaaattattttcactgtttttcttaaaatttttttattcattatactattgaaacttttatgagtattattttacacccattctttccataaattatttttataaatatcagcattaacatattatttttttaaggcttactaatatattaaagagttaatttatttgaatttatcgtaataagttcatttttattatttttcaatacattttctttatttggcattattagtatagaaattttttgcacaaatttttatttgaaatttaataattgattttgtgtaaaatccgtcgttttcgcaaatattttttattttaacttatatttataaacatttaatccgtaaagaattcattttttaatttatttttcattatgcttaagttaggttatttggttttcaattttttggaccataatgaggtgataatttttttatttttaacaaaatgaataagaatgtatttataataattatataaaaaatgcttattgaggttcgaattattctgtttaataaaaaatattacaagaaaattttatctaatttttaatagtcttttttaaatttattttttaaaaacttttatgctttcccctcaccaaataattaaattaaataattttactgaaattacccttttttt

SEQ ID NO: 6952 - DNA, 2938 bp, Heterodera glycines
taatttcccttttaattgaatttttatttttaggttaaatatatatatgaacaatattgaaagttgggttttgttcgtttaatttttgtatttaaaatgctcttacttgcttttttgtctttgttgttttctttaatcatgttcaattgcgacgtatgctttgcggaagctgcggaggcggaatctcctttttgttaaataacaaaaattatttttagttataaataaattcaaaattctaaaaattattttcactgttttttcttaaaatttttttattcattatactattgaaacttttatgagtattattttacacccattctttccataaattatttttataaatatcagcattaacatattatttttttaaggcttactaatatattaaagagttaattcatttgaaaaattattttcactgttttttcttaaaaattttttattcattatactattgaaactgtggggatgagacttattatttgctttattataataagtattatcatttgtaatttgattatatagttttggttttttccattttttcgttattcgatatgatttcttaattataatttgaattttattatataaataaatcgtttttgaaattcttacttatttttatgagtattattttacttccattctttccataaattatttttataaatatcagcattaatttatttgaaatttaataattgattttgtgtaaaatccgtcgttttcgcaaatattttttattttaacttatatttataaacatttaatccgtaaagaataattttttaatttattttcattatgcttaagttaggttatttggttttcaattttttggaccataatgaatataaaaaaatgcttattgaggttcgaattattctgtttaataaaaaatattagaagaaaattttatctaatttttaataggtcttttttaaatttattttttaaaaacttttatgctttcccctcaccaaattaattaaattaaatcatttttactgaaatttacccttttttttgttatttagtcaagacttgtaaataaagagatttattgaaacaaggagacggactaacaacttaacctgatttggtgagttaaatgcctttctatgcacaactcacttgacatttaatgccatcagcattttgctattttaaggatgtccgtaaagccaaagataaattttaatgcaatttcatttaaaaattccaaagacaaatttttttaatttataaactttcttttagaattttatttttttaacaaatggtttttagttaatgattttggttttgttaatgttttgtgttgtatttttaattaagattttttgaactatttattgcttgtttttgtataaatattaattattaactcattttcgttaattgatttaagttgttgtattaaatttatacaatatttttaattctcatgagtagtgacccgtgtacttttgttacaatttttggcgctaaattcaaatttgaatttccgcgtcaatatctttggtaaccgggccacgtaggctgcggctgccccacacgaacaaatctctcaaccacttaatttttttttatggaaccctgacccaaaatccttactcaaatcctgacgcagcccgtccgcctcgtcctggagttgagcaagcgcatttggcgaaagcggcccctcccattcctcatcccacgccttgctgctgctgttgttgctggtggtggtagtgttgctgctgctgcggttgttgttccacatgcacaacttggtcccattgtggtgtcggctggtagggaaccagttcccacgcatccgggagctgtgggtcaatttccaaatgctgctcgggcagaggcgggtccagttcccacggctgctgctgctgctcatgctgtagaccttgtccatggtccattaccattagctgtccatcatccggcgcctgttcaatcaagattaaaattcaaaaaaaaaaataagcaaaaaaccaaagacagcaaaatgaaaacttaccgcgttgatcaacccatcggcctggtaattgttgatcagcccttgaaccacaaagtcgacatcgtcgacaagtaaattcagccttgcgcgaagttgggcacgttccgcttggcgttgctgggagctcatttttggtgttgaatggaggaacaaaaaagcgactttcccgtttgcccttttgtatgaggcgggatcgtggccatctgtgtatcgaaggtccgacgcttcggcgaccgatgcgaacggggtcaaattcaaataacaaagggatgtgcagcatttctgaaccggcacaaaagagaaactaatgcatcatgccgctaccggcgatgcgcttgtcacatttacgggtatattaaaaaccaaaggggattaaataaatttaaacgaataaatattttaatttattatgaaatggtgattcaaatttattgaactattttgcaaaattgattaaagtttgtgatcaatccatccatccgacattgttatttaccatttgcccactttcattggcattgttgtatgcgttgttttggttattcccagtgtcaaagttcgtgcgattgtttccgaaagtgccaaatgttgagttgttattagtgaagctgcttctaaagcgattgttgttgttgtaatcgttgtttttatttgcacaattcatgtcgctcagtctcatattaagtgaaacacacccactgcacatatgaaattgcacttttacccctcctaagggatcggactcaaaagcataattaccgccgctgttgttattgttttttgttgaattgaacaatgtttgtgagcagcaatgacaaagattgaaagttagaatatatttttttcgtaaaagtttccataactgagcattagtattgttgacgctgttattgttgacgctgt

SEQ ID NO: 6953 - DNA, 832 bp, Heterodera glycines
atcgaactcaatcattgttgttcatcaattgttaatcgtcgtgagcagtgagcatcaaaaatggccgaagcagcaattcgccaactgtccgacgtgttccagcagttcttgactgctcagcaagcaaatgtggcagcaccagcacaaccgattccaatgcaaatttggcaaatttcgactgttttggtcttggtgaccatggcgaaagcgacatcgagggttggctggaacgctttgcccttgccttgactgctcaacaccgaaccttcaggacgatttgaaggttaagctcttgctgacaaagctgagtgagacggcctacgccgagtatagcaaacactgtttgctgaaaaagccaacagagtttgactttgctaaaacttccgaaatgctgaaaagcttattcgcgaagcaaaaatcagtttggatcaaccgatatgagtgcttaaaggctgaaaagcaagacgaggaggaatttcgcggcttcatcaaccgccacaaaaggctgttaagcgattttgagtttaaaaagctcaacgaagagcagtttaactgcttgatgctcctcgtggcgctcaaatcgccgaaggatgctgaattgcgaaagcgcatactgtcaaagttagcggccgatggtgacagagcaacatatgaaaatgttgtgaacgacttacaaatgtttctgtcgaccatttcggaagcgaaagcgatggagagaccatcgaactccaacattttggctgtaaagcgcaggcagcaaccgaagaaggacaattttggagaaaagggcaagaagcagcaatcatgttggcgttgtggcagagagcacact

SEQ ID NO: 6954 - DNA, 2970 bp, Heterodera glycines
ttccctttctttctcttactctccctctccttttctttgctctattctttctcagcctccgtctctctctttctctcctcttctcattgtttttcctccgtctttctcatttctttcaataacatacatcatctttaccagaaatggacacaccattacatgcgttgttttctgtactgttttctttctctcattttcctctttattttgcaattatttttctgtttaattaaattttattttttcccacgaattgttcattctcagaattccgaaagtaagtaaaaatatatgtattcatttagggaaattcgtcagcacatcaccaagcgacagtgaatagtgtggggacagtggcgagtggacaaatgaagccatccgtgaaggatctactggaccgggtgttggacgagtacaaccatttgcagcagcaattgcacaatgttcgggttgagctggagaagagccaacaggagagggacacgctgcaccgatactcactgatggtgggtcagggaagagaggccgacccaaaattgtcattctttacccctccccccaccaaaattggcattatttacctctcccccaccaaaatgtaaaattgcccttctttaccccccaccaaaattggcattctatcccccccccccctcttatgccatggattcattgttttttgttccctttacattttcttcactttttagtactccgaaacgtttttcactctcaacttcgaaatgctaaaacatggtgaaattgttaaacgtctcagcggcatcctttcggtactttcccggcattccgcttaaaatgtgccctcccatttgagcatgtcatccctctccttccccaagaacaccaagcaccggcagttcaggcgattgagcgtgccaagaccatcaaccaacaagtcgtttttgacttcattttctcaatttgggcacttcgtttaggatgttacttcgattgtcaacggccaagtacagcagcagcagcaatttgcttcgattctgcccgggcttggttccatgatgaatccgacggcatttgggaatccgatgggggcgatgatgtgagcgaaatgcgaaggcaaaagcattacattcgaataataatgaactgcaggggcatcaaaccggaggacgcgatacaggcggcggctatgttcaacaatttgttaaaaaacccaatgcttggtgccaccgcggctggacttcctcccccggttggactaaacggacccggcacaagcgttgcctcaaatgtcgggccaatggtcgctccgaattcgacatctttgccaccaaatggggatgacggccccacgccaacaactcaacctggacgcagttcgtccgcacttaacagcagtagcggggccgggattggacataatcggccgcggtccggcagtcggacgagtacgcccaactcaatggctgctaagaggaccaagttggagccggaggaaggcgatggcgaattggaaattgacgttagttggtgcaacgtccggactgaagaattattggagtttcaggtccaaaacgatgatgcgagttcatccgctgctccttctcatcatacgaacgggcggacgagtcaacctcctcgtcaaaatcacagcgtcaaagacgcggaaagggattccgcgtcggcttcatcttcccgcgactcgaccacccctcggtccggcaagcaacaggcactgactgtacttccgtgccattcgtttcaactttccccttgtcagttgtcctccacccccggctcttccgctgccggcttcgcttccataatgccgactgctgatgccaacatggcgcatatgtttctgaacacggcctttggtggacattttcctggcaatctgaacagacaaatgtttcttgggttgggtgctggcaatgcgccattgggtgctgctgctggaatgccaaccgcaaatgggaagccagcttatgcgtttaaagtttctcagggggagccgaatttgatgccagtgcaattcccctcggatgcttctcaagggccggaagttccaaagtgattttcgtaaaaatgataatttttgtctatctttattctttaggggtttgaagagaattggtgatttgccacacggagacgtcgtttgtgcggttacaatggcgcggaatggtcgccacgtgttcaccggagggaaaggcgccgtcaaaatgtgggacatcggagagcgtattggccttgcttcgtctgccggtggttccatttccccctcctcgtcgaccatcgccgatggaaccaatggccgagtgggcagtgccgagccgtggacacccgtgaacacttttccatgtctgaaggacagttacgtccgctcttgcaaactttttccggatgcatcaacgcttattgtgggtggagagacgaggaccatttgtgtgtgggatttaaacagtgaaaaggtgagcgtcggaataagaacggtatgccatgaggagggaccaaacttggcaacttaactttgtttggccatgtcactgaaacccctcttggatttccattgcccgcttataccgctcattaacaggtgaaagccatgctcgactgcgatgctgaggcgtgctacgctttggccatttcggccgactgtcgcttgtgcttcgcctgctgttcgagcggttccattgtcatttgggacttacaaagtgaacaaaaagttgcccaactcgatggacacactgacggggcgagttgtgtggatttgaatggcgatgggttgcgactttggactggcgggttggacaacacagtccgatgttgggacatcagagaacgcagtgagctgagcaagaacgttcttgagagtcaggtgagcaattagggggcgggactttttatagggactttggattgaccacgtttttggggtccatcgcctagctaaactttattcttttatacaggcccgtattcaggggg

SEQ ID NO: 6955 - DNA, 3324 bp, Heterodera glycines
ttttttgtgacttcggcggtgcatttttttgaaaaacaacactggtaaaaaaaatatagcccgaagagcaaaaaaaagctttccctgaatttttttctggatacgggcctgcttttatgtctaacaattcgttttttcccaccttagattttctccttgggctgctgccccaacgacgaatgggtggcggtcggaatggaaaacaacaatgtcgaggtgtgccccccccccctcactgcttgtaatataaatgctgtttttaaggtgttgcacatgaatcgccaggataaatatgtgctcgatgaccaccagagttgtgttctttcgttgaaattcgctaacagcggaaaggcaagccaaaatgagtcgaatttgaataattttatgtttttcagtggttcgtctccaccggaaaggattacgtcgtgaattgctggcgaacgccgtacggttaccgtcttttgaaaagcaaagagaacagttcggtcctttcttgcgacatttcgcatgacgaccgtttccttgtgactggttctggtgacaaaaaggcatctctctacgaattgagcttttgagggttcttcacttaattgttttcccattcgcttttgttttgtcatagccaattttgtcgcctccattttcccagtggccattttactttggaagcgtttcaccaatggtttaacaattcttttcgatgaaggccatcctagcacattttgttttgtcatttgtttttattaaacattttttctctcggattggaatcctagcgatggtgaattgcattatcagtctctttccccccgacagatttccccttcctctgttttcccattcgtttttctatccgcttgatccctccattggttttaaggtgctttctaagccccaaattctcactattgttcattgattaatttcatttgacacaaaagaaatcatttcactccacgaaacattcacattttcctacaaaatggtcggctatgaatttacttctttttctgattgatttgcataaatatgtatggatatttcaattcggatattcattatgacaaatctcggacctaattcaaacaaaatcgaaaattcatattatgttcgcacctgtacattaataccattttttatgttgcaatggttgagatttaatttagctttttcattccgagggggggggggtgagaagaacatttcgggattaccggttttcccgcgggaatccctttcccgccaggctgttttttcagaaggtactgacatttccaaattgtgcaccctccccctcggaatgatttcaataataaaaagaatggaaatatgaaattgattcgctgtttgcgtcactttcatctcgcattggccaacagaatggcactgatccggcgtctgttctctcctaggccctccctccctcggccccagtcggtctctgtcagcaatttcagtgccatttcagtcccatgttcgctgtcgtcggattcgcaactgaaaaactcgaagagctgttcggctgcttgttccctcagcgacgcgtatggcgaatccaacagagaaataagcttaaaaaatggcaaatcgaagacgaaatatgcccaccgagtgcaccgttccccccccccgagaaatttttcaataaaaacccataagtttttccaagggaaaatttcaaaaaattgattttttccgctaattttttttttgtaatttctttatttaaaaagttttctaaggctttttttgtttgtaaattaaaaaaaaattccttgggagggaaacggcttggggggacaagctgttccatgcctaccaggcgaagcacgcggcggtacatttgactttgcttattcagttgaagcagcgagccgagcacagagacggccaaagttttaacttttggccttcccttccccacggacagcttaagaaatatttgatgacaacgaaatgaaaagtcattccacttgactttaatcggcagctcacaaagtgccgtaaattcgaaatatccgtccggattttcttcaatttcttgcaattggcggtcgttgagaagcaatcggaagagttgaagcactgggccggggtcgccttgacgggaaacgatcgaagaatggacggagagaagatcagagagaaaagagtcgaggaactggaaaaagggggataaaacgaagacacagacaacaaacactaagggcaccttggcatttcgtttgttcggtttcaaatgggaaacaatcgccaaaaaagcattttgactcgtccaactgcaaacgcttcctaattttgttgcgattaaagccttttccttttcggcactccttttttgcctcaccggcagaaagaacaaagccagccaaagcatttcttccgtaagtgtccgaatttaaaagaggcgccaaccgcgcaaagccttgggaaaagcgccaatcggccgcttcgaacggctgcggtaaatgcgccgtcgttgccccaggcatcgttccattttggcacttgcctaaggataaattcgccaaaataatcaaaaatagcataaaaggcattcacctaaggtgaacagcgaactgagcaggtccctttcggcaattgcttcactcaacgggtgcttttcctccaattgcatcaattcacccagaattgagcatgctttcttaaaatgtcaatttcaaatggcggaatggcgtcgtcagaacggacctcgcgaaggccgtcgatggcttcgcaggccctttccacgactttgccaatcgctttgttcagctgacattgcgaaatcgtgagagagtttagggcagaagaaaaggcgagggggagaagccgaccgatggcctcaaagggaggaaaaaacacaaccaaaacattcactcaacaaatgccaaaattacagcgattgcctcgagtcgcacaaaacggccgatgtcgccgtttgttgttgtggtgtaatcatcggaaactgatgctaagctaacaaacacacttttcgtatcatatgtgttttcttacaataacattccatgagctgcccccagtcgaagtttggaggtgtatatttcgtctaacagagtgccaacggattgaattgccgcaactctcacaaaaacccatctcggagtgcacacgctttcattgttagaaagaaaatgacgcaatcacatcacttacatactctgtaacggcatcttttaacttttggagaatggaagcacccaaaagggaagtgccatcgaaatgggaagagagaaagccggcggggatatggccaaggggaacgatgcaggaaatgccggagggactcatctcggcactgac

SEQ ID NO: 6956 - DNA, 1531 bp, Heterodera glycines
tagggaagcatggggaagcatggggaggggaggggggaggaaggatagggaagcatggggaagcatggggaggggaggggggggggaggaaggatagggaagcatggggaggggagggggggggatttttttagcaaatttcatgaaaagattgctatttgttgattttcgaaaaaacattgaaaattttacaaaaattttctaaaacggcctactctgagggtggggtgcgttttgcctttcccggttgccccgagtctcttacggttgcccccccccgtgtgctcacctgctgcaccactttgtccgtctcctcctcttcgtccgcgtcgcccatcgcttcgtcaattgcgtcgtccatcatttcctccttcatgtccataatttcggattgcttctcaaattcgttcattatcttctgaatttgcggcaagttcagctgcttgttcatgctgcgcatcgcccgcgtgacgcctttcattgccttgaaattaattaatcgaatcattccgattttcaatccaaggggaagcacttgtgccattgagtcttggctcttcagcgtttgaaccttcaaagagactgcctggatgttcgctctcatcataataaactgaataggccattttaaatggcataaaccaaaaaggcaaaaacctttttcacgtattgacgcgtcctaaccaaatcctttgccattattcgtacagaattctaaaatgaaattcggaaattgatataccatagcaaaaggatgagggttaaattctataatgaaatttgtgacgacctttttttattcgttttctgccaaaaaaaaaataattaacacctaccatttgccccattttggccattttcttaatgtccgcgattattttcttctccgacatttccaaccgttggcgttccctgtccaattcccgaattgctttattcagtgcacgttggttttgccgtaacatttccgtcggagttttgcgctttcctaatgtattttattaatttacaaaaaaagaagattgctaacttaccaaaaagaaattccattggaacgaaagtcaaaatgattagttaagcgttaaaattggaaattatcagcaagcctttacctaaaaataaacacatattacaaaacaaaatgaatgactcatctcaccaaatgatttttagatagtaaaattcaagaaatgagtgccctactaaataacaagatgcatcaaataatttcaatatttatcaagaatttgtttttacaacatttctaaaaatgaacacctttcttcaaccgtactatgtgtcaagccctgtgttagacaaaatgactcataacgccaatttacataattttcaataaatattactggtcgctgcctttttgtattgttatttttgatcaggcacaaattacttcatatacatctaaattcagagttcacatcatgaaaaaaagagataccataaaagtgccatagttcacaattgaaataaatagacaaaatatgaatggagggggggggggggggaggat

SEQ ID NO: 6957 - DNA, 997 bp, Heterodera glycines
  misc_feature (54)..(54): n is a, c, g, or t
ttttccttttttgacagttctgtacatgattaatttattggaaatgtattgagnccattttaacggatggacctgcaatcgcttttttcgtcgcacaattgttgactgcaaaagttgtgcctccgttaactgctcattcagttgccgtaatttctcactcatacgctgcaagtcgttcattctttcggttgactccacattttcacttccctccatttctttttgcatttctgagacgcgttcgttcattgtttgcttcttcgctttcttcatttgaacctataactgctgttaagtaaaaattgccgtttaatgaaattttatgggaatagagataagcaaaatattcccagtaaaaatgtttgcctgcgaaagtaattgtcttctcagcagctcaacttcgtcttcgctgtggtgttcggttgttttactttctttggacatctctaaattaaccatctgtggattaaatacaatttgttttctgttagatttgtcccatcaattttttttgtcttacattagggaaaaccagacaattatcttaaaacttatcaaatacgtacaacaaattgtaatgcacctggatcgctttctaactccatgctgactgtttcataatcatcctcttcacgtcttcgttttaaaacagatgaattgagatgttctcgatttaattgaaatttgtttttttgacgttgattacgcgtaaaaagctcttcttcctcgacatattctccttcttcgagctccattacaagattacgtacaacaacgagaatgaaacttcaacgaatttgaatgtaaaattattattcgttaaaatttttaaacaaaaaaaggaaaaagtgaaatattaatttaaaacgcatttggcgtactatttatttaaaaaaacagcttttatttttctctttttctgtgtagcttttttcatatacctaaatctgcttattgcttcaaattcaagatttatcaaaaactttgggcaactagc

SEQ ID NO: 6958 - DNA, 2567 bp, Heterodera glycines
gcccttaatttctcctgaaaacttagaaaattcaacataactctgcctaaaagacagatttctgtctgcaaaagaaatagaaatgtgaaaaaagatttgttctttcttatttagcttattttatcagtttctttttggtagttattgagatttgattcgtttttatcaagtgtctctattttaaattaacacccctttttcgggaaaaaattcataaaaattttttccatcgtcatttcgccttctcctttttagaatcttaatattttcagaattgctacgtacacttaaaaattcagctcgatcggttcatgggaagtggtcaaactcccaaaaaacagggtgtctttattttaaattaacacagtgtatatggcacaacatttcttaacattttattgttgcataacatttcttagcatttccatcgtcctttcctcctttttggcattttttatggaaaagcatttcttcttggcattttctttcttttttcttaacattttcttgaaaggtacggctcggccgcttcgcggcctcggatcattctcttggcattttcttatttatttatttattcgtaaaaataaaaaagtcatcagaagggcgaaactcacttactctgacgactgttcagttaatgtgtcgtagagtaaatgataaaataaagtgatgatcacaggaattaaaagagacaaatatgtgaaaataaataaataaattgaggtcaaagtcaaatgaggtcgaaaaataaaaaaaaataccaaatcacttaggaatttgttataattctagcttttccggtttcattaccctagtgaacttctaagtttggttttaaattgatttaaagaatttgttttgattagttctttatcgagttgattccacaattttgttaccctcccagcaaagggaatgaattttttgcccagtttatattttgagttaagtctgtaaaaggcgatgttaaagcgcgttgagggattaaaaattgaaaatagtttcagaaaaatttaaaaaaaatttaactaaaaaatgttcggcataaacaattttatgcgccatgaacagatccaacagttttcgcctattctcaagtgttggcagttgcaggtattctaaccgatttaggtatggaattggtggaaggctgcatttaaaaaatacccttttggtgaaatatttttgacacttttctatttgtttaatatttttttgtagagacggattccaaacctccggagcgtattccaataaaggcctaatataagttttatataacgtaatccaaatcttagatgatttggatttaattattctaaacaaggaacgcatacgtaaatacgcattccttgttatttggttaacatgaccggtcacattttttccattttataattgcctcgtaccaatcttccacaactgctattagttgacttgtcgtagacctatttctaacaaaaccaaattggtattccgaaattttattgttttttaggaggaagttgtaaatattttggctaagaattctttccataacctgcaaagtgagcaggttagagaaataggcctataattttcaggattagatttatccccttttttgaaaagaggtaaaactattgattccttccaaatatctggaagagaaccagaatctaaagaaatcctgaacaggtcagtaataacagttgccaatgaagaatggcagtttttcaatgttttatagcttatatcatccggggatgtaccatttttattcgggagttttttcaaaagtttttgcgtttcgatgatgttaaagtctatatctgatataaagcattgattagcaaaagtgttgccccagtttatggcagcctgggtcaacctcagaatcgttaaacgaatttgcaaataagttagcaaataattcagttttttcatcaccaccatgatagcatttgttttcaaaaactaaatttggtatttcaaagggattaacatcgtatttttgtatgtatttaaaaatcgaattttttccctttgaaatagccttttttcaatttgagaatgaaatttatttgtttgtatttttatgtgcaaactaatgctatcatatagtgtttttttgatggatcagttttacattgtctatacagtctggctttctctttgatggatgcaattaaatgctggatatttaggggtcatatcttttttggtaatccttttcattggaatacactcgtttaaggtttctagcagtgtattattaaaggcactgtatttttcgtttatagtaaaatgctcattagataaagcgctaattctagaagaaaccataatattaaaaagagacacattcgacggaaaaaaccgtcgagtgtaaaagaattttgttttttgtagtgtttttggaatagtcaatgtgaaaaattgcgctaaatgatcagaggaaaaaacaccaccttcaatagtacattgctttacaatttgatcattcgctgataaaactaagtctaaccacgaattttccctggtgggtccgattcgtggcattgaaaaaggaaagtttactaaaa

SEQ ID NO: 6959 - DNA, 5872 bp, Heterodera glycines
aagtttccgggctctaattatcagtggaattaaaaaatgaaagcccgaaaaacgtgcaaataatcaaattcgctgacaaattaacatttgccagtaactcacttctctgcaatttgtgcagaatattgcccttcctgctgctgttgtttttcatcaaagcataatgcatttttaatatgagcaataactaaaaattttaacataatttaccaaagtaaattataaaatagaatttaaaatgtaattgttggtgcgttaattattctctcccctcccctttattctctctaatccgcatccgccatggaacgatatttattttatgaatgaaaagaaaagcaacgaaattgggattgatttacatatttattgggccgttttgcccaattaaatatcatatggaaattgcgttcatttcttttcttttcttcaatttaccggaatatatcaaaacataatttaaaataaaatttttaatgagttaattaaggtaattaagctaagccccacccctttattctttaaattggcatggaacgatattattactcattttatggatgaacaaaaagcaacaaaatttggattgatttacatatttattaggccgatttgcccaattaaagatcaaatttgcattcatttcgttctaatgagttaattaagataattaagctaagtctttaaacttacatggaacggtattattactcattttttggatcaataaaaagcaataaaattttgagtaatttgcatttttattggaccgttttgcctaatttaaatatgtattaaatgtttcttttcttttcgtccatttcgcccattctccgccgataagattttctgttgcattctgtggtcaaataaacttttttctgttcatcggccaattggactgtgctgtgatccgtccgataagaaggccaaagggacggcgcaaaatgaaaagggaaaaatggaaatggcacaaaaaaagggaacgaatgggagacgacgaatgttgtttatgattaacattttccattcattcattttttgtcccactcttctgctgttgctgattttatcggaaaacaacggcaaattaacgcaaagaaaaaatggccaaaaatgcggggaatgaacggaggggggggggaagcatttgcaacaatataaaattaaaatattacaacaaaatcccacgatttacattacacaaacaaagggaacaacttaaattgaacaaattcacaggaagaaatttttaatttaattaaaaaaaaaagattttgaatcgttttgttatcgatgaaattaatagtcgagactaaaaaatcatcgaaactcattatgtaaaaataatgaaaaattaacaattctaacttcatcataattgtttgtcaaataaagaaatttaattatgtagcaagttaattataaatttttggcattgcattttttggctaacgaaaaatacgaattgatgacaaaaaacaaaattacatataaatgacttaaaataaaattcattcatttgaataccgtcagtatttcagcggtccatctttttcttattttatttctttacttcatttttctttacattccttctgaaaattgaaaatattattttaaataaattagtgtaatcgagcaaatgaaactcataataataaacagtacggccaaattaacgagtgatgagccaagtcatagcgaaagggggaggttatgctagagagagaaaaagtgagacggcgagagagtgtgggaaaaaaagatgacagacagtgaaagagtgaagagagagagagagaaagagattgaccagtcgccgctaccgattcccccgtcaaagaaagagtaacaaattcaaaaataattatttataaaattatcagcattttggcaaaccgataaactgttgacattctaaggctttaaacaaaatgccaactctttgcattcatttatattttaattggcattcattttgttttggcaattttctaagcattcatcacctgatatagtgtttgatcagctccattggtagtgggaaaatgattgttcgattcttttcagcactaaaataattaaaaatataaaaaaagtttttttatttccacgctttttgccttatcgaagtcaaagtttgaagaaaacggagctgaatggcaaccggcgactgcgcaacagtgtgtgccgcttcgcttaacgcttttgaggctttctgctcgccttcagcagcaataatctggaaattggaaaatattaataaaattaaaaaattaattttaaaattttacatttatttttaaatcttcgtcttaatgaaataatttttaaattcaacccaatcttctaaaagcatgttaatatgaaagcatttgaacataaaaataacacatcccttatgatttgagaaaatcattatatttaaaattttcttgtaattttggtttcaacaaatttcattaaacttttatattaaaataaaatgtaattaaatattaattttgtatttttctcttcctaattagtgttacctttgcgcccgcttcgcgcgttgcctccgcttcagcggccatcgcccgttgaagctgcaccggaaggcggacatccttcatctccactcgttccaccttcactccccaggggcttacaaataaattaaaattaagccaaaaaggggattttttgtgttagggaggcatttaaaaataaattaaattaagaattgctatttttatggagtccatctgaaatatatcccaatccttgaattatatttccgactttgttatttcgtccagtgtgctttgcatttgcagcgagatttgttcgcggtcgctaaatttaaaaaaataatattattgtttaaaaaatattatttcaaccttaacatttcggccaatgtttttgtgcccaaaatgttccttagcgtggtttgggccaacaattttgtggatcgacttgaatcctccacattggttaccgaaatggtcgcatttgaaatacgaaaatagacaacaacatcctgaaaagaaaattcttatatttttaaaaataaatgtaattaattttaaataactgagaaaataataacaataataataatatgacaaatatataataacaacataattgaggaatattaatattcatgttttaccactgctacggtgacagcatcgcgagagagaatcttcaaattaaataataattagttttatttatttaatttaaaaatattaaatagtcgaattcaaacctcttggggtggcacgtcaaatgaaagcactcgcaggtcaacttttcggtaggtgtcaatgcatggaattacgataaaaatgccttaaaattaatattttagaaataataaaattaaattctcttgaaagtcacccgggccgcgggctccgccgggcaataaacggcccaatcggaaaatgacagctctttcatattcacggacaacctgaaaaatgaattttaaatatttaaataatgtaataatatatttttttgtacctttacgcaaaaacaaattgcaattggaaaagtgagggcaagcaaaatgtaggaaaagatcatcagaatgtagccactgatgcccaagttgcctgtcatcggctcttaaattgttgttgtttgtaatacaaaaaaatagttttgtataagaaaaaatcaaaatttaaaaattattttaccaatatttaattaaaaaaactaaaataaacttggttcaaatggcgaatattccaggcccagcacgtggctggaaaaccggtgatgaattcgtggattacgcatttcattaatgccaattaaaattggaaaatgaatttggaaaatataaaatcaattctctttggcattttctctctgccaatgaattgggccaccggcgctgagtttgtaaggcttaaggtagggccaaaacaaatatttatacacggggatttattggctgagttgcacaggaaggaatggttgaataattggttattagtccgaccaatttaatttgacaaaaaacggaaaatgggaaaaagatattttttttaaatattaattaaaaacggaaaaattaaataaattacgaaatttttatgggttcttaaatcaaaactttccaatttagcaatataattggagccttgcatttggagagcttctttttaaaaaagcaataaatttaaaaaagtggataataaaatttattttaaattatactttaaaaaaacaaggtaaattgaaatggattttttagagattcatttaatttagcaacatttttcaatgcgctgactcttttcttgcggaaatattaatgccttaaaaataaacaaagcgtgtaaatcctttgtaaaatgaatgaatgcaaaatgcctttttgaggtgttagtggtgaggatggccttggcaaaagaaaaaaaaaatggacaatggaaaaagaaacattgccaatgaaagggaaggaattggcattttattatttaaaatcagcataattttaatttgaataccaaaattaaacaaaataaaagtattttgttatttttataatttatagttatttaaaaaataaaaacattcttaagatgaaattataattttaatcattaaccattaccatttgcaaagaaatcgttacggtcattgcccttgaaccgaattgactggtgttgataatgctaaaaaaaagttttttttttttgcttttaattatcactaaaaaatgcctgtgatgcttggaaatggcgttggtgttgtgtccaatgcgatgtcgtcgccgtcatcggttgtgttgcagaagctgcttggcctcgtctgctgctgttggtcaaagttgacgacgctctcccttttctcgaactcaaaagtcctctcaaaaatgtcattttaataagaggctaaaaaataaattgaaaatggcagaattttttggcacattttttgggcatttacttcctctcaaaatttgtgccaataaatgcatatgaaaaattaatcaatgttttttgccgagttcgcctctataagttgccgcttttaagccttcggcttcgcttattagtgccgtcgttggcaattttgccaactttgcctttacgcgggatacacatcataatgatggaataattgagttaaagtaagtcgtaagtggcaaggaatgttgtggtaaagtctagcacaaataaatggcggaagaaaatgtgaatgattattggccaaataaaaacattcggaaaaatttaaattaaataataatttggtaaagaaaatagcatgaattttcaacactaaaaagctaaaagtgaagaaatactacatttttttgtttcttagtatgcttattttccaataattaatattaagataaatatttcaaaaaaattttttaactaagataatttagtcaaaatatcctagataattatagagaatgtaattataaattaattggagtggttggtatacaatttgaaagaaaaatgaattggagcagcccatgacattctgttgaaagtaaattgcatggtttttatgaattagaaaccgcacactctcacacaaataattttgtgccagggaatgccatcaaccgacgcaaaaaaaagtgccggctgagccctcaggcaattggcaattgctttatgtggggactcagcgggcatcaatcacctccataaaaaggagaaaaaaaagaaattaaaactgaaagcgaaatgggaagaaaactcaaaaaatgtgacgtcatttgaaatgctatttttatgaaattccctttgaaaacatccaaatttatagtagaagccgatatatgtagctaaaataatgggaatcaaaactgagttctaggaaaatgtgtgcttat

SEQ ID NO: 6960 - DNA, 2065 bp, Heterodera glycines
  misc_feature (1914)..(1914): n is a, c, g, or t
aaggttaaaattggcgaagaattgtcagaaagtttcagaatattttcaggagtgccccagggaagtgtcttagggccattactctttttaatttttataaatgatctgccgtccgttattacaaatgaagcggcatcagttggcataaaaatgtatgccgatgatgttaaattatattatgcccacgaaaatgatgaccattcgaatcagttggataaagcaattgaggctttggaaaaatggtcaaaaataaatgggttagaaatttcaactgaaaaatgttttgttttatatttagggaaaaagaatatgaaaaaagaatattttattaactcaaaaaagatttcagaatcggataatgttcgtgacttgggaattataattgactcgaaacttaatttttcagaacacataagcaaaattatacgaaacgcatatcttagaagctttcagattttgagagtgttgaaaagcagggaaataaagactctaacagcagcttataaaacttttgtacgacctcaattagaatacgctaccgaagtttggaaccctaatttaaaaaaagatatagacaaaattgagcgggtacaaaaatttttcacaagaaaagcacttagaaaatgtggttttgtgtacaaaaaatatggggaaagactaaaaatcgcgggtttacataaattagaagaaagaagaaaaattaatgatttgacaacagcttttaaaattattaaaggattcaccagcctagaggctgagcaaaatttctttttctcagaaaggcccaggaggcctttacttttacgagtaaagcgccacacggccaaaacacaaaataatttttttcataggatagtaagaaactggaataaccttccagtggtagcggtgcaaattaataaggcaaaggaattcaggggtttactaacagcaatgagttctgagtaggaaattttctgtgccacatatacactatattttaatcacctgtgaatttttaacatttgatttatttttattcatttttattacggtattcattttgtattttttatttgatcatttttatttgtttgtttttggcaccatataagagcactaatgtgcctttggtttgctcgataaaattaaattaaattaaattttctgaaaattatttaatttattgttattttttatattaatattttgcgattctatatgaattatgtaaaaattttaaaattttgaaattttttcattaatttttttgttaattaccccatcagatatcattaatgatcacagcttagctgagacatatgctaatattttgtcaagagacgaaacaacacggcataatgctgaacatttgttggccattcgaatttgttccgcacgaatttggcaaatttttcagcaaattcatttggcactcaaacagaagcataatgccagattgaaggatgtcaaaacaaatgaaattttggcacaaattcaatcaaattggcgtcgcttttggaaaacacggcacgcaacttacaaatatatgccaaatgatttgtatgaacattgggcagcagtgcaaggtcaatggcaagatttgacatttttggcgcgccaattagtccaacaattagtgaccgataaatataatgttgctaaatattttcaacacataaagcaattgttgccagagcggaatctgttttatcagttggctgaggagcatgccaaaaacataaccaggtgaagggagaacctttgatcactgatcagatatcacttatctcaaatggaagtttttggccactactgtagtttgctgtatccctcttaaaacgaaaagggagacctttttgttttgaaaatttttttttatgacaacttgttattaacccgaacccgaacaaaaggataaaatgatttgcatgngaaaggattatataaaagatcaatttgatatacctattttgcattatttttccagaaatttggacgctaggcttaagaatttttttttatttctaggattttctcgggagcctatctcaataacccgcaaccgatttcaccatttcataaa

SEQ ID NO: 6961 - DNA, 1173 bp, Heterodera glycines
atcttttttattaaatttattaattctttttaaatgatatgtatttgaaataaataaaatgcaaataataataataataaaaaaaagaaactttaaagattggcagagacaaaaaatgcatttagtgaaagtcttaaaaattcactgctggaaggaaaagggaccaaatttcggctccaaaaatttttctcgcttagtcggggcgatattgcattatatgagcaaatggttagcaaatttcctcaattaaaaaatttgtctagatcaggtaggtgcatttaaaattttttttataaaataatttttaaatatttaattgattttattatacaatagaattaacgaacgacgaaataacggaattacaaattcgaacttatattaaatttcttgacaataaaaatgatgagcaaatttgtagacgcgcaaaatatttgctcgatattttagcattttatcaatggtattttaaaataatttttaataaaaaaaaaactttttaaggttaaaaaataaggacgacattttaatggacaaacaggccgaagtgttaaaacacttggagttgtacgaacttttgatggtcattaaaatttatattttttagttgcaaatttctttgtttttttttcaatttgaaattaataaataattaaatatttttattttaggattcggtgccaaatttatctcaaaatgagatcaataatgatatgattatgcagctgttgtacgaacagagaaaagaattatttccaaatttaaatattgtaaaattttcaaattttgacagcccccaaggcggtgaaacggatgctaaatcggcacaacaatttttgcacggcaaaatcctccaaaaattggttttaaacagcgaatttttgacgcagttaaaaggtctctgaaaattctttaaaaattagcaaaataaaaaataaatattaatttaaattttagattagatacaatatttgtaaatttcggataaggaatttaaatttagataattataaataccgtatttcctaaaatagagtccccgggggttttattttcaacccccctcaaaagggaggctttatttcaggggcggttctaatttagggggggggggggctgtattttaggaaataaggttgttttatttaaaaaattatttttatttttaaattt

SEQ ID NO: 6962 - DNA, 3402 bp, Heterodera glycines
taaattggaaatgccaaaaacggatgccaaaaattcacattgggatgaaatgcttcatcatcatctccttctatgttcatgaaattgagtaagcaaaattaattaataaatttaaacaaaataattataaaatttttttttaattcaaaaaatctctcaacaggcgattaataaaccttaataacactttaatgaatttgggttaattataatataaaataaaatgcactaatgaattaataatggatcgggggtcagttttcggtgccgaccgtttgggcgtcgccaaatttgaaatgctaaaactttttcctttatcagttaacatttagcaaaaatgccatcaattgaaaataaaaccatgaatccttttctaaacaatttgattaatttttttttaaattgaaaaaaacttggaaaaattagcaaaaataattttaaagttttttcaggagaaaatatagttttatttgaaaaaaattctatgttaaaaaaaagttatggcatgcagcgacgaaaagccagaaaaagcccgaattaccgaattatacaaaagcatttaatttgggttgctatttagaagagttattaaggagcattaccaacggtgctgaaccggccggcgccgaactggctggcggtttcgctaatgaattgcctaatgaattcattaagataaatgcactaatgaattgttcaatttaatgacaatgtacaaaaatgtgatgtttaaaggacgaaaaaataatgatgattcagatggtgtaattttggaaaagtcagaagaagacctcaattttgaggcaatttattttcaccacaaaacggtattaaaagaattggtcaaattgctttgggtctttcaacgatatttcagacatattaggtaattaatgtgaatatcatttaaaaaccaataaataatttcactaaaattcatcagcaattaatagagcccggaaatttcaaatttgcggatcccgctgcggggttggaactcaaaatttttttgggatacgggatcccgtgggattaatcccgaaaatcccgcaatttaaaaaaaaattcgggattgcggattgggattccacaaaatcctgcacgggatcccgtctcgtaccgggcactagtaattaatccattcataattcgataattaatacaatttggaggtttgaaattttctataatttattctctataactaaatttcacaaattaaactgttctcaccttggctttattttaatgatttttttaagaaaattatgaattagatttattgaaaattttgtttcatttaatttaaaattattaaaaaaaaatttttttttaaagaattaatgatgaaaaagtgaagagactaatcattcaattgaatgtggacattgcaatggctgaccttttcgtggaagtgaatgatccggcaaaaaaaacgtgccaatctttgcctaatggacagtttgttgactcatctggtggcaaatggcacattgtacacagaagtccaagaatggcaaacccacatgctttatgaacattttattaatcatgtaaaattacaaagataatttatttattttttaaattaaggttctttggttaatgtttaatcatgaaacttgttctcgaggggtttttgacgacctctgatcatgaaaatgacatctattttggccaacttctaactaacccgaactcggacaaaagtttaaaattccaattgtccatttatgattttttgttcaaatttaagccatttttaaagtagcgcaacaaattccattgatttaaagatgaatttaaaatctttaaataattccaaaaaaaaaacaaatgcaatttctttttttgctaagaatttcatacagtccatgattagaatcaatcaatatagccgcattgattgatcagcttcaatcaataatgattgttggttgaccaaaaccaatcaatcctcattattcagaacgaaattccgcgttcatcggatgccgatttgcgctgggccaaaccggagtgccataaggcggaggtggcccaagcggcagtgagcaaattattgggccaaatgcatttggtggtacaatcgcacagttttgtgctgggccaagttgcaaaggattgtgccgaatttgttcaatttgtcaaccaaaatgggattggaattttgaaaaatttatattgcggtaaataaatgtgccataggtcgtcgtatcgtaaaagtgccagttttgcagaattttcgagcaaaactcttcacactttttgtttgatatggttgtgcttataaaaattattacgagtttttctcgaaaaatctgtaaaattggctttttacgaaacgatccagccgcgtcaggatcaatcagccgaggacaactcagctttacgaggtgtcatgacaacttgtacacagacaactcgtacaatgacttatgctaggcctatgctttaggctaggcctaggttaagcttagtctttattttgtaaaaatttttattgtacgactgagttgtctatcagccgaattgtcccatcagctgaattgtcctcagctgactagtccagaagccaatccagcacattaaataaaaatcaattttaattttgattagatttttttcacagaaaatattgcctttaatgagcgaatcacttattacaagacaattttgggctcacctaattcggaggaaagaaaagtggcagaagcattgcttgtcattaaaatgacttttagtgaaattttacaaattgaaaaagcaaatttcaagtattattttcatattttgtttaaaaagcattaatttaaataaagatataaataaaataagtttgcatatatttaatgatttatctaaaaaacaaattcataaatccttaacaaataaaatattaataaattgaaaaatattttataaaaatgctaaaatataaatattcaaattttttttaaataaaatttgattttaaagagcatcgaaatttgacgaccaaattggcatctttcgagccgaattaattgccttgatgaaaatgcttcaaattgtccttggcgagacaaaagcaatgttttggatgttttgtccaattttaacttattttcattttctgaaaacgaaacaaggacattcatcagaaaagttagactacaatcttttaaatatgtgcttcaaaaatacggtgagtgattagaacaaaatcaaaaaaaaatagaattttaatttttgtaaatttttgaaattaaattcgaaggaaatttacaaatttatttaaaaaattatatttaagtgactaataaaaataaattaaaaattttaaattaatttcgaaagaattttaacaaaaaaatattataaatttttgaaattaatttttgaaagaatttttataaattt

SEQ ID NO: 6963 - DNA, 5865 bp, Heterodera glycines
agtcataaaaatccaaaaaagcaagaaaaaatgcaaacaatatactgaaaaaattaggcaaaagttaaaaaaatcccatttcatcaatttttatagaataacatttaataaatagagtaggatttttaagcacttaattttataaatggtacctaaaataggaatgataagtgattctttcaacaattacgaaaatttcatccaggtttcattaaattatttttaattaaaaatttatagatttaaattaaaagttttaatattatttaaaaattccgccagtgtcggattactggggagccattacggtggagtcagattttaatggctcgatcaattctttttagttttatcatcgttactgtaacttccacagtaaactcagtttcggtttcagtcaaaattccttctcccactgatcggcttctcatcgcccgaaaagagaaatccgaaaagtgttggcttttgtccactcccaaatgtcaaccaatgctacgggggcgaaatggcacttctgttctttgtcagtctctacgccagtgccgagatttgttgtgcgatttgttgccacatttttgaaagacggcgacagacaaatttagcataagcggaaaaagcaaaatttgttgaaattgaattgttggactttatttgaatttgttttatttggatttatctttaatagaaattttagattaaaaatataatgcgagaataatatacaccagggcctatttcaattcgggtcatatctgcgatatgactctatgacacgtgtcatatcatacgcaaaatttctgtttcaattaaacaccccaaaaatcatatgcggcgtatgatatgacgtgtcatagtgtcataggcgcgtttcaattgtgtcatggtatcatatctccgatatgatatcgtatctgcgacgccgtcatacgcggcgtacgactttttaatcatatgcgcgttcaattaactcccttttctacttatgatgccgtcatatatgacaccccttcccttgggcaaatcatatgcgggtgtatccgctccgaagcggagacatgcccaatcgtatgtagaataaaaattcataaacaattttaaacttaatcgaaaattttcattaaaagcattttatagaatgaaacctctattattgaatgataaataaattaaattatttttcccagtttataaatttgaagcgtaaatcaaaaatgcttaaataattttatttattttgggcacttcaaaattaaaattttttttataaatgagatttagctatgttaatttttttttacaaagttgtgatgttttctaaatataagaaaatttttgcatttttttttccaaaaaaaatttgttcagacatttcgaatatatccataaattttccttctcctatggacctaaaagtaaaaaactattttagttcagctgttaagctatttttcgaatttaaatgcttattaaaaattttttttataatagtaaaatatatttgttatttgcccttattttctacaactaaaaaaagatcaaaatttaaactatttttacggaaataaatttaaaaatgcttcattttttaaatctttgttaagttttttatttaaatggcctaaatctcattaataggtctttctttatttatcccaaattcggtatcatatgtaggcatcataaatagaaatcatatcatatgtagcaatttgaattgaaacaacccaaactgatatgacactcgcatatgataccatatcatatgtggctgtcagaagtgagttccgcatacgatatgatcttatggcacgtcagtttataattgaaacatgcatatgatatatgacacgtcatatccgggatatgatctgaattgaaataggcccagggaggcaaaagcgttactgctgcaaatggatgccatttttggttgacatttcctttgtccaaatgcccgtgctgaaattctccacgagttggcaccaacgccagaaggtctgtccaaatgaattgaacagaactccaaccaaccggtctctaattctactcattaagcaaaagcattttaagcaacataccagtcaaatgaaaaatttgacaacatggtctagagaaactcaaaccgtaattaaggcaaatttgaaaattggcaattgatttgcttcgctaaaatatttgtcccttcacaaagctaactttttttctcaaaaatttagagatttatcttggttcatcaacatttattccatatttattgatacaaatccctttagaaattattacgttttctatcctatttctcctttcattttcgtcctttctttaaattgccattaaaatttcgaaattcggcatttcttcggcgaaaaagcggcctttgcatccaaaacagtgattttcggctccccctcgccgcctttgacgctcagttcggcttcgagcgttttggaaacgtaaaggtagcgcaaggaatcgggaaaaatgaattgatcggtggtgccattgaacggtttcaggttgacgacattctccaaagttgcctgagggcatgcaaaatgggcgtttaaaattggagaattttgaaaattgaattaaaaaatgtgggtaccgtatttcattcagaaatataagccccccccccccttatgagggggtttttaaaacataagccccggggtttatactagaagaaatacagtagattttttacattgaaaattaacaccttcttaaggaaaaacagatataaaaaatatttttcattttatacttaataattgttgtgggttcaatcattaaacggataaagtacggtagtttcggattttgtttacccgcactcaacgaataattttgtttaaattattattatttaaatgtgtgtcagtttagaataaagcatcgcgttccaacatttaaaattctttagaaaatattaatattccaaaatcaaaaattgggtgtttgttaatcccttttaaattttgcagattcccgccccccccaactaaaatatttaccccttccggcaattggactcgaattttcaaatcgcacaccaaaaagaacacataattagtgatctccacacggtattttcgaagaacatcatttgtgcagttgttgttggtgttgttcaccaaattcacttcgatttccaccatttcttttgggtcataaattatcggtcgttcggtggtcgtcgttggcacgcgggaaaatgccgaaaatggcgaaacaaattggagcaaaacagcgacaaatatgcccacaaatttgttcattgttttattttatgtggattattgtatttattttaattaattttattttatttgggagtgaattttatttattcgtttaaacgtattttatatgattttgtgagcagccattttctgacagaattcataaaatttaaagtcattgtgcaaacatttgattgataaattccattttcattgaatattattttgtgcgtgtgaaatgtgagagcaaactttaaaaggtgagcaaattgtttttaatggattaataaatttatctatcgctatgtgtggcaaatttttaaaaatttttataaattcaaattattgggattggattagtgcctaggttgtccgttaaaaaaggctttacgcgcaaaatgttcaatatcatctaaaaaataagggaatatttcaaagctaaaaaccaacttttgtgtattttgaccgttttaaaagattagaaattcttcacttgttgagttttaaatgcgataaaaaatatttttattgacgcgatcacattttttggcgatttgctcagaattttcaaaattttcccaaaattatttttcattttttggttcggtatttgtatttttcttgaccaaagtttcgggaccgggctacttttttggttgaaaaactgggactttttggctgggaaaaccgggaaaaaagccgggaatttcccggtcccggtcaaaactggtcaacacgggaccttggtattcagttgtccgtgtccaggtcccggtcccgacctaccctagtcttcacattcgagtttcaaaccagttaaaagcaatttaacaagctacatttgacaaaataggggtagattttaggctctaaaaatcctcaaatttagggggtctaaaatcgtaaagcattttgtaactgagcaggaaagaacagtaagagaattgaaaaaacatatttattagtgtaattagagagaacagatagtcaaaatccacatggcaaatcaaactgtacatggtgagcattatataatacatgtgatcgaatgtcttccgaataattccgtccgattgtttttcaattcgattccctctcaatgacatcacatttactgctgctgctgctgcggttgctcgtcctgctgcctgaaaaatcaaaaataatttttgaacagaaattcctttttttttcttacgcattgccatcctcccgctgctcattgttagctgtggtgcgaaaaaggtcaatcaattcggcacgtctgctttctcgggccaaatccctcgctcttttgccttaaaaagggggcgggggagagcagtcaattgaagcatcacaattaagccctttttgggcccacccaccgtcaattcccacttggtctgcgttcgcgccgattgccagcaaatgacgcgccacttcagtctttttttgcttcactgcccacatcaacgcgttgtacccgtccatgtcagcgtggtcaatgtgggcgccatgttcgatgagaaaaacggctgaaaattggggaaaaaattgagtcggcttttgtaccaattgcttcttactaatgtccaagcgtccgtggatgcacgcgcccatcaaagcggtgatgccgtcggtcgcttgctgattgacgtcagctgcccattcttccaccagtaaacggcacacctccaaatggccatgagcggcggcgtccaaaagagcaaatcgagtccctgaaattgaaaaaagacattaattagggcaataataacgggcaacccaccgctgtaatcgatctgttcaacgtttgcgccgtgagtaagtaagaagctcgcaagatcgatctgagcgaaaaaaatgctaaatttttccacgtttggcatttttcacccttccggcacgagaagtgatcattatcggcgttgctccttcgctgtccccgagattgacgtcggcgccattctccacgagaagggtgactgaaaatggtgaaaaagtgctgatgagaaaattattccggacgattgattcaccgatttctgtgctgcctttgtcacatgcaagcagtagcggcgtcaaggaggcgtcacttcccaagtccacgttggcaccatgagcgatcagcacactgcacagctccaactggcgcatattgacagcaatccacaggggcgtaacggctgaaaatggggcaaaaaagagatgaattaggcaacagcacaattgtgtccgcaaaacgcatttctcacccatggtcacgttgttcacttggccaagggtggtctgatgcacgtccgcgcctttctccaactaaaaatgggtaacatttattattgttgattttttgcccctgaaaattgtgtctaccaaaagtgcagcaatttctgtgtgtccctgcataactgaaacaatcagggcaaatcgttgtcgggtgtatagcgggtcgttcatctgcagcaaggtgttcagctcatcggcgctcagcgagtcgatcagtgcacgcaatcggtcgatgtttccctgacggatgaagtcgaagaattggctggtgcgctgcgcaaagtcatcgacggaaccggaaggagcgggaggaccagcatcatcagacttaattaattggggaaaacga

SEQ ID NO: 6964 - DNA, 6130 bp, Heterodera glycines
aaattaaaaaaaaaaaccaaaaatggaaaggaaatttgtgtcaaactcattgagttcgcgagaaatgccggaagccaacaaagggtcgaatgtggcacttcttttgtggaagaggggcaatggctcgcaatttatatgtgtcattttagaacggatttgatgctccagttgagcaagttcgacggcaataagttcatgaaagcgatcagaaagggcagtgccaaagagttggcggtaaatcagcgtattggactcaaaaacgctggaccaattctgtttgttggaaaggttgatagatttccatgaaataaaaaggaagagaagcagatccgtctgtatccagggggaagaaggctggcacatgatcttccccccccccaaaaaaatgaaaattttttcatggaaaaaggcgcaaatttttggataaattagaccccaaaacggcaaaaaatttgttattttttgaagcgaaccgctacaaaagcatgatgctttttcgcggagcgctgaaaattttgaaaaataataccggagacaaacaatttttgacccgaagagcaaaacaacaacaacaaaaagcttatcgagtgcccttccagaaatttttttctgaatacgggtctgaaaagaagtgacaatgaagaaccgaccgatttgaaaagttggccaaccgccacagcgaattccaccgcctggtcaacatgctcaaaatatgagcacattttgcgcactctgtcgcccacaatttcgcacattctcaaatggtaaataaaaacagtttgcttcttcttttggcaaaatgtgctctcactttacagcccaatcggagcattgcctttgcacttcgctccgtgcgggcagttcaaaggacgggcaaatgccattcactcgctcaatggctgtcttaagcaattgtctggcactcatcggctgattttccacaaagctttcgacaatgtcttaaacatttaaaatcaggattacatgcccaaaaagtcgaaaatcggcatgccggcactcgtacgactccccccccccccccccccgaaattgttttggcactggcattccaattctatttttgggccttaccggggctccaccctttggtggtaacgcattgaatggcggagatcagtgcgccttgggcaaaaatttgttccgcactttgcacagtgtctttcatctgtttgatcaggcccagcaaagttgagtcgggttgtcgaagattttccatcaaaaaatccttaaaaatgcaattatttggacagttttagtcattgcattgcaaatacgcactgaccatcctcgacttgaggaaaagctgtaacagttcatccgcggtggtccgtggcctcaacaaaaggtaagcgaccaaagcactgacagccaaatgccactgggcaccggcagaacccattttggaagtggaaatgtcaagcaattccattcgaaaatggataaattggtcggaaaacatcggcaccaccggaggatgggagaagggaagtgcaaaggaatcggaggaggaaagcgtccgatggaaaaagtcggcgacacacagacaaaaggcacggaccaaagggtcgtcggagacaaaagactaaaagcgagtgaaaaattcaaattaattggaaaattcaagcggaagaacgaatcgggtgcaccaaaaatgtcgcaaggattttccataaaattttctaataaaaaattctacgatttttttcttgaaaaatttcagtttaatttttttttccaatttcggcggcgaaattatgtcgtcctgttcccgaacgaaccatggaaagcaaattttgaaggagcaaaaaacaacgactggcattgggtcgtaataactttggtgccaccaatttggtgccatcttcgccggcaaaggagggcatttcgctgggtttgtctttctgctgtccatgcacaacattttgcccaatgttcgccagcagcgaggccaattcatttgcaatttcggacagtcttttcactgtgttcgacgcctccaacacgtctctgtaccttctgccgaccatgcggcgcaactcctcacgctttttgtccatctcgcctctgcaacgatcgcaattttttttaattttcacagcaataaatataccaatacataggtttccgggggtcgctgatcacgaacacagcacccattgaccaactacgaaccccgggcacgaattcgaacaaacacttttatcaaaattcatttattacccaaaatcgatttgaatacaataaattagtcgaattgatgccggattcgtggccagactccggaaaccatacatcgttttttttgcttggaaagtgaaaaaattttgcggggccgaactgcacaagaaactggcataccggcgagcaaacaaaaacccactttagtgatgattggatttggacgagctgttcaacattaagctccctcatcattcggtccacgttatttaagtcaccactactcattattatgacctttcccaatatttgattagcaaaaaaaaacaaaacaaaaaaagtaaaacgacgaatattgcaaaatatcaaacggaaaaagcaccaataaatacatttattttatatgctttaccaaaaaatgaattacagaaccatattgcctaacaaaaaaaggtcatttcactgctctgattcacccgccttgccagccacctgtcaaattcaaatgtaaattttaagatttagttattctaaaatttttttccaattttccagctagaaacaaattttttttgttgtcataagttcttgatcagtgaccctgaaaacctatgcaaacaattttcacgaattataatgtcaaaaaaaacaatccaaaaggatctccccactagtttttttaaaaagaaaattcaattatttttcgaaggaaagcaactgaaagcatcggtgcttttacagctagaaaagtgcgctgctgtaaaaatacccgtgtgaaatcctgcatgttcgtagtcttcgcaattggcgtgccgtaaattcgaaactcatcgacaacggttttgtcgccccctccaacattgtccttcacgaaaaactgcagattgaacacattctaaaccgcgacgcagttgttttgcattattttatttcaccttatacaatacctggaacttgacgtatttgagcgcgacgagtttttcttcggacaagtcgatgcactgaaaatcattatttaataattagtcaattagcatcggttgacacattttctgaacctgaattggctcggtggactgtgcctggtcaaacccaagagtgttggtgatgttcgcaaatattttcacagttttcggcgccttctctttggggccgttgaaaaggacggagtgcactttgaccggttggatgaaggacacgctgatcagcagttgctcgtcacaatcactgatcaggggaccaactccgttcagcaaattgttcaaattgttggaatcgtcctaaaaagtaatacaaataataatgcacaaagagaacaatggatagggaataacctcgttcaaacattcgcattggactttgttgaaaagcggtgacaattcgcattggccaggaatcggtgagaccatttgagttggacaatttttggaccatttgtgggccaaattctgaagtgcagttttgtcggcaccacgcaaaaggtccacgcgttgactgaagaaaagaaaggcaatgatttagccaaaataaaggactgaccggcaggcccgtagcaagaggggaatttttcaagaaaattggactaatttttgaaaattattacataatttagggagggggacttgagcacccggccggccattatgtggaaaagcatcaaaaatcgaattaggtaagtccattagaatagaaagcagcgaacgaaaggactaccaattccaatctgctgttcactttactcattgtcaactaacccattaaggagaacaatgaatgttggcattgcactgacgccgtatgtgttctttgtttctgaatgaatttaaggtgtaatataaatattcaaggctttcgaattataacatgaattcaaagaaaaagtccttttatataaaatttcctcgcattatattgttattatggttaaaaatgtatgaaattagtttctggtacaagcctagtttaaggggtcatctttagctctcacctttgcatttgtcgacatccactttaacaaatttcaaattaagataattgttggataattcgtcaaaaaccggagcgatcgcactgcatggttggcacctaaaagttactggttaataatgaaattgcagattaaaaaatggacgataccaagtagcaaaaaaatcaacaatacacggagcagtcccaacgtttaaaagaaattttgtaaattcgctgtccgtttgtggttttacgacaggcattcttcagaataaatatatcagcagctaaagaatacgtcaaatgatgattttgtttgtaaagatgagattttaggcacgaaaaaaaactaaatatgtagtcctttacggtaggggtcaactccttccgggcaactccgtctcagaactgttcaaaaagctatcttttttctgagttcaccaaatttatcaaagatggtatcattctaaattcgaatgatatcaagattgttgaattcggtgaacaattaaaaaagttatgttgactcaaagttggctcagacggagatccggtcctttaagcaggcaaaaaaaaaacattggcattatgttaacaattaattttaaaatcctgaataagtaccgattctacagatcaactttaagcaaaaataaagtaaaaattaaggttcgagccccgcccccgggggcgggacaggttttttgggctcacccccgcccccgcccccgtgacgctgacccccgcaacccccgcccccgcgaaaagccacccccgccccacggggctcgaaccctaaaataaagcatacctctgctgctgataaaaaagaataattaaaaaggaggaacaaagaaatttgtttcaaatttaaattgatcatttgtttggcgaaatgttttctcaaatcaaatctcgacatgaactcaaaaaaccggcagcgacaaagatgcctttttctccatgtacataaattggtttgccttttttcgtcgtgagatttctttttagagtgctttatcatttgtttttttggtattttatttcgtatttatctctcaatgtttctttcctttctgtttcataatattttcttcctccgtcctcccttttcgcctccttttaaatggctcgtcagcaattgaatattcgccgccgttccgttgtctcttacgttggcatcagtgagcatggccaatgcggctactgcaaattcacaaaacgcgcccatgacaaggccaagttcggtacgttcgccctctgatgggctcgtgtcttttccatccgaccaattttctattccgggaaaaacaaattgtcgaaaagttttcgggtgggagtgagaggcgtctctggaaaagcattttgtttgtaaaaccaaccccccaacaaaacaactccaactcagcagcttcaaccagtgaatgcaatgcctccgtcgatgcgtcgacggtggcgagcagtacaaataatgatgggcaacaacaagcgaatccgcccaatgcacatgaagaaaatgccaacgatgatacaaatggagggggcgactcggccgtgttcggtacggcctacccttgtttttgttgctgttccgttggcatacatcgttttagaggggctggcgggggagggggaatttctgtgtggaaatgccatagacggactgggcatttgtgagtgcctttgatcaacccttttgtcacactttcatggaccatttaaaatcctctgtaaaacttaaccgagttttacaaaagccctccgattggttctgatggcattggtctcacaaaaacggcccttttggttgggattgaatcaaaaataaatgctaacatttttattagttccttttttaccgttgtgtcctttaattttgtgcttctctctgctcaggcttgcttgcttactgtctgaccattgactcatttggccaacttttggacatggggttggagtcggt

SEQ ID NO: 6965 - DNA, 798 bp, Heterodera glycines
ccgccaccgggggcgggacaggtttttgggctcacccccgcccccgcccccgtgacgctgacccccgcaacccccgcgaccttcacccccgctttgaatttttttaactatcgagaaattttatgaaataaaataaattttacttgttttttattttatttgtggattggtggatagtgcttcaatactaacagtacttttgtcatgagttcgattccggctaacgttttcctttaatttatttattttttctgattaatacagggtttctttatgttcttgtttctaagaaatgttctgatttgggggtaatgccttattttcatctaaaagaagaaaatttctgaaaaatttggctaagttctaacaaaattcatataaattcttaaaattttccccggtggcgcctatcggcaccgccggcccccaaaattcctatattttttcttaaaaattagaaataaatttaaaattcgcccctatcggcacgacccccacaaaaaaaaaatttttttttcttaaaaaaaattacacaaaaatccctaaattttggttactttttagtcgaaatctatgcaatttatgtcaaaagaaatagtatcgaggcgatcaacggatacagtaagcataaccagatcactctaaaacaacaaaacagtaaaagataaacagatcatttaagtcaaattgagaatcaattaaagtcggatgggtctgactcatcccattctcgtcctttcactggcaaagcgacggatgaacgttgagcagtgcggaaagacgcatggcgttatgcaa

SEQ ID NO: 6966 - DNA, 830 bp, Heterodera glycines
gcattttttgttttgattttttaaaagccgtgaaacgtttccgtaggtcttctccaaactcaatttgctcattgtctataagtgaaaaattcgacattttcattcaaattcaaaattaccaactcaaaatttaagaattttaaagttagatttggttgttattttctaaaatacatacataaatgaaggaaaatggaaaacattgtgatgatgtgaaggattccactaacatgacggccgactatgaaaagatgttcgctaaaaggtatttttaaagccgtgccaggttttgtcggttctagtgcagaatacgcgtcccatggacttttacgcgtcccataattttttatgcgccccatcaaatttttatgcgtcccaaggttttttacgcgtcccattgaattttcacgcgtcccatgaacttcatcaattaggattttttttttagaattaaccaacttttttatctttggtttccatccgaatagcccatgcttggcaaagcgtgtccagacatttgcgcctatgtccaaaatcggattcaaacaaatttttactaaaattaagaaatcgtagtcttctaattattaggaacattaattttgctgtttgaataattgatgtgatgacttttttaagaatatctaactatcaaattatcagacccccaatcgctttaggctatcagggattaaaaaaacttgttgaacccgacataggcgcgaatgtctgggcaattgtgaagatcattggtcccgaaatttttaattaattttttttctaaaaattttttaacacttttctaggggtgacttcaggcgctgagcacg

SEQ ID NO: 6967 - DNA, 2315 bp, Heterodera glycines
aaaattaagaaatcataaatcgtagtctctaattaattaagaacattaattctgctgtttgaataattgatgtgatgactttttcaaaaatatactaactatcaaattatcatacccccaatcgctttaggctatcagggattgaaaaaaacccgacataggcacgaatgcctggagcaaaacgtgggataaccttgccaaagatctctaaaataattatagaaaatctaaattggatgttttgattatgtttcacgcatccacacatccattgtactttttctaattgaaagaaagaaaagaaaatattcccaaaattaaaaaatccatgggacgcgtaaaaactcttggaacgcgtagaaattcaatgggacgcgtaaaaaaccatgggacgcttaaaagttcatgggacgcgtattctgaactagaaccgtttttctgccatatctgtcgcttttttctgttaagttaaatttaaggttcacagattcggatgtgaattacattatggctttgaaaattgttgagattgaacccatatgtatttctccatggaaaagttgtgaacatagacaaaacattgtcgaaaatggacgattttatgaggcacagcgattttcaagaggaggacggggacgtttttacaacagaagcagtggaaattttcgtgatgagaattttggaagacgaagagggggaagttataatcaaaggttttaaattgttggactttttgtttaattatatataatcatggcaaataaatgtctttttgatcccatcatagaagtaaaaagttcttttattattttatgatttttcattattacaaataacttttgtttgcatttttacaatggaaaaactgagcaacgatgagacgcaaatatatgacagacagatacgattgtggggaatggaagctcagaacaggtcttgaaagggatgtgtccagtcaaagaaactcgaggatttgttatcatgactaaacatagttgcaaattatccttcatctaaaaagggaatcgtgaactgaaaatggaaaatagagtaaaaatgggcggccatcggacactaaaattccagttttaaggtcctgtaactctgaaatgttgctatcggcagctaaaattaggaattcacaatacaaaagactgctttatatttttcgacttgcagttcgcgagcttccactgtaagaaatgacccatgagtttttgtatttaaaggcttcggaattcatccgttctgttggttggattgagtggtcttggcgcagaaattgcaaaaaacctgatgttatctggcttaaaatctttgacaattatggacaacaaagaggtactaatcggttgaaaactttccttttcattcattcaggtcgttgaaggcgattatgcatctaattttttgcttgttcgtgccattaaaacgaacgtatgtttttactttctcacatttgattgccttttgcacatagatttgttttagcgtgctgaagcttcagctgaaaatttgaaattattaaatccgatggttgaattaatggtgctctccgattctgtcgttggaatgccgtcgaacttcttttccaaatttgatttggttattgtcgttgaccaggattatgacacaaccaatttaattaacaagaaatgccgtcaaaacaaaattcggttgtttggttgctaattttttaacggacttttccgttttaatttggctgtttcctttaggtttgaagctgccagtgtcttcggttgggttggctatgctttttttgatttcaataatcacacctttttgatgtaaatcaagaaaagttgccgtgtagagcaaatacttttcttttttcagtccaaaaccgaaagagaaggaaacaattattgaaagtattttggatggggacgaagaagacggggaaactgggggaggaagagggacctgtggaatgccaaaaaagatgaaaatgaatggcattgaagaaggacgcggacattgcggcgatagccatcaaacactgaccatcggagacgaagaagacagcaaagtcaagaaggtgaatttacagagagcaaatgtagaaatgctctctattaatgcgaaattcctttcatccctttcacttcattttccgataataaaaagttcctcttccagactattccatttccgagctttgaacacacttttgccattgaactcgggacgaaacgcttccgacgcaaatttaacattccaagcacttattttgttgtgcggggtaagtaattcaagttgtattttatgtttcacaacaagggcgtagctagggg

SEQ ID NO: 6968 - DNA, 1880 bp, Heterodera glycines
atcggcacattatggtcaggtaaagcgtgagcgactatcgcatcggattatcctgaaataactgtcaaattaatagtctcaacaagcgtggacagcaccaacccagcatgaataaagagtggggtgaaaagacggtagagttggtcgggaatgtcacgcctcagaaatggagtcattccgcaaacctcattcagacaggaaatctgaagtttgcaagtaaataattaacaaacaatacaaaacctgagaacaaagggtcgcattcgggtggaaatgcccacggacaaagtcgcagtactccctggacgttatccgacattgtccgtgcatttgaatgcagcaaggccgtcctgtgaccgtacagtgcatatgcttttcggatttgggtattgatggagaatgcttttcgcaaatcttttgttgaatcaatttcatcttcaattgattggttaagattttttaccggccaattcgaaatgttcagtccccacacataaggatgtactgaacgcgggcgagcacagtatcggggatcctggccacaaacaacacgagagtaattcatttcgggaaaagtgccgttagtccatttcaagagagtcgcaaattgtttctggacaaaaatcgagacaatcaattagcaagtttacgtaccgaacactctgatgtctggaaacaaccactgagcccaacacaacagccttaacgataagttcaataaagaattgaagaggctaaatgtcgtttcaagttcggaggcgttatttggcggcgtgattttggggtgcacccgttataaataccaaattaacccaagaatattgtggtccgaatgaaaaaaaagaaaaattttctttatgttttgtggcctataacctaataaattgctgtttaacatatgactctcgaaacgagacactttcaccgagtatcaaaaggacgcacctcgaaatgcggagtaggacaaaacgtcgtcagccgaaacgtcgtcgaacgaatttttcaaccataacttttttctttctcaaccaaactaaacattcttggtattattcgaaagcattcgaaaaatgctattagcctgcaaattttcaaaaatttttatttatgcacaaaaaaatcagagcaaaaaaagttcgaattactgggtttttgagttccttctggccataacttttttgaaacttaacgaaaatttttgagattttgcaaattaataataaacacatagagctatcgaacaacaccaacaattcttaatttgattgacagtgaacaaagttatggttcaaaaagtcttccgacgacgtttcggccgacgacgttttggggtgcaccgctcgaaatgaccaatttcgaaattaagtgtatcgaattgaaggaaatattactcaccggtgctttcggcttcagtctttcgttcttcagtaatttgttcataaattttatcgtcccttctcatgcacggagtaaatttggcaccggtatggacgagatcggcctttatatttatgaaaaatagcaattgtaaaaccaaaccatgtaaatttgactcacaaatcttggacccatccaaatattgttttgttcccatacgacaatatgtaacggggagagcgaagagcccataacgtctccgcttctctcaataacattgagcccatttgaatagtcagtgccaatgccatggaaaatgagcataaaaaaagtgatgagtaaatgtacagttgagatccaataagtgaagtaaggtctgcaaaacagcgatatgaaagatgccaagaggtaaggaccggtaatcgttcgacgtgtctttcagcctacgcgcgaattcgacgttgggtcggaaatggccaaatattggcaggcgacgcaccctt

SEQ ID NO: 6969 - DNA, 1205 bp, Heterodera glycines
atttgattgtgtctttttcgactagcacttctcgttaattgacgactaaaataattgaaatgtcaataacaaaataaaaaacaattcaaatacccgtgtagtactgaactaagcccagacaatgccatttgaaacacactttccttttgctcaataatgccgcttcctcgcggttgtctattcaaggaatgtgcacgcttaacagaaagctaaaaatttcatcccaagaaatgccttacaatgactgcatttcttgatgatgaagttggtactgaggaatcgccatcgacgtaacaaaacgtttctaaaaactaggaagtttaaaattgccttctacaattaccagttaatctcgaacaacttcgaactttgtctgaaaccagtagttccgcctttattccatactgtttattcaaatgcctaaatcttctttgtgaccatttctcatcatccatgtccttttaggttagttaattcgatttttaactaaacaaaaattaattaagttaattttggaaataaaacttctggggacgaaaaatgaggaaatatatacatatgagaaaattaacttattttttaaaaaagattttcccaaaaaaaaatatgtggacttaatcaaaaatttaaaaaaaagtgccgatagattccgcttacaaattagtagggctgtcaaaaatatgtacaaaatgtggtcataatatgtacataaatatgtagaaaaaatcccgaaatatgtaagaaaaacccaaaatatgtaaataaaatttttaaaatggttatttttttagaaaaaaaattcttcggaaagggtgaatgaaataggcacaaaatgccctagaatcacattttagtattttaaaaattacctagtttgataatttttatttttcacaagaaattttataaattttcaaaaattctcaaaaaaaaatatgtaaaaaatgtatgaaaaagtccgaaaaagttatgtataaaactccaaaatatgtataaaagcccgaaatatgtaaaaatattaatactgacttttactggtcccataaaaaaaagaataaaaaggctgtttttctacggttcttctttccacccgggggttatcggagccggtggatcaacaatatgacttccattttccgaccaattcttaaacccggaacccaatttcaaaaaaaaaatcgaaagttcaaattttccaaatttgg

SEQ ID NO: 6970 - DNA, 2268 bp, Heterodera glycines
ttgtataaattgtctttaatattgtaattgatcatttatttattaagtaattttaaatataaatattgttttcttttttataaaaaaagtcttaataattatgactatcaaaaatatgaacgaatcttataataaatactcctctctttctcttcctttgtttgatcgcttcaattctcacagtttccaaccaacttcggaaattaatcgatgtagctgataaaatcccggctctactgcactttatgagccaatcgacttttatgaatctaattgacttttatgagtccaatcagagtttatgagtccgataaaatatttgtgaactactttttttctgctataaaaccgacaagttttcttaaactgctcaatatatctagttaaaaacacattaaaatgcaatttatttaacttaataatattagagaagaaggtggaaagaacaatatatggtttaattttaaaattaaaaattttcaatataaaattcaaatgaattgcacatcagcaatactccataaacacaatagtatttgacaaatttgttgctgtaagcatggtggaaaaccaaagaagtctaattttgaaataaattgatacaaattaacgcgggacaattgaaaaccgcttttatgaaaactgagcacgagtgttttagtgcaaataaaaattgaaaatagcttcaaataagaattgatgaaaaaataatattataaaatattacttaaaaaatgcattcaaagtgatgatacccctggcaacaataaaatcaaaaataaaatttataagatactttaattatattagaaaaataaactctaaaaacaaattaaaacaagaatttgaaaaagatatcaatatttataaataattaatattcaattcaataaaataagataacaaaacataaataatttatatttattgcaaataatataaattgcgaagataatctatttaaattttttgataaaataaaaacaatgaaaaaggaataaattcaatcaaataaatttagagtttgttttcaatgaaattattgatgagcaaactaccttacaaataattgtacatttaaataaataaacatttaaacaaagtggtattgtataaggaggaaattgactatctaataaaaatagtaattgaatcgtaaaaattattttagggcaaaagtatatttagtgataatatgatagacaacttaaaatttggataggtttaaatatacaattaaaaagtatatttgttttaataaaccagtcttttgaaaccattaatatcattatgcttaattctctaaaaataacaaaatattataacttgtttgactgaatacataaataagatgcataactaaatgatctttcaaaacaaatattcaaaaataagagtagttagcagcccgggattgtcgtaggagacaaattatgattgatgggtattggggtctttgaagttgccgcctaattgatgggtttcgggaccgtcgcagcaatttcgcgcactaaccaaagggtatggggagtaattaattaacgggaccgtcgtagggtatgggggggggtaattaattaaccggaccgtagcatggtcgggaccgtcgcagcaattttgcgcactaaccaaagggtatggggaggggtaattaattaacgggaccgtcgtagggtatggagaggggaggtaattaattaacaggacgtcgtagggtatggggggggggaaattatttaacggtaccgtcgtacggaattaaccggacatcgttggaaaaattttttttttgcacacttaaaatttaaaattgttttgcatgatggggagtagggagatgaggaccatttagctgccagacacttagctgatgggacagttcggcagatggacactaagttacacaataaaaattttacaaaataaaataagccaatatctaggtccatgcaagcctaaagtttaggcctagcctaagccattgcacgcagatttgtatcgctacactcaagcctgtgttaagcttttatcatttaattgcatactataggaaagaacgaattttcccttataaatatgaaaatcaataatttatgcgagcaattatcctaaataaattgaaaaatatacttttacaatattttctttcttataaaatgtctgtatcactactatgcacaaagtcgattgatgtattctaagaacaatttcccggaattcgggtaagcagccaatgctgaaaaatggtcacgattcgccttgtaaaaa

SEQ ID NO: 6971 - DNA, 5774 bp, Heterodera glycines
catcggtgaccccttattcctccctcccctttcgttaacggctataaatttcccaatttccattttaatttattttaaaaaatattcaaaaattttaaacttctcaattcttcccctcccccttgccaacgcttccatcctgtcggattgtgaaccttagggttccgtcctttggaatgtgaaccttagggttccgtcctttggaatgtgaaccttagggttccgtcctttgaggacctgagcgaattttcctaatccaattttaaaatcttttacaattttctctactctctcgctctctcctctctcttcgtggttatgtccttttaggacgtgaacctatggaattttcttcatccaattttgaagtctttttcaaaaaaagtacatttttacaaattttcaatctctctctcttctctctttcatggttccgtccttttaggacgagaactgtacggttccgtccttttaggacgtgaacctatggaattttcctcgtccaaatttgaaatctttttcaaaaattgcagtttaaaaattttctctctctctctctctcctctctttcatggttccgtcctttcgggacgtgaaccgtattaagttgaaatatatggaaacaataaaataatgaaacacggaaaaaatccaaaaagtaaattttgaattattaacccatataaatctaccctacaattaaaaattgaacctattaaatctactatccaagccaattcagtttctacgaattaccataaataaaataatttattcaaacattattataaataaccccaaattctatattctgatttattttctgcttttttctgcttggtactcaacattaagacgagggtctaatctaatcatatatatggcataattacacaaaataataataaaaatgctattttaaaaataataggaataaaattgaaaataatacgacgccacaattactattgaacacatttgcaaatgacaaccattttcgaaatttgaaagtagcaaaaaaaacaattcaaaaaaacattataattaaaaaggttttttgtaaatttttaataatatgtataattgattgaacctgagtcaaaaacgtaatattatttattatatcgattttagttgtattttaataacaataccattaaaaactaataacatttatgaactgacaccaaaaaatctaacgtaatttctcgcaacttagggcataatatgtaaatgatatttaaatgaaaataaacaaaacaaattattctaaatatataataattcttgaataaaattaaaaatttactatataaaatttgtgaaaaagtaaacttccacatccaattctaaaataataaaaaattgaatttgttccgttacatttatttcaaatttcgaactgccagttagaattttccaattgtcactttcgattgcttacaagaattgtcagagattactagctgttaatgttattattaaaacagaaaaagtaatatcattaagattataaaaatattattataaagatgacgaaaaaaggaataaagagtacagttgataaaccaaacctactttttaaatgaataaataatgtaaaaaaagcaatttattaaaatttcaaagttctggagataaaataatgaataatctatagactaaaaattaaatattataaatataacattaaattcttttttaaaataaagatattaaaattcaaaattatgtaacaaacagagctaagaatcttttcatgtcttttgtaacgaaaaccaaataaattggtcattgacgagaaggcgctaaaattccacttcaaaacgctcgaaaacgtgattattttaataaataatatacaagaacgacaaaattatattgatgaataactaaatttgttaagtaataattaataacatttatttatatatcacaaagtttattctgtgactatttattgtataaaatatgaagtaaaaaataaattctaataaaaaattttcttcaatgtatgaaaagaaagttataagcttatttgtttaaaatattaaaaactcacaaaaatcaatataataatataaaaaatttttcatcaaaaagccaaaaaaatatattaaacaaattataaagtcctttaatttttaatacaaaataaaatgaataaacaatttagaagaaacttacaaaaactaaaaatatttaagcaacataggagctcattccgcagcttgacattttttttgtaatacaacccagggatggtctttatccatttttttatttgatggttttttgactaatatcatagcaccattttattcagaaattcgggatctcgcctctgagcccagatgcaaaaaattgataagtaataaaatgaaatgaatgaacatgtaataaatgatctgaaaatattacaacagacagaattattataaaaaaatgaaaataatgatattaaaataaaaaagaattacattatggaaataaaaaactaaataaagattaattcataaaattattacgaatgttgtgtgaactttaggtagtgtgaatttatggaaaattaactgcatcaaaggaagcaagataattaaatttctaactttaatatccgatacctatttgaaaaatttaaattcaatatgcgggcctggtccgcggacagttgatcgatcacccgtcttgcacacagttaactcctcaaacagctcaatggtacctgttaatggcaggcaaaagtgaaggcacattacaacaaaacgcacaaaatgcaggaaaatttcaaaaattttagtctggcgatggctgacaaaaaaagggaattcttcgccaaccctcgtatgaaaaaattaaaataatttacaaaaaatattttatctgcctgacggcggcatctgagcataattcaaacatagaaatttttcaataaaattttttaaaaagaatttattttgttaaaaaagtagtattcataatgaaatttcaaaaaaagttaaaaaaatttaatttacaaaaaaaacgcaatcggagcaaaattattgttgaaaatacaaaaaaaaacgtaaccgaaaaaaaaaactaaaatttaagttcaaaacggaaaatgtgcatttccggtactaaaattacaagtacaaaatacaaatgtatttttttaataattaaattaaatttgaaaaaagacttgtccaataaacaaaattacaacagctttttttgttctctccatttctgccagccacggcgatacaagtcaccgctaataaaaaaaataggtgcggagcagaaatggaaaagagaagcgcctcttaattgatggaaaaatgaaaaatactggattaaatattttttaattagaaaattttaaaggaatttattaaatgtgataagtatttataacattttcaggagaaagaaataattgtatacaattagaaagaacaacttttaggtttttaatgaattaattttttgtgaaaagcaaaaaagttgcatttgtaaacaatttaaattgtgcaaataatatcggcaattgtattttaggtacctatttcttgagcacctaaaagtccgttccctaataaagacactttgtattctttttaaatctttggcattttttttaagccaacaattttctccgcctttttaacagtccatgactgagcttcaataatttagccttaaacaattttaatagttttttcatgtccaaaaacagagattgcacagaattccgatttccgaattgataaaatgtcggattttttatgttttctgaattttttgccataaatttattatttttttatctactttcaaccttttcacagctcttttatttcagtttaattctttttcaattttccgcactttcgcaaatgccaaaatggaagcgcgacagtgttggtcagcaatttattattctgcagccaaattcgtcgataattttttcaattagtttttcgtacagtttctctcacaaaattcaaatccagttctgctatatggaaatgaggagatgaacgtaatagctatttcaagcttaaagcggactatggctccggcatcatcatcatcatcatcagcagcagcagcttcagaaaccaaaaaacgaaaattgttctcggaagaagaccggggtataattaatgtcaaaaataaaaatacaaaagaataattgaaaagttttaagaagtggccgctcttgcactggcggcgttcacacagatcaaaatgcgcttggcggaggacattgagggccagggaaatgcgcacccgaaagcttgaagaaggtgcagccgcgataacggacgagcagatggaaacgatgcgccaacaaatggagcaaaaattccgtcaaaatctgctggaagccgagcagcggattgatcacaaatgggcgacgatgctgaacaaagaacaacaaaggactcagcgaattgcggcacaaagtgcgacggtgattggccaactgatgagtaagcgagtgacagagaggggagaagaaaaggaaaatacgagagagacagaggaaaaaagttgataataagtgatcggtgcaattggtgcctagagaaaggccaagtgttattcggagttaggggatgcggacatgtgtttagctgtccaccatgctctattgcgataatggccgttgaccagccaaaatgtctgatttgtttccataaattaactgatttggaatacttaggatcataaatgtgtacaggatatttgatctggatcctaagtatttacaatatttgtactcctataattgtactcctgcagtaatacctcatccttaacacttttttcattgcctacagtaatcgttaatgttttcatttttctaatttcattaaccaataaaaatttgccacatctatttgatcacacaacaacccatagaaaatgaaatttgcctgaacaatccataaatttcgaccgtgtattttgtaatttggtttaaaaaaataaaaaatgtgaaaatgcataaaaataaatgtgaaaatttaaaaaatttttgtgccattttttgttgttgttcgccatctgctttctccgccttttcctccttttttctaatcttcattcagtccttctcgcactttgaacgcttcaaacaatgcatttgcctgaatttttaaatatttttggttaggcttatcaacacaaataatgaggaaatgtgtgagagagagagagagaaatgagaagcaaaaaactatagggggaccaacacaagggaaggcctgcctaccgcttttcacagctccgaaataagcattgaaggggggccaacacgagggaaggcctgcccatcaacactcagactttatgaaatgtgagagagacagagtgtgagagagagaaatgagaaagaccaatccacctttgccctttgcgctggtgtgaagtcgacagaagatgagaacacaaatggcaattgttgctcgaccacttgcggaccattttgctgcttctgacgcactaattaataaaaatttcaaaaaatttaaatttagaaaaattttttattacattgatgaaaaagtgggcgagcattaagccgttgttgtagaaatggcgccaccggtcggcccacaattgcatggagcgtagagtccatggtagagtcaatgtcgtggaagtgcgtcagcttaagggcatcgcttttcgttgataaacaacaaacctcttgcccttgataatctgaaaaaaaggaaattaaatcgaaatttaaattgaaattttaaatgtaa

SEQ ID NO: 6972 - DNA, 5703 bp, Heterodera glycines
  misc_feature (5525)..(5525): n is a, c, g, or t
  misc_feature (5654)..(5654): n is a, c, g, or t
atttcatcgtcatttttatcacagtgccaattctttctcatcaaatacataacgccaagatgggcctcatatttttgtgccaaatgctttttaattttctcaatttcgtataacccatgagagatcatgggtctatcattgccataaatactcccttcctctttccttcgacataaataatttgaatattcttctgccattttaaaaaatgtctctgaatttgtcgctaatcctttgacaaattccgaaaacagagcatcttcagtctaaatttttgatttatttaattttcattgaaggttaagtctcacccatgttaattgatcatcgaatttagaattgataattagcaaatacttatcagcatttattttattggcactttttgccctttcttccgcttttttgtacattttctctaaatattcttcaaaattttcattaattggtaattttgattcataattcaatcgttctcattcaacaattttggttccgaattataagtgaaaaagttgtttaatttataattcaaaaaagaactcagagatgaattaaaataaaattgcgaaattttggccaaacaattcaccgcataaattattgccccattaatttcaattttgtgtttaaacacaaattttggctttactgtgtgaattccgacgtattctctacacaaatattcgtacaaaatgtccaaatattttcgatatttttggcattctgtcagttcatattcttcaaatttccctgctattttgtcacatttccaattcattctcataaaataaaaaatgccaaggtgtgcatcatatttttgcattgaatattcactgatttgcattttctgatcatttctcacaaacgcaattagcattttgttctcaacctaattaaaatgcaatagtaaaattaattccccaaattaattaactcaccgatggatttgcatttgaaattggaactaaaaaatgctgagcaataataataaaggaaaatgcagaaatataacaaagcatatttctattatttttaaattttcaaaaatgaaagtgaaggaacaatgaaagaatggaagggtcaaaaaagaaacactgaatttaaattaaaaattcctttttggtgagggaatttttataaaaaaattcaaaaaattaaatgaaatattttgaaataaaaaaaaataattattaattaattttattgcctaaattttgaaattatgcctatgtattatatttttgtttgttaaaaacttttcaatcggaacccgtcagttgggccctcacggttggacatagaattttttggctaaacttttttctttgtccttcaaatccaatattgttcatatcattcgacagctcttcacatgctatattagccttacaaaaagcaaaaaaattttctagaatatcaaaaagttattagtttccgcatttttcatgctataactttttaagcaattgtctaatcacgaagcaatcttagaaatggcttctaaacatgttaagctttagaatcatgccaagattgttggatttggatgacaaagaaaaaaaagttatgactgtcggggagcgaggctgccgaaaataaccaaaagacggtagtttttgttttgagtggggtcgggacggtggttctcggcgtaggtcaattaccacaaattgaaagaattcacagcaacagtacaattaactggtcaagctccaacttgggtaattaagccaaatttacaacaaaaacaaaaaatgtaaaaatacaatttttacaacaaaatgatcgattgggggagaggaaagaggaattaggagttttcctcccaaatgatggtgataagcgaatgatgattggggagaattcggacgggcttaaatatgggccaaaatgagtgggtgacaatgatttcacgtgaagggaaggaaggtgggcatttcaaacaaagcattaacgcagatgaaaactctacttaatttaatttctttattttaaaaacgtggattgatattagtaattgcaatatttaaaaaatcggactggtcatcagtaggattatccaaatctgcttaataaaatttcttatattttaaaatttggattgatcatcagcaggattatccaaagcacttaagatattttcttttattttaaaaatttagatagatcatcagtaggattatccaaatctacatattataataatcaatgcaatacataaaaaatttgattgatcatcagtaggataactaaatctacttgatatatttgtttatgatattaaataatgaagcaatatattaaaaaattgggatttttcatatagtaggattatcgaaagctacttaatataataataacgatgcaatacttacttacaaaattgggatttatcatcagtaggattactcaaatctatttcatatatttatttagtataattaaataaagaagcaattataaaatcatataagtaggagattatcaaaatcctttttgagttaatctaacttgtatatctctccaaatacgtacaaaatttagcgttttcaaaatttattcacaagaaaagcatttgaaatgttttttatttacaaaaaaatgggaaagaccaaaaatcacttagttactcaaaataaataaagacgaaaacagcttttaaaattattaaagggttcaggcatttgtatttaaaattaatttaacatgtatatttagaaacccagatagtttatcattgtataattttatcaatgtataatttcgtgacgtatgtattgtcgtaaaaattgaacacgggcgaactgtattcatccataaaatgtattcaaattaaaagtggaaatttcaaaatttttattcatttttttctgaaaattgtcctttttcggaacccattttaataataaaattccttaaaatgtctttttttgcctaaattatttctattttaatatgtttttgtggcttttgaagaaaagcgtaaaatttctaattttgtaaaattttaatttgttaatttaacaaatactgaaatttcagaaaccttttcatgaaaaattacaattctattaatttacaatgtgtttaaattaaattgaaagaattaaaattattttaaatataactgcgaacttatatttaaaaacccaagaagaacaaaagtagcggatttgttgaagaagaaaaatggataattaattataaaaaattatattagtaaaaataattaaggaaaatattaatttgggaatatctatgcatgacaatgtgttggattatcggtcaaagtgaaaaataaacggtgaaaaattaaaattcctaaaaagttacaaaaaaatggatttcaaatataactaatagaattttttatttttaaatattactacgaaattgtatttaaaaaacacaaataaaaatacttcaaaagcataaaaacacagcccatggaatggcaccgaacattctgaggaagggcttaatgatgccaacaaattagtgatgctttccgagtgataaaaataaataaaagaaaagtgaagagaaaaaagaatgattttttgtgcatttttgccattttgtacaaatgtttaatctcataaataaaatgacgaaacaaacaaaaatgaaatgaaaaaatgggcaaaaataattggaggaggagggggaagaaaacgcacttttaaaatggctaattgaatttaaattgaccaatgatcagcagagacaaaaattaacattaaagaataaagaaaagatttggaatgtaaaagaggggaattaattaattaattagttttagcagaatggtgctcaaaaatgttgatggaacagccaaaaagcaaaagacgtttctttggtgtgccattggcttaaacttcggatacaaaactgctcgttgtgcgcgtactgcgcctgaattagtgaattaatttgctgtccatctggtcaattaattctcctacagatgggaaaatgacatttgccgcttcattgggtcggccgtcgccaaattttccaccgaatttgttaatggaaatttctgagctgcgtgaactccttccgccgcccaaatttgtcgcgctggcattttggcactgcgcataatttgcgatggcgccggagacggcgaaaaaggcggcattgttataaaatggtaccaagttaattagccaaacaaatttcgatcattttgtgcccactttcttctgtgatccatgtaacccaacggcggaggctttggtggaatttgtgtgccgcaaggtaacagggaaagattggcacattctctttgacgccaaaagttgtttttgtcgacgaattgtgcgagtattcaaaaagagaaaacagaaatgggtagaagtcggaggaggacgaagacgaagaggagaggccgcggcacgaaggaggacagaaggaacgggtcgcaggtgttctgcaagttcagccaattcaaaaggacagagcgacggacgcacccgcggatttatttgacgtttgaaagtctcgtaaagattctggtcaaagatgcaaccgaatcggtgttccatctgagccaagcccccggggttaaagtgaatggcatggtcgagaagggcaacggtggaattgggcagcttggaaaggtacggagagacgagcaaagcaaacagcgacacctccaccagcgcaaacagaaggccgagcataaggaacacctagggatttgtaaggattgggccagagtttaattggaatgccaaattggcattttggggccgtctcttgcgcggattctgagtctggcaaaagcaaagattgaatagacaaacgagttggacacaaaattgttttttgtatggaagtgtgtctctaattacaccttacaaacaattagtcttctgtcgaatcgccgaactccacacaacgggtggatgaaattaacaatacaatttttagacaccggaattccgtcgaaattttggtaacccataaaaaacattttttgtaaggaacaatcaaaataaaatgtgtttttaaatatgactccctttgcaataattacaaaatcagattctaaaaaaattgcaatagaaactgtctcaacaaaacctaaaatatctttttaaattttggtgtttcatgtgcatttactcgtcaaaacgctcacctttggttcatttcctccccatttgcctcatcaaaatgagagaattcgtttccgccgctcacgaaagagggcgactgcacactttcgctgctctgtcgcccgattttggcccattctgcgacttcctcctcctccccaacaaagttgaccagctcaactttgcccaccgcgttgttatggcaattatcttcaattaaagagttcgtccctttccggtccgttccttttccctttggcactgcccaccgcttttgctccgattcgccatgccgtgctcctcatcctttgggctcgcttcgtccatactttccgactcgcccagcccattgctctccttttgttggtcgaccaatgctttttcctccccattttncactattagcagatctgtcgtttgtattgtctttttattagttaattcccatttacctttacattttgatatttatttgttgcttgctgcttgcttatggtcggtttgaatccgcattacattttcccnaagtgacgaaaataaccatcatatcccacaaatctagatcattttcaat

SEQ ID NO: 6973 - DNA, 2564 bp, Heterodera glycines
  misc_feature (2482)..(2482): n is a, c, g, or t
attaaaatttttattgcatgtaaatgcatatgtggccccctccctggtaatcacaataaaacagaaattattccctaaggcttgatattttaaaaattttcaaaaaagctagcccaaaaatattaattttttttacaatttggggacaattaaaaaacttttgctattaatgaattaagctaagaaagtttgttcaattttcctttttctccgcttccgaccccccccccacctattttggggcattttgcgggcgaaggtgaggggggtcgacttctgcccattttccatctatgctttacaataataatgtggcgcataatgttgccggaaagccttcaatttaaattaattaattgacgcagttgggggagggtctgcgccgtttgttccgatttagccgtcgccaattgcccaatttgccgcccaaaaattcgcaccaaaaatactccgcaaatttatctcaaactcaaacttgggtaattaaaccctacacttacaataaatgtgcgagaaatataaagaggaggccgtcgctccgccgatggtccgatcggcgtttttgcgctgcctcgggcgaccttcacgcgggtaaggcgccacatccgctttttatcgctttctttcccctaattcacgtgcccgccgtcagccgacccctcccttcacccctttctttccttcatcatttcccgtttgccctaattttctcatcatttcatccatcaatcactcctcgttcgctacttcgttcattcctccccgtcctccccatttgtccgctcgacggacattcgcggctgacgttcagtcgcgacattcccacgactttgaaaacgtcgttttgagcggaacgcgacgcgaccatttgtcgtttcagatccatcaccagcggggacggctcggggtcctcttgttgcgaacttgccgtttcattcgctctcatctcctggggcattggaggcggtaccagctcaattgcttcaattcttgaaattgccggtgctcgccgtgtgcctcgagtagctctgttccgctgcgtccactgatttcccgtcaccaaattgcggacggtaacgatgacgggccccattaagtagacccataccaagggtatcaggacatcgcgcccaaaaatgaatgtgacgtaaatgcagcatgccgtagtccagtaggagacgagcagccgaagtttgtccatgaaccattcttcggtgaggccaatcactccgctcgggagggctccgagtgtgagcgctcgtgccgttttgtgctccttctccttcgacttgtattgatccaaacgcagccattcgtccaaatgcgcgaatagcccttcgcctgtttcctgcgaatggtgatgacgctgtgaggatgtgaagctctggatcgaggaatgcgttgagcgtcttcttctcgatgcggatttagactggaatgtagcggtagcagttgttgactgcatgatattccacattttgcattgaaaactcagcgcatgaaaagattttcatcgtgtcctcgtttaaccacctggccataacatcctcgcgtgtaaaagtcgtctggcctgaatggtaggatttcctcctctggaacttctacggcattccttggaaaaaagctgcgcgattgattggcttgtggcgagttgtcctgcagttaattgtgcgcgagttgctcctcctggatggctctttttcccaatccacgatcgttgacgatcttcaggtaatcatcctccaggattccaaacgattggtccgacaagcgaatcggttttccgttgcatgctgttttcattttcgcctctttgctaaacgttagcgcctgttccttgcttttggatatccatgttcatcctgcacaatccgttgatcccgtgtgctctccgtccatactttcgacgaaatggtagtcgcatggcttacagctctccttgcactccgtttcccaattgatggactcgtgcgcacggcacgagtacacacaaaaggaaaaactcttgttcgcgcgattaaccttttgtaccctctagaaattaacacttctgcggaggacgaagtcagtcaaattcaagtgactgccattctggattagcaaagtgcggtgatggcggtgatgggaggcatggacccgcaagctgccacaacggagtccagtttgcctccagggacggtgaggcaggattcacaaatcgtcacgacagaatcgagtctgtctccagtcagaggaaggaatgagcggcaagctgtgaaagagcgaattcgaaagagacagccaacggaggaagtcagaggcaaaggcaaattgaagaagaatgggccatatgatccactgtgaccgggcaactacagaattcctcgccgaaacccgttcattccgtcacgagtggcgtacaatgagcagacacgtacgtatcgacgacaacggggaaggcggcttgatctttcgggattgaggaagttgttcgttggattgngcggcactgaatttgtaagacgagagctgcaagagaaggcgaacccggctctaagagagaaaagctgcgaaaatataaagtc

SEQ ID NO: 6974 - DNA, 1618 bp, Heterodera glycines
tttcgaagtgagttggctaagaaaaaaatgttttttaacctttaaatttaacgctcgaggtccccgattaccgactatgtatcgggagaaggggggaaaagtcggggggggggggcggagttcaggtaggggaaggggaataggctgaaaaatgtcgggggcgccgggcggctcggggtcggggctcaaccctaaatagaatttagccaaaaattgtcgccatattttgcaattgtcaataagaaacctagaaaattaaaaaacacaaaaattttattttgatctttttaaatatatacttatttattagccactgttttgttttattaagtcaatttcaaagttttaaataatttttaaaatttggcatttttatttgcgtgtttgagggattttaggtcacattttaagctccgaatttagcattttttagtgcctagaaacacgatcattatttattattctaagcacatttttcaaacacgaaattccctccacaaaatgaggcttgctcggaaattgaattaaatttgaatggattaataatagtttaatttaatttttaaatgattacttaacagtaaattcctccgttatttaagttaatcaactgataattgtgaaatgcaccgacaaaagcacaaaaatttttgtcaaaaacagaaagacagaacaaagaatcaatttcgttgagcgaacaattcagacgagcttggatgctgactcttttcttggcattggtttaaggtaaccataaaaatgttaaatattatcagaaattttaaaatttccacggctcgccgccttggaattttttttaaatggcgcaaagtttcggagtcatgaaagcttttcgagattggattcattcacatttaaagtacaatatttcttatgctgggacttatttgccaaaacaaaaaactcaagaccatggtgtcgggtagcgatgttagggcgggaaaaaacagcgtattgcgcttcgagtcatgttaaaaaaaattgttttaaattttttgatgatttttacaataaaaatcagggtccagtttcaccgacagcaccaatgggcaaaatttgtaattttaattgtatttgttaagatattttctaacagattcagaaacttttatgtattttgattaatatatatttttaagtgtgaacattttattgaaattctttaatcgattttctccattaatttagatggtattttgagattttctattctcatagaataacatttttagaactgaagacaataaaaaaatatataaaacatttttgaaagaaaaaaatagttaaaatgaatcattttgtcgcttagcaaaagtaaagaaccttgagattagcaggacataggaacacagttaagtcactgaaccatgcgcataagataagtgcaaaaatctattggtttgaccgtaacaagaccaaaatgttcgggtcgcggattaaatttaaattaaaaaagtagctgaaaaatgattaaaaataccgacagaccaatggttttttaatcctttaagaaaaattttaaaaaaactatttaaaaaaatgtttttttagtttctcgttgttagtaattaaatgacatatttttaacaaaacttgt

SEQ ID NO: 6975 - DNA, 2499 bp, Heterodera glycines
  misc_feature (120)..(120): n is a, c, g, or t
gaagcatcacaaaggtatgaaattcgtggtactacatttgcagactgacactgttctaaatgtaaaatcttattgctttttggggaaccgcacagtttggcgggcgcgggtttttttgcncaggccttatgaaaatggcagatagttagttatgcacacagtcaaacgaaatctttttgaaaattttgtgaatttttaaaaacttgccccacaaacccgcgcctaaactaaccacgacgacctactttttgcaattaactgaatttaaacttgaaaatttttttaaaaatttcccatcaaagaaaatacataaaaaatacaatgccaaaataggtttttctcagtcgaaacaaaagactgaggagcaactacaaaatagtatgttcgtagcgctaataaaatatgaattttctcgattttattgatggggtttcttgaattgctaattattggagcctaatgcagggttctttctttctttgtactccaaaagcaaaccccgcctccccccccccccctaatttaagtattaatattaaaaacaaggtgcaatctatatttaaataaaaagatttctgctatttttggcttaactcgcaattttttatgtattttttaaagattttttggccaaataaattacaaaacacaacctttttgtaattttgcccgttggcaccgccggatattatcaatatgctaaagtcggtttttaaatgttggctaaccgtgaaattcactccattaattaagaaaagttttttgacaaacaaaacttctcttataaaaattttcttcgattattaatccacgtaaaaaaaactcaaattaataaatattagctaaattcacaattttggcaccaaaagagttttacatttttttcgttagaaatccgctcacctcgtggattaatataaaatatcttaataaaattttaaagccaacgataattttttaacgacaatttactcaaaaacattgcaacaactttcgcacaaaaatgatcacaccaaaagatacgagcatttagcccaatgttttggcacaatttcttttttctatggacaaatttataaggcactaattgtggcacaaaattggctaaaacccagtgtgaaatttgaccaaaaattgacggaactcaaacagcaatgtgatgatgccacaaacgaattggcaaaaaccaaccccaaattagctgaaaataattccatcaaaaatctgctgctggacaatgatggcattaaaaatttgacaaaaacttttcacgacattaaaagcattgtaaattcgccaaagagtaaaagtgctaaaaatagattgacagaagaaaatggcggcgcaatagaaatgattgaatttgatgatgatttaaaaaatatgggaaaccaaagaggatgacatcactctcaaacggacactgacgatttcatgggaaattgggtgtggattgactgatgagtaggggcacagatttgtatggatttccatatttttttgcacacttatttcggcctaaaaacacgtaaatagtatttttagcttggtttgatgcttctaggatgactttttattgccatatttcaggtttttgtccatgtttccctattttcatacatattttagcattttcattaaaaaagtcgaaaaaataaaccccctaaagatggaaaatttttaaaatacgccaataaaatggaaaattttgaaaaaaataccaaaaattgtgcaaaaaaattcattagcaactcgcttaaaaatgatttttttttacagaaaattactaatctttgcaattttttttctaaaactttattcttataaagtataacaattaattcattaaaatttcaaatctttatacgaatgtatctcgtttttcaagaaattctgattcactaacgcttttccactgacgcattttaagaggtgaactaaattttggcctgttcatcaacctaaaaaaatttatgtaagcgacggctgcatattttatttatttatttattcaaaaataaaaaataaccaaaagaagggcattgctgccgcttacacttgaggtggaaatacgaggtcaaatgggtagaagtgaaagaagacaatttacatttggtaatgaaatgaggtcaatgggtagttgtgacattattgttgaaattttaagcaaagggaaattggtttttataggaaattgagaaaaaatttttgggtaaatttttaggaaattgtgtagagatattttttttttcgatttgttggaggtctgcagaactatttatcgaagcactgggggaattgttttcgaaatgattccagttggaggagaaatttgtcagtatttgagagtggatttggattttcgttttgtgtgattgttttgtcaacctgcgatgattttgaagtgtcttcactggcctccttcggttctggtccattttctttggcaagagtcggaacatttgtctgtggggtttgtattgctgatgccaccggagc

SEQ ID NO: 6976 - DNA, 5996 bp, Heterodera glycines
  misc_feature (113)..(113): n is a, c, g, or t
  misc_feature (272)..(272): n is a, c, g, or t
  misc_feature (5931)..(5932): n is a, c, g, or t
  misc_feature (5939)..(5940): n is a, c, g, or t
  misc_feature (5957)..(5957): n is a, c, g, or t
tttttgccccatatttctggcttttttagtccatagtttatgattcatatgatttttagtccatataatttacaatccttataatttactgttgcccgccattattaaatttntagcattctgagcaagatccaacgacagtaagaatgtggtcaaataatgaacagctagaaaatataaaggacaacacaattttttataaggctttttattttattaaaatagttaatgctgatgaattaaaattcattatttttaaagaaccaaaaagnttgaattttataaaattgtagtagtaaatattttcttaaaaatattagtgaaaaagaaattcatagacctaaaaaagttctaaatttgatcttttgtttcatttttcttagttgctttccaaatttattcaaaatggaggtgtgtacagaataatttatttaatgcttttattgaagtaaaaaagtcccaacaatagcttaatttggcgattgaaaaaaataagtgtatggagataaaaaccatctttaaatttttataaatcgggatggcatttgcaggcaaatacttaaaatttctgtgcacttttcatcggaaaataaaatatgataaaaataaaaatacatcttgaagaaatgagatgaaaataatttcaaaaaattcacccctatgaattgaaaaaaactttctccaaagttttcttaacaaaaatattgcttttgaaaaacttttcctaaattcttcgaaatttctttttcaattgaaatatactcaaaatattatgtgttttttttactaattaaaaagttttttacatattagaaatataaacataaattaaaaaaattttatatatttatttttatacgttttttagaacaaaaaaggtctttgaaacggtcagataagaaaaactctatcataaaatctcagccgaagaattatgattaaattaattcttcataacgatgttttatatcgtcaaaaaaaagtcaaattctccaggcgaaaacctaaccactgctcagggttaaaccaaaaaaagcaaacaattacaaatggacggactacgaaacaaatggataggatttattgctcatattttattttattagcttcatcaatgaaaaataaattaaaaaaatgatttctcgccttgtctgatgtaaatgttgtccttgcttttgtattcgctaaatgccatcaccggcagcggttttgaaatgcgttcgccatgttgccaaagcggtgaaatttgggcacaccttgaaaaaaaaactttaaaaaaattgaaaatgccatgcaaaaaaaagtgccaaaaatgttacgcgtttgctcacctttcagtcaatgaaaggagtcgcgcatgcaattgttggatgtattcactttaaagtataaaataaaatttaaaagattaaaatgtaatcgcggtttggattttggcatttttagtatagccagcttaagaggatttaaagcagaaagattgttttttatcaattttggagcggttcggaagaaacaaagccaaaggcttgttaggattttgtatgaatttgttattttaatcaacaaaagaaaattcaaaaaaagtttcaaaataaaccccaaaaaacagttaattaaattgaatgaatatgtcccatcaaacacaccattcgatcacgaatccattggatggcatcctcaactcgacgaaaagcgttgccacgcgtgccggacgatgcggtcgagtagcgttcagtgacgtagcgtgctccctggctaaggccaagctttcagacggtggaggtaggcagttcgacgttgttccaggccaataactctgaaaaattatgatcagcattttaccgatttagaaaaaaaaaatttttgaaatttcttattctaattcgttgatcctccccgtcccccttaatttctcatcctatacttaggaactaaaaggtttttagtttcgtggtcaatcctcggtctcgagcttcactgaaaatgctctataagtttccatattctttaaaaatccctcgattatccgctcactgtttgttgaagtcggccgcgtccgcgtgccgatgttgccgcagcgtgtccacgtccaggaacagctcgtcaattggtggcttcagcatcttcaggtcgtccccaatttggcgcacctgtcgctccaacagttcaatgcgttcgccgcgttccgctgcgtctaccgagtcaatgcgcgtcaataagtggtccaacttttcgttagtgatgccaatgccgcgcgtcagccgagagaccaagtcgtccaagtttccctgataagaaatagaggttggcgtgtggtacagcagcaacgacgtttgataaacattgttatcccctgataagctatcagaatatttagctaggttcaaattgatctattctggcgagaaatccttatccccgtctgatcagtttatgtcttgcgattatggtgactgatttcttgactgattggggagatcagcagaaatttgtgtcgatcacttggatttgccccacaaggtcttgtggacaaacaaaaccttcggctcatccaccaagacttacaaattactttaaaattaaaataaaacgaacatgtttcgaaaaatcagttccaaaaatttcagcaaaatcaaaggcaaacgccaaaatttaaactctcaaattcgtggccataaaattttagaaaaaaaaaattcaattaattttctatactgatcagtcagatcatctcttccgagtttatcagccaggtatggtaaaagtgcagaagggcacagaatgccaacccgtccttccaactgccggaaaagttggcaacattgacaccggggtatccggacgtaacatggcgagcccattggagcaatgcttcacgtgcagtcagcagtgcaagtgggagtttggagcggtgtcagcagcagcggttgattcagcattagcttgtggagtgccgttgttggtctgttgagtgatcaaatggatgggtgggaaatagagtggtgaatgaagagaattgtgagagaaatgagagtgcgagatacttgagagatagatagagagaaaagggcagaaacaaagaaaaaattgagaaggaaaacggagaaaaatcgcgcgcggaaagaccaaatgtaataaaagattggcagtcagaataattccagtcagtcaatgctcgcgtttcacacatttctcaccgaaattttcaaaaaattttaggctaattattaggactataaattattagttcggcgcataattatgttcgttgttttttagaaccagcgtatttctgagctttgttcacgtcgaacgcaagaaaccggattcgaaccgatcaattattcggatttttaaatgatacaaaaacaaattttctcagctaaactttgtaagttttttttggtttaaacaaaaaacgaacataattatgcgccgacctaataaacgcactaaaaagtgccaattcacaaaatcaaaaaattttaacttagaaattctattcccctttgttcatagcatatgtgcaaaaaatgtgctaatataaataattaaaaagactgttaaatgttcttaatgaatgttcatacctcaacatcagtgcgtcccgtccgtccattgtaattaaattttgtcgcaataaaataagtgttggtgtattggtcacattaaaatgatcataaattggcctaaaacaaaatatttaaatggttatagtggtgatgtgctcattaaagaatgagaaaacttaaaatactaaaaaccattcggcgctaattaattaccattttttctgaaaatcaacaaaattaggattttttagtaaaaatctcctaaaaatatggtcaaaattctcaatttttcccccggcggatttccatatttcgggtttttgctccatattttatgtgcatgttttgtaatttcactgctatccataattgacagcccaaatgataagaccacaatcaatttactaattgctttttgccgtcggtccaatttcctaattgaggagcgagaacattcgcatgcaagaaaaaatccaccaaatgtcattaatttcacagttgagcaagaattgtttatttcacggccagtataatgctaaagttggcggacgacataaatatataataattccacccaaattgaataaaaattattgctgatttaatcatactatactgactgatttactgtagaatcgtccatttctcaattacacggacattttctcatttttatgtgcgacttcaccaacctcttacggtcaaaccaagagctgaaattcatatcatgcaaatttgcccataagcgctccgaaaaaaagtgatgtgaaaatcaaatctgaatttctattaatattcgatgatttagtccaaaaatgattaattgtttgaaataattgaagaaaatttgtttgaaaattttcattaatttaatttattataaaaaaccaaataattttgtattattttcacttgatataaattaaaatttgacttttttttaaatttttaaaattttttgaatttttaaaatttcccggttggtcccggttcccggttcttgcggtcccggtcccgaaaaaaaatcgaggtcccggtcccggcttctcaggtcccggcaagtcccggtcccggttttggcaaaaattcccggtcccgtggcactctaaaaataatagaaaaaataatttttggcccttagaataaaaaaagttattctggtaaagggtatttttttaatttatttttaaatatggtcaagcctaggtttaattttttggtttttgcctattttttcctgaatccccagtgacctgaaactcaataaaaacatgttttttggttgttgttgctgttattgttaagcaactttttgagttacctattagtgcctattttctagattagaatctattgctaaaaagtcttaaaaagctagttgcctaatttagattttttttaaattttgaaaattctcttttttgagccagagaaatttaagctaaattttggaaattcataagacgagttttattttataattaattttttttattaaagttaaaaagaaattagttttttaattagaggctggcggatttatagagaatgggttataatagagaagatacggtagataattttcagtaaaaaactgtttacagaatgtcaaaattacaactttctcacggcggcgctaatagcaccgcacaaccacctaaaaactcatatttttcttaacaaattgacacaaatcgcaaagtttattttttggtgaaaatcttttatcacacttgaattcttaattgtaacttttaatagctgagcgttgtttttgaaaaatgcttaaattgcttatttgttagcggaaataaaaaattttgataaaattcattccgggaaaaaagaaacaatttgaggaaattgtcattctgtgaaaaaataacttttgtatgatccggagcctgattttaatgaattaatatctaaggtgtgtctctttgacaacaacccgaaccctccaacgaaagtaccatttgaatttgggccccgctttgaagactgcgtgcggcccaaaaaacaacgaaaaggcaaatgccctcatcatacagacgcaagatgaaatggttgagctctttaaaaccaaatagaccatggaagtcatcaaggaagtatgtatgagcttcattaaaaattaaataatatttaattcagctcgcatatcgtctcctggaaaaaaacccttcttgaaggtgaaattcaaaggtaatatatataaataggattgtaaattatagggatttatattttttctacgatatactacgaaggagctcaaaaatatattgctatgttaaaacttttctttttggagggtttttagtcgatataggggattttcgggataaatccttannatgcatnntttttaagtatatttgngccattttttagtaattttacaataaatgcaaatcgacg

SEQ ID NO: 6977 - DNA, 1133 bp, Heterodera glycines
  misc_feature (148)..(148): n is a, c, g, or t
agtaaatttacaaataaaatgcaaatcgacgtctgggaaatttaaaaaaataaattcgcccaaaaaagaacgaatattggtttgtaatttttgtagtttttagtgttttttaagtttgtttaagcaaatattgtatatgcatacattntaaggaattttcgagggtttaattatatttggccatttttagcttttttgcccatatttctggcttttttagtccatagtttatgattcatatgatttttagtccatataatttacaatcctaatataactgtttgcccggcattattaaaatttttagcattctgagcaagatccaacgacagtagaattgtggtcaaataatgaacagctagaaaatataaaggacaacacaatttttataaggctttttattttattaaaatagttaatgctgatgaattaaaattcattatttttaaagaaccaaaagttgaattttataaaattgtagtaaatattttcttaaaaatattagtgaaaaagaaattcatagacctaaaaaagttctaaatttgatcttttgtttcatttttcttagttgctttccaaatttattcaaaatggaggtgtgtacagaataatttatttaatgcttttattgaagtaaaaaagtcccaacaatagcttaatttggcgattgaaaaaaataagtgtatggagataaaaaccatctttaaatttttataaatcgggatggcatttgcaggcaaatacttaaaatttctgtgcacttttcatcgaaaaataaaatatgataaaaagaaaataatttcaaaaaattcacccctatgaattgaaaaaaactttctccaaagttttcttaacaaaaatattgcttttgaaaaacttttcctaaattcttcgaaatttctttttcaattgaaatatactcaaaatattatgtgcttttttactaattaaaaagttttttacatattagaaatataaacataaataaaaaaattttatttatttatttttatacgttttttagaacaaaaaaggtctttgaaacggtcagataagaaaaactctatcataaaatctcagccgaagaatttatgataaattaattctttcatacgatgttttatatcgtcaaa

SEQ ID NO: 6978 - DNA, 5707 bp, Heterodera glycines
gtttgtttaatttttttttattaagtttttcaaattttaccttcaaatttcattttgagaaatttgagcaggtacgagtggaacagcccattgctccaatcgcacgcaagccgccaaatgtaggcacggtacacgtgcgtcaccttgtacccagagcggagggcggcctccagctcaatgtgcgtcacagttgtcgaaaatcctatcaagaaaaatatttgcttaattaaaagtttctaaacccacccctttcagagtcctcaaaatgtttgcagttgtactcggggtcgatcaagccgcgcgggtacatttccgaacaagtccggcagagggggaacagcgtccggttgttgacccggtagggaaggaccgggatgtcgtagtgacagtggcggggcggcacggcgtagcacttgatgatgccctcaaggcggatgccatcgtcgccaacaatgtccgctggactcctccattccacgtccttgtcaaactgcaccacggtcggatggccaaccgggtaattggtgtacatattccttaaaaagccaaaatttttcaattattaattttttccggcatttcttaccgcgaaggataaagactgttaaagtccttcactttgattgtgcggcttttccagtcgcccgtctctgggttgatcaccgatgcgcccaagtattcgggccctgttcgacctgtgccggaaaattagttaaaaattaaatggaaaaggtaccgccaaagaaggcgtcgtggaagtcaattggtccggagtccgggcagttgtcgaagtacgccttcatggctgggttgtcctccagcattgcgttcaggtggcactcccagatgatttccacctcgaactcccgcgcaatgtcccgggttcgcttggcatcacgggccctgagggcaccggctgtttctcctccgcccacaattgccgcatcgtcggggaagcagcttgggcatccatgccaatagcacctttttcaatggagaaattggcaccttttcggaattctttccttacccattgacctcgatggccaagtttttgtcttcatcagggcgctccatcatcccgtccaagctgtagttgccgaatttgaactcccctccagggctttcgacatggcgcaggactcggccattctcccgcaattcttcttcggcacgccactgagagtcgacaaaatgtaaaattaaaataatttggatacaccttcaaatatttcctggcgatggagctctgtttgcctcgcttctcgtatcccaagtgtgggatgatggtaacccgttctttgtcgtggtgagccaactgcacccaatacttcatgcagccggatgggatggtgaccgaatccgtgatgtcatgccgagtctcggacaagaacagctgcctcatctttaccataccataggccaggatttggacatcttaaaaaattatatattattattatagtttttccaaaaagtatacctgtcttgcagtagtccgcgatcacttcggtgagctcaagcccagtttcccggttctcgtcgtaccattgctcaaactttgcgcgatctgccgggaagagtccacctgggtaatagttctcaattggtggcagggtgtccagcacagtgccataattttcagcctaaaaaaattattttctaattatctataaataccccaaaacaatagttgcgtgcactgaaaagttttccaacatttttaaccgggtcgtagtgcccttcaacaccgccttcaccgtcgataaaaataacgcagacttcatgtttataatttttcacagttgatttccacgaaggcttcatttttccaaacgtctcaaagcagaaaagccgaaacattccgggatggagcacctcataatagtccttaatgataaatattacgaagaataaaaaattttgtgcctgaattatttctccatattcctctatggaatataagggcaggtgcatgtcaatgttgcacccctggcccagagcctgcacgccttcaagctgttttctctcatccctcttatactcagagaagcgttgtcggggcagaaaataaaaattttttttgtagtgcctgttaaggacagaatttttcaaaaaaggccggcccgggttgattattttagaagtaaaacaacatggtcgacgaatgagcgtgaaatgcgatccacgaccgcctagggcattcggaacgtgtccacaaacagttcgggcaaccgcagcggacatgcgtacgcaaacgcagccaaatggagggatacggcggcaacaacggaaggtgggatgtgggccagcgcgtagcagaccatgacaacttcgctgacgaattcgcaaatgcccacacactctttgacggcgaagtgtagaagcgatagcgatgccgaaactgcacagcgtacggcatgctgaggttgaacttgagcccggacaacacctttataatgcgcacacaaagttatgactaattttttgaattttcaagaaaaatcgtgaaaaacatttcaactttattttttgaaaaaattttataatataagtttaattatttaaaaaattcgccggtgagatttggggtgtacacataaaaatccggtaattcaaaattatgtttcctattcacccgcggttccatgcgcatgatgtactcccccttgaacatgtttgctgctacatagacaaagtcgtcaacatttggcttcaccaactcctcgagttttttcgatgtcagctttaagcgaacttgtacctgaattaataccgtttcaccgagttttcaacatttttaaaatggacataaacaagccaagcgaaaagaatttgtcgcattcgtccatctacggttttgtgcctggaccggcttctcaatgttttgctgttgaggttataagactgggaaatgactcattttaatttgctcttttatcattaatattctaaaaatcatatttttcaaattcttttacaaacatcggctttagggttcaacaccggaatttttgattcatttctgctgtgtactgtcaatgcttttcgaattcggttcatttatttggtgggttaagtgttgatgatcagccgaaaatggcaaagaataaagaaccttattgatttgaaaaaaatagggaaatgaataaggctgctagatgagaacgacggaccgccaatgaaaacaaggaaaaatcgaataaacaatgagaaattttttcaaaatatatataataaaatcgtacaaaagtaatcatgtagataaataaaactgttataaaaaaaaagattttatgagaaaaataaataatttatttgtaaatttaaaataaaaaatataattattatttcagaaataacaataatttgataaatctttttaattacttaatttaatttataaatattattttaattatttggtccaccatttcctttaactttaaagtttggaaaattccgttaattatttgtttattgggctcccttcccttttgataatttatttaaaatcaaaagttaaacaggaggcagtaaactaaattatgtattaataagaaaaaaatatttttttaattatttataagagtaaatgaatattttattattaattttagaataataattaattaatcaattttaaattaaatttagtttattaatttttattttacagtcccccaattcgttccattcaaaagcgaaaattagtcaaaaataatgttaattgatttgtttatttgacgcccttcccgcactcttttcctttgataattgattttatttagcccccgtaaagggtaccggagttaatttgagcttataaaaataaaatgttcttaaatacaaataaataaattattggttaataattttgttcaaaagtaaggatgtaggtaaattaattgttacaaaaaataataattttaatgagaaaaataaattttatttatttatttgtgaatttcaaataaaaattattattattgttgcttaataattaaataatcaaggaaaatttcgttaattgctttctttattgggcacccttccatggaattttttaaattaattttataataattaattatttatttataattttttatttgtgaatttcaaataaaatttattattattgtttgagaaaataacaatttgataaatatttttaattaattagaaaaattccattaattgttttctttattgggcacccttcccacactcttttcctttcataattgattgtttgtttagccctttttatgggtattggaattaatttgacctgatagaaaaatttgatgagaaaattcacaataaataaatttaattatttattaataaaaagattcaaaataaataattattaattgtttgctaatttaaaataaaatatttattattatttttagaataaaatttatagtaaatttaaaaagaaaattatttgttattatttaaataataataaaataataataattaattaattaaacatttttataataatttaactaataaatattatttaattataaccctcgttcctttttcctttaaaatcaaaaattgggaaaattccgttaattgatttgtttattaggtcttattgcagcactcttccccttcttcattgatttgtttattttgttcatcttaaggggtcctgtaattaatttggtttagttaaaataattatgcaaaaaaataaataaataaaaaaataaaatattgggctcataaattaaatttagataaaaaaaacattcaaagccaaagagttagaaaaaataaatttgcatcaaagtataaaatttcattgaaattttaattgtttgaaatttaaaaaaatatttgttattattttaaataataattaactagttaattaattagaacattttttaaaatttataaataaatattatttaattatacggtcccccatttctttttcgctttaagtcaaaaattgggaaattccgttaattgatttgtttatttgaccccccttcccttcccgccacccgaactcgccatttcccgtatccctcgctgcaacccttcctcgccactctcgctgccgagcaatttctcgccatttttctcgttgcaatgtactctcgccacactctcgcccccctgccaatcgctgctgcctactctcgcccccactgccactcgctgttgcctgctctcgcccccctcccgccgctggtgacgtcaaattttccctttatgagagcaaattaatgtttatcatcaattgccaatgtggccgagtggttagtgcgtcagtctggccgccccccctctggggttcggatccgcttggtgcggggaatttttggagaattttaaatgaatttaaattcaacgtctttgacctttaagacgtttaaaataatttaaaattaaataaatttaattaaaataatttgcataaagtcgcgcaccaaaaaaagtcgcgcaccccctgcaataggtttgggtttgcaagaaaaagtcgcgcaataggtttgggtttgcaaaaaaagtcgcgcaataggttttggcttcagtactgaaaagtctggcgctcaaatggcccgcgctcacttggcggcgctcaaatggctggcgctcagttggccatgcacccctcccacacctatggggggctaccgtaatccggtgaaaatggagtctctaactacta

SEQ ID NO: 6979 - DNA, 5721 bp, Heterodera glycines
tttatctgcaaaaatgcatgttgttttttatttcattaacttttctttctttttaaaattctcggctgtacgtccgttgccatttatgtaagggtggattcaaaccaattagaaggatattttattgttaattaggatgattatattatatgatatatcctgctgatgataaatattacaatgtaaattttaatatttatttatttttattttaataacattttaactcattaactttctttttcttttttaattcacggcgcaactctcattctgttgttattgaacggatggacccaaaccaatatggaagaataatttgataaatttaattatagcgtctttgattgattttgtaggatgattatttatataaaatattctgctaagatatattttcaatttattttaactttttatgtattctttttgtcattccttttacttaaactgtgtgatctttaagaaacttttggtaatctctgcgaatttcttttttttctgtgtggaataattttaatgtttttttatgttaatattttgctaaatattatttttaatatgaaaataatacataattgttacatttttgcaacccttaagaatggagagtccttaatctaaatttagtttttggatttaaattccgtggtcaaagttaggcaatgtttaattgggagaagccatgttgaatttggagtggccaacgaattcggaaaggaccaaaggaatgccaaaaaaagaaggccaaaaagacgaggatgctaaatcagcaaaaccatttttattggttattttaggtgcaaaagataaaaacaaaaaaaaattggtgcaaagcgtttaaaccgttttttgaaaaccgattaaaactccaaaaaaacaggagaaaattggtccattttctttggtaccgaagtattcattttctccatttttattttaaaccggcttaaatactttgccgttaactttattggctttctgcattgtattcgaaccaaataaaacctataaaattgattttgacttgtgccattaacgaagggatcaattttccatttggttcaccccaatctttgtatttgatttctcccatttaaaatgtcaaaaattttgtccatcgatacataaataatttaaaaaattattggtcgtaaaatatgaacgaacagagggcgaaaaagaaaacggagaaaagaatgaatgagataatttatctgtaaggggagcggtggacagcacaattaggggggggggggggaggagcagggggatgaagatggacatgttggcgttggttgggtcaattcgtcagcaaaaagttcaattgatggaacggcacaacagaagggcatgggaaaagaggggagaaaagggaggcgaaacaatgacacaacaattaaggcataattaaggaccgaaaggtgcaaatgtgaatcgattttaaaatggaaagacggaaaattgcataattaaggacgacagaagaaattattaatggaacaggtcgaaacgtaagcggtgtttttttgttcattttgggctaaagttaaaagtttaaagaattggggtccgacggtgtcggcaggcgcagccatggaaatttgaaaaattatgatttttcaaccgattttgcactaaaaatagtaaattgtggattttatgctaaatttaaatcatttttaatgaaaaaaaaattaagaatttatactttgaagaagtaaaaaaacatccgtattttctgcctattatttttgagtttgaaaaaattaaaaatttccttttaataaaaaacatattttattcaagtaattctcatatatacattattttttttatcaaaaataaaatatttggatttgctttctttttaagattttgcactgttatcttttggcattccttccttatcagtcattaatatcagtttttttttgttttgctttggtcttcttccgtcagtgataaggcgactgcttctgctccacttggggcgagtcgtcgtcgccgaacaccgcccgcggtgccgtcgttgagccgtgccggtagttgcggttcagcgccggtggacgccttggcgttgaagcagtgctcatcagttccgcgtccatcgcaccggaagcattggaagcggcgccgacggtggaggtggagccggtgatcacttgctgattgatgagcagccgacgcgggggcgaataagcggcggcggatgggccagcagcaggcggcccctgatcaagacgacgcgtcggggaaacggtgatgcgaaaacggcacggctccgcaggtggcggactgagttcggccttagcaaaaagcgaaacaattcaaaagttaaacgaaattcaaaaatgtaccgagtgaactgatttgatcatttttggcggggaacggccgcggactttcgctccatgtgccgctggcacaacagcagcaacacgctcacggcccaaaggggtcggccgaagctgacgacgaatttcattgggagccggccatggcacaaattggtccatcgttttgggaggtgtttcgtggctgaaagggttcagagtttaatggaggaaaagcagctcatcacccaacccaaaaattaacgagaattaaaaaatatatcaaaagaattaatttaatttttaatttttacaaaatatcaataaaaattgtttaaaaatgcattaattcttattaattcgaaatttttcaaaaacaaccaagtaaattgagagaaaataaaattaattttcctggatttttgaaagtaaatttgaatttctgcctcttccccttctctctctctctctcccactctctctcttctctctgctctctctctctctctttctgccttttctcacattttcgtgtgcgctgatgacggcagtgacggctgccgttggagaagtgcgggccttcggctgtttccgcttgcgctcgttgtacagctcgccgtcggtgatgttgatttccgggttgtcggtgtcgttgctgtggaggcggtcggcagtccaatgcgtcgcggttcgcgcgagtacagcgaaatgcgatgcggcgcctcaaccgacggcacgccggagatgacggacgcatcagcggaacgcgtcattgaggcggacggacgcggcaccgcatgggagggcggaaagtgtgttgatctgaaagagatggaaccgaactaatgatggcaagccgctttaaagagagagcagctgatgttgaactgaactgtctcacccccccccccccccccgggaattacaacaatttcaacgcgttcaaacgttttaagccttcgtttatcgtattgacaaaatttaaaccagagttattagaatgatttgaattgatttaaacgaaaattggttcttgaaatccacgaggtttaaaagggttgggaaaagcactcgccaatgcctttttcaaacatttgtatgtttcgatttttttttcgcgacacaaactaattaattaattttgattactttgtagaaaaacccttctatatttgtggttcatactcctataaattttttttaaatctatgaattattcacgccaagcagtgctcacgcacatcaaccgtggcgagtgaattatgggccgacccaacggcgccagcggtccctccaaacgaaaagccaacgaatgtttggcgggtggacaccaagctgatgatggcctcgactttgtggtcaactgcattgcaaaagtgggttaaattaaaaaaaaaaacaacacattagctatatgctgaaatggcaaaacgacggcatttcataggcaaagctaaacaattcaattaattaattattgttaataataattaagcattaaatcactgctttttggaattgactattgttaataagataattaatcactcttgcgcggctttttgatgttgccgaaagtgccgtgccaacggcgactccgtccccagcagttctcttgggttccttctgttcgttgtcgccttcgtcctctgttctggctgagtcgtcgatgaatttgggcgaatgcagctcctcataaagcgacttctcctcgttgctttttctctttttgttttccttcgccgttggcacttccgtgccgaaaaaagtggccattgcgcagccggcggcgtcgctgcgcgggaaatgcaccggtgatacagaggaaggtatgacagaagacgaagccaatggcgcgggatgatgaaaaggggcgaccaaagtcctacggatcgacagccaaaagttagcaatgagagggggagggaaagggatgttcgagagtcagtctcgacaatccatcgcacagaagcaaaacatgttgaatgccatttaaacggataagtcaaagcggaacggagtgggatagtgccaagagcatggccagagggaggggggataaaagggcattaggcccgggtcagcacgaaaaattaaaaacaaattgatttttaatgcaaaagggtaaatctaatctgggtgaaagtcttgtggcattttgccaaaggaaagcacacaatgaaaaacggcagaacaaacgcatttgcttatggtcactcaatgtcccccccccccctctaattactcccactaattaccgaagttcgtccggcgtactcaatctgctctcgtactcttccctcggtgctgaaatgtctaattgtcgtccgccactttccgcctcatccaatgagctaaaaaaatgttcagaaatttttaaaagtgccagaaatttacccgattgaaggcggatggtaggccaatttggcactccgaggcgaccaatccgttgggatggcagcggaaggcattcccagcggaggtttggcagcggcgaattgggcctataattttgcatgaattaataattattaatttttattctatttatgccttttgcggtggaaaagcatccgcagaagtgatgctgaagggcgcccgctgttcctccacacttggggagggcagcgtggagctgggcggctcatcggatgggcacaacgacgacagatcggcgcccttgcgctgaacaaaacattttggcacttattaaattgaatgcatattaataattaatcaataaagaattaacaaaaagctttttttattaataaactcaccaaataatcgagattatgtacttttttaaatttttaaacaatttaatcaccaaaatcaatgaagtttggagaaagggaaattttgaatgtaaatttttctcaaatcgtctggcgaaaatcccataaatttcatgttttaacccttcgctaagtttttcgcttcccacctcccttttttgtcccttttctcacattttttgccaaattggcaaagagtcgccacggctcgcgcctcttcctctccacctccggcaaatgttggccctgctccaatttgcgtcctgcacctcctcccattttcttccgctgatcctccgcttttgtcgacgctttcgttttgtttcgatttgctccgcccgccaattcaaaaattttgcgcttctcttcggtgcgttccttaaaaatgggacaattaatcaggcaattagttaattaattactaataaaaaataattagtttaaaaaaatgttttaattagtgagaaaaatgattggaattaaaaagaaatttagaaaataataatgaaaaaagaaatattttcacgagtggtttagaaataccaaaaatttaaataataaaaaaccaataaatttaataattttaa

SEQ ID NO: 6980 - DNA, 1040 bp, Heterodera glycines
agtgccaaaaccaacggcacgccccccgtcccttccttttaccctccgcttcgttcccaaccccacgcgcgagtggacacttctccgctttactcggcacaaaccttcgaatttctgttgcccccgccgccgcccgtgcgccgacgtcaccaaattgagacaatgacacaaaaggcaaaggcggaaatggaggaggaggaacagaagacgaagcaggaacaacagcgagaatttgagggggaggaggaggaggaaaattgtgaagagaatggcagcgaagagaacggtgtgccgaaggaggcgacggcaaaatgccaccaacaaaatggaagacgagagaatggcacaggcaaagtaggaactgtcgggaatggcacgcacggggaaagttggaccatccgtttccctggctttaagggtttgattattgggcataattttcagtctcacggagtcaaggaaaagtcattcgcgaaaaccggacgctaatcagcttaacattgatttggagaagccgctatatccagtttcaacaatgaattgggggggggggaatggaaaaattgatcctattttcgttgttaaatgaccaaaatcattgctttatccccccaggcgatgccgcagcactcgccccccggctcttccgccaattcgtcgtcctcctccgcgagccttttgcgcttccgtgccgcgttggacagtccgttcggctcgcgcgatgacatcagcaacaatttgacgaccgtaagcaacggatacgccgcctttccgcccgccccaccggtgcacaaaattatatttcaatttttaagagttttttcagcgatttttgggcggcccattgcgccacgccaatggcggcgctcccgtggctcacccgcagcattttttggcaccgccgtcgcccttccgtcgtgccgcgccgtgcccaggcgacagcagcgagccgctgctgcggcgcagtctccgctcgccgaccatgcgacggctgcaggagtcgctgcagagtttggcggaggatgtgccggtgtcgccgg

SEQ ID NO: 6981 - DNA, 2061 bp, Heterodera glycines
ttgtttggtgccctcccttcacacattgaaaagtgtccattaaaaatccttttcttgccggagggtctgtttttaaattttcggaaatttcgcctcattcccgcgactgctgattgatgtttttccacattccttctcaataaatgtctgtgtccgctgctgactttcaccaaccgatcaatccaccgtaatttaaggactatttcattaccgtatcccccgcccattgatacagtaatttccctacgacaattttcaactgtgtcattcattcatttgtttgttcgttcattcattcaccgtttgtgcattaaacattaacattttattagttgcattatttttgaaaataaaaaacaaaagttcttcaaatagccgatgagagcaaaagtacagcagcagaagtacgacatatttcgaatgaaaaagcgaaaaatacaccccgaggaattaacttccgataaaatttcaaaattccctaaaactaagaaatctaaatttttgataattttttatggcaaactttttgaaagtaataaaagaaaaagaaaaaatcgctttaaaacagagttctcattttgtctttttctaagatttgtcttttggagggctgggccttagaattccgatacaatttacaaattcctctcccatttcttgctacgttgggcgacatttctgttaacaaaaatattcttgcctaaaatcgcctcggaatcgcttgaaatgcacttttgcaactgcttcacggaataatttgcactttttatactttttaaaaaattcagaaaaattcgaattaattcttcgttttcaatggtttttgaaccccccccccccccccgaatttatattctcaatgattccgttttgttcagcgacttttcgaaaacaccgaatttcagtgacattttttcaagaaaaaagcatttttatgtccggcgtcggttgcaaaattggaacagagattttacattttaatcaccgttgaaaaacctttaattttcagcgattcaacaattaaatagcgctaccatggaatttcctctccaccatgccgtttttttaaaccaaattgaaatggtccagaagaatttggcggatgtaaagaagaaggacttgaatgggaacacgtcagttttaagaaaaataacaaaatataaaaaattatattcatttttaagggctttacacatcgctttgtatgttggggcgcacaaaggtagtcactgtaactgtattacagtattcttagattatattttttatttgacataaattgcgcggattttgttggagaagggagcaaaagtgcggagcaagaacaatgctggatggagcgctataaaatggacaatttcccgcttcaccgtgcggtgttttccaatgaagttcaaatggtcaagcagcacatgaccgaaatgaacaagaaggataagcaaggcaatacgtgagtttttaagaataataaaaagtacaaaatgtttttcttttcttaagacgcatatcgcctgtatgcttggccacaaaggtagccaatttgtactgtgtttacagttttttcgattattttttattttacagaaattgcgcggattttgttggagaaggcgcaaaactgcggagcagaacaacggtgaatggaacgcgttggatgaggccatcgcgtatggcgacattggattaggtgtgaaatttcaaatttcacatcaaaattgaaggggactatataagcttgtagtgcgtttgcgcaaaaaatgtctaatttttgcaattttgggcttaaaatttcaattaatgtaaattggggtcaatatttttcgaaaaattcccttatttaatttttaactaaattttaagtaaatttttttacgtattaaaaaaatttggttttttgtctttcatttaaaataaaatccgattactctctattattctcctcaaaaaaataccaaatttcggaaattttataccgttttctgtattttttttggttaaaaatccggtctatagttattaaagtaataagtttttccatttaatctttatacttgaacaatg

SEQ ID NO: 6982 - DNA, 5524 bp, Heterodera glycines
  misc_feature (160)..(160): n is a, c, g, or t
catgtattgctaaaagaacagcaaagttcttaatataattttgtggcgaatgtcggaaacgactgagaaggaaggagatgcagttatgttgtgatattcctagtctcatttgcatgtaaacaacattaattatttcaacatttcattgtttacctttttntaacaacgaaaaagatggcattcgaaaatatttttgaccatattggtcagttttatgttgtcaatgcttaaatattgtgcatttttcgttcaataaacaagccgagctcatttttgagctaaataatagagttagaattggaaaaaatacttgatgaaaaatcatagatttgatgtcgtcatatgacaaatctgatggcatattcttgctcagcaccctcgataacccccgggtgaagtgcaaaatcattaaaatcgggctttttccctttttttatgggaccaatgatctccaccattacccgggttggtaacccgggtttttttcgactgtagaagatccatccctcttaaatttcaattaactgggactgtatatgtgatttatttttccgtttattagtatctgctgcgagtgttcgaaccgctcatcccgcgcttctccaagctgcgcggattgtgcaaggcgcgccttcccgatggattcccggtcaaagtggaagtgccggtctttcttggcgtcaaggtggaatttttctttttttctacatcactttttggcagggcagtttttccaattgtttgaaaaggcgaatccggaaaaatttttcacctttccctcgtgcaaaaaaacgtcaggcctcgaaatttctttcggttcaaaaaaatgtccccgacagaccctccccttcacccttccatccccaacaaacgaaccaagtggaattttcaataattttttgggttttgtgaaaatgtgaataggatttgcataggatattaaattttatttcttttcaatttaataatttgttttttttgttccagatgaaggtctcctttccgcgtttcgaatgggccaaccacccggacgagatgtttcgcgttcccgagggataccaaccggaacaagaagtcatgatgattgataattattttttgctaaattatctgtaattttgtgattttattgtttgtttatttttgtttaaatattaatctctttcaatgtttcaaaaaatatagccagaagaattcaaaaagcaagtttttcgaacatttttggccataacttttttgaaaggacatttcttgaaattttgtaaggctaatagagaacacttagggctatcgaatgattacagatgagttgaaaaataaactgtcaccataaaaaataacatttattttacttttatttttaaattttatataaaaaaatattttgccattttttggcactttctttccgcccgaattggccataaacaacagacggaaacacccattattattcagcaagaaacagcgtaacaacaaataatgcaatggcacacaaagaataaaaagagaagtatgataataatgatggcattttgtttaatgactgtgctaaaatttccatttcgtcgcccgaggggaaataattcacccttgagaaaaaaaacaaacgcttaatagacaattacgacagatacacatatttttcgatgaatattaaaattgcataaaatttatttatttattttaatttagaaattattttaaaaacaaattctttggccgtttttaatttaattttattttattttttctcaaattgttacaaaatgttgctgaacaaccagcacaacaactccaccaactacagcaatggttcggccatcaatggcaattcgtctcccaattctttggtcgccgattctccgattggtgccaatgcgtcgccgaagcgatcgccggcactgcaaaaaaattcagcgcattttcggggcgaatttgtgggcaaagtgataattgtcactggtgaattttgttgaatttatcttattggaattacaatattttaccaaaaaccatcaaataaaaagcataattaaatttaatattgcctaatttatttcccttttcgggtcatattaaaatgttaacatttcgagaagaattcatggaaatcatatgaaagaattgaaattaaatatttaaaatatttatttttaaattgaatttaaaattattattatttatttaaaatacgatttgttgttttctaaggcggaacgcgtccattcggccgccaaatggcactgagttttggccgcgaaggcgcctctctgaccattcaggagccctcgggggagcgtttggcggttggaaatttatatttatttatttcatagctaaaaaaatttccaaggctgtgaaggagtccctcgtgcggtcgggcgtcgacgaacggcgcattttggccatttcgggcgcaacgacggaggagggcacggccatggaattggtggaacggtcgctgcaacgcttcggcaaaatcgacgcattaattgtgccaaatggcatttaaacggaatgccaataataaagaaattgctttcaaggtgagcgtcgacctgatcagtgactccacacaacattctgccgctgatcagctgtttggtggcacaatgcgatggttggcattggcattttgttgggggatttaaaaattcaggctggtctacctgagctcattgctggtcaaacccttggccaaaactgaggggagcatcgtggcgatcagcggcactttgccaaaaacggcggtggccgcccaatggcacgccatttcgagatcgggtccagaaaacatttaatgcttgcttagtgtaaatgttgttttttcagccctcgccggatgggtggccaattcggcgcaaatgttcggcccaaagggaattcgcatcaatggcataaagtaaagagagaaacacgcatttgaagtgatcaatttgtgcctttaattatcataaagtgtgggcattgttcgagctgatttccgctctcgacaagcgaaaaacgaagatgaacaacagaacgtaagcaaaaggacacacaaaaaaaagattaaatttcaagagaaattttgataattaggcaaaacaactcattaatttttaattaattgccattttacacattgtcctcttaatcctcagttgtgctcctccgcagtgaatgccctccgtcggcccggcactttggaagagattggccaagtggcactgttcttggccagcccttcccgggccagtttcatcagcggacaagtgatcagcgcggacggaggagcgaatggggcatgagagagaagggggaacggagagaggagaagagaaagagaggaaaagggggaaagaaaagggaaaagaaaaaaaccaattaaaaaacatttaaaatgtaaaaaataagggaatgagacaaatttagaagataaaaacccaatcacaatttaattgatttattagttaattagttcattaattagttaattattgtgcaaatgcctttttcccaatgtacactataaaaatacagaaacaattccatcgcattttcttaaaacaaatcagcatttcttgttttatcagttgtccattatttcttctccgagtttgatttgggtggttcgatcgccgatcagtccaatgaaaagtcggtccctccgccgccttcgcctgtcactgccattcccaaataaataatcaccgaaaaagccacacacaaacaaacaaaagcactcggaaaggagttccaaaatgcgttgtttaattctcttttttcgattttggtcctaatttattggaatttcattcatttgccaataaagccctctccttcaaagcgcggcataatgggtgctttcagggtttgccaggatcatggtcctcctggctggcccggatactttgaaaagcgcatccggatcaacctggaaaattaggatttcatctgggaatccggcacagatcgggttcccaaattcttatcctgcttttgaatttttttttagattctcgtctcaaaaaatttgcaaattttttctttgcaaagttttcctttttggggtaattgacgttgattagcgtctccgcccttttacccatcgccctttgcaccctctaattaccccaccccaattaacccctcaattaccctccccctccatgtctcgtcccatctttggtcatatgagtgacgatgcctttctttttatttatctctgtgcaccgttagcgtgatcggacagcagcaaaagcagaacagcaacgaatgtgaaaataaaaaatgatcagtgtttggtcaattcattaattcttttccccctccccgcctttttaattgtttttttttcatttgcactcaaacggacggacggacaaatggacaaataataaacaaaataatgacggacaaatgaatggcattttgaggacgaacaaacgcaaaatggggacggacaaaatgttatcatttatttacctcccttttttgcattatcagcacggaaagacaattattaattgactggcgtgaattatttggcgtcatcattttttgggaaattccgccgacggaataaaataaataaattttgaatttcaatatttgcaaaaccaaaatgttgtaattaatggcggcattcttttgcattgtgccatcattttgtgctccaaaatgtccgctcaatttcattgctttcgtcggatggcaccgtcaaaattggcatttcaaattggacaaatgaatgcttttcctcctgttgttctttttcggattcgttcatccttcgccctttttgtttgctcgtctcattttgctattacctgttttcgtttttcgtcaattttcaattttcccctttaaaatgccgacaattccctttaggtctttcattttcttttggccctaactttggttttttcttcgttggcctttgccatgggccaaaagtgtttctgtttctgtttctctgccatcgttcgtcgtttgttgttgccattctccgtccttcttcttctcgtttttttgctctccgaattcgcttctcctgcgatggcattgccatccgtgccgaggaatttgcagagtaataaaattttaaaaaatttaaaagaatttaattgcctttgaagatgctgtagacgatcaccgacagaagcggctgatgttgcatccatcggcactgacgcgacgatcgttggaaaagctggtggaacgcattgtggcctcggggtacagcccggacggaattattgccattcggcccggcaaaaaatgagatggcggagaagcaaatgaatggcaccgaggggaggaggagggaaatgccgaaacggataaatagcgaagcgggggacacggcacggaaaaggacgaagcatgagaggatgaagaaaaagcagttgaaccgaaccggggcacccccgggggcatcatccaatggcacgtactaatgctgctcgagagtctttgtaagcgactcgagaaaagtcacaggtttttagatctcggcatcgagtctcgggcaattctt

SEQ ID NO: 6983 - DNA, 2232 bp, Heterodera glycines
caaattgcaattttacgtgtttgcctcagctgaactatcggtctctccaccaagtcggcctttggccaatgccaatttcgcgaccagtcatcgctttgttagtttcggctccccactcattcactaatttgtaagttcacaaatgctaagcttcaccacctttttggccaatttggcctttaactcggccaatcccagcgttattcactctttgcatgcgatgaatattaattggatttttgacaatttgccgtataaaagggagggcaaacgaaggcaaaagcacacgccgtccaaaccattcaatcaaaaccaaccaaatccccactcattagctcattatgaaatttgcccctctggctttgcttgtgatccttttggtaggcacttttataagcattcattgaacaccggtcaaaagtgccatgcttcaggtgtctttggtcgctgccgtctctgctaattccaacaacccttttgatgcggacgcggccgacaacggtggcatggtgcgccatgctttggcttctaatttccgtttttggcatttttgcctttgactcattaagaagcgcgtcaaacggcagcaacagcaatggcgttggagtccgcaacagcagcgctgggtgccaataaacattgcgaatgtgaacattgctcagaatggataagcgcactgagaaggagccgaaccgaccgaccgatggacggacggagacgaaaactgaggacaaaatgccaagaatatgtgtgatcagtgacaaattcaaacccaatgccgcgccctttcgatttattcccgatggaatgacaattccaaacttttttttaatttgttaaaattaaagagtgcatggtaataatttaaattcgtttaccgttacctgtcaattttggaaaagaaaacggtcaaaaaccggctgaaaaatttaatcatttaccagtcgacttaatttccgccgttaaattaccctgttttctggttaaaaaatttgcatgttttttgaagagattttttcgattttttattggattttgttccggaatactgaatttgcccttagcctggaaacgaacatatgttcattgtattctgaatagataaatttaaaaatcaaattgatgaaaatcatagacaaacttaatgatttttaaatctaattgctagaaaaattaaaaagaattttttatattattatctgccgagacacagtttctttttaccatttttccttctataactcgccaaactcttggacccaaagatttaaaagttttctttaattttagagttgcacgggatcgggtcgggaattcccggtcctccaggtcccggctgtccaggttgggggaaagggattcaatccctccgcaggaatcaaatatattttgattttttcttggttttttatacatttaccatttttttaatgtaaaaatttcagccaaaatgcaaaaatggatatttaaaagtgcaaatctgttagcaaaacatgcaaatgtttagttttcggtttttttttctcaggaattgcctgtcgacaaagtttgattcttcatatttattttaaattgacaattttttatcattttttaagaaaacgcgttaagaatttgggcctagtaatcgccaaatctggtcatttttggacaaaatctgttgacaaattgcactcaattttcaaaattttcccgggcccggcgcaccgccgccgccccccttttcttctcgaatttttttcttggaaaaagcgttccgcgaaaaaagtggtgaaaagcaaaaaaaaaaagggtcgtcgaccagcagcagggcgatggtttcccctccaaggcaaaaaaaatcccgttgaccgtccctgactgctggacaaacaaaacatctcccttattcttaaaaaacgactcaaaacccaaaagtttggcgattttttggataaattctgtcaacaattttttattaaaagttcaaagattttttaaggcggtgccgaaaggcactgcctcccccacttacattggatttttggaaaataccgaagttatgaagttgtcgacaaaattttttcgattttccaaatcggtgttaccttctgatcagattaaggttgaaattctgaatttttaataatattctgattaattgtttggaaaaaatgaagtaaatttgatttggaaatattattaaatatatttattttaatttaattttgctttaacttttagcttttataa

SEQ ID NO: 6984 - DNA, 4839 bp, Heterodera glycines
  misc_feature (4805)..(4805): n is a, c, g, or t
gcagcaacagcaatggcgttggagtccgcaacagcagcgctgggtgccaataaacattgcgaatgtgaacattgctcagaatggataagcgcactgagaaggagccgaaccgaccgaccgatggacggacggagacgaaaactgaggacaaaatgccaagaatatgtgtgatcagtgacaaattcaaacccaatgccgcgccctttcgattgccaaagtgcaaaaatgccactgataaataaacaaagtgagagcaaaccaatggaattttagcaaaaatggagaatatatccttgaaacacagctgaaaatgggttagccaacagctgctgatgttctaattttgtgaaaaaaatcaaaaagttaaattgacaaaaaattgtttatattctgaatgttgaaattgaatatgccaaggcattccgcaaaattcaaacttatgacccattctttactgaacggtggaaacaaaatgaaccggaccggctcatttcggcccgcacggttcggccccagcccagtttttgttgatctataacttttttctttgtcaaccaaatccaacaatcttgatatcattcgaaagctcttcacatactctattagccttacaaaaagcaaaaagattttctagcctgcaaaaaaattatgaagaaaaaacttcaaaaaaattgatttttttagttttcatgctattacttttttgatatttgtcgaattgccaagcaatagcttagaaaaagtttttaaactcgttaccaagattgttggatttggttgacaaagaaaaaagtcatagatcaaaaaattggctggggccgaactgaggtagaccgaaatgaacataaaaaagcaaatgcaatttttaaaatttataacataaaatgtaaatattttgccaaatataattttaggtgaagtttcggtcagtttagaaactcttggcatttctgttttgaatataatttttacaaaattataataagaacaacgaaaaaattttgtttggcgcgggatgaaccttatgatatttcgacatggcctttgacttaaaaccgaaagttgagctgaggctttagaccgagactcgagactggcaccaaaaaaaccagctgccctgactcgagaccagagacaaacaccgttggcataatattaggcctaaatgatttcgggtattttttgtatttcctatttcgatttaaatccgttgctcgccttcccggccttagggtacgcccatttaaaattattttcaattatttaatttagttttaaaatatttttaatgtataattgatttaacatatttaataatttctctttgctctctttgctttaattaattaatttctctttgctttaattaattattttctcattgcttttcgtcgtaaacggaagcattcacatgaaaaaattctcaacattttaaaattattcaccaacaaaacaaaatcttacttttacttctctaaaaaatgattgcattttggcataattttggttttctttcttcaaaattgcaaaaaacatttgattttattttaaagcaaaaaaaaagaaaaataaaaataaaaaaggatgaatttcccctttttaatattaataaaattcttttgtttttgtttgataaattctgtcttaactatgccaattggtgatgattttttgaaggatgagctgaggaagaaaagcgaaaatgaaatcgcaaaattggaaataaacgacgaaagaggggcaaaagtcaaagttagtcaaaaataaagaatttaaaaagccaaaatatttataaatttatataaaattttgaattaaattgtaatttcctaaattattttatttaacgataaaggcagaactttttgatgagcaattttggggaaaaaggccgggccaaccggaaaagctgcttaatgtggcaacgcaagtcaagcaggaagctgggcatgaaaaaggcatgtatttgcataagaaagaaagcaaaatttaagaatttaaatgcaatttagataaacaaagccaaggaacttttaattgtctgctgaattttggcggattaaaaaaggaaattggaaaaattaatgcggaagaaaagccgcttcttcttcttcttcagcagaagaagaatggagaaagcagcagcagtgaaagtgacggaccacaaaagtgcagggaaaaggaggacggcactcaaagggccatggggcacaaacggcagcgcactgaagtcagcactggaacgtcagcgcttaaacggcttagaattggggagggaaatgaagaaaaatcgaagacgaacagccaaagcgaagaatcggaagaggaagaaattggcaactattatccgggagaaacggagagcagctcaaatgctgatgagtcatcatcctacaaagccgagagttgggaatccgaagaatcgaaaagccaagacaaatggccaagagcaaaccgatgggaaagccaagccgaattcgacgaagaagaaattgttgaacaatcggaagaagcggaaagccgagaatgggctgattttggtcatgaaaattgctatgatgaatcggcccaatcggaaggtcgagactcggtggactttaatgacgacgcatcagatgactcagaagaaacggaatgcgaagatttagaaggcacaaatcccttcccaaaacgaacccatcttgaaaggaaaacagaaaaaagtaatgcgataaataaatgtagtggtgttcgagagaaaatttcccgagactaaaacatcaaaaacccgagactttgttcggtccgagactgagactcgaaatcgcattaggacatatggaaatcttcagactttgtttaaaggcataaaataccatcgcttcgttttaagatgattctctgcctcatgcaaaaaaggaaataaataaataaaattaaatttaaaaaataaaattccttttcgaaatatttttctttttataataacaaaaaattaaataatttaaaaaacggaaagcaaaaaatattcaaaacaaaattaaggaacttatccaaccgatgaacaaagaatggaaattgtgaacaaatttatggaaatgaaaaaccgattttatgagagtggggaaaagcgaccgtttcgccaagtggacaaagaaatagcggacaaattggacgtaaacgcacggacaatttacaagtggaaaaagagattcggattgagtaagcctgcgacttaattaaggtaattaattactaaaaattaagaattgggagagaacagaaaaattggaattttgaaaaagatcaacgaactgaaaagcaaaaacccacagataacattggcacaaattgagaaagaattgccaacccttggatattatagtaagttgttcaggctttttattttcggcattttttaatttttaagcttaagtttaaattttaacgtaaatatgtgctgattttcataattatttcattaaaaatcccaattatggtaattttggagaaaattcgtcaaaaggtttcaaattttctaactatcggcatggcgtcgttggtccctccgccaccaaaaatttttgagagaaaaacgcaccgaagattttttaaactatgaattaaagtaattcacaaaaaaaggaattcaaagttacttccttccattgtcaaatttattaaaaaggagggttgcgcctcggggaagaaattttcagggagcggcgggaggggggggggggggggagcccaaaattgtcgaggaccggagaagccgatcggagaatgaccccttttaagcagattctgcattctctgattcaaaatcattgaataatgccagtaaaaccctgtccaaattggctttcactgtcaaaattatctattaaaaaaaattactaaaatttcttttaggaaaagactttaaagaatcttataaacaattggaaacaattagaaaatttgataaaattgtggcaaaaaagttaagtccgctttcatttgaagagaaaaccaaaattgctgcagaattgggcgtgaaaatcagaacactttatgattggaaaaagaaattaggaattaatggtctgttttaaggggtattggaaattcatgaattttgtaaaaaaacggacgagggccatgaaaaaactgggacatcgggaccaatcccggtgtcgggatttaaacgataaaagttaaaattaaaaattaatattgccaaatttagaagagagaggctacggaaaaaaggaaaaaatagcaattttaaaacggtatgatcagatcaaaaaagaaaacccacaaaagacaatgggacaaattgttaaggaaatgcaagtcagccaaagcatgttttatttgtggagaaaagaattcaaagtcaaaataaaacgtaagtaattaaggaaggaattaaaaatatttaaatttatcggcacaaaatcctcaaaattaattaataatatttaagcacattttttatctgaggatgaaaaacggaaaatagtggcaaaattcaacaaaataaaggaaataaagggacagtcaattaaacgagaagacaaaaagaaaattgccaagcgattgggcttttcactgaatgcaattttacgttggaaaaaccaattcggtcaaaaaggtcgtttaattgcagagaattaattaatataattgtgttttattttaattatgaaaatatttgacaatttctctaacagaaagtcgaaccttcgaattgtacgaaagaatggaattgctgaaaaagtattacaaaataaaagacaaacacccaaaaatgggggataaaacattgccaaaagctncgaatttgtgcgaactctgagaaatggaaaatgc

SEQ ID NO: 6985 - DNA, 5671 bp, Heterodera glycines
aaaaattggcttttcgcatcccttctcaacccaccgtttctccagcaccgtaacttcctacagtaacggtactccactgcccggcatcagcatctcttccggtacggtcactgttttgccggtgcgcggccaggacgcccaattggtgcccattaacgcgggcggtgctcatttcatcgttggcgtcaatagcacggagacaccgtcgacggaaacggcgccaacggcggaagaccaaccgacgcggggggacaaaatacgtggcgacgatgcgcacctgcagcacatgatgaccgggccagaccaaacattggccacgccgtatcctcaattgacctcaccggacggaagtccattgccaaccgacgcggtgggccacctgatgatgcaacaaggcaagaaaatgccgaaaaagcaatgaatggcaaagagagagagagagagagagtaatggggcagttgaagagagaaaaaaagacggaaagagtgtgtggaaataagaggaggagatatagagtgaaggtgctgatgtccagccgcagaatatgaggaagggaacgagtgagaacgaggattggatttggggggaaaacggaataagccaaaatccgggccctggataaatggcctccccaaattggtaatcccttgggcgcccactagatcgaatacgcgtgcggggatgggcgagaaggagtaaaatataagataaatattggccaatcacataaaataataattccgccgcgctttgctctcggctctcgctcgccgattaactgcccactcaactgactccttatcgagagaatgctcccgattaaatagttggacttatggaacggaaaatggaatggaagagagcggggatatgtgcttgggaaagagataaaacggatgtgattaattgcgctttacacgtccacccttccttaagtttgtcctcaaactttgatttacttttgagttggaatgaatcaaaaaataatcaagcatcaaaacgtgacagattgaccgaagtcataggaaattaaattattgatacataaataattagatttcgactgaatacccgaaagtcggtgtgaaaactgacgtggattaatttattctatcaacagggatgtctagaaacaaaactttgttttaatgttgtaaacatagttttattttgtcataaaaaaggcacggattttcaggcgcttaatcgcaaaataaatcatggctcatcatcaataaaagtatggtttaagatttctttaaaaaaaataaaattacctaattgcttgactaatggaccaaagtcctttctactatgagtgtttcattttcttaacgattctccgctcttttcacattgggattctaagaaacattaaaaagatttttgatttgttttaattctataattctgagtccgtttgcttccgtaaaagtttcactcattaaaataattactcattgtcaaccatgacgaatgacccaaaggtcgattttaacaattttacacagcatgccaaaaaaactccattaccaaaaagttgatttgtggttctggttaagatagtaaaggcaggacttaggttagagtccattccaaagcattaatattttaatatatttttttgagaatattagttttagtaaaaaaaaaattgggagatcttggtatcactcaaagctattgaaaaggagaagttttttaaagcaaatgataaacgattgactcacatgaaattcgaattgggaaaaaaaaattaattcgatatattcgatgcagaattttcttactgccgcaaaatttgaaaaaattaaataaaattttataaagcaaaaataattttgttatatctattagcaaaaagaaagattataatttttctgataatcttctacaaatcagtggaatattcagaattgtctaaatggcatagatttgtatgtgtcgaaattgaaaattttatattatcatggactttactgaacgatgtgaaataggggatttacgatatctgagccccaaattttggtattaagacacaagagtaattaaaaatgtccgtctaaatagattccttttggccgattttttagtattctattaattaaaaaaacattcataaaatttaatgtatattaaccacaaggcccgtaatcttgacagtgctgccgaagcagaaaacttttgcaaacacgaattagcataaattactgctacgatttgaatatttagctgtgcctcagttttgtgcttttccaagaattgcactttccttgacagatggaccgaaatccttgggtttaatcttctttatatttaacggcgatagtttccgaatacatttcgaaaattaaaataatttgacttatttttggttcaaaattttaatggtttattttaataagaaagaatttaaaataagtttttaaatgctgcaaatttttaataattagggaacaaaatcacatgactggtgacccgagggtacttttgttctcaatataattctaccttcggtgatggtagtcttgatcatggttggaagtagaccgttgttttgcgagaaactcacaccattgacggtaatcctcctctactggatcaatttgtctgacaatcttgataactaaatcaatgctggttccaatgtattggtgaggtactatttgggttggtttatcacttaacgtatttagaccagttaaagtagacagactgtcttcaaagccttgaattcgaaaacctaaggtaataagttctacccaagcatcatcaacaattgctgaaacatcaacatctgatccaaattggtgtgaatagaaacgttgtagtgactcccctacatcaaaacagacatcgacggcaattattttgccggttttttcgcattttagaattctttcaattgacccacagccatcctctgggagcaaggtaaaatttgtcgcaaatttgttagaagcattaagagaatttgactcattttccacaaattcttttatatcaatgatttcacccaatcgaaaatattcatctgattgtgatttctttttcataagcaaaaaatgaggccaagaactcacttcagttaatcgtgatgccaaggtccaatttatccctgtttgaataacaataaatttgtcatccgttgaaatagtttcagattttctattctctgattcactcagagatttgggctgtaacatggcccataacagagggtctgtcaaagttcccaaaatctgatatgttcgagcaaaataattttcaaaggttgtgaaaaaagctattaatgtcctcaatattctctattgtcatgttgtttatagctaaattagctctgctatgcatgactggtgaccctaaggccgtcttagttgttttgtccaagacctcaattctcacctcactctcttcataatttggctcattatcgccaccacttttattttcaatcatgacggatgaccccaaggccgagttcacaaacatttttttaatgtgttgcccgttttcagagcgagaaactcgcttcccatcctcatctgccatttcaggatcacccgaaaaaaaattcggtcaacgacgacattcgttgttggagttaatggcgaatgtttgtcgacagtggcggatcgcgcgatgatgtgaggtcttcataattttgtgccagtggcatttgtcgtgacggggccgccgagacggattttttagaactcttattcttttgatttttggcattttaaagctaaattttatttttattatacaagcgaaagagaaataaatattgaaaataaaaggaaattaaaagaaagtgaaaaataaataaaaaaaataattgtcgaaaatagaaatgaacaaaaatgagcggagatctgtggattatgggcagagtttgaaatgaacgaaatggtagaacaatctcgtttaagagaaagcattagctcctcccacagagcattgagtggccatgaatcacgtgaaccataaatgaatggatggctaatccattaagaatagctaaaaatatgatgatggacagagataagttggataacggtggcaaaaaaatagcaattataagtgaaatttgacaattataaactaaaaatctgtttaaaaaaatgtatttgtctatctttattagtagaaagtgtaaggattaattctttttgttttttgagcaccttatttggatggttataagtcggacgagaatcaaccgaagaaatatttgggagatgattcaatagtcctaattctgctctttcgaatgagcatttatttgttcaaaactattaaaatttcagagactagttaagtttttgtaacagtaacgaaatgagaggacaaaaaacaaatacagaaaatgtttaaaaaatatgaaacatttaattttaattttgtttggtatttattaattgcaaataatgattgtatataaattgaataaataataaatattaaatggaaaaggccagcggtgtgagtaaaaattagcattgaagggacattcaccttaccttccttcacatttgcgcaccaaaaaaaaaattaaaaggcggccacaacaacggtcaaaggagaattatggatggaaatttgaatatgcatttgtgtgtgaataggagagagagaatgaaaaaatggtgttattatacagtatattatatataagaaagtgggaaacataataattttaatttaaatataaaataataacaaagaaaatattttaattactatatattttgagttggattcattgcttttcatgacgagttctgcgaacagaaagtagaagtagcacagtattccaactttattaagatttgtttacatttattaaattcgcgccaataagttgaaattaaattaaatatttaattttttgagtgatttaatattctttactgactttaagggtctaatttgtttgtagatttggccttcgactcagcagggataacttcggataacgattgtttattcaacatgccactaataaaagaaagaaatttgtcgttacctgctgcttaaaaattttttttttatctttgtttcgaacatcatgcgaaaacccgctaacgggtataatcattattctcttttttaatcatttcttcacaaaaattaatgacaaaaaaggtaatttgaagatttttttgtcaaattctttgtaaattaaaagaaaattaatattacttaaatagaaaagcagacttagaaagaaaattatgacttgtcaataattcgtcagttaagctgaaacttcgctgaatgaagctgaaataaaatgttggttatagattttgttcattgtgtaacaatgaaaagcaattgaaaatgtcaacaaaattcggatattcataactgatttatttaacataataattttttttttacagttatcctagttgctaaaaaaataattgattttcttcaattattataaattaaacttatcgactaagcatgaagaggcatgcgaacaaaatgggtttttatttatctaattttaatgatacgggtcgagtagacaaattcagtaatttggaccagagattaccaatttaaagagtggcaaggaccgcgggttaaaatatcataattaatttgagttaagaaaaatttctatccatgcgacttgaaattactttaagtctg

SEQ ID NO: 6986 - DNA, 1750 bp, Heterodera glycines
  misc_feature (98)..(98): n is a, c, g, or t
atatttcgatgtgctcactttcagtacaattattatgataaattagatcactgtgggaaaaaaggaaaaacaatatgttatctgctttaaattttcanaatagtcataaaagaaaacctaaattgttaaaaaaaataatttttaaaatttctttgtaaatatatttcgcccaatggtgacgattaagacaagtattgtaaaagctaaacaaaacataaatttctgtctaaataactgaatatttttccgttttctcgattaaatctatccaaattaaaaaaaaataattttccaattaataatagcaccatcagtctgcctttgaagaaactcagattgaatttatcataattacttttgagttgcaagtaattagggcatcgatggttcattaaacttgacggtcgccccgaaaggattttaagtagagatgtgtaaatgaaatacaaaaaaaaaaaaaaactgaccaaaaaaacaaaatttcgggcaaaagatgcctattttatttttttgtaaattcgtttaataaacttatgcataagactgaataaaaagaatcacaaaaattaatcagcataaaaaaatttgtgtagcgttctgactggtaacattttttttatattacaaaaaaaaaactttgttaattcttaatacttctttgcttgcaaaaaataaaaataataataaacctccattttctcaacaaaattttgatgtcataattagaaaacgaaaataaaggcaccaaaaatcgcgaaaaggcactataataggcatctaaaaattgcaaaaaggtatgaaaaagactcttttgcaaaacaaatcagattatgataagccaatgaaatagtcgtaaaatgaaccgaaaaattctattcataataatgaaaaaaatgtttaacatcccaagattattctgtaataccgtttaactacatggttctcaagttctcagaatatattgaattttctacaacataaaatgtgaattgttcgttcacgcaaaaacatcagtttatgtgatagttttaaaaggaccaaaataaaattatacgcgtaatgatgatttgaaagcgcagtttaagtgagtgaatgcgcacgaactcctaattttacataaataatttcgagttaaaaaaatactatttgctcgattcttcaatttaactgggacaatgaatgcatgacgatttccccaaagagaataaattaaaatattccttataatgcataccaacataatcatattttattagcataaactcatgttattggcatccaatgaaactaataagaaatgggactgaaaggccaaaaaaaaattgctcaccttctgactggcgttaaaagtccgcaaagataaaaaatttgtctttgttaccctttgtgtgttttaagtttatttcagcaagttaaaattcttttatccaaatgcacgaattgaaattaaagggatgcttagcatcatttttttaaaataaaaatcaccattcaatgctcattatggatcattaaaagaaccaaggtctaaccgcggtttgggttcaaatttttttgaattaagtatattttacctgtcaagcgacttctttcacttatcatagtaaatgttgaaattttttttttatgggatttgaggtctattatttcattcgaaatacttatttaatattgctataatttgtgcattagctaagttattgacttcgtgtttggttcctctagaactttctgattctgaaacacgaaa

SEQ ID NO: 6987 - DNA, 695 bp, Heterodera glycines
tagaaggcggaatttcctgattcggaaactatagaggaaggaatctggattccggaaatttaaggttgaacttgcgcatcccggaaatttataatagtagaaggcggaatttccggatcaggaaaaccgtatagaggaaggaattctggattccggaaatttaaggttgaattgcgcatcccggaaatttatgatagtagaaggcggaatttccggatacggaaactatagaggaaggaatctggattccggaaatttaaggttgaattgcgcatcccggaaatttatgatagtagaaggcggaatttccggatacggaaactatagaggaaggaatctggattccggaaatttaaggttgaattgcgcatcccggaaatttatgatagtagaaggcggaatttccggatacggaaactatagaggaaggaatctggattccggaaatttaaggttgaattgcgcatcccggaaatttatgatagtagaaggcggaatttccggatacggaaactatagaggaaggaatctggattccggaaatttaaggttgaattgcgcatcccggaaatttatgatagtagaaggcggaatttccggatacggaaactatagaggaaggaatctggattccggtaatttaaggttgaaattgcacatcccggaaatttatgatagtagaaggcggaatttcc

SEQ ID NO: 6988 - DNA, 5257 bp, Heterodera glycines
  misc_feature (4888)..(4888): n is a, c, g, or t
ataatagaaggcggaatttccgaatacggaaactatagagaaaggaattatggattccggtaatttaaggttgaaattgcacatcccggaaatttatgatagtagaagacggaatttccagacccgtatataaaagaaggaattctggattcctgaaatttatatatattccggaaattaataagctatttatgtgaaattacccaaaattaattatttaattttttgtatattaataaaattaatttctaacaataaattaaaataaattaaaaacctttttaataatcaaaactaatttaatttccttaaccctgcctcgataaagttaaacccgggtgcaacaattataacaagacgagcaaaggcccctgataagcaggagaagaaaataaattagtcaaaagaagtggagtgattaatttggaaaaaaaaaagttttttttaatgagtagcaatttcaaaaataaaatgatccaaatgagtgatcagaaccgatgattaatcagtagcttttcaaaccaaaccaaactgatcagaccgttctcggtgaacaaaggtgatgtgagtgattattggaatgataaactggaaatatatataatttgattgttagtaattaaaactgaagtggtgtaataaaagtgaattaggtgaaaataaaattggtattgaacaagaattaaatattaaaatcaagaacaaataggtaaagagaaaatgttactttatttgcataattatttagaaataaaaaaaaagttattaattttataaaactattttaaaagcaaataaactgcaaactcataagaatttttgcaggcagagggtaattttaattaatatccatgtgccgaattggatagacaaaatgccgccgcaaccgttggcattgtaaaatgcgtattctcgttctaccataaccaaaatgaatatactacggtatgcctgcatttgaacgtgcaagggagcagcaaaataacgacgtcattatcgagtgccgaggagacacagtacagggaacttcccgttacggtatacaataagcaatttgccgaaatacggtgaacgcgagcacagcaaacgcgcacacacacacacacacacacacacacacacacacacacacacacacacacacacacacacactactcactttgatgcatggcgagcggatggacagcgcgcgcgcgagcgggtgccgcttgcgcggcgtcgagttggcggtggacgacacggacggggcgagctattattgttgttatggtatttgtatattcagtaagtatgttttgtattatgtatggtgtgtgagtatcgaaaaagacggcggttacggtaagtatactgtcaattgtatgcggtcagtaaagatagtacggtataatcaaagtgggaaaaaggaggagaaatggaggaaagacaaagagatacagagaggtacggttgctgggtgtactgtgaaagggagagagatactgtaaggaatgagcgttagtgctgtatataattgtaattagtcagtgagtagctttagtcaaacgcgcaattaaatcacggtaattagcttaagtacccataattaattttttaaagtcattaaaataaattgggaaattggtaaaaaaaatgccttcgcgttaacctccgttgctggcgaaatggtcatttcgtctatttggctgttcaacgcggaggaccaataagggattggctcacgaccaaacagttcatcgttggaccaagcgtagaccttgacagaatggagttttttaatttaaatttgattaaaattttaaatatattaaatataaattttaataaatttacatatagaaagtgaatgattattatttaaaaggctatttaaaaatttataattgcttattatatattcttattcattaagctttaaaggtaaacaaaatttcaatatttaaattttatttaataaataaattaaatatttttttaattttttaatttaatttacattattttttaattaatccactttaataaaattagtttgacctgtgccgcggtgtgcgcatcgattagcgcaaagccaactctggtgcccagtgcaatgagtccgtgcgcggaattcagtgccaatgcggtgaccaactcgggtcgaatgccattgatccacgggatttggcacaccaactcgggctgatagcctggggcgagaaaaaattcatattatgtagaatgcgccaaaatttcattaaaaaaattataacaattttttaaagaaaaaaacataatttttttttcttaactatctataattttaaaaatttacgaaatccaacttcataaaaaaaagtttacgaaattgtaaacgaagaaatttcgttaaaaattgaaacgaaattaaacttcattaaatttttggaagaaaaattttgctttttcccaatttcataaaaaattttcccctctttaccagtgcttttacgattttcgttgaaaattttacgcaatgccgcggacctctctatatgatttacgaaatttacccaacccccccccccccctgtccatctatgattggaaattcattttcaatcattttttttatttcggcatggcacccaccagcgggccggcgcaatgcgccgccgcgcactttcagcgggataagttccgcgcagtgggagcccaacgatgtgtccgtggagtgggaggaattgcgagaagacgacggcgctggaagcggcggcgatggcaccgattgttcggccgctggcgccgtcgtcgccgatggcattgctgtgccgtcggcagcatgcgattgtcgcttgaggcgaccggtggcggacacggcttaatgttcactaattaattgattaattaaattgcctgtggcaaagtgacaattaatttattaatcaactattcataaaaaatttattaaagttttaaacttgaaaattttccggcaaaaaacttagaaatttttataagaaatttcatccgttggttttttggaaaaaatttttgaaaaaacagtaatttcatcataaaatttcgaaaaacgcaagaaaattttcaaaaatattttcttcaaaagcttctttaattttttttgaaagatttatattagaaaatttttttaaatttcggaggaaataatacgcgggcggaggactagatatatccttaattaaatgaccgaaacaatttaatgattttttaatagcgtaattaatgcctaattaattttttgattaccctttggcacttcttggccaccattcttgggcgatggtggtgctgttgtgggtaaaaaagttgttgaaatggtggaacggcacaactgtggcaacaccaatgtctgtatgaaaaaaaattgtttagcaaaaattttcatttggcattttgtataaaaaaaattttgaaaaatccgggatttaccgcaatttcttggcaacattcggtcttggcaaaaaggaacagtgtgacttggccagaacggctggcaacaagcagctggcgcgagtccaagcacagctccacgtccgcaaccgcgtggctaaccacgggaacgatcagctgagaaaaatgggaaaaaatggtaaaaaaaaatatttttttaaattagaatttaatggcattttgtaaatttaattaatgaaataattataaacaacaataaaaataaaatatatataaattgaaaaaataatttaccaatgaaaattacaacaaaaaattttttaaattataatttaaggggttttgtaaatttaattaatgaaataatttaaataatgacatatacaaataaaaatttattataaatagaaaaataatttataaattgaaataaaattaaaaaaattgcttttataaacactttattttttattatataaaactttattaaaaagtaaaaaaataattttttttattgtaaataaaaacattttactgctttttcttcgcctccgtttgctgcttgtgccgcttgcagagaagcaatgtgtgccgcaacattcttctcgaaatgccttcccgttttcagcttgtacataatcttaaaaaattaaatttaatcttattttattttacagtattcgttatgtttttttttggtgctacaatattaccaaataaattaccgtacctgaagctgttcactggacgcttgccaaaatttgatggacccatcctcgtggccggtcaacagcatttcctgctgtcctgtggcacattctcggccaattccgcctgcataaattatttattttaaagagtttctatgccctcaatgaaacaacttttagttatttttatgcctataatttttttaacattttttgggccgactaattagccccaaatttcttagagtgatttttatttagattagatatttaaaactgggtaaagtacaggcctgaagccagaaaaaaattaggggggggggggggatccgaagatcctttttttgctctttgggtcaaaaatcccaaacttttttctccagtgttatttaaaaaatttcagcgccagaagaaaaaacaggaatttgtagccgttttccgctaaaaaatgacttctttttttttttttgccattttggggtcaacatttaaaaatttcccactttttcttgaaaactacgggcctggtacaatataataagggcaaagtacggaattttaaaaaatgaagactgattaaacgaatattgcattagaaaatgagagagtatcgtatagccgagggagtacggtattagaatttttatgggttggatcagcggcagcacttaccgttgagaggccagggcgtttcgctgagccgtacccccttgacgccgttggtttcgtccgaccagcgtcagggcggcgatcagttgggccggncaatcggagaaatacgtgacggaacagcagaacgacttatatatacaaaaaaaaaataataataaaatttaaggctactcatagttttttttttaattttaaaaacaaattttttccatttaaaagccgttttttttatcaatatcgttgttatttttacttgaaatagaataaaaattaacgtttttaagcaattaaattagttttaacattttaagcaacgcaatttttttttttttaataaaattttttcttgaaaaatattattcttttatccgcggggcccgtagaataagaacgtggttatggttaaatgaccacgaagttggtggtaaaacccgcagaataagagctaccacgaactttggg

SEQ ID NO: 6989 - DNA, 1932 bp, Heterodera glycines
tttttttgcatttttatgttttaaatccatttcctttttgtggattgttttttttttaatttatttaaggaaatattgaattgataaagattttttggaatttttgagggtttaaaatagatattttgggagtttttagtaaatatttggatatttttgagatttttagttgatatttggtgtttttttagtgaatattttatgtggatattttgggttttttagtgaatataatttagaatattaataatgatataaataaaattttcatttattttttttgaaattatgtatatcctcaaatgtcggatcctcaaaagtcgggtcctcaaatgtcacaccacggtcgagacacctttgtgcatgtatcatcagtagggcttcgatttttaggtttttacatatttttttcctgagctccccgtggcctgaaacgcacgaaaaacatgtttttttgggctgttgttaagctacttttcgagttattagcacctattttctaggtttttatttttagcacctaaaaaacctaaaaaaatttaaaaaaacttattttcacctattttggcgttttgcccaaaatttgttaaaaatatgcaaaaaaaagaaaaatacacccctaagaaccgacccaaaaattttttcaaaaaatacatccctaagaatcgaccagaaaattttcaaaaatgcgcccctaagaaatgaaaaatttctcaaaaatttatctccaaaatttatttattttattttcttgacgataatttttgattttgaaaattatgtatatccttaatgacttggcaaaatatttttgctttttgatgaaaattttcgattttacacccctaaattcggaactttttggcacctattttcccatttttagcacctattttgggggttttttagaacctaaaacctacttattttggcagtttttagcacctaaaaatcgaagccctaatcatcagtttcttaggccataacttttttcttacttggtcaatccatacattcttggtatcgatcgaatgcttaaagtttagggaatttacaatacaattgcattaaaaaatagcaatgaaaaaaaaactcaacattcatcatttttcatgtatattcaagaataattactgatcggacgcttaaagggaaatagagccaatttttctatgctaaaaactaaaataattttactttttttaggattttgccaaaaaatgtttgcgttttatttgtcaaaatgcggaacaattgtttgattctgaggaattcttgcaaattgatcagaatttgttgtgtgaaatatttggccgtgatcagttggtgatcagcaatgaatttggcatttggaaagctgtaatttgaattgaaagaatattacataaaatactcataatttaaatattattaaggcactccgttgggccgacgaaaagtgccgtcaaaatgccatcgaatgttcctctgaaaatcgtcgtgctgcgcttggcccggcactgttcaaaattcgtttccctctcatcccatcagatgcatttgtgaagcaaatcggtagaaatttaattgtttttcgacctttgcgcttttttgcagttccttctggtgttttgtccaatgaagaatttgtcggtgtttatcagtttcattgccatccgaatttttgtggtgtacccggactaaacccactgaaatttccatggaacggacgaattttcgattggaacacagccaaaggcaacagaggaacattgacgatggaaattgggagattttctgaatttacacaaaaggaagtggggagtaaatgctttagtgattatgaaatacgaataaatggatttggatggaaaatattggcaggaataaagccgaaaagcaatcaaaaatggctgggcttttacctttgttgcaccgctccaaaagaaggtg

SEQ ID NO: 6990 - DNA, 3037 bp, Heterodera glycines
ttttagggtcaatttttcactgtaaaaaacgtcaaaaaccatttaaacaatatatttatcaccacttttcaccttgtttgagcaagtttggcaatgaaagaaaataattgtgaacatttaggcacgaaatttttgaattgaatttgattgaaataagagaattcaacaagggtgtgcaaatactattcctctcagccgttttaatgttcttgagaacagaaaagacagattcacaaaaggcattggaagggaaaattgatagaattgcagagactagtgatttgagcaggacaaaattaggatttttgaaaatagccgctcatttttcatccacgtttttcctatttagaaatgaaatcagaaatagatttttgcgacattctgctaagctagagactagagatcgaataaaatagacctgaataatgaacgttgctatagttggctcttaattttggtgaaatgtttaataaaattcaaataaatgagtatagaacaggaaacccggcaaaaacccggcacggaccccaaaaacccggcaaatgccgggtttaccaggtaaaataacacccctggtcgcaaaagattaaattaaattaaaaattgacttaatttccatataaattaaaatatttccgacccgcgcaaagcactgccatggcattgtgtccgttcaattcgctcaaatcgtccgcataaatgaagctgagcatcactttgaacgccacaacttcaacatcgggcacctccacaggattgtcggcagatgcaaaagcaaaaaaaaaaaaaaattaatatttttttattttcgaacttcaaatgtaattttgttgtttgcactttttcacttttaccattttccgcttttccattttgcgagtcaaaacggaacatcgcctcaaaaacgtcggaagcggacaccaaaatgcctttatgggccgacaaaagcttaaaatgaatcgaaaaattaaaatatatttataaaaattgaaatataaactcgcctcctttccgtctccgtcccccaccaaaaagtgcgcatccgcatgtttagccgtgcccaacaaatgcttcatccgatccgccaaatttcccgattttgacgaaatcatgtaaaaattgaaaaaaaagaaaaaatttgttttggaaatttttgctaaaaacatagaaatttttaaatgagactagttgacaaaaacaagagatcggaatttttaacatacgcgggcatgtgttatgggcttggcactaacacgggttacggtctatgaacggacccgtgtccgatctctagtaaaaaccaaattcgtacttgcccaactcgtatagtcgagaattgtcatttttgtaatatggttaatttactaaaaattgaccaaaatttcagaaaatattcccctacgaaattaaaaattttcccaaaaattcgttttcaaaatttatttatttgttttcatgaaagttgcaatttgcgagtgaaattgatcaaaaatgagttatttgtgggatttttttgcgtaaatacacttggtttttccaattttaaaaaactatttacgcaacttttggcctttttcgggttttttgcaactattttgcacttttttagcaactattttagtaactattttggatttttagcaactaaaaacccgatctctaataatcgaatgtttatttacatgaaaatgagtcttttgaagttttcaatgggcaaccagcaaattaggcaatcgattgagttgtttttattggccagcacttgtgattttcggcagaggatgtttttcatctttcaataatacaaaagtagggttcctccccgacccctcggggggcaaaatgtcgggggccggggaccggggacctcggggacatgtcgggggtcgggtcggggaggagctcaattgtcgggggtcggggaccccgatcgggtagtggatcaacgaaattttttaacgaaaaacccaatttttctttttcaatgctcgtaaatcttccttttttcactttaatcaactaaaaatgcgtccaatttggcattttataacaaggcatcccaggctccaaaaattttcagaaactgaaaatcgaatttcgaggctcaaaaattttaatctcataaatttgaacaattttagcggcgcgattttcaaaaactttttattcgagccacatataagaaaaatttggagcttttcggcggcaggcggtgccgataggctccgctgaaaagctattcggaattcctagttcattctattaacaaacttgttcaaaatttttcaccctgtcccctcttcgtcgttcaattacctttttaaattctttacaacactcggagtccccaatccgccgaattagcgtcggggggtcggggggcaaaaagtcgggggccgaggacctcaggggacgacatgtcgggggtcgggtcggggaataggtcccaaaaacgtctcgggtcgggtcggggggctcggggtcggggagcaaacctagttcaaagacttaaaattttaagaatttaaacaaaattagacgggacgcttattatttcgggcccactaagccggatgtaagaattgactaaataataagattgccaggcttccatgcataaattttttaatttgcaagcaatttaaatttttaagcacaagggttgttaaaactaaattttaatttttttatataacatttttacattttttggttttgtttttttgaaattattatttttttttacttttttgaataaatttgtcaatttgcgcatccctatgaaagtttttagcaactattttggggggtttttagaaactaaaactaattattttggcagttagcattaaatgagtgatagaaaaagtgagtgtccgataattttgttgtcattaattatgaaaaatcattaattttatttaaacaaccgattattgttcctaataaaccagaatcccgttttttcgggggccccatactccctcacattcgcccatctcatttaccctctcataagtgccattttgctgatcat

SEQ ID NO: 6991 - DNA, 1643 bp, Heterodera glycines
ccgagtccacaatccccgctcaattagtgtcggggggtcggggggcataaactcttaaaaggggggtcctcgggggacgacatgtcgggggtcgggtcggggaataggtccaaaaaacgtctcgggtcgggtcgggggtcggggggctcggggtcggggaggaaccctagtttttggaaaataattctcaaaatgtccttcaatttgcattccaattcattgctttacctgctgctggcatggattggtcgctgttaaactgttgttgcgaagtgtaatctgagattatgcaaaagcgattatcattacttttaaagtcatttcgtagtcatctactaataattaataaataaattattcaaattcaaatctctaatgacttttaaaataaacttttcaaggtaaataataaaagaaagcatttttgcgatgcaaaatcgattaaaaaattgattaaaatttagcataaaaagtatgaccaacacaaaagctagaaaaaattaattaattaattatatttcatatgattggtcaaatggaagattttgtaaataattataaattaccttattcgattaattcaacgatttaaaaaattttggttgagaaatttacagttaaaaattttattgaaattttttaaaggcataattcacattaataattgaaaaccatggatgggctggccaggtcaggaaagagaatttaatttgtttaaatttttaaaagtgatgaaaacatggaaattttcggtcacactctgaatttttgccactattttgctatccccccaccccgagtttaggcctctattttgggatttttcgacctaaaaaatcttgcaaagattttatttaagtcatattagttttttaccagtttctattggatattttttgttcttaagaaataatttgaaaattacagattacgtattatggaaaaccttggcggattacggatttccgtaactgaaaatacatttacgccggccccattcaataatattaatggaaaaaaagttacgaagaaaaaagttcattttcaattttttgatacccggagaaattgggcaaaaagggtagtttaaaaacgaaacatttgtaaaagtattaaaacttaataaattataattgttgactgttttttgcagattttactccttcattttttgtttagaattctttaaacttacctttataatagggttaagccccgagccctcggggggcaaaaagtcgggggccggggacctcggggagcgacatgtcgggggtcgggtcgggggggagctcaattgtcgggggtcggggaccccgatcgggtagtgatcaacaaaattttttaacgaaaaactcaatttttatttttaaattatcgtaaattttcctttttttcactttattcatctgatttcgttagcgccagcaagagtgagtccaatctggcctttaaaccaggggcttccatttgttcttatttataagaatttctaattttggggtagcgacgaaaatttttctgatttcgtaaatatattttattttttgaaatttggtggcataatctcactatttttcaagaaattttaaggtctgccacaaaaattttttgatcttttggtcccgaatgtactgaaattt

SEQ ID NO: 6992 - DNA, 1037 bp, Heterodera glycines
  misc_feature (15)..(15): n is a, c, g, or t
taacaaaacttaaanaggcaaaggaggtacaaaaaaattctgtttgctaattaattactcattagtacactaattgtgtctgtgctgtcccccctttgtcctctcaatgctccgccgcttcgatttttcattccctccgtccaaaggtgacattgtcgaggtgcccttccgctacctgcacaagcttccgctgagtgggtacgaagtgcgcgactttaccatccaaacgtccgaattccgctctttgggcattgacattgaattttccgtcgattgcaatgggttcgcttcgttttcccactgtttttctgtttctcaattccgtcccctcagagagcgtctcactggacgcgtttgtccaggcgttcgacccgaacagaaaatttccttctacgccaaagtgacactgtccgactgctcccggcccaatttggcggccgtatccgtcggcatttacggctacaacaccgtttccgccatttttgtgacgccgctttgtggctgcgagtgcgaacacgggcggcaacaggtgcaaaagggcacagagagaaaggcaatgccatccttttcgccttaggaacggcactctccccgctgcagttacatgggcaacctcatctgtggccaatgccaatgtgaccagggaaaaggcggggtaaggaaagccacgggaacataatgagacggcattaacaattgaaggagaagtgtgagtgcgacttggacaagtatggcgtgtcaagtgccgacgaattggtcggactgtgccgagagtgagtgagggggggggggagagaggagcattttggaaagaaatgcatcaccattttaccaacagacacaataaagcgccgatttgctcgggcaaaggtcaatgttcgtgtgggaaatgccaatgtcatgcgaattatgtgagcaaaacaaacggacgaacttttttggcattcttcattacacataaaattcagcttagcggtcgctactgcgaatgcgaaaacaccaattgtccactgagtgtggaggggcgaatgtgcgca

SEQ ID NO: 6993 - DNA, 1694 bp, Heterodera glycines
  misc_feature (57)..(57): n is a, c, g, or t
ttgaaggcgtgtgcgaccatggctacagtggcgaggactgcgcatgtgacgatgacncggcaccgtgcactgagaatggggtacggtacaacgaggggggagggggtactataaacagggtctcaccatttaatgttcctttgagattgtttgctccaacaatggcttttgcgagtgcgggaagtgctcctgcaatgtcggctggacaggcgaacgctgcgccgtttcggcgcctttgccggaggaatccgccgccgtcggggcgataacggcgacagaaagttccgacgaaagggaaagcgacggaggaaatgcaatgggaacgacgggcgaagagaacgacgacggggaggaagggccgagcacggacgccgaactgttgccaacgcaggcggaccggacggaggaggaggcggaggaagaggcaccacaggtgaaaaaaggggctgggggaagactgatagagggagtgtcacggcacgggggaaacccccgggaaggagggagtaaaaaagtgccatggcattaccgggaaggtgggaaactgatcgagggagtgccacggcaaattttgactgatttgaggaacaaataaatccgccagtgaatgcctttgccttccctttcagtccgctgctgcttctgcccctttctcttcgcctttgctttccctccttttgtccacgacttttctttcccttttctttcgtcccattgaaatgtccaattaaatgctttgaatttgtcctttgagctgccgccgctttcgtttccttcacaatttctcactagcagaactgacaattaattaggacaaaagggcaatttttataaatttaattgcgacaattaaatatttttccctatgccctttttcagttctgctgatttgaatttgatttgtttatttttttgccttttcacatttttttctccaattctttcttcgtatagtggaacttatttgttaggtttctgatattttacaattttttatttctccgttaaaccaaagtgagtggacaaaacaataaataaatatgacttatgcaaaaacatttttgtgaactgataatcagtgatttaaagcgacaagtaaaattagtgaacgtctcagagggcacaaatacattcggatgaaaggaatttcctgtgtcccatcagttcagtcagttagttcacttgttcgctgcgtacgccgaccatcataagttcctctctgacgcgtcccaaataagaagggtccgggtaaccatagcttaatgaaaccatttagataaattctttccaaaagcaaaggtgtagaattgcggtcccgacagaaacaaggacttgattttttcggaaaactttatgaaaattaatcgggtacaaaaaacttatacacagaatttgtagagctcaaaaagagctttcgaatgagctattgaatgcttggagaaattaagtttttcgttttttacgattttttgaaatttaattactcgaccctacttcccctgtgaatttctcgtaattctcatcaatatacaagtttccggtcccggctttgcccataagtccctgtcccgctctactctaatcttttttccacataatttccgctttcccagaaaatttttcacatttgtttgatcaaattttgcttctttgataaatcctctttgttcctttgaaatcccttttccctcctt

SEQ ID NO: 6994 - DNA, 2448 bp, Heterodera glycines
  misc_feature (2349)..(2349): n is a, c, g, or t
  misc_feature (2373)..(2373): n is a, c, g, or t
  misc_feature (2396)..(2396): n is a, c, g, or t
ttggtcaaggccggcaagcgtgccttttgtgcgcccaatttatataaatgtctcatggcttctcaccttgctcacttgcaattgaaatgttgattgaaatgcgcgaatctgagtgactctgtcctcgacggaaacgcgtggaagtgacgccgttgtttcggccgagtgcaattccttggaaaaactcctttcaaattaattaatcaaataaaactcacgaagattgcgtccgggtccggcaccagtggaacagaaaagttcaattggcgattgcgaagtccccgagccaaccaagcgaaatgactgttcgctgtcggtgttcccggttggtgtgctcactgtcagccgactgtcgtccgattgattgttttccgagttacttgaagcagatgaaccattttggagttgtgattgagcacgcaatttggcaatgatgaatttgtgaagagatcgcatatggaaatcattggtgtccacgatttgaattttctaaaatgtggagttggctaaatgaaaataatttccatttacctttaaacgaccaaatgaagaaaactgctgaaggcaagcccacaaataatttgaagcggtatcaagtgaggaaaataaatttcctaaatttaatgaattgaaaaatatgataataaaaaccgtaccaagcagaggcatcgaaagactctcaatccgaaggtccaaagctttttggatgattgcagaataaacttggtcgagagaatgacggtccatgccagaaacgggagccaacagcacagaagcagagcgaattccacttgaaataggaacagagatcacacgtgaaccacgctgtttgcgtttctcctcgtttaaagaattctaaacatcaaaataaagaactaaaacatgttcatgaatattatatccagtttatttcttgaaaggttgttcaaaaaacgaaccatgaagtcctgaccacctgtgtttctgattgcccttccgacacccgcattgagcttaatgtctgggtcacataaaattgcaatggcatctgtttcagccatcacaatgtccccctgaaaaaatgcaaaaggtaaagaccatttaaatgtgtgatatgtatatcttactcgaaaaatattcaattcaattcctttgagacggcaactgaaaattttatctaggggcggcataagtatgattctaaataaaatttttttgacttattgctattaaacgaccatgaaataatatgacatttttagaaaaaatggcgattgcctaataattggtggagtcgttgattggacgtataaacaagaagagagagagatagagccgaaaatcactgctcaacatttggtgcaaaaaaaataatttagctcccagtttaaagtcacaatcagaacgccaaattatgctctttcactttggcgtactatctcttcattttttatagaaaaaacagcatttagtgtttctttccctctcatgttggcgtactattttcacacctcacacacgaaaaaaaaatcaaattcgcaaattctaataattttggttatatgggtataaaatcactttgaacatttagaatcaataaaaaaagcaaaaattttcgcattttggttgaaacagcggcctaggatttgagttatacgtaatgaaaatttgaaactcctacaacttttttctgagatgtcaaattgcttagcattcgcttagaaaaatattctccttttcaaaaacctttttaaatattcggtttgattgggaatgaagcgagttatggcagatcaaaataaaaaaatacaaaaatggcattttctagtgcaaatttcgaaatagcgcgaaaaaattatgccaattacactttttggcgttatgactatttaaattttgaaaaccatccaactttaattaagtgctctgctgaagttcgacaaatttttgctctcattcattttttttattttgtaattaattctattctaacttaagctttgtcaaatatcatataaattcatctcatatgtcatctgcaaaaaataaaaaatccattgagaatgtaatcatcagtgttcggaatgagtttggttatctgaaccagctctgggacactgtttacatggacttgccaacccgggaattccgcgtggaagaagcctgcgaatttatgttcaatctcctacaggtgatcagaaaatcagaagagaaagtaagtacattaagaccttcatctacgtctaaatatatttgcaattttaggtggtccgtaatattgtttctgacttggaaatccgccgagaagcagtgaccaatctgaggaaatttttggggttgccttctttcgacgagtcgcttttcccgccncagtcgatcgcattggtacctcanattttttctaacattctcactgnatttttttagctgaaagtgcttgattcggaaaaaaccgattggaaagcgaaa

SEQ ID NO: 6995 - DNA, 1493 bp, Heterodera glycines
  misc_feature (55)..(55): n is a, c, g, or t
  misc_feature (72)..(73): n is a, c, g, or t
  misc_feature (75)..(75): n is a, c, g, or t
tttttctaacattctcactgatttttttagctgaaagtgcttgatcggaaaaaancgatgggagcgaaaggnnanggaattgtgggagccaagcgaggctgacggaaaaatacaaagcattgtgcgatagggtgggaacaacggcgcgacaatcgaaaggagtgcacgacagagtgagagagcgattggggagacaacgctaaaatgatttgttacagattatgtccgaagatgagttggacaaactcaaaggcgaggtggacgcgctgcagacttttgtcaacaaacggctcgagaaggcacttcagctccaagcggagagcaaacggtgccacggcatattttattaatttcaaatttcgtttcagaatctttgagaccattcgcccgtccatcaatagtttcaatgaagactacctccactttttgcgtgttgacttggacagccaatccaccgtgttatcgtctgactttctgaagaagatggaaaaattgaatgaaagagtgagtttaaagaagggcgatcgaacgaagtgcttaacgatctctgtttgcttatgcccctaaaaatttagctgaaagaccatcacgacttgtgggctaaacaggtcgtcttccgctatgacgagctgctcgttaaattagacgagttgtccgcaaaatgtttccaaccttctacggagtttccagcaaagccaaatttgagtaagtgacaattgtcaaaataaaagtcattaaatccttgggaatttcaaaccgcttatttatttgcgtgattaatcttattttatatgtaatatttcagaaaatctgagtgagaaggaactgctaaaattggaggaggaagttcgaatccgtcagcaaatgtacgagcgagcgaagcccgtatttgacaaactgaacgaatggatggccaattggaagcagaagttggacatcgaacggcgtgtgtgtcgtgcgtctttctacaagaacagggcggggtgtctggacacaaaactgaaggtcctttaatcgaatcataattttacatgaataaataatttagcaacaaaaaatcgtggaacaaaaacttccgaaattgctgaacgagctttgtgagttatgcaacgactacgtcaaaaacttccaattaaacgacattatcatcgacggattgcgagctgacaaatacgccgaatcgaagatgcaaaattatcaccaagacaaaggagtgcaaaaggctcagaaggtcattcgttatcatccatcctttgattgtttttgttctaattacagcagttttcgaatcctcctttgaaacggtcaacgtcgaaccgtcccgcgacttcgtccacttctcgacgcaatgtattcgtacccagaaattcgtgtggtcgtgctgctcctcgcgcactgaacccaatcggggaaaagcagcagacgccgacgacttcccgcaaagaaggcgagacgaagcacgccactcgtaaacggtccttttcaagcagtca

SEQ ID NO: 6996 - DNA, 7681 bp, Heterodera glycines
ctggttttgaattgattcgaaacggaacgaccagcatcaaggtgcaatttaatgagcctataaaggacggcgggtatgagatgatcgttctgggggaatttgattcgattttatctattaatgctaatcgtgtgctcagtagcgacggaagcatatgatgaattcttatgagattgaaatatttctatccaaacatccgacaacccgaaaatattttatcgggtttttgcttccgacaagatgccaaaattgaaggacaggcattttccgtactgttttgtggcgaatactgaccgggcgggcacgataggtgaacactgggtcgcctgttttgtaaattcgccgacagaaattgaatattttgattcattgggcgattatcccaatgaagatttaagttcataccttaacttatttgaacgaattctcattaacgaccgcatcgtccaacatcaattctcagatgcatgtggtcaattttgcatttatttcttgacacagcgctgctccggaatcccttattgtgaggtcattgacggtctatataaggtttgcccgagggccgatttattagttaagcaattgtcagtaatgtttaatttaattgttctcctaacgatagccagtcaagtgattgcagaaagagttactattctttctgatacacaactttttgacgacaagtatctcactatgccaaagagttcggtcaatgaaagacagttcgggttcgatcgctcgagattatgtacgataaataggaatctgatttcagggtggagcctatcaatccaagaaattaattcaatagaaaagagcggacccactaatgttaagctttaccaggattttcgacaattaaagccccgagcgtgcttttattacaacgatcatagttatttaattttccaaaacgaaaagacaaatgaaacttctataacaagagggagtcaagaaatggttgtcaggaattttcccggtgggaaccttagatttgatcatattgatggtcgacttttcgtaatcagagacgatcgaatagacgagattgaccttagaacaatagagaatttatggacaaaacacaatgaaaccgaaattattagtaaaccgatcggatcaatgccatcggcatacaccgatttcctaataaatgaggggcaaatttatctaattaaggaaaagaaaatatacaaagaccgatttgactcaaacgagatacttcccaaatatgtttcagacacagatagagaattttttaattttgtcgtgttcaaagaatttgagaaaattagagtttcaagttcaaatatttgggtatattttttgtcaattttagatttggtagtggtcgtcatctgtatttcagttctcagaattttaaaaataaagaaaaaagcaaaaattcatcatacagtggtgaggtaatggtatataaggaattgcaacgaatatgaaaatgcctactcgtgctcaaaatgaattctctcattgaaattctatgcgattttaacgaatgcgaacctcacgaattatcagaaattctacgacagcggaagaaagaaaatttgaaatttttgagaagacacgccctaataacgagacaccttaggcacaatcagtttatctcaccggatgacatcgcatttaacggttctaatcgactttttgcctaccgaggtttcctcggggttactgtcgaacagcacctctactctagacatcgggtcaaactacaattccctcaactaccgtgtgtaactatgtaccagaataatggtcataggtgctattttccccttgaacttttagattttttataaaaaatataacggctaacaggagtgggccttcactttagaccgttccacccccgctagtcataatatcactttaatttttttattcaactttatttaacaaaaaaaaaaacaataaaatacaaattaacaaaatccaaatggcatcacattaagttcttcatcgattatccccttctggcagaccggcctgtacattttgtgcttctcccttgtcaccacttttgaatcccttgtcggcctaaatattgattttttaatgagtcaaatgtttgaaaaacgtacccaaaatcattcttgtacacgaagaacgccgggtcaacctcccctttcccgtaactaagaaccatctccctgaatgtatcgtaatgcaaagtcttcctgttgtccacgtcgaacgtaatccccctaattttcataacgtattccgtctcccccgtctgcttgtttttcatcttcaacgcgtactgcttcgcccctccacaacaatattcttcaatctcatgcccaccgtattcctcactcatttctcccaaaaatttccccgtcgtaatcggctccacgtccctatcgtgcaaaacaaaaatactgtccgtgtccgtgtacaatatttctccgccatggctctccgcttctctcatgaattccaataattttaacctcgccatactcgtcgtcctaaaattaggttatatacaaatttataatttttttgaactcaccataaactaatgactatgttgctcgacttgtgctccatcacaaagtcctccttgtccctgtatatcaatctaatcgcctcttccgaatattcaacaatatcacataattcaattttatggtcacacgctattttataaaactccgacgccctatcaattaccgcattcttgttcaaacaatttctcatcgaaaactttccctgaaattgaaaattacctatcgaaatttattttcaattttcttacccataaactatttagcatcaacttgcttatgtaccgcaaccccggattcttcttcactttagccaattcaatgtcgattccatatttttccttatactcttctctccacatatccttctgctcccccgtctcaacccccttcgggaaaccgctcgcctcctccttcagcttcaaaaataagcgcacgtatcccttgaataaatcattcgcctcctcttcgtagtgccacgctctataaaatctgtccacagtataaccgcattccaacgcctttgcctgaaaatgtcaaaattttcttaaaagttttctctataaattcttaccaattcaacgctagtatatgtcgccacgtatcgccgctgtgccccatcatgtgggcacttgtagttacatctcgtagtctccttcttaaattttgacacacatctccaacataacgggaacaataatctctcatcgcacttcaactgaagaaccggaacccgcaaccctcgcggcgggttgaccctcactttatacaacccattatacttcaaatcctccggtctcatccaattaacatcaatctcatcactcttcggtaaaataatctccggcaatccaatcgggtaagctgtaccgtaattcaccgacggatacagactcacaatatcataaacactaattttcttcttctcatccgatttcgcaaacaatttcatcggtcccgtcctccctccctcatatgccatcctcggatcatcggccccttctcatttcctctgtcgtcaaagaagtccctcatttcctcatcctttttcaattccttctcaatttgacacccctaaaaagtagaatttataaattcaaatgtcaaataaacatacccaaacttcttcgacatccaaagtcttccgtagctccactaatctctcctgagactcatcgttcaattcctgggctgtccttcctccaatcagttccgccgccgggtcataacaattcaaacatccgtgtatgtaacatcccataacctcaatgcatttgtcgctagctccgttattcgcaataaacccatccaatttgtaattcccaattttaacttctcgtccgttccccgcgtgtcgtatctcaattccatctctcttgctcctccactccaaatattttattgccatcacactggcgcgatcacaccgctcatatcccttctccggcacaatcgataattgctccgtcaataaaaacattgctttaaaaatattcatcgcaacccccgcattcgtacaactcctcggcagggggtcgaatcctttcgtaatgtcgttaatcaatatcctcctaaactcaataatagacaacaataaaatctccgtgtcgtttcggcaataatttctcaattcttcatccaaataaaagggtgtctccttgttctcattgtacctgaaaaaaaaaagaattttattcaaaaatttttctattttcctaccatttttcgaattttataaatttatccttattcatagatcccggcgaatagtcctccatcggtagcagatgttccaatcgtattccataattttctttcttgttgtaataataggggaaaaagggcttgtcctcacagtccaaattaaatgtcgccttcagcgactcaagcttcaccggcatcaataaacatgtctctccaaatcagccttgaatgtttcttcgagttttgcactttaaattcataaattttcaatccattgatgagcggtgttcttcccggtacggcagaggtaattaaaaacaaaatgacctaaaaatttatgatttaaattaaaatattaaattttatcattaccatcaaatcgtccggcattgtgcgcaaatatgtacgtatcgtaattggtaaaagccgttaaaatccattccacaaagtccttcgtcggctcatgtccctccgcctcgctccaatccttggtcctctcttccctacaaattttgcaattcgtcctatttttgtcgtcacagcattccgtacaagtcactctcaccgaaatataattgatcacatgctccttctggtccccttgtaaatcgtatcctgcgatgtctccgaatcctggagttaaaacttatttttgtagattttatttgtagaacttacccatactacaattcgataaacatctttgtcctctttctcctcgatcggcataatataacatccccgtttggggtcgtgactcacactacaaagctggcaataagtctcaccacattcatgtcccttcttcgggttaaataaatatgtcttatcgcacatcacgcaacgcctccataagttacaagtctgatgtccctgatgatagttgtaacactcccaattataaaagtaacgtcgacacttcgggcactcaatcttcactccaatctccttttcacatggcattcctccaactctattgcagtaataacacctggcccggcactccaatgtgtggtaaacatcacgcgagtaaaagcactcacagtcaatacaaaatttgctcccacgattgaaaaagcaaacataattctttaatccatcccagtgaccattcttcaaaaatatcggcacgaccttctctcgtcccattggtcccttccaaagcacacggattgatttccgcggatccgcagacttctcaaatgccaccacccggtatttaccggggtaaatctcatcctgaaaaatttattaattttgcattttttcatttaaacccacccaatatttctgaacattcggcaattgctccacaccataactaatttcgtttccatcaattccacaattacgtaaaagctcaatagctgcgtccctctgtctcataatattgttcataaatcgattaaaaatgtttcgatgcacttccaaataattttttgacgccgccagtgcgtagaacaaacataatttatccgcatttgtaatccttaataaatattattattattttttacctttttttcgttaaattatttaatttttttgtttttagtttatttttttacctttctttttattttatttaattatttttttgattaatttttttttgcttcattaaattatttaaaaataattatttaaatttattttttactttctttatttttaattttattgttttttttttgcttcattaaattatttaaaaataattattattattttttatcaattaaaaacacttaccctatccgctggtgttccttgaatccaaagtcaaatttatggacattcctcggcccctctccattgggcatggtcacgcaagttattttcatcgtaattggctccgacagcaacagcattttcttattttcatccccgtccccgctctgccccagtttgttgatttcctccatgataacatccgcattattctggggtacgcccgatacggcacccacaccgggaagaaaagcctgcacccgtaattgtcactccaaacatccgcacttttcgcttcattttttcttccgtagtttttaaagccacctttatcatgttgtcgatagtatccttcatcgcttcatcagggcgtcccacgtccgggttgacacgaaattccgtaatatttttcgtaaatccaaatttttcgcaagtcgtcgtttgataatccatcaatttataattttccatttcttcatcaaaattatttctgaaatattttaattgattaatttttttttgaaataattcttgtggttttatcttataaatatattttaaattggtataagaaattttctttaatatttttattaaaaatcacttacccaattgatcggaaatcccattttttggcaaatggcacggcgggttggaaggagttcgcgcgtttaaaagacattttaaaacaagaaattgcagcagaagaattaaaaagatccgaatttgaaaagaaaaaagacgtaggtaaaatagattagaataaatttaaagaaaaaatagagcggagcgaattaaaattagtgcgtgaagagagtttaatgaaatccaactatttagctgaatgatttgcgatttgggccgggtgtatgaaatgggtaaaaagggaggggtttagtcacgtgattgtctgggtctgccttaattttgagggtcatcaatcatttcggtagacaactgtcgcattttattcagcaaaaatcgtctggatattctttatttcgaaagtcatcaatcattttttgtgacaggtttgcaaaattaggggccctatcgcaaaatagttggaacaaaaaaactaaaaatatggagaaatttcaataagaaaccaatcaatcacattttattgacagctgacctaagattaagaggccacattgcgaaataattggaacaaaaagtcacgtgcagattgcgaaataatggaagagaaataaaaacacatcaatcaattttggttgacaggtgacctacttttgaaaaggtttttcatcccgatttatttattcattttcgatttttatttttaaacacaatttaaataattaattttattgtccaatttataattgatattgtttgcagtcatttcaattaatttgcacttcttccaaattccgttatcgattttttttcgcggcggcggcatcgcggcgcggggcgagcggggaggaaatgcaaaaaaaaaaccccgcactgttttggcacattttcaaaaaatgcattttttatttcaggattagaaaccgtcataaaaaaaaatctcaggatttgagaaaataaaaccgcccaaaaggtttgggatttaatttgcaaagaaaaaaattgaatttccttcacctgccactttggtgacaggtggatgattgatgacctttacgcggcgctgagcggtcgggtgaaaaaacacccgcgaggatttggggaaa

SEQ ID NO: 6997 - DNA, 2744 bp, Heterodera glycines
ataaagcgagtaaagcccataaaaattggggcgaaaatccgacacttagccccaaaatcgggcaaatgcccggttgctagggtaaaatgtcacgctaaatttaaacgagcaattatcgagaatgaaatctcggggagaaaatgtattatttatgggtcaataatcattataaccttttaagtaatttatggccattaattcaacaaattgtgcgacaaaacagcataaggggaaaacggaaaaagcattaactgatgataacatttgttctgctgattgagagattaacatggaaatgattaggaaaatttcccgcgaaaaggtcaaatatttataaattatttacccatttcctttgatattattaattaatgggtgggggggggggagttaatttgaggcaaacattttttacacttattattataaatattatataattaattaccaccaatcaataaagagagaaataatttggtttaaaatttaatgaatatagtaatcctgtcaatattttgacaaaattgttcatcaaattcaatcgctcaaaaaacaataccctcatcttttcaacaaatagttctaccagacctccaacaatttcttcaaataaaaatatccctcaaaatttctctaaaaattttacccaaaaaaaaaaaaaattttttttttcctcttttacaacccctaaaaaaacaacaacaattttccctttgttggaggtctgacttttctaatttctgcttcttcattcaaaatttcaattatcttttatcactacctttcatttcacctcatttccgccaaaagtataagtggcacatgcccttcttttggttatttttatttttgaataaataaacttttaaacgtgtagaatttataagagaaaaatatgaaattcattttcgagaattatattattatattatatatttacatataaaaatataaatttgaatttttagaaaagcttagcaatgaaactgtgcttattattctttttaattgttgaaattgaaattggagcggaaaagaaaaaagtgcaacaaaaaacatttgaagaaatatttggagaaaaatgggaagaaaaagaaaatgaacagaaaaagagagataaaatagaattgaaaatcggaaaaaaattgggcacaaatcgaaacaaaatttacaaatggatcaaagaattaggaatatacaaaaaatggcataacaaatcaaaaacggatgtacaaaaaattgaaattgttcaaaaatttaatgcaatgaaaaatgaatataaacaaaatggatgaaaatattcgacaaaagaatgggacaaaaattatgaagaaattgggaagaaaattggagtaagttatgtaacaattcaaaaatggaagaaacaatttggaatgggtgaaagattaacggagaaagaaaaaatggacaaaatgaaaatatattggaaaatgaaaagagaagacgcaaaaatgagtgacgagaaaatttcaaaaatattgaaaattcatcgactgaacattttcagatggaagaaacaatttgaagaagaattaaatgaggattaaaaaaacattgatgagataaaatatcttttcatttattcatttttttcttgtcatgatttgcattcactcaactttttgcttcctcctaatccaaggccttgtcttcatatttgttttttaatccctatattgtatagccttacatatttttgatttttcttaagataattaagattaaaaaaaggtaaaataaagacgatttttgagttttgaagactttatttactagcattgaaaaagaaaaattattattttttggttaaaatataaatttggtcatcccccgaccggggtccccgacccccgacaattgagctcccccccgacccgacccccgacatgtcgccccccgaggtacccgacccccgactttttgccccccgagggctcggggcttaaccctagttaaaatcataaagcaaaaatcatcattttataaaattccaaatttaaaaatcaataaaaagctttttcgcggtgcgctttttccaaaattttttgggaagagggggcaagcggtgccggtaggcgcggcctggaaaatttttaaaattttgaatacaatttgtttttggaatgagtggaaaaagaataacggagaaagaaaaaataaaaaaatattggcaaatgaaaggagaaatcccaaaaattagtgacgagaaaatttcaaaaatattgaaaattaatgaacggaccatttgcagatggaagaaacaatttggagaagtaattaaggaggactgaaagattaaagagacaaaattcggtcgcattgttcgctttttctacgataaaaattgtttgctttttatacatattttcgaaaataaagattctgttggtcgaatgtttaaaaaaaataataaaaaattttaaattaacattatatttgaaactcccgaccaaaagggacagaaattatgaagtcaaatacttccatttggcataaaaacagctcctggcattttccagtcgataatggaccaaatgttggcagattttgacttcgcgacagcctacctagacgatatcatcatcgtcagcaagggccaaaaagaacattctgaacatttgaaaaagatgttctcgtgatttcaagaatggggatttcgcgtcaaacgggaaaaatgttcgtttttccaagatgaaattaaatatcttggacaaatcatcgac

SEQ ID NO: 6998 - DNA, 2190 bp, Heterodera glycines
attggaaattcggtgaagtgtccaaaaagagaggagtcatttatgacgtggacttccgtgacgggtcgtcaggaagattccatgccaaccaactccgtcctcgacacactcccgacgaagccaaccaattgcaaatatttcccgacgcatttgacatcggaaaacccgccgatcgacaaaatgccaatgatttggaagctcgggatgagcaaaaccaaactgtccaagagcaaggactcgagaatgatctgagtaagtcagacaacgacgaatcagtggccgaagaagcagatcagcacaagttcagccacgccgatacccgcaacggaacagacgtgccccacaaaggtagtcgccgtgagcagctcaaaaggggaggtgttcggatgagcctatttgaattatattggcgatctgtctattcaaatctccgccatttgttgtcaatcgcccataaatagacggtcattccctccctccttgttttttccctcattttccctcatttcatttcattttattattttcctccgaccaaattttttcaatttttcttttgacttgttaggctctaaaaaaataaaaaactagaaaatagttgctaataattcgcaaagtagcttaacaaaaccaccaaaaaacttgtttttcgtgcatttcaggccactgggagcagagaaaaaaaataggctaaatcctaaaaattggagccctagtaataaaatcgtagtgcgacatttgcggaccgacatttgcgtaccgacttttgcggaccgacatttgcggaccgacttttgcggaccgacatttgcggaccgacatttgcagaccgacttttgcggaccgacatttgcggaccgacatttgcggaccgacttttgcggaccgacatttgcggaccgacatttgcggaccgacttttgcggaccgacatttgcggaccactatttctgggttgaactgtcaaaaaaaaaataataattttttcaaaaattgagtgactaagtagttttatttgtgatttttaccaagttgaacatcgcccttcaagagtaattgatcacctattttgcaatcaatatcgaaagaacccattttttaaagaagtttagtttccatagataaaaatagtatgtagttgctcatttttaattttggacccatagttttaataacagcaaattacggacaatttttgagaaaaagataaactattttagtttttgtttgttaatttaattggtttggcatgccggaaaaaattaagctctcggttaactaaagcgtggaagtgaaacaagataaaaaattttcttggtataaaattcttaaactgacttttatatttaatttagctaattttttcgccaattttcacagtttaattataagttagaaattctataaaaaagaaagaaaaaagttatgtcaaataaggcttctctccaattgagacagatcgctttgcatcagcttaccttcactaatttcaatttgggaatattaaatttattaaatttcttattatttttttctttatttagacagttcaacccagaaatagtggtccacaaaagtcggtccgcaaatgtcggtccgcaaaagtcggtccgcaaatgtcggtccgcaaaagtcggtccgcaaatgtcggtccgcaaaagtcggtccgcaaatgtcggctaacccataaaatatatgtttacaaaaaatcaaaaataaaatcatttttcttttttttcattcattttcatcctcaaattcgttgagcatgcctatcgtactttgaatcatgaattgcatttctaagtcgtcatactgttgttgtacgtcagcattttgactctgtatatctttcgtacaatttttctggcgcaatggatttggactgatgccaaaaactaaaatattaaaaattctaattaaaaaataaaattattattttcataatatccctccttaaaaattggaataaaatatttaatgatacaacattttttagataatttatgtatttttttttaccattttttaattcgaattcgtttggtagtggcggtggcgatggcacttcaagctttaattggacacttttttcgtttttcgctttcatttttaataattttgcgtctcttccaccatcttttttaagattttgcagattttttgctttatttgccgattcaattaaat

SEQ ID NO: 6999 - DNA, 1107 bp, Heterodera glycines
atgaaaaagcctcaatggcattgtcccatgttttacgaggcaagttcctccgttttgggtacagccgacttcgtgctctttgttgttgccattgcaattcgattttgtccgtttcttcctccgatgcactgtccactgatgatctgctgctgttgctccgtttcgtcctgcccttcccgttcagcaccatcagaagcccctctccgttctgtccatcctcccgacttccgtcttcccttctctgtcgcaatacgttaagccaacaatcggccgcccggtcattgtcagcctcaaattggtatttcttgcccttttcagtgctaaaatgctcaaaagagtgaatggaatggcgcggaaaagagcgagcacactgactgaagcagaaagacgcgcacatttccctcgagcaaagaacagaaggctccgtccatggaaatgtggccgaggcattctttgcgcgcgtcgaagtccgactttgagcggtaatacaccaaatgattgtccatctcctcgaggccgaaataaagccgtttgcgaggttggaggagcgaggcaaaagctgaatgggagggagcactgagaaggagaagtaggcattgagagggaccgttgccgagtgatttcatggaaaggtacccctccagcgaaaagcactgctcctttggccgaggctgggaggagtgaggcggcaacgaggacgaggacgcatttgcggtcatgccgaaattggtggaaatcaaagggccaaaggacgatttgacggaaccatcggcggagggggaacactcggagtgagcggaggggaggaaagaacggagagtgccggcaggagaaggggccaaattcatcatttggaatcggattggctaattaattgccaaattagcagaaattaaatggaaatggaagccaataatcaaaaatggggaagaaataaaacattatcaaaagaaaaaaaagaatgaatgaatttatggacaagctaagcaaatggccatcacaaaaaatggacgaatggacgatacaatttggacgaaccaaaagacaagcaacggaggagggaggggagggagggagggaatggttggatcggcggaagggtggcag

SEQ ID NO: 7000 - DNA, 3112 bp, Heterodera glycines
  misc_feature (2965)..(2965): n is a, c, g, or t
  misc_feature (3023)..(3023): n is a, c, g, or t
  misc_feature (3064)..(3064): n is a, c, g, or t
  misc_feature (3066)..(3067): n is a, c, g, or t
cacaaaaaagctcagtgtgggcgttccacaaaaagctcagtgtgggcgttccacaaaaagctcagtgtgggcgttccacaaaaagctcagtgtggcgttccacaaaaagctcagtgtgggcgttccacaaaaaaagctcagtgtgggcgttccacaaaaaaagctcagtgtgggcgttccacaaaaagctcagtgtgggcgttccacaaaaagctcagtgtgggcgttccacaaaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaaaagctcagtgtgggcgttccacaaaaaaagctcagtgtgggcgttccacaaaaaaagctcagtgtgggcgttccacaaaaaaagctcagtgtgggcgttccacaaaaaaagctcagtgtgggcgttccacaaaaaaagctcagtgtgggcgttccacaaaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaagctcagtgtgggcgttccacaaaaaaagctcagtgattgataaaataaaataataaatttaaaataataaatttaattattgtattggtaacatccacgttgaaatcaataaccatcaatacatataattttgggctaccactgaaaatgtaaaattaatacaataaatttttatatgtttaataaaattataatttagaaaatgaataagacttttatttttatttttttgttatttcgatttgagtattcgacctctaccaattccggttttgaagaatttataaaaaatcacaaagctatagaacttgtcaaaagctatcaaaataaagaaattaaaacattaaaaaaactccatgaacaaatgcaactaaaaggtattgacttaagtttttgtaccttaagacgctacgtgtcaagactaactattgtttctgcgcatacaaataaatcaaaattacatttacagttcaaaattattatttaaccttattattttattttatcaatcactgagcattttttgtggaacgcccacactgagctttttttgtggaacgcccacactgagctttttgtggaacgcccacactgagcattttttgtggaacgcccacactgagctttttttgtggaacgcccacactgagctttttgtggaacgcccacactgagctttttttgtggaacgcccacactgagctttttttgtggaacgcccacactgagctttttttgtggaacgcccacactgagctttttgtggaacgcccacactgagctttttttgtggaacgcccacactgagctttttttgtggaacgcccacactgagctttttttgtggaacgcccacactgagctttttgtggaacgcccacactgagctttttttgtggaacgcccacactgagctttttgtggaacgcccacactgagctttttttgtggaacgcccacactgagctttttgtggaacgcccacactgagctttttgtggaacgcccacactgagctttttgtggaacgcccacactgagctttttgtggaacgcccacactgagcttttttgtggaacgactcaccacggttcgttgtttgtttgctcttactttgtcaatttcgaaatccacaaaatattaatttggcaaccgacgcagtgattgtgcaaatgccaacaatggcacggattgtgcataatgatggcacatgtaaaaattactggaataaattgaatatttaattggcttttgcatttttttaaaatccaatttactctagcaaatcttttcaaccaaatcccatcaatccctgtggacaatgaattggaatgtgcaatttgtcttgatcaaattggtgccggaatacttgcgaagcgaatgccctcgtgcgaagtaaataaatattattaaatatttttttaatattaattttagcacatctatcacgaaaattgcattataacatggtgagcatcagaaaaattataattgtaaaaaaataattttataaaatctattatttttaaacaatcgaatgtcatctctactcaaaaggttccccaattttctgaatttaatttctaagattttgaggaaatccgatggaaatggaaaattttcaaaatattataaattaattttatgggcgcaaggttcagagcatttatagaagtttaaaatagatttaattttgttgttgtttgtgatcccaagtgcgaagaattatgcttatttaaaaataaaaatttttaattttttaggtttcgagttgggcataacacttgcccaatttgtcgtcagcaaataattgaaatgccaatgatacagccccaaaatggtccatagcgaaactgtgtttgaccttgtgccaacagcgcatccagaaattagctgatgattttactataaaatattaagaaaacaaaaaaaaggtgctgagagattataaaagataataatattttattatttatgtctatatgtatttgtgatttacacaaacatcataactagggctgggatttttatgtgctaaaaatcctgaaatatgtaataaaatatgtgctaaaaaatgctgaaatatgtgctataagccaaaaaaaatgccaaaatatgtgcgaaaatatgtgctanaaattggaaaaacaatggtatttttgcataaaaattccaaaaactcattcttttcatnttcgccccgcacattgcaaataaaaaacattggaggtgttngnnggtaaaattagtccttttttgataaatttgtttaaagattatttt

SEQ ID NO: 7001 - DNA, 2036 bp, Heterodera glycines
  misc_feature (1942)..(1942): n is a, c, g, or t
  misc_feature (1972)..(1972): n is a, c, g, or t
  misc_feature (1994)..(1994): n is a, c, g, or t
ataatcaattaaaaaattttttacattccaaaatatcaatttttttttaaaagattggaaatatttaaaggtaatttaattaggaattttaaatataaagcaaaagttaacttcaaagtaaaacatatataatccaaagttgaaaaaatgttaatgggtaataatagataatctgattttttacatattaatgtttcaagaaataaggaaaaatttctaatattcatattgaaaataatctagtaattggtgttttagattgtcggaataaacatactttgccattcttttcttcgctgagtctactcatcagtaagttatttctatgactttcggcttaaaaagtagatagctccgccactgatataggaattatagatctaagattggtgaattctttcaattaacatgctatttcttgtaattctcatcattcgataattttcctatcattcatgttttgttaatctaaaaaccaaaaaacattatatataaaatttgaaatccataatgcttaaagtgtttaaaacgacataaataatatcaaaaaaattatataatataaaatagaaatcagaaaatgccaaaatatgccctaaaaaattagataattaattaaatatagaaaattataaattaattcagctcattgttttttcactgaagaattaacagtagagttcgacctggacctggatccaggcctggatttttcctggatccaggtccaggtcattttttgacaacctggattttcctggatttttgtccaggaaatccaggtccaggtcaaatgtgaaaaaaatctaggtccaggtccaggcaaaacaggaaaaaacctggattttcctggacaaaattttagaatttattatttcaagtgaccgatattttttcaagttttcaaaaaatgattaaatatatttaaaaacaaattattattgtaaattagatatttttagatgttcccaagcaattaattgaatttttcaaacatttttttgatttttaaaattggtttaaaaaatccaggtccaggcctggatccaggtctcgaggagcctggatttttcctggacctggattttccttgatttttgaccaggaaatccaggtccaggtccaacatggaatccaggtccaggtccaggtccaggcatttttcaaaatgtcgatctctaattaacagtatcaatatttaaattaatcaaaaaaaaagtttctaatttttaataatcgaattatcacttttcaaagataaattcctattttttttttactttttgaacacttttgtcattttacaccccaaaatttgagtttttttagtgcccttttttccattttttagtgtctattttggcggtttttagagcctaaaaatctcttttattcagaagaaataaaatatccaacgaaggggtgaccacttacacgttagattttagtaaattaatatcaagtccaaggagttcttttacagactaaatttttgtttaactcaatccatttatttatacgttttttgaaactgtcaacagatggagcatctgttatatctttgttgagtttagaccatattaaggccgttctgttgataaaagaatttgaagttttactggattgtgattttaacacaactttacgtctaagattataagggatgtgaccagaaaattgtgggaatatgtcttttttaagatgagtgagaccattaataattttgaatgcctgaactaaatcaattgtttttctcctttcttctaaagtttgaataaatcaagtctttgtttgtaaggtatgtaaggaagtctgcatttaaataatgcaatttttgtaaaatatttttggcatctttctaatttattatcttttttgtatgtcggattccaaatttcaggcgcatattctaaaagaggacgaatatatgtcttataaactntggtccaatacgtatagagcgggattttanatttggcaatattgagaatccnttaatagcagcttagtaatttagtatatgattagaaatctta

SEQ ID NO: 7002 - DNA, 2469 bp, Heterodera glycines
atgtcacctcgatttttttcatgtcgcaatatggcgccgaattggaatattcttcaaacatttgcacaccgttcaactttatcacatcattgccattggtgatgccaaaaaacagttctaaaacagaaatgtttttgaatgtaattgttgcatttcgatgttcattttcaagccattttccgtcctaaaattttggaaatattttttttaattaaaaaacatttaaaataatttaattaaaaattacataaaaaacacgcagttcaacttcaaatacaattgtatcattgttaaatgatgtgtcattgttaaatgatttgcctaatatgatggaaaatgttgccagatcacttgctaaacattaaagattaattgaataataaataaaattactttttttccttaatttattttgaaattataatcaattgaaaaataaaaaattatttttgattattttatataatctaataatcaattgaataaaaatacagttacttatttaaaattaatttgtttaaatgattcataatcaatgaataataaaatacaattatttttattattttgaatttattttgtaatcaattggatataataaaaataaaactatttgttattttgaaatcgttaataatcaattaattaaaaattttttttatttttaaatcatttaataatcaattgaatattaaaataaaattatttgtcattgtttaataatcaattaacaataaaataaaattattttgttatttttgaatcgtttaataagtaattggataattaaataaaattttttgtttcatttcataattcttacctgatttatcattcgtaaaattaacaatcaacaattttgcttcatacacattaagcatttggacacggaaaaagcatgacgaattttcatgaaggccattgattccagtggagaatggaagcggaacagaaaatttgaactaaataataataatttaattatttaaattttaatgctaaatgataatttaattattttatttttaatcaattttaaattatttcttacattctcattttcaatgccatatgcatccaattcgggcccatagagaagcaacatttggccgttaagctttaaatgccaaaaacttttataaaattatttcgaatttttatttatttttttttaaattagcaaaaatatgcagcatcccgagtttgagttattgtaaacaagctttacattttggtgccaaaaagtgactacagtgtttcctataatacagcctcccccactgaattagcccccccccccgccctgaaataaaggcacacttttaagaggggttgaaaaatagagccctcgggaatacggtatatttatttctcgaaaccatgtatcaattatttttgtaaatccatgcaagaccaaattttcgggttcggccaatgcaattaaaattttgccatttctttttttttttgctcaccctaattgccgtaatgtttttccatgcctcgccgtgccaccattcatttggccaaaacacatcgccaagctgcttgccgctcaccataatgacaaaccaatgctctagcaggaaaatgtcaaaacgtaattcttgagttccgttcggcatctgtgttccattgaccacagttgtgcccatctacattaattaattgggcataattagttcactcatacaatttgttaattgccaaaattactccgggaaaagacacttccatgtcatccgttgtcccaattgtcatactcattacgattgtgtcattattgtcagtagaattggcggctgttaaatctgaaaaatttttgcgcagtaattaatttttttttcaattccaataaaaaaagtaagcgaataaatttttatttattttttcagagttccaagaaaaataaatgtaaatttaaaatttttcttcttaacccgtttaattctatttttttcaaatacatagcgtattttttatttatttatttttttgaatttgattttggcatttctcaccggttcctccacttaaaaattcaatagtgaagttttgccaatcttcatccgtcagcacagtgaacacaagatcagcctgcaaatgttccgcgtccaattggccaagttcaaaagtttcgtccatttgcttcatcgggcattgcgatgagccggccgatggcacaatcggctcaattgggtcattctcatcggttggtcgagtaaactttattaaaatatttaaataaattacagtcaaattatttaatgtacagtacccaagcgtccatcgtacaggagcagcttcggtagacgtacaggctcacatactcctcggccatccatggcaacatgtccatgccgagcatccaaagcccaacatgttcttccatgaatggtccttggcccatttgcttggcgtactgttcagccgtatcaaattcttcgtcatcgaatggttgtcctaaat

SEQ ID NO: 7003 - DNA, 1320 bp, Heterodera glycines
  misc_feature (82)..(82): n is a, c, g, or t
  misc_feature (101)..(101): n is a, c, g, or t
  misc_feature (107)..(107): n is a, c, g, or t
  misc_feature (152)..(152): n is a, c, g, or t
  misc_feature (160)..(160): n is a, c, g, or t
  misc_feature (194)..(194): n is a, c, g, or t
  misc_feature (291)..(291): n is a, c, g, or t
aaagcgaatcgttctaaaattgaaaccccctaaagggaaataaattttttaaattaaattgggttattcctttgaagggganggggaaggggggggaaganggaagngggaaagagagggaaaagagagaaaaaattttttctcaaaagggnccccgganagcagagcagaacgccaaaggggaaggaaaaccnaacaacgcccaaacacccacgcaaccgaccccccagcacagcggccaccacgacgcaccggcaaaaagaacagaccaaagcaccgggaggcaagccncgggccacgaggaaggcagcgggacggcaagcaagggacaaacgcaaagtatggcacaaaaacattggaaatgttgcacccgttagatgaaagctcaaattttgaaaatttaaaattgaatttgaatttttaaattttacggttcagtgacgtatgctttgtctaaagtgtgaagaaacggtaggaattcgaagaaggcagccaagaagagcagattgacgatgcccattttagccttttaaataattattttggatactaattattttttttaaagatttaaatacatttttaatttaataaattaattttattaattttgtttttcatttaattaaatatattattcaaaaatgtgatccattaacaaatgtaataaaattaatttagacaaaaaccgtagtcatatacggtacatatcttttttgtgccccctctcgaatttttttaaaatttttttctgttgtaatttttgcgatgaaaacgaatctgaaatttggtacgtgggttatgtgaaattttacgtcaaaaaaaaattcaaaattggcaacttaaaacaaattttaaaagattgccgtgtaatttattaatgcagcttggaatgaaatagtctttataattatcactggtctatgaactttgacatgctcaaatattattatttaattttgaattctgggccaaaaaatcttaaatttttttgaggagcactctatttatttaattatagttttaattttatttatttagtaaaatcgaaaaaacatttatctctatttttaattattgtaaatatttgttatttactatttaattctcaacaaaataatgaattcatttgattagcgaaaactgcaggttgtccattaactgatggaagcaaatgataattcactttgactaatccaaacatatttatgattagcataaaaagtcgtgtcgttttctacgcgattggatggacgattttttctatgattcactgcgaaaaatgggaaaataaattaaacaaaatgaaattgagcaaaa

SEQ ID NO: 7004 - DNA, 3333 bp, Heterodera glycines
  misc_feature (2119)..(2119): n is a, c, g, or t
aaaataaattaaacaaaaatgaaattgagcaaaatgtattgaaaaagaggttaaaattaaggaatgttttttttattcaaattcagaaaaaatttatgtttcttgaacaaaaataatgaatgcacaccagggatggcacggaattccgatttccgacttccgaaaattttggggcctcggaatgccatccctgatgcacactattcacaaatttgttaatttgatttaaaaagtaataacattaccatattaatttatctttctttttagcctaaattcacttaaatttcgaataaaaatatactttttttttggaatttttaaaatacaaatgcttttttttcgttaataaatttttttaaagcacaattgctctttttcaacaaacttttttcctttgctaattcatttatggcattttcgattatttttgtgctaatgcttgtgtttctttctttctctctttttctttactgccattctattgcacactctcattttccttttatcccatttgtctctctctctctcactcttcgttttccaatgtctctcttcttctttttttctcttgttacattcttatccactcttccatgcttttggcatctctgtttttgcacataaatttgtgtctggcgctgcacattaattaacccaatgcaaaaatgtagtaggagcagcaccagcagcaataatatattttgtgcatgcctaattgattacttaaatgaatcattaattccattttttggtagacaaaaaattatttttgttagccacagtgattgggatgccgaagaatcggtgagatgagtcccacgatggaagggataattgagttccaataattgggatgcaaagaagtgggcagaatgagtcccagttattagaatgccggataaaattggtgagattgagtcccaagatgaagtgacgaagaattttttgagattgagtcccgtaattggaatgtcggagaagaattgagtccctgtgattttgtgccgtaaatttgctgaaactgtctcatggttaagtgccgaagaatttttagattgagtcccgtgattgggatgccgtagaagaattgagtcccagcgactgggatgtcgaagaatcggtgagatgagtcccacgatggaagggataattgagttccaataattgggatgcaaagaagtgggagaatgagtcccagttattagaattccgcataaaattggtgagattgagtcccaagattaagcgacgaagaattttttgagattgagtcccgtaattggaatgtcggagaagaattgagtcccagtgattgggttgcagatgaattaggtcacagtgattggaatgtcgtataattgaataccggtgattggactggcggagaattgagtcccagattaaataaagagaagagtcccagttagaatgccggagaattgagtccctgtgattttctgccgtaaaattgccgaaattgagtcccaagattaagtgcaaagatttttttagaatcagtcccagtgatcggaagggataattgagtcccaataattgggatgccgaagaagtgaggagaatgacttccagttattagaatgccggataaaattactgagattgagtcccaagattaagtgccaaagatttttttacaatgagtcccagtgattggaatgccagataattgagtccttttgttttttgccgtaaaatcgttgaaattgagtcccaagattaagtgctgaataatttctagaatgagtcccagtgattggaagggataattgagtcccaataattgggatgccgaagcatttttgagattaagaggcgcatgcttgcaatttttaataagcaagtccttttataatttcaacagggactgaatagtgcgataaaaatttaaaaatgcgtttttttaggtcaatttctttcaattcggaatgtctaaaacgattttgagttttggaccaaattatttatgtttcattaggtttttctttgttacctattgtgccacaaataggctgctttatctattttctttttaaatttagacaatatgatttctgcaaaagttgaaaatattctctgcaacaaatcggtcatgctntcggagataaattctattggctttgacatggattacaccctggccggtgaaacatttaaaaccagttttttccgaggaaaatcaaaaattcattttccactttttcaggctatatatcacccaacacggaggaactcatcttcaaattatgcattgagtacctgcagaaacataaagggttttggattgaagcaatagctttttgtgtaattgagcaacgcatggcggagaattcttgacttggttttttgtttattttagaatgaatttgtgcaaccaaaacttcttttaggaaaaaattgctcaaatgtatcccagaaatatggtccaattgaacggagaagtgaaagtgatgaacactttctacgacttgcccgaaaccgatctgttgtcccaacttgttcatctcttcgacaaaaactctggagtgtaagtaattgaaacattttgccgacaaatttactattatttatataaaaataaaaaaaccactttaaattggatgattgttgggcttaggttttcatttctaagtaactcgaattggcactttgttggaacgaattcgacgttcagggaaaaagtgttttttgctgaccaacagtgcgtacgcgtataccaaggttcgttgatggatacgatcaatttctgcattttctgtcgggtacgccccattcagctcccattagtttcctctacaagaaaaccaaaaaaaaaagcctaaaaataatttttccaataataaataaaaatttttggccaaattcgtattacgacattttctgtatatagattttcggaattggaaaaggaaaaaaacttcttttatagtgtctgaactaataaatttgaaacaatttaaataactgaatgatgataaattgtttcattcggacaacttgaaaggagttttactcaaaaaccgggttgtatccctaaaagtttgtctaattgacgccagaacgtaaaaggaacactttgtacgaccttacagacacggacttgatgtcacaacttgttgagttcttcgacacagaatttggaaagtgagtaattgtaactgaattgtgccgacaattttacaaccttcattttgcacttgaaacgacaatgactccagcaagattttcaaaaaaattttattttccgctggttaaatttcgtcaatttttgactaatttgtggagtatgggtagaaaaaaagcatattttac

SEQ ID NO: 7005 - DNA, 1249 bp, Heterodera glycines
aaatgcgcaaaaatgtctgtcggaaggatcgacttaaaattcagaaaattaaaaattatttaaaattaacgaattatttatattttattttttgattctgacctactgagcgcgtaaatgataaaattgacagaaaaattgaagcaataaatgtaaaatgatccggcatacagtaaataatggttttggtacagtttttcattggacaccgaatccattacaaatttcataagacttcgcacggaataaggaatattcaacacaatgtaaacaacaggaattgcaaacagcacaacattgtttgcacgtgccacggctgatgaattgacattccctaaaacccaaattgttaattagcatttaaaataaaaacaatttttttagagtgtataaccaaaatttaaataggattttattatttctaaaataaacttttttcatagaaaaaacttaaacttatgcaaaattatgccatattttgcagcaaacaaaggctctaattgcagattttacgaatcaacctatcaccctcttcagagaatgttaaactaaagtgaataaattatttaaaaatccatttttggctcataaatctattggtatttttaaaaatttttccaaaatattatattttttgttctttttttattagtatattttttgaattgaaatttatttggaaaaagttgattacttctttttttaagttgataagtttctggaaaaggtggcatttgaaatattgacaagaaaattttcttttattagttcttatttaattattccaattatgattacctgtcagaattgaacggcctcgcaatttaatgatgattgttaagttggcaactaaaacgaccagtgttggcagcaaaaaggtgaaaaatgatcgtggccagtagaaaaaatacttaaaataataaaaataaacttttttttaaatgaaataaatttaattaaaatttttcaatttaatttccatacatatgcctcgtgaagagaataattgtattgacatttcacacgttcttcagatgacgaagacaccaaaattgtgtatgtgtcattttcagtgcttttcaatgcaaaaagcaaattaaaattcaataaaattattggcaaaatccatgccacaatgattttccaacgtttgaagtcagagtgcttaaatgaaacaattttagtttattagtttaacaatttaaatattttaaaagtgaaaattattattaaaatagtattttaaaaa

SEQ ID NO: 7006 - DNA, 1894 bp, Heterodera glycines
  misc_feature (600)..(600): n is a, c, g, or t
atatcgtcgatcagttcccacagattccgtggatatcatgtatgcttagacagcttttctcagccattcatttcaactttaaggaaatgatctattgttttgcctggactatcttctattttatcgccggatcagtgttagccatttaagtcttttcctttttactccgatcaccactgatcagtgcctcccctgttctttctcaggttggccatcgcctcagtaagccatccctacgccggcggatgggcaattgccgcggtcagtgaataaattaaaatgggaaaatgaaaacaaatccatcgattgattcctttttagttcttcggattttcggcaatgctcgcctacgctttggattgttacctcaaatttttggcatggaaaaataacgaaagggcactgggcggaatgggaaacggcacagacggaagcggacgaataaatcgaaacagcgaaaattattgaaagcgagggtgacacgtactgccgatgttgcctccctcccctatttttgatagaaaatttttgtttaataaataatgaaaacgtatggcccttggtctgagacaccccttgtacatgtatgatggggggggnggaggaagtgaaatggaatcgtgcttttttcatatttatagacatgaaacaacgaaaaagacatacattttcatataaatagaattaagttttgcacaacatcacaaaatcaaatctccttccattcgagttcgagcacccgctgcaaaaaacagtacaaatcgacaagttcggcgatctgaaccaaaatcagcacagtatcacttgcctgtttccccaagagaatgcgttaccgttttggtggttggtttgccggctccgtgccccgcctttgtctcaatgcgcgccagcaccggcctccgctgccattcgcttgcctccgtgcgcagcaaatggtacagctgagcaacgtactttaaggtgtgaagaggcacaacgcggtccttaaaaagtaaacgaatgaaaaaggcaaactctggtaagtacccaacccccgcgtacccctccaaccctttgggaccgacccgctgcagcagacaacttacatcgtgatcggcactcatcagcagtgttgccggccaattcacgccgttcgtgaggcggagacaatgaaggcgcgagtacctttgtcgaagaaacaatgaataagcaggaaaaggggtaaaacatacctgtaaatgaaggagaagtcgtccggtttgtcggggtctccatattcggtagcccaagcagcgccgacggtgaacttgttgaaacggagcatgtcaaggacgctaaaaaaagttcataataaatagcaaatctgctgttattgcttacttacccaacacgggtgacgacggccccgaagaggtccggccgttgttgagagcagactgccgtcagtaatcccccgttggacccgccatggatggccaacctgaaaaaggaattgcgagttttacgaacggatactgcaccacaactcacttcttgttgttcgtgtatttttcgctgatgagaaagtcggccgcggcaatgaagtcgtcgaaaacgttctgcttacggtcgagcatccccgcctcgtgccatttttccccatattcgctgaatttgaaacaataaaccaaaaaacaagcgatcatcaataccttccaccccgaatatttgcaattactgatacaatgccaaaatgtttagcgagcatcaggcgagtaacggagaaatatggagtctgagaactgccgaagccgccatagccgtcgagaattgccgggttactgccatccaatttcacgcctttttgaaggacaatgaacatcggaatctgttattaatgttcaaaatgttttaaagttcgagttactcacttttg

SEQ ID NO: 7007 - DNA, 2494 bp, Heterodera glycines
  misc_feature (2454)..(2454): n is a, c, g, or t
ttttgtgccgtctttgcgtgggtagaaaacctgttttgaaaatttgttttagtcagtgaaaacgttaacttttaacacccagcacctgcttcgagtcgaatgcataacatcctccaagtagcagacgagaagtttgtcgccgtcaactggccatgctctctaattttcgttgtttgtcctcctcaataaattcaccatcgcctggctggacgcaactaaaaaattcaaatataaaaacgaacaaaaacaaaaaagcatacttgttggactttttttttgtgtgctcatactaaattgagaaattttttagacaattactgttaaatattaccactaatctgtccggcgatcccaagcccatttcatggaaataaacacatttgtgttcaagtcttttcgtcgagctcccaccggcaagcagctcagggtacgtcttaattgctttttttattgatcatattggaaaataacgaacctaaatgcccgtattgtcggtattaacttttgaggcatctcattgactctgacttccattttattttttcattattgtttgttttaacctgtgatctcactcgatatttattcacttactctgagactactttactgtgatcagtcatcagagtaagtggtctccgcccttctgatggcaatttttctttatcgataaataaacacagcggcccaattttgggctcccagtacaattatgcttattttttatttagtaatcagaacgccaaaactttgcaaaacttaaaattttccggagattttcccttgcaaaaaaagaagagccgatctcgagttaaaaactagacagctaaaaaataaactgtgattcgatagagtgggtcaaaatactggcctatgcaaaatttcaagaagattggtcaataggaaaaaatttttttcaaggacaaagttttttctttttctctcattttgacgcactatttccatgtctctaacatataaaataacacatggttcatttttttgtcaataaacaatttttttaaacttttgactaattaagaaatattcttcagaattttcccttcaaaaatgtttttcactttttgaaaataaaattttttctcagatttcgggttctccgatggcgtcggaaaccactccctcgtcacttccgctcccaaattcatcgcaaagcatttatccgttaacaactcaatcagaaactgctgctgtgtgcttttcctccacctcgagtccaaaattggccgtttacaacaataaccattcggtcagtgatcagcagcggtgctctccgtcagtcaacaattcaaagtgcaaattgacgagcattttaatttatattttttggcgatttccagtataaaaagagtgctcagccgaagcggtactccgtcctcttccaacgcatcgctccacttaaaaattggcacgcctaagtcaaccgccggcgatgtctatgatttccatagcagtcccgaagaagatggcgttccgaccacgggccccggctttttcttttcctccgccccaaacgccggtgttattcaatcgaaaggtcgcaaagcattaaacaaaaaaagattacctatctacttaaaaaatataattaattcacaatcagttccagaaagtcttcaaccgccacaaaaaaggataaaaacggcaattttggcaaagaaattattggctgcggcagctgactcgaatttaattgactcaattggagtgggacaacccaatggaaatggcacaccaaaaaggatgtcatcggacgaacattttggaaatgaaaatctgagcatttttggtgagatttgggggtggtaaacagtaattaatttttttaacaatcacagagggaacacagagagaaaccgaaggaattggcgaaggactctttgaggaagatgaagaagaaacggaggagcaggaggaaagagaattggacgagcgaccggacggaggacgaacggatgccgccacttcagtggttgtccaggaacagaaaaaggtgggtcatggtacaatcagtgaaactctgattctagtctggaaaaatctaaatggtaaatgaatatttgattgtttttctcagaagggaggtgcggtgccgataggcgccgccgactaaaagccgggaaaaattggaatatttgatgaatttttattagaaatttgttcaaaattttaataattttcctctcccctttatccgtgacccccctcccctcatcaccccttcgattcgaaagggttccccatttttggggcctttttcggggaccccctattttttgtatgttctaaaatttttgagacttgacgagttattgaggttcctttagttttcttaataatcctttttgagacccctctctatttgaagctttatttacaaaagaataacatgaaattaatcctcacagaattttctccctaatttatctcaanaaataaataataaatttccagaataacaattgaccatgat

SEQ ID NO: 7008 - DNA, 2408 bp, Heterodera glycines
  misc_feature (61)..(62): n is a, c, g, or t
ttttggtgagattggggggtgtaaaacagtaattaatttttttaacaatcacagagggacnnacagagagaaaccgaaaggaaattggcgaaggactctttgaggaagatgaagaagaaacggatgagcaggaggaaagagaattggacgagcgaccggacggaggacgaacggatgccgccacttcagtggttgtccaggaacagaaaaaggtgggtcatgcatggtacaatcagtgaaactctgattctagtctgggaaaatctaaatgttaaaagaatatttgattgttttttctcaggagggaggtgcggggccgataggcgccgccgactaaaagccgggaaaaattggaatatttgatgaatttttattagaaatttgttcaaaattttaataattttcctctcccctttatccgtgacccccctcccccatcaccccttcgattcgaaagggttccccatttttggggcctttttcggggaccccctattttttgtatgttccaaaatttttgagacttgacgagttattgaggttccattagttttcttaataatcctttttgagacccctctctatttgaagctttatttacaaaagaataacatgaaatttatcctcacagaattttctcctaaatttatctcaaaaaataaataataaatttccagaataacaattgaccatgatttgcctccatttgtgttaaggttccgcccttgcgcatttcgctgttgaaaacgccaagtgaggagggcaccgaagtctcttccgcccaaatttcgccgccgattcgcaggaacagaggggggagccgagtcggaggacggagacagggccacgggacgaagaaggacgatttacaaagaatcactaggtgatagagtggcccattcttcattttcctacgtcttttaggagtcgcgtccgtcaaattgcgacaaatgcaaattcggaggatggaatttcccttttggggcgtaagcggcgctttcaaccggcgggggcgagcagcggccttttggaggaggaggaggacgcgatcagcggaacggcggagatggccgaaagcggagaggcggaaaacgcggcagaggaagagcagctgaacagcaacaatgaggaccagcgcagcgaggaggactcgaggcacagcgggacgggcaatcggacgaccgaaggcgcaggtggcggaaatccgaagggatttattaccaaaaaccaaatgatttttaggacgaaaatgaacatgtccgttttcctacagcttgacaaaaccattagaattttacttgttataaataaactcaatgaaatgtcatacaggattctgggatacatcctaaaacatcgctggccgaagtttccgggacataacgtcaccgcaaaataataaaaattgtaacaaattttttaaaagcttttttgtaaacctaggtgttactgattttgaatacaaaaaatttgctgcatttccagaaaaaaaaacaaaaaaaaattacaatttttgattccttggactttcttaggtggcgttttgtcctgctcccattatttccgttcgattagtccaaccaaactccaattagatgcacctcaacagcagcgacagtctttggcagcttcggttctctcaaagaacagttttgaacaaagtgcgacctttgaagcgatggtcggccgtttctgtaaggcaaaatttaaatttttgactttttgtcagatccgtgagaggtgggcacttcaatacagggaatatttgagcaaagtcaccgaaaggatggaaaatgcaaatttaaatgcacagcaaacggaccaaagccaagaaggggtggccgaaaacaatctcatcggagtcggttctcctgctcactatcaccaatttgcgtattgcttttccttaagagtgccgtgacaaaagaatggcccgaattgctgcagaaactgtacgccgaacaatcgaatcgaagcaacgaaatggcggaagcgcaccgccaggacagagaacgcattcggacgatgatgcaaagagaagtgacaaaaatggcggaagcgcagggacagacgggcgaaaggcagacacttttcataacggcaggtgggaaaaggcgaattttgggtgggccatggttaaccattgggttaattgtaagtgtccatgctgcgtgactcggaatgttatgacccaacggtttttgctgcggggacttcgcctgccaaaaagcaccaaacgccctcactcgcccaaattcagcagaaattcagttatttggtgaacaccaccaaaaatagacatgcaatggaggcacacactcttggcgaaagccatgcaagttcatcgtaaaatgccaaaatttgcaaaaaaagacccattttattcagaagtccgaatgaacagagca

SEQ ID NO: 7009 - DNA, 2378 bp, Heterodera glycines
cctaatttttcttacgattactccaagtaaaattaaatcagattttggtagaattttaattttatatttcatatgtttattttttttagatttacctcttaaattttgttgaaattttcgcgattttttgactaaggtattcgtttttttaacgattttttccttttggttttgtttttaattttttttttttgctaaagtctatccaatccctttttttgaaaatttaaaattaaatctctaataaagaaaatgttgttgcttttttaaaactccattttattttaatttatttttccattttttcactgttttcaaaaatcctagtaaaatttttccaattttttcatagcccctaggtattcgggtttaattttttaacaattttttgccccctaccacaatgaatcgtcgcgcggcaatcagtgcgtcgttgtcgcgcccgtcactgctcagcccgtcctgttgcacccacatcggaatgttgtcggctgtctgagtgtctcctactgtggtgcctccaataaattaaaattttaatcccgcattaattagcaagcatactgtagctagcaaagggtttggtggaaactaattagcatactgtagaaaaggaccaccaattcattaatcaggtacggtaggaggaagtgtaatttacaaaatcaaaaaaaaaaaacctttttttgggggttgaattcgtgaaaattacagctagacaggctcttgccactgactaaatgaataagtgagcggaaaatgcgatttcacggtaagggtgacggtaaaaacggtaattaccgttaccggccaattttcaaaggttacggtaaaactggtaattaccgttacaagtcaatttcgaaaattggtcggtaacggtaaacggcaatttactgcggtaaatttattcccgaattaatttttatcatgccctctcgctcaactcattcaattaataattgcctaattaccacaattacccaattaatcactgtcaataatttagtaaactattctatttgctataattattgtttcaagaatctgcttgaaaaattgttcacccggctgtgtcattccgagtcccctcattgaaccgatgataaaagcgaatctaaaaaagaaaataaagttttaaaaataaaattttaaaatggcactctgtgtttttgccaaaaataaatgttttaaaaataaaattttaaaatggcactctgtgtttttgccagccaagccaaggtcagtgacggcaagcaaaaattgtcgtcgatcattgatattatcaaaacaagtgatcacaactttaggaaaatgtttgatttaaattataattttcttaaatctattcaacatttttccaacatgaaatatttttttttttttgtttaattttttatattcaaatattacaagcattttagttttatttaagtttttaattttttcttttgttaatctttttaatttatatttacttacttttgaatattttattattattattatttctacaaaaatcttcgaaaaatttttattagaaaattacaagaaaaaagtattgtgaaatatttttcagcgatttaaaaagtaatttattattaaacttttcaaaaatcgctagaaaaattcttgacaatttttttttcttgaaattttgttaaaaaaaatattttatttttttaaaatttctgagttggaaatttttaaaaaaatttcgggaggacgggtaacgaacgatctgctcctgccaataatatcctcttctattttctgaatattactacttttttaccatttattaaattaattttaaattattattttttttttttgattttgatttgatcaatttccaacttctggatcggtttgacactgcgatcagtgtcgagcgcatgctttccgcgctggagtccattttgcgccggaaaacaatggtcacgtttgggtcgtcgttgaccaacgcgataaaatccgtataaaaatattggcataccctgggaaattaatctttttttattaattaggctctaattaaaattaattaattaaataagtaaatcggttggtggccggctgatcaaattaattaaatccgttggtgtccggctgggcaaattgttaaataatccgttaaaactaattaggggcagcccataattaaaattaaataattaattaattacatccgttggtcgtccggcgtgtatacaaatgacacttcactccaattgtaattgcccaaaattgagcgaacagccattgcgagccttgaaaatagggttaagccccgaccccgagccttccgacccccgacccgacccgagacgttttttggacctattccccgacccccgacatgtcgtcccccgagg

SEQ ID NO: 7010 - DNA, 1928 bp, Heterodera glycines
tttttttgaaaatttgagttcattttgctcacagattttcaccaaaaatgaccaatttttgcgcgattttgagaaaatttttaagaacaattttgcggactggcggtgccgataggtgccgccggaaaaaaaaaaaattgaaaatagcattttttacataaaaaattttaaatctataaatatatttaagaaatctgaacaattttcgtcgctaccccaaaatcagaacattcttataaataacgcactcttgttggcgctaacgaaatcagatgattaaagtgaaaaaaggaagatttacgagcatttaaaaataaaaattgagtttttcgttaaaattttgttgatcactacccgatcggggtccccgacccccgacaattgagctcccccccgacccgacccccgacatgtcgtcccccgaggtccccggcccccgacattttgccccccgagggactcggggcttaaccctacttgaagatttaaaaaaattcaaaatttaagagaagccaactttaaattaaaaaaaaaattattagtctcaaagactatccaaaaacgaccctaaaaaatcattaaaaataaaattaaagaaaagttttgaaatgttttgagatttcactaattgcaaaggctataaaaaattgccttagggaaaaatcattaaaaatgcaaaagacagtgaaattaaaaacttaaaaaaatcattaaaaaacattaaaaattttgaattttttaaaatcccataaaaaattcttgtaagataagaaaaaaaaattacatttttttgaaaatttagagagaaccagctttaaaattaaaaaaaaattattactcacaaaggcaataaaaaaaaaccctagaaaagccccattaaaaatgcaaatgtccgagacacttaaaaattttaaaaatttttcggaaaatttttgagtttttttttaaatgcgtaaaaaaaattcttttaagataacgaagaaaaataatatttacattctcgaattgacattggtgttgaaaacggtggggtacagtgtgtcattgttcaaatctgatgaaacggttgggccccacaagaacaacggaaggttgtagaaggtggcaccgtagccggcgaccaatgcacccacaattttctgcgccaatccaccatcatttaatcactgggactcaacccaccaacattccaatcaacgggactcaatccaccaacatttcaatcactgggactcaatctcatcaatccttcagcaacacaattaccgggactcagttctccgacatttcaatcactgggactcaacctcagcaacggaatacagaactatttaaaaggaatccagaaattgaaatataacccataaatcaaaacactatggtgtacatttatattgctttttctatccatcaaaggatttttctttcattttttattactatcataacatgctttttattcaaaacaaatatcaaaaaccaaatcagattcttttcatattataaacaaggaaaagtacaaaaaacttttttaagtaacaaacctttttcattcaaacgaattctaatgtatttttttaatcaaacaattctccattatcgtttacataagcaaaacaaaaagctttcacatcaaaatggaaatcaattaacaaaaacgaaaatttagacaaaaaataataataacagcaaaaccacaaattttttcttacacacaaaaacagaaacttcatataccggattttccactcaaacaaacacaaaaatgtgctcattattttattaattattttatataataaaagatgggttataaataaggaagggatgcgagacgaatttcccgttatctctccctttcctttcttttgctctcttttcttggccgattgcagatttactctactttttttccccactccctccct

SEQ ID NO: 7011 - DNA, 1767 bp, Heterodera glycines
  misc_feature (1755)..(1755): n is a, c, g, or t
ctgactgactttgatttgaatttggccatttgttgcggatattgccgtcccattctgctgaccgtctgattggtgaagcagaaaaataaccaaaaaaatttggagaaaaatttggcaaaatgttttcatttttttaggatttggaaaatttgaaagtatgctttttcaaaatgacggacatcacattttcatcccaggaaaccttatcatggcaaattggatattttgttttcacattttgtacggttttcaaccgtcggatttgacagacggaaaatttaaatccgacaaaattttgattaaaaaaattcatttacgacccacttaaaaaatgattaagacgaagcgaagccccatttattccaagtgagaagaaaagagaaacaaggaactgcgaaagttcaattaaaaaaaatttaattttcaaaaattcatttaaaaatataaaataaaagacataaaaaattaattggtactgaaaatttatttaactaaattaattatttaaatgataatttaaaataaattttaattttaaatggttctcaatttctttttgcaattaaaattatgagtcactaaggcttgggtttatcaattttaatttcattaacaaaaagcccgagatttatctttaatttattaaagaaatattgattcaaatttattttaataattaatttattttaaaaataattaatttttttaaaaatttaatttgtaatgcttcagcttggccccagctcatcggcgtcgggcagtacaagcagcagttcggcggacagtgaagcaatggtggcaccgaaaagcaatgggattgaagcgccgccaaaaatcagtgaaccatttcagttggcacacacggcaaatgggggtaatttattaaaaaaaacaaaataacaaaataattttttaaatttattaccttttgtaatttgataaaacattttttaatattattttttaaaatttctttatttattaaaaagcactttaaataaaaaattttatttttaattataatttgacaaataaaaaaaagttttagaagaaatgaatattttctctaaagatttttaaatttattgattatttaaaaataatttcaattaatcatatatttttttcaaaaaccttttggcaaattaaaaaaaaactttttaaaaaatgcgaaaatttctaacatttaataaatatttcatattttataggatttaaatattttaagccttttaaaatccaacgatttcatttttaaaatattcaaatatcttttctcttttttgaaaattctgtattaaattatgtcatttaattcatttcaattatttatttttaagttcacaatttaaattggcaatttaaattatttattttaaaactcgcttattttattgtaattgttttaaatttctgaattttcccaaattaatattaaaataattaaataaacttttgtccccctctttcagtcaatggtccatttcatccgtgcaaattgctcaacgagccaccaattgtgatgctcggcgatggcatcagttgcagtgccattggcggcggcgctggttgtgttgcgggctctgctcgccgtcgtagccgttcgccgggcgcgcgtcgcaacgcgcattcggtgcaacaaccgcagcccatccgcgcagcgcaacaactccaacaccaacaacagcaacaacaataccacggggcaaacaatgggtaaaagttgtgccgatttatgaattttaattattttanatgaatatttat

SEQ ID NO: 7012 - DNA, 2560 bp, Heterodera glycines
tttttgcaaagtttatatttaaaaaaatttaatctttcctgtgggaggaacggcctgctccatttttcttcttgaaataaaaagaaattatgaagttttttgttgttgaaaatttaattgaaaagggacggcgagtgggaaatgtactgttgccaaaaaataaccttgtaaaaaacgacatttgttcgaattcaggtccgggatttgggtttatgggtcggtccacaatcaccaaatacacatacattgatcaggccgatcgctgagccgatcagtgtgccaaccaacacgtcggaccagtggtgtttgtagttgctgacccgcgtgtacgccacaaacgcggcaccgccgaacagcgcaaattggacagcaggcagcaccaatttgctgaccagtggacgataaatgcgtgcttgcaaatacaactggcacaaaaaaacaacagaaaatcgaataattcttttacaaaaaaaataaaaaatttttaggcaaaatttgcattttttaaaaaatttctaaacagagacttcaaaaattttctttttggcaccgccctcgccgccccctcccgcgttattttcaaaatttttgttcaaaaaggagcgtaaaaacgggtccgtttcatccccgaaaaatttaaaaaaaaaaaaatttgaaacgtacaattagaattcttcgaaataaaatctattgttagaaaaaattttttatacgaaaatctcgtgaaacaatttttgtttcatagcgattttttcattattttatgataaattattaattttttttttaaatttctacaaaattgctgaaactttctcaaaggtttaaattgtattacatgcaattagatggcaaatttaacttttatgtacgacccatttattgcaaaatttttaaatttaaattaaaaaaaaaattttctttccttaccgctgtgtaccaagcggcataaaatgagaaggccgagtgcccggaatagaaggacagcatggactcgtggatcaaatatttgttgtcgcccaaacactcaaaatccgttacataactgaaaaaggtgtattaaatttaaatatatttttttgaaaccaaaaaaatgtcattggtgtaactcgtgtgtccaaaaaattttgaaatgcgccaaaatttcattaaattttaagggaggtgactcacacaaacaaaacattttttaaaaatgattccatagaggtacggacacccttttggattgcaaattttttttagtcgggaaaacgttttttatggggttttcagggtcgcgctatcacgatcctggcaaacattttgaccaatattgaatcatgaacctcagaatcaaaagttttggcttttggttcgaattcgggttcgggacagcgacccggaaaatccactaaaacaaatttttatgacattgaaattattggaattttaaaagcataaaattttcttttaaaaacatttacccaaaatttttgctgacctgtgctcttcagccggacagttgcttctgtactccttcaacaccatttgtgtgctgccgtccggtgaacggattggcatttgtgtggccggcttacacacgtccatgaaatggggacgatgacgtccaatggtgtactgaaatgggagaagttcttagtttttttttaaattttaagtgttgacgcaaggggtgattttggaggcccgatggccccaaaaactcgaaaattacaacaaaaaaacgaacaaaatgaatttcaatggtagttacggaggccaaaaatttttagaagacgtaattacgctcaaaacttaggaatttaatgttacaattaattccattttttatttagtgaattataaattttcagttaaaatctacctttgcaatgtcgaccatcaattggttaaagcaaatgccaaggaaaaaatagcctaaaaattgaaattacaaaaaaaaaaatatatattccaataaaattaataaattttggcatttttttagaacagttagcctccgtaaatcttaatttcaaccaaattattcatgctattaagttaaaagatgccaaaattcatttaaaaaattaattttccgaccaataaacacataaaagcggacaatcagtcgatgaacattgtactttttgtagcggtacatgccaaactcgtcaggacattggcgctcccaaaccaacgaacgcaacagttcggtgcccataatctgaaaaaatatgaaaactaaaaattggattattttcgtccaaaaaagtcgaaagttttggaatgagtcaaaaaaacgaaaaattcaaaaaaaaaaaaaaagtaaaatggctttgtaccagcatggttggcaccataatgccaatcacgatcagcatttgccggctcactgtgcttggccggtacgggtaccgaatggactcgtcgtcgcagtaaaagccccgcttgtacggcttcacccattcatggaaaatcaacaagggcacagctgggggaaaaaatttttttggtgactaatgcctgtccaaatcatccagaggcccatctaatgtacaccccctcccccaaaaat

SEQ ID NO: 7013 - DNA, 1129 bp, Heterodera glycines
ccccccccccccccctctctccccttatgcatgtgaaaacttttaatcgtaatggccaaatttttaagagttattcaaaaatgaatccccacacattaatgctaggaaataaatcgctttttatagttgggttttaaaaatgaaagcgaatagaaaatgcacgcagaaacattgaatcaatcgccaaaaggacggggaaaaaagtgacgggccaattcacacggctgggtgattcatttgattgaacaaacattgacgaaaaattaaaatcgaaaacccgatcaaattaatttaccaaataaaaaagaaaatacccatctaagtttaaaattcggcagaattccgagccaacaatatcgaaagtcggaattccgcgctagaccacagtctgtaccaaaacgaagcaaaaattttttgacattcacctatagctctactgcggcagtttacgcatccaatcaatgaccatcttctgtttcttaggccattacttattttttcttgatcaatagggctgtactgacccgactcgtactacagaaaaaatcatcataacttttgtcaaagtcgaccaaataaaagattttggtctcattcgatctatttccatgcgaatttgaaaaaatttagtcatgtttgaaaaaagttgtagatgaaatcgtggttcgaacagtttttctatttttgatgactttaaattattcttaaattaatcgaagtacctaggctgtgttgatgaaacacaagctaacattagttatactgtcaaattccgacgtcagccgatgattaaacaacaaaatatttttgtttgtttgttacttttctttacttaattaagcgacgaaagcaattaatttcaaattgtttcattgataaaaacaagagaccgccgaaaaagtgttcatttatttaaagcaaggacacctcagattttaaattatctatgtatattaattcaattctaagattttaattgaaaaaaaaatttaagtatgcaattttaaaaaaatgtaaatacatgtaaataaagattttatggtacttttctgtttcagaggcccagatttgaattttaaaaattcatcaaagagcgcatagacatagaattgaaaaactatgcgtaaaa

SEQ ID NO: 7014 - DNA, 1792 bp, Heterodera glycines
ttactttttcttatgacagaaaaagcatcaaattgttaagcaatcgaaattaaaatatgtccacaacattgtcaactccgttcataccatccactgtgcaaacaaaaccttttgctggacaaaaaccgggcaccagcggtcttcgaaaacgagttagtgtgccatcttttcaaaaaagcctcgtaattcggtggcttttcgcttacaaaaggacacataaacttcaaattttcgaatttcgcactttaaaatggttggatcttttattgcatgagtgctagctttcagtttgttccgtatatttaaacagtttttagacgaaaaaatacgaaattccaaaattaaactttcgaccttttattcgaattcgggtccgggtttcggtattgatcggaatgggtgacatattcgtgatcagtgacccagaaaaccctctattcacactcgactttttcaggtgccggagttccagcagccgaattacacagaaaatttcgttcaatgtgtgctcgacggtgggcttggcgaagcaaaacgtggcgccgttttggtggttggcggtgatggacgctttttgtgtccacaagcggtcaatgtgatcatcaaaatcgcggctgctaatggggtcagattaaaaaaaacacatctgggggctttagggtttagtgacggtaagggcttaggacgattattcagtaaaaattttttagccgtggcattacaaaaaggggcgttttcagactctcagtttacgactaaaaaaccatgaatttttcaatgggtcataactttttcaagaagtctccgaattaaacattcttggtatcattctagagctgaaagatttctctattggcctacgaaaaatgaaaaaaaaattgtggccaaaaaatctcgtaaaagcgaatttttaaatttattttagtcataattttttttcgaaaacaaaaaaggctaatttcaaaggccttttattacaatacctgaaaaaatgaggaggatttgtctattcggcgtgccaacaaaatttggtcaattcgaaaaaaataataattccgtcttattgttaggtgtccaagctgatcattggccgtgacggaattttgagcacaccggcggtgtcccatttgatccgcaaaggggacaatggacgacaaatcaacggttggccattttttatgattttttaaatctaaaaattttttaggtggcataattctaacagccagccataacccgggcggcccaaaaaatgacttcggaatcaaatttaattgcgaaaatgggggaccagcgccggacaatgtgcgtgaaaataaaaaaaaacattataaacaggccccagaaaaggtccctcacatttttgaaggattttcaaaaaaaattttaaagtgcgccatattttgtcttatttaatttttttaggtcaccgaacgcatttatcagctgagtacaaacattgccgagtttcgcatttgccccaatttggacattgactttggccaaattggcacaacaattgccaccattgagggcattggacaatttgttgtccaggtttttttcctttttttttttgtaaaaaaaaataagtaatggttcaaatttgcaggtgattgacagtgtccaggactatgccgattatatggagaaaatttttgactttcctaaggtattggattcaaaatgggctatttaaaaagattttaactaaaaaaatttttttttttaaagaaatttctcaattgagacatgttttcgacagtctgtaaaaagaaaaggttggggggtt

SEQ ID NO: 7015 - DNA, 1523 bp, Heterodera glycines
  misc_feature (62)..(62): n is a, c, g, or t
aaaaatataatcatatgcatatatcaaagtccactgaaaaatgtaaaactccacatgaaaanataaataaataattatcatttcgagactaccattgtcatcgcatatgtcaaattagccgactggcattaatccctactttgacttaattgaaaaatttaggattggaattttccaaaattaagtgacaaaaaattaaagacgcatcttcaaatattaaaatattatttgttagttctttcggtgctgtaagttttctacagtaaaattttgttttcaaaacttgttctaaatgataagtgttgttgacttttttcaaaattaaaataatatgatttttgaattctgccacaaatcctgcaggtttgcatcttggcattaaaacccccgcattttcctaaagcgattcgggaattgtatcttttttttttgcaaaaaacctaggattaatttttccaaaattaagttacatttcaaggcaggctcgaaagtcagctggtatacacttgtcatagatgtcggttcaaaatcggcctgccaaattgttttttccttaaagtcaaaagcttccccaactccttcatatactcaatggtactcaaatggctgccctccttattttgtctgcccaattgtctatcttcaatcgcccacccataaacactctcgcatttgccctcttccattctatttattgactgaaatttgttaaaacttggtcccggcgaagaacatagcgaaaaatggtgagacttaaatcttattaatgaaagacaatgaattctggatcaagggagtttcaattagaggcaagggagctgatgaacccgatgatggtgataaagccgaaatttggcgagacttagtcccgatgaagaaatgcccgaagaatcggtgaatttgaatcccatgtaatagccgcgagaaactgatctccctatccatattaaggcttcttaaaggatgcaagattaattacagaaaatctttatttaaaatgcattatttaaacgttatacaagaaattctgaattttcaatttgcgattgaatcatgtctaaaattcgcacatctgaatatgtctatgggaataatagaaagaaaatcaatttaaattaggacataaggaaataataaaaaaaattatagatatgaaaacaatgacaaaaatgtaataaaatgcgtagacaaagcaatgaaagtataaaaagggctgacagatattaaaatgaaaatgtgaaaaatggttgttttttgttttttatgttatgatatataatgaataaatgataacacaggtattttacaaaaaatggaaacaatcaaaagtcaagttttttttattatgattatgatttatttattttatttttttgtaaaataatatgaataatgtaatttttcgggatcaattttcatgtcacataaaatataaataattttttttttgttttttaacataatttttgtgttaatgtgtatacaaaggaggggtactcagtttttcggcatttttgaatctg

SEQ ID NO: 7016 - DNA, 1593 bp, Heterodera glycines
gcctggtcggggagaacacttggcaccacaaggaccatcctgatccacaatggccgggattctgcgcaatgttttttctccaacaagtcgatcgaccccttgggtaaatttttcggagttttaaaaattaagtgcttttcggttataccaccctttttcgtgcaagttacatttcttaaatcatctaaggatttatgaaaagttaaataataaaattgcttaaagcatttgttttcttggtatggttcagtagcccaaggggtccttaaaaatagctaaaatgttaaaccaaattcttgattttatgaacataacttttttgaaatcaatgtaattatatattatggataatacatattcagaatatttgacttttacttgtgtgctttaaaaattacaccgtcataaaattgcatatctttaaaaaaataaataaattttgctcatattcagacttaatccaattaacaattaatgtcattaacccttagattttctattaactgtaaaattgcaaattaatttaatttacaaaaagttatttcttaaaactccgaaatcgacaatttttaattataatacttttcaatttgctattaattaatgttttggcattctgatgatcaacaatataaaattgattgacttaaacaattttattattttattttctttttattgcctcttgacggacttgtgaaatgcctatggtggaaaaatttatgaaatggtacagtagccattttttgttttttaaccaaaaatttatcatttttttatgcaggcaaaaaaggggaaaaaagccttcatagtcaaaccaaagtctctaaaatgccttgatgaggcaaggggaggggttctaaataagcatacggtgggtggctccttgtgtttgacgtttacctaaaaaaagaaatgaatttttttttgtatatttttaaaatattatttcattaattattatttattctctttttgcgttcaatttttgcttttacatagaataatcaaaaccttacaggattaacattcggctgagtttttgtgtctgttgcaattgtcgttgtcgtcgtggtctgaaccgggagctgctggaacttaaatttgaaattcgttaatataaaattatttgttcacaaattttcatttagaatttcataattcagctttcacacaatttgtccgtggtacatttttatttaaaacttttccaaatttgcttagttgtatataaaaaacaataaaatgaatattttgaacaaaaaatgcccataactttactcaaaaacaactaaatataactttatatcttaatgcatatgtaatgtgtggctaaactttctctgaccttcaattttctctcttgggttcaattccccaaaggaacacttttttataatttctttacattattttaattgaaattaattaataaaaaatatttcaacttaaaattattattttttaattttttgcagtctaaaacccaaaaattaaccaaagattgggtcattttttgacaaattctgttaacaaagctcactcaaaattttaatttttttccggtggcgcctatcggcaccgccgaactcc

SEQ ID NO: 7017 - DNA, 4982 bp, Heterodera glycines
ttaattaataaaaaatatttcaacttaaaattattattctttaattttttgcagtctaaaacccaaaaattaaccaaagattgggtcattttttggcaaattctgttaacaaagctcactcaaaatttcaatttttcctgccgaacgcatatcggcaccgccggaccccaccccccccccccccccgaccattatcacaaagaaaaaaatttaaatcaaaaaaactttttggaaaaaccgccgcagaaaaatttataagcaaaaaatttaagattattaatttattaaaaaaaattcagaattttgtgactcacgagagcacttaaatttttaaattaaaaaaaattttctcttgcgaaaattcccggtaggtttcgagttaatccaaatttaaaaaaaaaaaattttttttggtcctgcaccaaaaatttccagagactcgagggtgtaaacaacgagcgagctcgagattttttcacaattttcttaaatttttaaaacttgaagaaaaaattttaaaaaatttaaataaaattttttgtttctatttagattaattacatattcaaacagacataattttgtcaaaaatcccataattgcccattttgtgcgatttgtttttaagaggcaaaatgccaaaatatctgtttttatgttgcttttaatcaaaaattgttcggagaaaagaagctattttgttctacagaattcttgttattacccatgtacacttatgcacatatgcatagtcgcaacaccgacaagtatatgttgcgccatttatgatgcagacatcccaatcacaattgttgcattccgggtttttggaataaaaacacgctggccttgacggaacttcctttcaaaatgattttttaaatttaatttattttattaagtttttacttttaatcgtttcttagtttaagattatgcaagcataggtctcttccatgaccggaaaatgcgtcagtgaaaattttaatgtcataataacaagtcattgcgttttagaggtaaaactgatcatggattcatttcagccaattccgaaccccggatccgagttcaaacaaaattatttttggttcaaatcggtaggaatcaaactgaaagcgatcatttaaacatgagagcatttacgctgtttttaaaccaacaatgctaaatttcaaaacgggttcggatctgaggttcggaattggttgaaatggataccggattgtttttatgacattaaattttcactgacgcattttccgggagccgtctcttcgcatagaaaaattcgcaaaaattgtataataatttcgtaaatttacttatttgtaacactgaaacaacctaatgaaactataccaaaccttcaaataaccaatcgacgcatttcgaaactgcataaattgagaaaagcaaatttattattttgaaaagagaaggacaccttttcgcatcccgcttccattttttcccggcagcagctatcggcaacccagcttcctcggggatcgtttaaaatgcgccagaaatgtgtcacggagttgcagctctcattaacaaatcgaactgattcacaaaaagcactgtccgcggcagaaaaacacaactaaaaggtacggtaagccatttcaataccgttctctgcccgcttttgtgccggtatcattttggcccaaattatataatgcttttcctataacaatattaggcttggaaatgctaggaaattaattgctcttaaattattttttatttttttgtatttttgcgttttcgaattaaaatattattttttttaaatgttcaaggacacgaattcgcttctcttgatcaaagtttaaaagcccaactatttgtatttgaaaatttgttctcggtagtacatattaaaatccatagttttctcataatattaattaaaaaattataatattttttctgttactgtgcctaaacggaacccacccatttgttaaatatcactattataccagtttgtttactgtatcgatgacttgcgattccttaaatgatttggtttaacaatttacaattcaatttattaaattattttaagtttttgttataaaatatattttatgataaaatacggttgttgtggttggtgatggttgcagttccgtcgccgctgtttgcctaaaagaagattaatttaaaactaattttcttattatgatcaaattactatcatttatataaacatgaatttttatttaattgaatcgaatttaaaaaaagaaattaaaataaatttcatatttcttttattatatttgaatttttgatgctttaaattaagtggactttaagaaattcgaaaacaaaagagaaattaaagtgggtgcccattttgttttttttttaattcttaagataatgaataaaaaggataatggaagaaaaaagacatttgctcaaatcttcatttgttaattttttcctatcaaattttatgtttttattactcttatttatttatccctcccactgtaattgccttaaccttacttgtcccacacaacatttaaagtcgtaattggccgaacagcaatcactggatttggtgcctttgttttccacacagttgccataattgccatctttgcaattgcaatcagaacgtagttcggcacagtctttctttaggaaactatcgatcagtttgggggcaaccgcctttactgtctccaccacaacagctttgccgatgtgttggaaatgatcggatttggtcgaagaattgtggcttttaattgggaccgggacctttagcttttggagcgggaatttggaaaactctttataatatcaattccaaacaaatcaaattacacaattcgaataaaagcgtcggaggagatgaagaacaaaaattttagaatcggagagcagtgagaacagaacatataattaattaagtaatgagaagaaaaataaaaatgcaaaaatgagaacataatgccaacaataatttaaaatcacaaacaaaaggtcaaatattccaacagatgtcccacaataccgcccaaaagcgctttacgcgtctccgcgagactgccgtgccatttttgtcttgttcaacttcaaccttcacgagaaaatgaatgtgattttcttgcgtgcctggacattccgacattgaggacaatccgacagaggtggtgatcggacagtggacaatccgacagtaaaatacacaagaagataaaggaaaatgccatcaccgaagggaaccgattgcaccataattcagaacggcattcttgtgcgagggaatggcaaaaaaagcgcttatgaactcaacaaatgtgcagccatcacttaaaaatgccaaaccaagctaatttgcaacggaatgattttttagaccgcatttgcactttttattttcctttttcttgatttggcacaatcgggcaggtcggctatggcattttcttatcttttttgtgtattttactgtcagactattcactgtccaatagtctaatccacttctgacggattgtccgctgtcgaattgtcaactgtccgattgtctgggagccatttctttcttttacctgaagagttacacccaattaattcagactaatttattattaataaataattaaagcaaatataaatttaataaaatttaattatttgaacattttttggaacaatttccgaaattgtttcccaaaaacaccgtacaaattctttattattgcaaaaagaaaatagaaataaaatcttagacaattatgtaattaacttaccggacacccgcacagaattgaaaatccatcggggcaacatttatcaccggcccaacccgcttttggaacgcaaacggctccacattggcaaaacatttccacggtctctcggcatgcggggacaatgccggaaggtaactgaaaccaataattatgaataattaaaaataataattatatttcacactaaacatatactgctccaaaaacgcaaaactagagaccgatgccaaagcttaaatgccgaggcagttcaagccaaagaaccacacaatccctaaccaatcaaaaccaagagaaaattataaattaccggaggcggttgatcagctgtctaaaatgcgagaaatagtatatttaattgattgtaaaacatcacatatacctgagcaaggccaacggcaaacaacaaaaaaacgacgaaagaaagcataaccaaaattgggaatttattggttatcctaaaataaaaattaaaagccaaacaaaatcgctgtatttccaaaagtgatttgaaggatggcctcctgatttgctgctagtcgtacaaatgatttaacaaaatggagggatttgctgaacagaataaaagcaccgacaaatcatcagccacacataacagcccattaaaaaaagaattatggaatttctcactaaacgatggttaaacgatgaatcacacgcaaccattaaccaaattaaaaataataatattcaattgaaaccaattcgatgatcaaaatgaagggcagcttcatttgctgctcgactataaatgatttgtgataattggtaaagaaaaatgaaattaatgttaattaataatattgtaataaatgtaaaaacgattagaaaattatggagtgccttaaaaaagttaatcacttaattattacgatcagtgccagaaaatcgcgatgagaatgagttttgatttgtcactgcttaagccactcgttgcttggcacttatcttttgatttaaactttgctcaacatcaactaaactattggttttaatttataatttctttgttaatattttgataaattgacattatattttttgattaagcaaatttattagtcaaaataaggaaaaacaaacagtaaattaaattatttcggaataacgcaaagaatcgtttgaaaagattatcatttctcaacaattaatgatttatcacaactattt

SEQ ID NO: 7018 - DNA, 910 bp, Heterodera glycines
  misc_feature (19)..(20): n is a, c, g, or t
tgcaggtctgctcaccaannttttttttcaatggggaagaagcatcgacgtttaatgggtgaatcagttttacaaattatgttcaaaggtaataagttgaatcttttgaataaaatattaaagatcagaaatcattttcggggtcagggtcagaaacaaaagtttcagaattaagaaacttgcaaaagcgcagacggaggagggaaaatagggggaaagagtatatagaaggaagagctacgatagacactcggaggtagaggagaggatgtcggggagaaaaggaatagcaaatcgcatcgaaaagagaatggcatttttagggggggggggggggaattgcaaagtgtgcgttcaatgctaacacaggaaatactaaggcaacagttgtctcgttaagaatgaccgagatcggacggagcaagcacctgtggacgagcaagagagtcgatgggttttgaatgggggggagagagggagagtgaggaattcctcgttggtttgggatatgaccatatgatggcttttcagtgtaactgaaggcggcgataggcaataaattggcttccgttatacgaatgaatgaatcaatcaataccaacaaaactgatggaccgacaaacaactgacctttcctccaactcaagctgtgccttcgtcgtgccctctccgctcgcctccgtctcgccgttttccatgttacatttcaaatcctcaagctttttgcgcatttcgtcaagactccttaaggatgaaaaatgtgtgtaattagcgaataaataagaaaataacgcactgaacgcgtttcaccgcctcgtcgtaagcgttgtccattttccccttctccaaactgttcagtttcattcgaatcaaacgcattcgctgcttcctcgcctcgagcgatgcaaag

SEQ ID NO: 7019 - DNA, 5942 bp, Heterodera glycines
cgatgtgaaatgaagtggactaagattctgatgcaatttgctttgattcgcattcatttgttctcaccggctcaaccgaagctgtttccgccgccggggattgcttttgttgcgactgattctttttgccgttttgcgtcgtcccctgcaaagtgtcgccccccgtgcgcagtccgcgccgttccgcttcccttctcagtctttcgagttgtctctgctttctgtccaagctcgaccgttcattaacgactgaaaatgggaaaaaacgaatgagaaaaaatggatacaaaaagtggaacacttaaaaaatttgaatgtttgaggtgaaaaacgggtgaaaagggaggaaaagtgcgagtggacagtcgactcccccacaaagtggcggaattgttggccattcgtcgaccaaaagaatggactgacaatggcggtggcaaaggcctcctcagtcacgccttgtgcattctctgccgaaagggaatttgtgggagcgcgtagcgaagtgacggggaagagacatcggacaagggaaaggctgaaacgccgccacatcgcttctgctggccaaagcatctgtccgatgaacatcccactttctcggcttcgtccaccaaccctttctttcgtcattatccatctcccaaacagaaggctgtctcgactcgatgagaatagttagacccacaaataatgagcgaataatggacgagtgcgtcaggcgctcaatgagaggagagactgactttaattgagcgaaatgggggagggttggagacggagaggaacggaacaaagggagagaaagggcgagaaaagaaaatggaaatacgcacttttatgtgggaattgtagggggtttttatggtttatcgcgcgagttgaaaggtgttaacgctttcttatgtgcaaaatatacaaaaattatgatgccaatgatacaaatgggaccgaggaaaaagtgggactctgagcaacacttttaattaagtgagtgagtgggcagggattagatttatctgaatgaagcgagaaagaggaaaaagaggatgttgtcgtagaaacgggggagagggaggtgcacgactaattgcgggggtatgataaggaatcaagcgaaactgtgagtgttggccattcacaagcatcgaaaagccaattggacaagggaagttaagcgagaggacgcgaacaacccaatccattcgtattgtcaaatgcaaattgaaagtgagaaaagggccaaaggacgggcaaattaattactgagaggactaatggagggatgaaaagaatgaatgaatgatgacagatgccaacggaagaaacgtggaaagaatcgataatgccaagaatggattaattgtaaaagaaaagagggaggggagacgaatcaacacaatgaaagcaaaccatgtgaatacattgagagagaattggttatttttaattcttctttaaacaacaaatggcccacctcgacgctttgtctggtcggtgagatccttggtgctcaactccagcgaagccttctccttcatgtggatttgatgcatcagttccattttctttttctgaacgtgtccctcggtgttttttctgtcaattagacaaaatgcttcttcacctgctcataatgcaattcaatgcaaattttgaactgttcgtccatcagcgaagtcttttccatttcagtgaccatattttccaatgaagtgaatccgttcacaagtccatccaattgcgtactgacattgttctcaagtttttcttaaaaggacttaattcggtggcttttcctccaatgcctactctgttcctcgtcctcctccaccacgctcacttcggcaatttgttgcttttgttgcgattgctgaatggaattgagttcggatgtgacggcgtcgattgcttcgtgatacgatttgatgatgtcgcgcatcaaagcgatgaattctttttcctgggccatcaaaccgtcgtacgactcaatcaatttgctgacaagtgcacgattcgaatactgtttaattgtattttttaagtagagtaatcagagagagtttcagcacctctccgctttcctccttggatttcagaatttgcaaatggttcaaaatctttttcttcccaactctgatcgtacccaaacggtcaatcacaaatcgctgcctcgtcacctcaaatattaatataatcagcaaatgaatgaacgccaaagcctcaccaagtcgcccttgttaatccggtcaatgagttccctcgccatgcccaacttgtcctgagttgtcatgtcacttaaagttgcgtgagcttttgggtccaagtccatcggcctctattggttgtgttttctgttctcgcattaaaaattatggcttttcattgaaaaaataagaaaagtataaaaacagcaaaaccaatagaacacttaattaaattcactttttacaccaacagaattttgaatgagatcgaaagaaacaagaaatcccagtataaaatcatcggatgagaccgttgttgttctgttggtaaattgcgcgcagagactcgcccaatttgtggactttcaattcggtgttccggaacaattccttgtaaatgttgatctgttctctcaacacagtctgtttcgtctttgcccctacaattaaattttttactgattttaatgcaactttttaagaaaatgactaaaatttaaggaacggtgatataccccttcccccaactttgctgttttctttttttttaaaccaataagtctctcccccacccgtcgtcaccttcgcatattttgacaaggtctgcttccaactccgccctcaaattcggcttgctcactttgtgtcggtgttccatccgatcgtacccattgatcagggccaagccgactttcgttggctcaaacctattggcattgttcaatacgacatactttctgaatttgatccgctcaatatgttctgcatgcgtcgcatcagtgccaatgccttttttgtccattagagcgatcaaatcagcttcggtcaaaaggggaggaggctaaaagcaagttgtgttgattcaattatatgttcgtccttaattcggttataaaacctgagtcgataaattagccatcctaatttggaaattcggcaacggttggccatttcgatacatgggaagttctttgtcagcccatttttcgaagggataaactttgagatagccccggtcgtcgattataaggcccgtggcggtgaaaatctcttcgttgacttccgcctaaacaaaaggacttcggtgacaaaatttcttggcacttaaaatgctacaaatggcatcgggaagatgactcaccttcactttcgtttctcttccacttgcatcgcgagaaactgacgccagaaaataccgacagaccaattcgtagactttccattcgtccatactcgcaatttcattccttaaaatgcctagtccgacaaaagcgacgtgtgccctttccccctttttgccacctgttggcatttttgacgggatgtattggcgggtgcgccttgtcgctttttcgtccattcctcggttttgcacctccacacatttgcacatcattcatcgcaaaatccccccattggtcattctctgttagtctgttgactattgaatccaaatcaaaatctgcggaatagcaatttgtttctgtcctacaaatgtcccatattccaaatcaattaattcaaagtaaaattcaccgcggatacgaaataagcccgtgctgataaagcttttctgcagattccatgatgcgttttacgttcattttgaggaacttgctgccgagtttttccagctgaacggtgtccatcggcgggggtctccatttggtcttcggatgggagtccacctctttaacgcgagccgaatggacaacagcagtgcacgcttcgtaaagagcctaagagaaaaaagaatatttggacataaaccatggattgccgaccagaatagcctctcgatcgaacaactgagtggacagcccctcccgctcccatagaaattcaatgtttgtgctcccgtccttgccgctcaatttccaaaattcttggcttacaaattctttgttctccctgtatctctctacaacaaatcccaaagttgggaattggcaacttccgtagctgatcacggacttcgggtcgttgtcccggagaaattggtagaaatttttcttcaagtacaaagtttggagccgagtgaaggcagctcctaaaacggtttcataattctacgggagcagagatcaactgaatggcccacctatccgaaggtccaattccattcggcagtcaaccgcatctacccaattttggtcaattgctgtaaggttctgaatcgcccgactgatcgcctgatcggtaatctccgaaaatctcgctctacggactgtgaggagactgttctcctttctgcacactttgaccacttcgttgccgatgaattcgccttccctgtcacaatccgtccaaatgagcaaagtgtgggcttttcggctctctctccttaaacacattctcattgttagaagtaaaaaggacaaaattaaacttcaaatttgtttcaatgtctcgcattccgctgtcaatgtcgagaacgacttgcccttcgaataagtcataaatgcgactttcgacccattgtttatagctttcatggaaattatagttcataagatgtccagtaacgcttgtgaacacaaaagtttgactgatcccttggaacgttgctaaatttcattaaaatattccaacaaaaagttataaaccttcaaatgtgtagtttttattgtatttggacactccgttttctgtccttgcttgccccttggacaaaatccttgcgatatttttggccacatcgtttttctccgcaacacaaagcaccctccgatttgtggcgttgatcatacccaaaaattgcgtattcgttgtcagtgcccctcgattggcttcaaatttttgagtttcctttcttaaactgcaacttctgaatgagatgaaagtaaagcgaaaattgcagaacaaaaacaatggtgtagaacaacggatgttcattaacaaaaaaaggaagagacaagcaaaacaaagccaaaaattaataaaatccaaactaaaagggattaaggaatgtaaaatgaccaaaaatattcatttaaaactttaagcgattgtaaaaaacaacaaaccaagaaaaaacacaaataaataaataaaaaaacaaacacaaaaaaagatatttaaaacaagagtccgtccaaatgatcagtgtgcccgccaccccccactaaatcgtcctgacttgcgctgtttatgtgctcctcttcctcccgtttaaagcctgggtcgacttcgtttggcttgctaaccacgcttagaattgcgcgcatcacttccattttttcaactcgttcaggtttaagaaggccgcaagctcgagcgaaaatcacagcaatgaaatgttgacactgtcgaatacaaaattaggtagtcattttttgtaaggaaaactcggcaatcctgaagaataggggtatctaatttgacttttttttatttgggttgaaaattggtagatgggtatttttcggggtgaaaaacatcatcaattttgaccaattcctaatccctaacccaaactagaacaaattaaaaatcgaaaatgaattttcaatgggccatctccgtaccaaaaaatttttcgaaaattttcggaaaaatttcaaaaacagaaaggggattttcaacattttgatgtttctcgtgaattataagacaatatattttatgtttaatgttgtagagaagaaaatggaaatacttctaacaaaaaaagaaccgtgcaaagcttcaaaacaatgaccattcatactttttcacaaatcgaagtacaaattt

SEQ ID NO: 7020 - DNA, 1063 bp, Heterodera glycines
  misc_feature (42)..(42): n is a, c, g, or t
atcggaaatttgccatttgaggtgtgtgggggttcccgcccncaatttgcccaccttcgttcatcgttttcagctgcgccttctccgccctttgcctccgtatgcctttctgcccacttttggtcactttttcggcactttgccgatacaattctcgaaaaaggcgaaacaaaatttgcaagtaaagctttttgaatgcgtccaactcgtttttggtcttttgtggacctaaaatgaattaaaaatgattaaaatataaaacgatttcgttcgtactttctttggctttgctggtcgaacttaacaaagtgtttgtcttttttatttcttcctccattctcttctcaaaatgactcaaaatttggtcacattcggcacgggcctcggcactgacaatgaaagggtgccgaaacgaagtgctaaaagagacaaatgaaatgccaacaatcattttgtgcgaatttcgaattgcttaactcaaacctcggctcctttggcccatttaaaagaaagtcgtgcaaatttcggacggccgccaatttggcgttttggcttcgctgcatcatttccatttccatttcgcgtttccattcgacgtgcgctcccatcaaatcatgaagtcctaagcaatgaaatgaaagatatcggcaatggtaaagaattgtggtcctcattttttttattttgtgctcaaaaccaattttaatggttttcgaggtgctgattacgaatcttaactcggatttacccaattccgaaccccggacccgaattcgaacaaaaaggttgaaaaaatttttcaagtgtgaatttttctggagtaaaagcttctaatccgtttaacaacaatcattttgatgtaaaacaatgggtacttatgtggtttacagaccataaaaaaaaattttttttaacacatttctagggggttttcggggtcgctgatcacgaatctgacatccattgcgaccaatttcgaactccggacccgaaatctaacaattagtcgaacataaaaatttaaaaaaaatcattttaaggcgcgaaaaaaacaaaagttcaa

SEQ ID NO: 7021 - DNA, 1496 bp, Heterodera glycines
aataaaaaagtataattagggaccacaattctttaccattgccaagatatcaacttaaaaaaatttactaaccctcccattaaaaatccgaatattttctcaaaattctcaccttcctcgtcaatttttgaccaatttgtcgcctcatcagtgttggacaattgagaggaggaaaaagtgtgatttatgcagagaaaagatattggaaaatagcgaattttatgtgcggtcaaaggaaatgaatggacagagcgaagacaaaagtgcggcacgggggaaaatcgaataaaaaattgccgaagtgcaaaattcaaagccattaatttctaaataaaagaaagcaaagaactaatttgtcaatgtgtagaaagagtaattctctctttgtcagttaaaatttgatttttccgggcctaggtaaattgtaaaggacaatttgatactaacatataacaagtttgtgtgcatatttttggtcaaaaaatcaaaaattttgtcagaaaataaatgaataaattaaagatgaatttttgaaaaatgtttctaatttttcatcttacgggtgcatttttaaaaattttctggtcgattcttaggggtaggggtgtgtttttggtttttattgcatttttgttaacaaattttgggcaaaatgccaaaaagatcttttcatcctggatcagaattcagaatcatgcagaacaaggggggaccggtaaattggacaccggaaaattggacaccagaaaattggacaccaagcggaaaaatggacaccgccggaattttggacactaaaggaaaattggacactaagatttcctttttaaaaaaaatcaagaattaggtgaaaataaattggcaatcatcaagaattggtatcccgacgaaaaaaaatgttaaaattttggcaggtattttttctaggcttaaaaaatgcgctgatcacgaatctgagctcagattttgaaaatcattgatttttatctaagatttttcgtcaactacttgatttttttccaaaattttaagaaatttagtcgggcgtaaaaactcatgcacagatgttatagagactaaaaagagctttcgaatgagctattgaatgtataaagaagtcaagttttaaattttttacgattttttaaaattcaattattaatccctaggggtcagatgagacggagaccttgggttcgagtccgtttggctgcggtttatttttttatgacatttgatgaaaaatcatagataaaatgaaggttcatgcataatcaaagctcagattcgtgatcagaatattttttaacccaaaattcattgctaaaaaatttttaaaaataatttaaaaaattgaaaaaaacaagtagttgacgaaaaatcttagataaaaatcaatgattttcaaaatctgggttcagattcgtgatcagcgcattttttaagcctagaaaaaatacctgccaaaattttaacattttttttcgtcgggacac

SEQ ID NO: 7022 - DNA, 2500 bp, Heterodera glycines
ttcaatcttttatcatgttataacgcaagtcctaggcagctctttctaaccaaaatgctaaatttatttatttttttattgattctaaatgttcaaagtgattttgtacccttataaccaaaattattataattttcgaatttatgttttttcatgtgttagagacatgaaaatagtacgccaaaacgagagaaaaaagaaatacgttattataattatttataacttttgagtttgagcacagacaataataattgagcatagaataatgcagaatttttttctctatcgctatgcaaaatttagcaaagatttaacataacgaaaaaaagctacacatagaaaagtaaaagttgtttttcacatcattaaaccgaggagatagtacgccaaagtgagagaaattacaaagaaaaagagaaacgacgagatagtactaggcttttctctgcacagtggcgcgtacccatagtgtcctcggtaggggtcaactccgtctcagcaatgttcaaaaagctataacttttttctttgttggccaaacttcacaatcataatatcattcgaaagccctagatgtttagaagatatttataagctatttctcagtgattaatcagctctcaaaaaagttgtcagtttaaaaccgcaaaaaaggcagaattttcaaagttttttatttctatctttttttatagttcgaaattttctgtaatttttagtaggctaatagagccgaagagctttcgaatgatatcaagattgtttgattcggtcaaaaacttcaagagttatattgactcaaagttggctcagacggagttggccagacggagttggccagacggagttggcccgttccgtttattaggaagatcattttatcacaaaactttgtttctgatgcaaaatcaaatcaacataagacaacaacggttatttccgaatatgttcacactaatcaacatacataaatacaacacaatgttatgcaatttcaattttgttcgccttttcccccttttctgctgctgcatcatttcgacctttctccgtgcatccattctttggccttctcaatgcatctgatcacttcttcgtcggtggtttggcaaaatttgacgtaaaaggacccgacggcgttgaaagtgggcggcgtcgccacacaaatcacttcgattccttcggcacgaaactgatctggatgtaatgaaaagaatcattcatctttcaattttacttttattcccaccaattgtttcgggcggcccaacaggaacagccaaaataattctgctgacatttttatgacgcaaaacggcgagcgcagcacgagcagttgcacccgtggcaatgccatcgtccacgacaattgcgacgcgtccatccaacggaattggcgttcgatgctcaccaaaataagtctgaaaggcaatcaatcgttgtgccttcgtgctcaattaattctgctcgtcatttcgacctttttctgccgttcgatttctttcatttgtctctccgtctcctgctgtatgtattgttcagctgtcgtcgaagtgggcagaagaaccgcggccaccgtttcgttgtcctttaatttgcattattatcataaggacactttccattaccaaaattggccgtgccaatccctcggctatggcaccaatcgcagagtcatcgttgtccggggcaccaatttttcgaacctaaaattcataagaaaaatctaagattatgtacgctcttctgcagaccaacaacaaatccaacggcactcgcattgctttggcaatttcaaaagcaattggaactccgccacggggaagtgccagaatgacctgaaccgcacgtcatcaaactttacgacagaagcattgttcgtcatacgattttgtctctctgctgctgaaggtcaagttgggccaatgctttgtacaatttttgtccggcgtcctggcgatcaatgaaatgaacagacattggaaaagaaaacgggaaatactgaagaatgggtggggtttcttattccttttttattgtacatcagacggtaaaaggaaaaagcggctctattgcgctttatgagtcctatcgaattttttatgaatccgataaaaatatttgtgagcaaataaatttaaaattttgttaatttgttggctcttcccaaactgatgaattcctcatttttttgttaaaaatccgttcataaggccactctctgttctccatttctccaaaatgtttctgaatgggcccaattaagctctcttctcccagtgaatctcgtccaacccatgcgcttttcgcttaatgtctttcatatgttctgctgctctcgaggtggaagcacaaattaaaattttaattcttcatatttcttccgttcgttgtttctccaaaatgccctttctttttgtcgttttttgctgtttttctctgaatcacgtaatgtcgctacaaatttccgaacagttttaagtgaattccgaggaat

SEQ ID NO: 7023 - DNA, 4545 bp, Heterodera glycines
  misc_feature (4413)..(4413): n is a, c, g, or t
  misc_feature (4424)..(4424): n is a, c, g, or t
ggcatggacacggtcatccaaaacttggacgtcgcgcaaggaacggacgtcacaacattgtcggtttgtttccgctcccattcagctctcgtccgctgtacggaggccgtcttttacaaaccgcacggcgagcagttgacagcaagacgcgacgacgccgagcgggcactgatgaccgaccaaacagcgttcaagttgccgaaaaagggagtccccctaattttagtccatcagaacacgcctgcccagcgcgacgaagtgtccacctcgtcagccaatcctggccagaccgacacagcgatgagagccctctggcgtttggcacagaccttccccggcatactcatccgctgcatttgcttctacgccgcccaagccttggaaatcgaacggttggtggcccagcaagaaattcccgacattttagtgaccatggcggacgcaacacaggggcacgaatcgtcacttgtcgtcgtcgtcacaacatgttccgtcttcgacagtgcagctgactcacagccgttctgggcggatgccgcgcagggtggacgtcgccatctcccgcgccagccatggaatgatcatcattggcgatttgctgctgctcaaccggacggatacgtggcggcgctacctggaccaagcgacaacggagacgacagtggtcggcccggagtacttcgacttcgagcagttcaacaaccccgacaactattacgacaaggacggacagctgatctcagccaacggtggtgcggtacggtcagagcatttctacagcaagtacggtaaaaatgtgtggtacaacaactccggtgagtcaaggggggcggagaacagatatcaaccttaccttcctcaaggtggcactcgggaacgcactcgtggccgggcctctacttctggtgcgcgcagatgaaagaaggccaagctgtacgccttcagccatggacggcagccgcgcatggacctccttctttcttcattccccttcctcacgttttgcaaatttctttttgttttgactctcttctctctcactctctctctctcttgtccatttctatttaaaattatcattcattttccttttattccgaactgttaatggcctttctttccccccaattcaaaattcttaaaatgcgtcggtttcctcacactttttctgacccattctttctcttctctcatcatgcttttacatctcgtccccaaaccggaatgacccctggttgcttttctccgatttcccttgccatccatccgagaggaaggtggaccgctgttcattactgtaatgcgcagcttggccgtggaagttcggattggagagacgaagggcgaagccgagagtttggacccattcattcattcacttcattttttcttttaaggatcggggacgatcctaagggaagggggaagttgtaaggattattcgacgcatttccctcatttaattattccttattggccattatcaattcaatcacatttatccatttttcacacgtttttccttttctcattgtaatgtctctccgcccattctcttcgcatttctacttccccagtgatcagttagtcagttagtgatggaacagacttcaattattattccgatttctcgcttcgtttaaatccaacatcgaatgaataaacacatctttaacagtcaatgagtcgtttgggggttcggggcttggtcaaaggcgccttggcttttccccattccctcccaaattccatccgggataaacggtgcatagttggtctgggggcacagtgcgcatccctcattgaattaacaaatttattggcactgaatcaaaagctttttcaaaatctataaatattatatcaactttttgctggtgacagcattggggaagaagaaaatgagcgcggatttttaccaaaacggcttaggcctccaccacggtttccgagaccacgcccgacgagaccacggccaacacagccaccacgcccagtgcctatgacgaatgcttatacaccggcaccgtcgccagtgccgcacccaactcaggcaaaccatggcgattacccagcgggtccaccatataatccgcattggaaaaatcaatgcaattaactttaattaattaattagtcgattcgataatctcaacaaatgttataagatttgcaataattaaatgtaattgaccagctagtggacaatgtcggattgtttggttcggttgttacaaatatgccgtcgatattatgtgcactgaatccacaaaagtacatgtatcaaccgatgaatccaggaagtcaatgtttattttaacgaatttcaaatttaatttgtaaattacaaacagtgggaggacaagcaccctatagtatgtttacaaatgattttcattaaatttatttaaatttctaaaaacccgtaaatttttttgtcaaaattaagatgacaaccaacaaaatcctgcgcagccaaacacatcccctcccgacagtaaattctttaaaatgtacaattaattattaattgttcggatgagcctatttgaattattatggcaatctgtccattcaaattccccgccatttttgttgttgtcactcgcccataaatagacggtcattccctccctcctggtctttttcccctcattttcattttattttgttattttcctccgaccaaattgtcttcgcttttttttattgttcgtcaataaacatttatttattgatcgtcttccttaaaccctcggaccgaacaattggcgcagtcacaaaaatttggactttgctcacatcttcgggtaagaacaattgagagcattgatctttttaggactaaaagcaaaagccgagacggcacaacaaattcaccgaaaagccgggattggctgtgaattttgattttaaagccgagttggcaaaattcttcaacaaagcagtcaaagaaactgctcagtcgtcaaaagcctggtcggcaaattcttcaatttaagcagtcaaagaaactgctcttcttctaaagccgggacggctcgacatttcttctagccgagtcggctctaaaattcttcgaaagccgagtcggctcgccaaattcgttaaaagccgggttggctaaatattaaattgacacctattggtgcaatacttcaacgtttattggtttcgggtcgaaacaataatcgtcaacaatgacgtaacctgccgcgactcaacaaccaaatttgcaacaattaatcgacgtaattgctcagcaacagacgcaaatcaaccagctgataaatgttcaaagaaacaatcagccaaatccagcaatcatccaaacaattccgtcaatgccggacgtcgcaattttcgaacaatgcgacgaaaagcatcgcatcaccgaatggcttgagcgattcacttttgccattgactcgtgcgcaccgaacgcggccgatgacataaaagtcaaggcactgattaacaaattgtctgaaaccgcgttcagcgagtacagcaaatttgttctcccggccaaggtgacggatttcgactttgatgaaacaatttcgaaattggagaagctgtttgccaaaccacaatcaatatttgtggaccgatttgcatgtctgatcgccaccaaagacgatggcgaagaatttcaccaatttgtcaacaggcacaaacgacttttgaaagattttcagtttgacaaattgaatgaagaacaattcaaagggctcatgctcctaactgcgctgaagtcttcaaaagacgcagttcttcggcaacgcattctcgccaaacttacaaaggatggcgacgccgtcaaatatgatgaactgattgaggagtgcatcaattttttgtctacaatccatgaggcaaaattgatcgaaacaacttcggtgtcatcaaggacagtgaatgcagtgaagccaaaccaaagaagggaaagaccaaagccacaatccaagcaaggccaaccaagcgcaactccaaatcagcttcaatgttggagatgtgggaaaacgaaccacacccacagagaatgctcgcacaaatcggctaagtgtcccaaatgtcgctacaacggccacttggagaatcaatgcgaaaaagtgcaagagtggcgccgcaaaaacttcaaagtgaagaaagttggaactcttagtattggaatagcactgaaatcaatcaacagcgcttctcttataaagataaaagtcatgctgaacggaaggatcgtgaagtccattctcgactccggagcagagattaatgtcatcgatgaggaaacttatcgacagatcggacagccaaaaatttggaaatgtgccgaaagaggcagaatgttcgacgggacagaaaaatcttttatcggaaagggagaaggacacttcgaattccaaggcgtanaagtaaagaanatttttatgtcgccgagaagggatcgatgaaatctgtgagtgtccaacaatggatgcatttggactggtggatggcatttaagcaaaatcaactctcccgataatctttgcagcgcaggga

SEQ ID NO: 7024 - DNA, 1726 bp, Heterodera glycines
taaagccaaaatcacttctccgataaatcttgcagcgcagggaaagaatcgagaggcaaaaatgccccgatcaatccaacaaaagttgacggcacgccaaataaggacgccgaaaaacaaatcagtcagctaaagcaggagtacaccaatgtcttaaaaaatgaattgggactctgcacaaaggtcaaagcgcatttagaattgaaacccgacgcacagccaatatacagaaaggctcgtccggtcccgtacaacgccaaaaatgcagttgacggagaattggatcgttgggagaaaatgggagtcatcggcaaagttgagcacacagaatgggcagcaccgattttggtcgtcaaaaaggtcgatggtagcgctcgattgtgcatcgactattcaaccggactcaacaatgcgctaaaagaccaccagcacccgttaccattaccggaagacatttttgccaccttaaatggaggccagtacttttcacaaattgatctccgggatgcgtatcttcaagtggagctggacgaagcatcgaaaaagctgtgtgccattgccacccatagaggaaattataaagtcaaaagacttccctttggcatcaaaacagctcctggcattttccagtcgataatggaccaaatgttggcagattttgacttcacgacagcctacctagacgacatcatcatcgtcagcaagggccaaaaagaacattctgaacatttgaaaagatgttctcgcgatttcaagaatggggatttcgcgtcaaacgggaaaaatgttcgtttttccaagatgaaattaaatatctcggacaaataatcgacaaaaacggacgcagacctgaccccagcaaaatcaccgccatcagtgagatgccagaaccgacggatgtctcttcacttcggtcatatttgggaatggtaaaccattaccaacaattcatcaaaaacatgcgcttcgtcagaaagcctcttgatgatttgctgaaaaaggacaccgaatggatttggagcgacaaatgcaaaaatgcatttgacaaaatcaaaggaattttgtcatcagaattgttgctcacgcactatgaccctctaaaagagatcatagtagctgcagatgcttctgatcagggaattgggcagtgatttcgcacaaattcccggacggcacgatgaaagccattgcacacgcgtcatccgccttaactcctgccgagaataactattcacaaattgaaaaggaagcactagcattaatttttgcagtgcagaaatttcacaaaatgatctatggacgtaaatttacgctcctaactgatcataagcctcttctcgccatattcggcaacaaaaaaggagtgcggcaatgcagtgccaatcgcctgctccgatggtcactcattctcttggcatacgcctttgccatcgaatatgtcaacaccaacgctttcggccaagctgatgcactttcacggctcattgccaaaggaaaggatgccgaagaccgcgtcattgcaaacacttgcatctattcggaactcgagtcatttcgttggaaccatcgagaagcttccaatcaaatttcaaaacatcgtcgagtcgtccaaaagtgacagaacatcaaaaaggtcatgaaattcatcagaaatggctggcctcaaaatgtgggaaacaaaatgtggaaatcagaattttccaccaaaggaagggaccactcagca

SEQ ID NO: 7025 - DNA, 1037 bp, Heterodera glycines
cccctcctttctcccttttttctccctcttccgtctgtctgtcctttttttttgtcaaagatactgtagtagtgccccaggcgaaagaatcgttttccgaatgctttgcttttttgctgctgttgctgatgaacggcgaaggaattcggcggtggaggaacgcaacgtaaagcattcgaaaaagggaagggatacggtagataattaattaattcattaacaaatggtaaataattaattaatgtgcaaatgacaattagtgcagccaaccacaattattcacaacaaatacactaattcatttctgtgatttggcccccgcccattaaaaacaaaaaatatttttctttttcttttatcgtaataattcgaattttattacttttttaaaatttttttcgattattattatttttcccattgattttattttcatttaatagttaattttgctgtttttcaactctatttcagctaaataattaatcaattgctcttgtggcgttcaatcagttcatcttttcccctttggttcacgccctgtaaaatcaattttgtttttttcgccccctcacacactttttggcatttagcaattgccaatgccaatgccattctctgctgaagcgccgcatttcgattttaatggagggagaagggcctacagctaaaggagggagagtgatcaattgcttaggcttctcctcgcgcgcccttttggcccattgcctcccccccccaaatgatgccaatgaatgcgcatatttgctgtctttatctctataaaacgatccgaccccccgcacatttggcatttcattcccaaattccctccctactttcaattacagcatttttctcttcttttgctttcactatttagaattcatttgtacttttattttaaattgtttcgcttttcactccctttgaactgtttcttcttcctgctgctgctgctgctgctattactgcatcttctaatggatgatgttgatcattgtgtgctttttgccctttcccacaacttttcccca

SEQ ID NO: 7026 - DNA, 6455 bp, Heterodera glycines
  misc_feature (2384)..(2384): n is a, c, g, or t
  misc_feature (3338)..(3338): n is a, c, g, or t
agcttttcatctgtccatcaaaacagttaaaatctccgtttctccccgtttttcgttccgtcgtttcgctctttcgaccgttttgtgttttgttcattaaaaagggtccctccctccccccccttttcccctttcgtctgttaaaaacccaataaatcccaatttccctcaaaaagttttcaatttttttcaatttgtccagcccatccttcgctgtttcacttcagtgtttttgccctttattaagtgggttctgttccgccaacttttcgcgctgtttgcgctgctgcgtcggctggcggaacatttaaatcggatgctttcgccaaagttttcatttcaaatgaaccgaatcacaacgtgccaattcgcttcaccgaataaatttgtctcacttccttaatttcttgtgccttttggcggacattaattaattagccaaatggtctttggtctcttaacgctaaatccgttcgaaatggcgaattatggccagacaaaaacagcgctaaattatttgcaccttaattttactgagaacacttttcattcattttaagagaatttgtgaaaattattttaacaatggtcattatcattactaatgagctttaccatttttctattttccctatttttcccctcttttttccatttttctcattttaattttaattttctcaattaagaaataattattgtgcgtatttctcctgtccaatgtttactttcgaccaaaatgagctttttgcacaaatcggcgcccaacagcagcaattgttgctaaatctgagcaatcagttaattgtcggagggatggaaacgcaaattgaaaagatcggccgaatggggcaaatggacattttggaggaacagctgaaggaaaaggaacggagaaagtgcaacggtaggaacaggaattcaaatttgaaaaataaacaaaatgccaaacaaaaaaacaatcaaccaatttaatttaaatataatgccaaacaaaaataaataaaaacattttgcagaactgtggaccgaattcgtttccaaaatgctattctttcaaaacggtccggtcgagcagtgtccgcaccaacagcagcagaatgccgcgccgctgtcccaccgccccacggcattttccctccccgcaacttcgcctttctcaacaatttcatcggtgggctcactgccgtcggagccaacaacgcccacagaaagaatgagcacaggaaatgtgatgatgatgatgagcccgaaaagaatggacaaaggaaacggaggagagaaaggacaaagacagaaaggtgagaaaagcaaagggacacacaaagacaatcactaattaattagtcaatcttttaattagtcaactccattaattaatgtctttagccccgggcaaagagcggccaaaggacggcaaagagcgcgtgcacaagtgcgaccagtgccaaaaggcgttccgcttcaagtccaacctgttcgagcacaaatcgctgcatttgggcagcagcagtcggaaccctttcgtgtgccctttctgctccaaaacgtgccgtctgaagggcaatctgaagaagcatttgcaagtgcacgtcaccagcgcggaggacttggaatgcttgtggaaacgctctttctcacggtccgtccgtccgtttcgttacgcattatttgtgtctattttctaacgaccaatttgaatttcagcagttccggtcgtccgagtaaaaatgcaccgcccgctccgttgccaaagcccggcgacgacctcggcatggtgccggtgctcgtctctcagcaggcaccgtttttgccattttggctctgttagctttgctaacccttccctccctgttcaggatgcttcttcctcctctccatttggctcctcccccaccatcaaatggactttgccccaaaatcgaagtgccgcttcatcgcctggccaaagcggcgccgcagaaagtgtcccccggcaacagaagagaagctttgagttgtcacggcaaagtgaggcgaacgggcggaaaagcggacgacggacagagcgaaaggcatcggcgaatggccaaagtgtgctgcgatcactgctcggagacgacgacgcgatgggcaccacggcatgagaatattggcaaatccatcaaatccctcccccaatttgtgatacgaatttattccgtccctccgctcaattttctctgtcttcccttttttcatttcattttgcttttctctttttgttggattattctgaggaacaaataaatttaattgctttaaaaactgaatgaaatttggaatttacaataaattcggctcgaaatgttcaaaaggcaaagtaaaagcatcaaataaaagcgcaaaagcatcactgaactttnttcgggtctttttttgtcgcttttctctccaatagtgcccccccccccctttcatttcgttttgtctgtgccattatgtgatgggtttctttggcacggattcccccggggctagccgagaattgccttcttttgtccccttttcctcttcccaaattggctgttcttctcccacttggtttcccctgctccattatcattaattaatattaattaattaattaatggtccgtttaacaccaaatgagtgtcattgttatcgctttaaaacaaagacactaacccaaatgccaaaaggatgttgcgaagaatattttgcggaaaatcaaagaaacattcgcattttgacactttggcgaagcgaaaagagaacaaataaaaaagaataattaatgaagcaataaaaagtaattagtccaattcacaaacatttgtatgttttgttaagcatttgcaataattatgcactgattaatgaaagtaatgctcgagaatggaatgaaaaaggaaattcccgagttgggctcggaatccccgagcattttcaattaatgaacgcttaattgaattgtcggtctctgccgttatcagactgattattctcaacaatttgtcaacttatctttcgcttttctctctctctcttcataactttagctgtctctctcaccgtctctctctcaccgtctctctctctctctctctttcttttgtttgtttgtctgtctgtccattcatttactgtctcataccctctttttttttgtttttaattctgctgattgacctcgctttaattacgtcacttagctgcccaattagtgatgggtctccgccgtcaccgctttgctttgacgtcacttttcgcttgtgtttccccgtgcgccctcaatttctcgtaaaatgttacaaattccaattaggaaaataaaatgcgatggttattttgatttnaaatgtttttttttaattattatatgctaaaaaccaaaaatgaaagaagtgccaaaatgtgtattaaaattgccataaaaattcaattgttttttaatgagttaaccatttgactttaatttcgacagcctaacctctttctttcttatgggctggattttctggattgaatggtgctatgaagttagtcaaaaaaccatcaaatgaaaatattttctgatataactttacacaaaagtaaccaatttttaattttgatataattcgatagccctaagtattttttattatcctgcaaaatttcaaaaagtttcataaataattaaatctcatttctctcctcctgaatttgtcgaaaagttcgatttaatttaattattctttaattattcagtgaatcagtgggttttcagttcccattaacacttagggctatcaaatgataccatggatgcttaatttagatgcttgtaaaaaagttgggttgcattaaattgtcaaattatttgatggtctcgtttttttgaagggtcgtgtatactaaaatagagccaaatatatttattattaaaagattgttattcaattataaatgaattaattaatttaattatttaaattaattttctgtactgaaatgacccgcctctttcgatcacccatcatccatacttttgactcttcgactcaccacgagaaaaactttgtttagaagaaagcggacaatgttatttcataatgtacatttacgtagttaaacttttacgatttttgacaattaccatgattttatttatagtctgttcaaaacctgagaaatatccaattaattatttttaattgaattcatttcgaaattattactaaatttggtcacttaaattatatttcccgatcattcagtaaatttcgtaagtgtttttcccatttctaatttttgtgcctctggcggtgcctaccgatcaaaacccatcactctgtgccctctcatttgctcatctctccctctccccttcccctctctctcgcccccttactattctctctctccatcccctttctctctctctctctctgccgctgattgcccctaattaatctctgatctcgtcccatctttgcaatttcttctctaaactggttgtgctgtgctgttcagcattttaatgcatttgaagaatcgaataactacacaaaaaatgctgaggttgggttgttgttgagtagttgattttcagttacttataaatttgggagaacggacggagggatcgattcgatcattcattggccaagggaaagacaattcgaaagaaaagaccttttcgaaaaaggcagtgccaccaaaacgaaccaaaatcggccacagaatgctaaaaacgtgaacagcagattgaatggattcggcaaaagtttaaatgacccaaaaatggcaataccaaaaaaaaaatgaaaggaagggccacattaaacgagttccctttttctttaccttttcccattctctgctcatccgtcgtccttttccatttcccctcaaaaaatgttcgattctttcgtcctcatttgtcagtccgccggagtttaaaggtgggaaaattacagttaaaatgcgtttgttttcagcagatggccctctttctcttctctctgtcctttctttggttcaattcgtttttctccatttttttttcgtttagtattaattaattaattttcttaataattaattaattttcttaataattaattaattgaactctcatcttggcacttatcatttatcaaattatgatttagacggtaataaatgttccgtatattccaaatttccactcgcatttttctgcgtttttttcgccaatgcccaaaatccgtcgtttgccagcgattttttcccttcttcgccgggtttgctgctgcccccagtgccgggggatgaacagaaagcaaagaatactccgacggaagaagaactgatcggaaaattgctaaagtcgggcgcgggattgcccccggggccaccggcggatttgccgagcgacggggaggaaaaagcagcgaagacgacggacggagcagcggagggacagccccaacaaccgcagcaacaacaacagggccaacagcaacagcagcagacggacacggaacagcccattcagccgatgcctccggtgagtgccatcgccgacgattccttccgccattcatcgcttttactttcccgccccccccccaggcagtcgttgccgaatcgccctcaatgcctcagggcaccgatggcggcgcgcccgcggcaccgccaaattacgtgcaatgtttacttaaaatcgcgccaaaagtgtgcgacccgggaaacattctgaacgcacaacaaaagcaagagattgaccaaacacttgcagaattgaaaatggccacgagaaaggcaaaagggggaaaatgaagcgaaatgagcgaaatgaaacaattagcaattaattaggaggacgcgaaagacgaatgtgccaagagtgggctggaggcgatgttcatcatcatcaaacactcgaaccttctcgacgaacagacgagcgtaagaaaagaaaagcggcgaatttcaaaacaaaatgccaacacttaatgaaggaagtccaaagaacgctgaaccaggcgatggacttttgggttcgggaccatccatgtgaaaagcccgtggtcattatgttgagcacggacccgtcaatttacaaacgaaaggtgtggacgggacggcattgggacgtgccggtcgacccggggcaactcgtcaaacttttcatggatcaggtgatcattgggagagagtcattcagcagaatgtcccggcaaagcaaaataacagttttttgtaatttggttttgataacactaatttgcgttctgctgaattgaattggcaaaacgaatcgaacttttggccttggggacggacgaactgtgcccgtggaaagggctgacccatccttaccatttcacacattatgccaactttatgactttggtgtgaatctgctgatgccattttcgacgcgggaacgacaaaaaaaccagaagagaagccattttcaggttgagtccattcggcaacaaaaa

SEQ ID NO: 7027 - DNA, 5483 bp, Heterodera glycines
tccaccatcagcagacaaacgtcgcagcagcaacagcagtcgacgacgccgacgcagaagacgaacagcaacaacgatgaacaagcggaagaacaacggcacaattctcagccggcaccgatcacagcgatccgaaaaacccttgaagcaaagatggaggagctgagaaagatacgagagcaggtggagcaattagtctaatttaacttcgaaccaattaaaattcttaaggaaatggtggcgcaccaaacggagaaaattgagtggcaaagagagagagaacaaatgggcggaagggcgcataaaatggtcaattaattaagggttgattatggcaaatgacaactgaaaaaaatttgtgcagaatggcgccgcttcgcatggccaaggcgtggattataagcaaatcgcggacaacgctttgcgagcggcggaagagctgcagaaacagtaccgcgagtatcaaaggcattacacggcggaggtgcagcggctgagcggacagctggtcaaattggagcaggaactggcgacacgacagcaaaaaattacggtagtggcaccgacggaaacggtagctgaacataaacaggacggccacaatgacgacaatgacgcggtcaatgtcagtgccgttataaaaatgccgacgcaacaccaggcacagcacgtgacacgaccacagaggggatatgaagtgaaacaatgccgaaagcgaccaatttaagcaattcccccttaagagtccatcaatgagttcactgacggaaaacaatttcactgacaacacaacgtgggacaaccgacttttggactgcggctcgatgatgacgcggtccatttcgcctcttaagggccaatcggcaatgttcaggggcgggtcaactggtgaggaacaatcaaattatgttgcccttgatattcaaattctcaaagtaccaatgcttcaatgccgtgccgtggacattcacacgtcctcaccgctggcggggctgggacagcgcgcaattgccgtaatggacgacggggactttggcagtgtggacgacgtgcagcagaaataccgcaggacgggaagtgccggtaaacagtgagcaggcatttcattggaattacttataactttttccaggcacaaacattctctaccgtatccgtcgagaagagcttgcccaaggcaaacatccgacagttccaaacggagaaaatggaatggcaaagggagagagaacaaatgggcggaaaggcgcacaaaatggtcaataattgagtgaggcatttgcatagtgccaatggttttgtgccttttttgccattaaaaatgatctcattattgctaatcatattttttgttttaaatttaataaattgttcttcatttattcgtcgtatttaataatacattttctgtcttggaagaaccggctgaaaatgttgttatcggttattacttgttccgctctaatctagattaaccaaaaaacaaattttattctttatgccataactgaacgcacaataaaaacaaacattgaaaaagggcaatggtaaagaattgtgtattttgggctcgaaaccaattaccaagtccgagtctagattcgtaatcaacaccctcgaaaacctccggaaacttcttcctagctaaattttacgatatcacaaaaaaaaatcaatacgggtcgacgatttgggggattaacttaaaaatttgcgaggatgattcatcagtttaagccaataaaaggacagcaaagagcaacgcatacaccagcatttccacgggactgttcataatggagggcaaatttaattgataaaacaaaggagaagcacaattggaggcactttgcttcttttttttttgagcgttgaggaacacactcacaaaggaaggtccccgggtgtccgtgggatttccgatgaaatttagtgggtggatagatcacccatggatccttaagaaaagtgtttttattttttgctgaatgaatacgagtgccgagtatgccgtgccaaagttttaactagagtagaacgggaccgggaattttgggcaaacccgggaccgggaccttttcgggttgaaaaaccgggaatttttggctgggaaaaccgggaaaaaacccgggactggtcccggtcccggtcaaaaccgggacctcggtactcagttgtccgtgttttggtcccggtcccgctctactctagttttaacctttttataattaaagaaagtaacaattgtttctgtactttacaagtgtgtaatggtgccacccaccaaaaagggcaatggtaaagaattgtgtattttgggctcgaaaccaattaccaagtccgagtctagattcgtaatcaacaccctcgaaaacctccggaaacttcttagctaaattttacgatatcacaaaaaaaaatcaaatacgggtcgacgatttgggggattaacttaaaaatttgcgaggatgattcatcattttacgcgttgtaattggacgatggaattgcgttttgggtggtgggcggtgcaacagacgcaccaatccgaaggaaatcccaccggactctcacaaattcatacagtccatcaatagttttgttcaattgtccgtccatttgtggaaagactgtcttggatgaatttcactttgacaggcgatggttggaaaacactgcagaaatattaacaacaacaaccaatgctttttatttgtcaatttgatttttaatagttttttgtttttcttacccaatgttcaaaatttataataaaaagaaaacaacattcagattaatagcaaatttctattgtttgtaaagtgcaattcttctcccttccttttcctaatgatgggaccaactcaaaagaaggcgaggctcaacttcaccatcgaccaactcatcgtccgtccgttgcgcgactcgcaacgcgtcaacgtcgttcctccgccgaccgtaacaaacgcagcacagcaaacgcagcagccgccgttggctgcacttcagcagcagacattgcagcaactgacaaatggtacaaattgaggagggaaattggcaaaagatgactcccgcttcaaaaagaaaaaactgtttttattttcaaaatccgaatttgcgtcttcctttttcagtgcgttggccctctcttccgtcgtccgcctttcgacccctttttccccctcctctctccgcgccgttcgctttttctcccttcgctcttccgtctctttttttctcttctccgcccttctctcttccgattccgtcttctttgcccaacaatttgtcttcatcgtttcatccgtcaccttttttgatgctcactccgccaactcgcgccgctttgatggccatcgccctccgaagacaacagcagcagcattttggaagtgcgggcagttcaacagggcctagcagcacatgctcatcctcacagtcagcggacacgacggaggtgggaaacgaaaaacaaacaataaactttatcatgtttgctatttggatttcggattaacaaaacttttttctgtatgtcgcacatttcctcttcagtgtgttgccattcgtaccgaaaatcgcccatgcgttgtttctccggcgttgcgacacaaaaatttgacgcttcatgagacaccgaaacgatcgaacagaaaaagaggactgactaatcgcacgcgatttatcgcagcgggcgacgactcgacgaaagccgaatgcgaaatttgtcacaaaaaatttggacgcccgtggctgctgaacggacatatgcgaacacacagtgatttataataatcattccaagccacaaattaacacttgaaaagtattttaggcggggacaaaccgtacagctgcgaaaaatgtgacaaaacatttgcggaccgcagcaattgtcgtgcccatgaacgaacacacggaggtatttggaatttggggctaccaatttgaaaattatttataaatttcagcggaaaaacccttcgaatgccctcgctgcaagaaagcattcaaagtgaagtcttatctaacgaaacacaagaaatcatgcgggaaaagtgaatcgaaatttgatgattgatgttttggtgtacttcgtctgtttgacctttttacggactttattctcatcttctcacaatttgttctttttttcttcatttgtattatgtgaatctcttttatgcaattacggtttttgttttgtgtttgaatacaattctgacatgggttcgtccatagtcgcccccgcaaatcaccccgattcgtagagacataaaaattcattaagctgaataaacaatcagataatagtatttaatcaattttatacaactaatacacacagaaaatacataagatcactgaaacgccttgtaagaaataagggtgagatccgcgggcggtgaattcgttttcgtcgaccgcttcccttcgctgttaacattataaacaaaagtccgttgtcggcgccgacggtaaatcagaagcacaaccgaattgatcagtagaagaaggagcaagctgaataattaagtgtaatagaggaggcaaagttgtgagaagaaggcacttacaacactccacccgctattagcacaaatcccaaagtgtttcctttggcgttgctattcgcatccaaaacattcgttttattcgacatggacgctggcgggcgttggttatggaacaaataaaattcctaaaatttcctgccgcattaagtgattttgtgttttatttgttttgtccaaaaatgaaaaattacaatttttgaaaattatttttaaaggttttggtttttacctaaaatgccggttccccccacctaaaatttatcgcaatcttaaacatctgatttttgtgctcacattttcataaaatgcttattacataataactttaataatacacaccgtttcaattttggcctcccagttccaaaaaaatttgcatgtgtggctcagtgatttttgtaagatagtaaaggaacaaaggggggaagttcgagtccgttgtgcaacatgaatatttttatttatttttgtgcaaaaaattaaaaaatgacgatttttgggaattatttttggaggtttttaccaaccaaattggtccatcttggtatcattcgaaagctcttgatgaggagaagctttttctaagcaaatgctaagcaatttgacatctcagaaaagagtagtgagagtttcaaatcttcataatggtttcatgcaaaaacgggatgtttaactcaaaaaagtatttgatacgttctatgcagaatttttttctctatcggtatgcaaaatttgatgcggatttaacatcagggaaaaaaattaaacatcacgaagtaaattcggtttttctctattaacagagataaagaaatagtacgccaaaaagagagatgtttttttctctgcactctctatttattggttcatctctcgttttttgaaacggtgtgaataagaatt

SEQ ID NO: 7028 - DNA, 1800 bp, Heterodera glycines
gggaaacgaaaaatcaatcaattatactttatcatgtttggtattttgattttggaattacaaaaacttttttctgtatgtgccacatttcctttttcagggtgttgccattggtaccggaaaatcgcccatgcgttgtttttcgggcgttgcgacacaaaaatttgacgcttcatgagacaccgaaacgatcgaacagaaaaagaggactgactaatggcacgcgatttatcgcagcgggcgacgactcgacgaaagccgaatgcgaaatttgtcacaaaaaatttggacgcccgtggctgctgaatggacatatgcgaacacacagtgatttataataatcattccaagccacaaattaacacttgaaaagtattttaggcggggacaaaccgtacagctgcgaaaaatgtgacaaaacatttgcggaccgcagcaattgtcgtgcccatgaacgaacacatggaggtatttggaattggggttatcaatttgaaaattaaaatttcagcggaaaaacccttcggatgccctcgctgcaagaaagcattcaaagtgaagtcttatctaacgaaacacaagaaatcatgcgggaaaagtgaatcgaaatttgatgattgatgttttggtgtacttcgtctgtttgacctttttacggactttattctcatcttctcacaatttgttctttttttcttcatttgtattatgtgaatctcttttatgcaattacggtttttgttttgtgtttgaatacaattctgacatgggttcgtccatagtcgcccccgcaaatcaccccgattcgtagagacataaaaattcattaagctgaataaacaatcagataatagtatttaatcaattttatacaactaatacacacagaaaatacataagatcactgaaacgccttgtaagaaataagggtgagatccgcgggcggtgaattcgttttcgtcgaccgcttcccttcgctgttaacattataaacaaaagtccgttgtcggcgccgacggtaaatcagaagcacaaccgaatggatcagtagaagaaggagcaagctgaataattaagtgtaatagaggaggcaaagttgtgagaagaaggcacttacaacactccacccgctattagcacaaatcccaaagtgtttcctttggcgttgctattcgcatccaaaacattcgttttattcgacatggacgctggcgggcgttgtttatggaacaaataaaattcctaaaatttcctgccgcattaagtgattttgtgttttatttgttttgtccaaaaatgaaaaatgacaatttttgaaaattatttttaaaggttttggtttttacctaaaaggccggttccccgcacctaaaatttatcgcaatcttacgtaggataaataatgatttatcctttatttatttatttatttattattttcatagcgattgttttcgcgttatatttgcatttaaatattttatttgttgtccttttatctttttcatatttgtcttctcattcgaaaattgtattcgaattatatatcaatgtttttatgttttcattttatattgaaatattgaattcgttatttatgttttatgaaattctcctttaatttcctgataaattccccaactttgattacccttgactttaaagctgccgttacaaaaacgagcagctaatatttgactaaaactaaagtggtgctgaattggaattatcccctcaaatccaatccccaactctgatttccaattccctcaccacaatatattccttctttctccaacg

SEQ ID NO: 7029 - DNA, 5941 bp, Heterodera glycines
cttcagcaaatagaggattaatcgaagcagaacttatgttaaattttatgggtgcaaattaagacgaaattgtaattagtgcaagaaggaaaagaaaaaaagtgcaattaaataggtgagattgttgagacccatctttttgactttttgttagtacgaatccccattagtgatgctcgatagtctcggtccgactctcgggggtcaagtctcggtctcgggaaattttcggtctcgagcataactaatctccatgcgacttcgttttattgagaacaaagcgagaaaagttcttttgtcaaagtcctttgtgatctatataaaggatataaaacccaaaagatttcttccttggttttttctttgcaaaaaagttttactgtacctaacctcaagtctaaccgctgaaaaacctatgggtttttgagtctcagtctcagatttgacaacaaacgtcaaatgttcagtcatgtcgcggggtcgtattttattcttatagtcagtcaaggtctcattgtcagagttataacaagcctgcagggtgtagctagacccttgacttcgggttggagattaaacacctacccctcccgagcgagactttttttggcttctcgacctcactttcttttcgtcgcgcttttttcaaaattttttatatagtaggtccgaaaatcgaatctcagtctcacatcacatagataagttaatatgtacatgacatcggtcacaacaaggtaaaagttcaatttttaaagggattttggtcagtctttggtcctaatctgtcagcccactgttggtaggcttatcggtctcgagcctcgtcaattcctcatcaatacatacgggaaaattgcgtcctgactaacaataaatttaatataatgcgggcgtaatctgttggctttatttaataaggtttcaacaactaacaaattttcatctcaccttactataaacaaagaattgagaatattcacacgactcaaacaaaatgaagaaaataaagcattttcttttaagttgaatgagtcaagagtctcgaacaagttaagttattcagtctttttaatttgcatatattggactaacttggcgagtttacgaccgtccctttcccctccccccccccccccacaccccaccccgatggatacatataactggatttcaattaggaaatgagtaaaggggtaattacggggatctgtagaacataaaaggtaacttgcccggtgggactcgaactcacgcccccagcaatccgtgccgtgctctaaccaactgaactgagctacgggcgatacttttagcggttctcccatgtcctttatcccaccccactttctcccacactccgttctttctggcatcacagatccaaaattccgtaatttccttaacaagtaattaaaattttttatcaatagattttttcccataaaaccttttttccctactttataatacgacatgatgaaggtgaggaaatttgcaggtgttcctaacaataaaaagaacaataaaaatcttttttatcccttctcccaagggactgaatctgccgagcaaattgtgtccttacaaaaggcaccatttttaaattagcgcgaaatttgctctcacattgcaacactctctagtgtatgacgtcatcaccaaaaagtcagtcgcttaagaaaattaatattttttgttggaaaccattaaaaattaattgggtgggtacaaagaaatttctacaaacaaatgcttaccactgaaaatttaacaaacgatttggcacttgggttgattctacccattcattctcttaaccaattactaaaacaaaagtcttaaaaaaatttcccaaggaaattgtgttgaaaaatgtattttattttgtttataattttttttttaatttttaatcagaaattttgttcagccgatgaacacatcattgcaaacaaattctgaatctgttgaatcgactgatggcgatgagtcgagcagtgaattgagagacccggtttgtcgattttttttccaactaattataagaaacaagatttaccagggccaacaatttatatatatgacttttttaaaattaaaaattatacgactaaaagtttttttaaaaattctctgattctcatttttaacattttacttacagtttttgtcgtgcatttttttacattaaaaaaattccatatctgttaaaataggaaacatttcacttttagcattctgcgctcggcgtggaagaaattgtgaatgaggaagaagcgcgcaggcgtcgcgagcagctgaatcgacgcccgtcctacaggtgtggcaccagggaagatccaagccagccttggggaacgaagctggcctgttttccatctgagtcatagttttgggccataattttccaaaataggccaaatttttcaaacgtaatttgcaaatttggtagatttttaaatttgacccgaaaaattgcccattggagataatctaaataaattttaaaaaaagaaattaagagacagaacatggcgctagggtaaaattgaagcgcatctttttaaaagtttgtttgtacctttaggatgattctcaaagatttggagacagtgggagacaaaccgatgaaaaaggaaatgcacgacgatggcaacaacaacacggccaacacattcaaccatgatcggaatgaccgaaacacgggcactacattacatcaattgggtgaggagactgaaaaaaagaaaaaatcgaaatttaaaccagccaaaaatgtcaaagttgacgaattcttcatatttatgttttacaaaaaacgaaattgccactttaaaaaatgaaatcacaaccttcgacgagttaatttttgtttaaaatttattgggtaatttaaatggtaaaattctttttatggttttctgggtcgtatgcaatatttctaatagaaaaaattcttccaaaatttaaaaataagtttcttatatgtttttccattctgccaaggttcgccgggtgaaaatcaagcatttgcaagcagttccaacaacagcagcaacaacaacaatgttggtgttggtgggctaaagccggcaaatttgccctcagggctccgtgttggagttgtaggaacagctgcagcttccaatcagccgcttactcagcacatttcgccgccgacacaacaaaatttggcggcacttggtatcacttactattttcaaaacataaaacatgcatttttttgttattgcctatttagggcccaaaaattaaaatgaacaggttttgacgatgaaccggggcattcctggaccaaaagtcctcgtttggtcgggattcccggtcttgctgttttccctccatatacccgggagttccagaaaagtgccgacggggccctggtcccatccatgcgttatattgccgagtctgggttcaacttgacccggtcatcgggcacttttatagtaggctaaaagttggcagcagttcgggggggggggagtatgtacccccactttttcttccttggataaaaggacctgacgttagttaaatgcaatttaccaatttgggattcgaaaaaattcagaattgaatagagagcaatacttttctctatctctctcttttctaaaaaaatgtacgcttcaggacagttaaatttgattggcaatccggccgcatcgattgcccaccaacagcaacaaaatcgcctgatggcaactgttgctgaaatgccgtcacagccgcaaccccaacaattgtctgccgcaacaaattcggcaccgccgccccaaccgttgctagccgccgtgaacaacctggaaatgttgggactcaaagcgccggatgcacttggcactgccgcatttggacccaatggtaaagctgaccttatcagacaaaaaacatggaaaggaaggcctgatttaaaaaacaaacaaacaaaaatttagaattttcaaacctgccagtgtgtgagggatttaactattcgttgcataaagaatccactttttttagttttagttttttcttctttttattgaaattaaagttttgtgaatgtaatatgacattcagttaaaattgtcgaaccaaatgaaaagtttcctaactcgttgacaaaatatgacttattgttaatccaaaacaaacactaaattagtttttatagcctcagtatgtctctaaaggtataaatattctcagtttagaaaaagcacccaaaactttattatgtgacatggtacggatttttgaaaactgtggcaaaggaagtctttggacaacggggttttcttaaattttttgataactttttccagtgctgtttttaaatttagtttcttaaatttgtacaaaatccaaaaaaaaatcatttttttaatgttttagattggcaaaacaatttgctatcttcgtatggccgaacccagcagcagcaatcgccccaggtatcgctgatgcagcagcagcaacagcagcagaacaatgctgccggcgctgttgttggcacgatggcaaacagtccgctcggcatgaacaacattggcgtcgttgccggacacgcagcagcactacagcagcaccaccagcagcaacatgtaacaccgccaccgcatgggcttggtaaattactagaactatccagaaaacagattcgggaggggcacccgaaaaccttttttgtttattcgacacagtgggaaatataggaaatttttttaccggttttcgcaaatttggccatttgggatcaaatttttcaaaaccatgggatcaggtatgcgatagtgaattcaagactgaacatttcccgatacttgcttactccggcactcgacacgaaatcgagattatcggataatttttttccattaatttttccggagaggggggggggggggaggaggtctggtcccgcgttcaatgacattgtttttgttacttaatgcaattttgaatttatctaaattaattctcattatgcattttgctgtgcctttcttttaaggttcgcgccaagggtccgcatcactcacttcattgtacgttaagtgccgacaaaatcgctgtaattgactgtttcagctccccaaacgttaggtcagagggcggcgatgacaacacccggaaaagacaagtgcgactgctcaaaaacaggtggcataatttaatttgatttaattttctacaattttttgttttttttttcttataattttcttacaaaaaaattattcaataattaaattccagggaagcagcaaaggaatgtcgtcgtaaaaagaaggagtatgtcaaatgcctggaaaatcgcgtaagaaaatgccgttgtgcatcaaatgcctgtttttggatccactatttcaagccgtaatttaaggttgccgtactggaaaatcagaacaaagcgctcattgaagaattaaaaacattaaaaggtagacaaatcctgggacatacattaaaatgaaaaaaaaattgcaattaacaaatttagaattgtattgtcggaaggaaaagggcgatttgcaatgacatctgtgttaatcaattcttattaattgacactgctagataattggcatgaatgaagaattattagtcaaattttgattataaaaaaaacaaacaattttttgcccctcctcaataagaaaaagaaaaaatttacaaaaaattctcaaccctttctttttgtttctctttgatcattttgcacacggttatcattttatcggttttcacattttgtgcatcacacacacacaaaacagatcataatcttttattatccttaattttccaattctaatcattacaattttgtttgtttattttcataaaggtgacagaaataatttaatttttagtagttccatccttaagggcgtggcagtcttagaagagcaatatacacattctg

SEQ ID NO: 7030 - DNA, 1101 bp, Heterodera glycines
atcattgtattgggagcacggcctcgggagtgatcagctttaatgcgaggaccgggccggccgggtgtatggtgccgaggcggacggcggcactttgcacggcaacggcaccaccaacagatgaagaaaagtgccaaaaggaagaaaagtgccaaaaaaaaataaaggaaagaaatccccaattagtggacggttcggattggtgccaatttggaagaaaaatattgagtgagaacaattcaagggagaaaatactgcccatttctaaacaaagaaaaaggaaatgaaaaattaaacaaaaaattgaagaaatgaaaagaaatgtgaggatgggcacccagcatgggtttaaatattagaatgagtgtctgtcattggcttatgtgaaagccgacttcggatgatcacaatgtcatccgccctcccacaccacaaaatttgtgtgggaaattgtttgaagtttaaaaatttaagattcgatcagtttattgtttggaaaagtgattaaccggaaatgttttttttattattgcggaaggggaagaggaggggggcgaacggcccaagcttttcctgggaaaaaggtcgatggaatttttctagggtcaacgttcgctttgacgggaaggggtggttgaagtgcccaattaaaacggggtatacggtaattcaattcctcagccgtttccaaggggtacaattggctaattgaacgaaccgtttgatggcctgagggcaatttaatttcggcagtgtccgcaattccggcctcatttcgattaattttcaaaattagcccggttttccagagggagcggggctcggaagggtggtggattaggacgatttctcccaatttgggccaacaattattagagggggccaattttttgtatcgctctcgcagggagggtaagtagtcgttaatccactggttccaaaacctttctgtgtgaaggctcgctgtttcccacaatgtttgcaatgaaatttgggtactttccggtaattttgattgggtcccatcgatttcggtagtgaggagggaaacaaaattttgaggaggattgaggggacgaataaatcaatcggtcttaaggg

SEQ ID NO: 7031 - DNA, 4790 bp, Heterodera glycines
cagtgtctcggtccgagggcgggtgatgggcttgctcttgagcaataagaaatttaaatgactttttaagttcaataaatgagataggggctgagttaggttttggattttgcttcttttggacaaatctgataaaacggaaaacgagggcggtaattcgaagtgcctttgggaggcgggaaaaatgagataaatcaattaaccgcttatcggaaagttgttccgtcgcaaaagtatacagtggagtggccaaaattgaagacgattcggatttagagttccgaaagtgttttatttggcggttatcaggccaattaattgggagaagggggagccattttggacctgaccaccacactgaggcattggaaagaatttgggcggagttcaggcctcttgtgccgatgtcggcggggttttcagaacctggtaaatggcggattaccaaatttgatgtactttttatcgacttaattcgattttggacaaaaatttccaatgaattttggggagaatttaaccaggaaaggacaattgaagagtccgaccaaatggttaattcggggtccaaatttaaggaggaaaagtgcgattgggtaaattttaaagcccgcgtcccaatttctacggcaatgagttcgagtcgtggaatggtcagtggcgtgcctttatgagtcggttttactttggtttttgaaaaaattaaaaacacttctgcttgagagaaagagggatgggtaattcggagatacactgtggcacacatggcgagagaggaggcatcagtaaaacaatgtaactgataatttcttccctccaatgggagtgtaacgggacaacggggaatggacaccttttctgcatttttccaatttttaattgcgcaatcccagtcgttttgaatttgggttgggagagtttgatcccaatcgctgccattttggaatattgattggagaaaaatttttaatgggagaatgagtggggaaataaggccaagggggtcgtattgagacgcaatgaaggacagaatggagcgtttagaagggataaaatcattattcggaggggataaattaaattccaaggagtcggtttgggtgttccaattaagacccaaaaatttttgttcagaacctgagagttttatgtcgtcggggagtttggatagagcattttcggaattactggcaaattctcggagtgtcattcctgccctttgaaaaagtgaaataatggatttggctttaatttgggcttcattgggactttgtacggaaaggagaatattgtccacataagtatttagggccacttcttgtgataattcggatggaaatttggataagtgatggcgtatcgttgcggcaagtaaaaagggggaagaagtcagaccaaatgatacacgggtgaagcggaaaatttgcatattggacttggaaaatgggcgatggggatctttaagccataaaaaacgtgcgcagtcccggtgttccgggtgaacagcaacttgtaaaaatgctttctcaatgtcacatgtgatggcaaagttgagcggaatttatggaccaattcaacattggaaagcaattcaggggaaaatggcaaatatgaggtgggctgggtaagagagccaattgcatttgtagagacaattagggaccgtccattcattaattgtaggccaaattggttcgaaaaagtctggatgactctggactttgggtcattaaaaacacctaatctcacagaaacgggggccaagttcaaattaagggttttggcttcgtcaaaattaatgtacgagtgggtacttgcgtcttccaaaagaccgatgccttcccgggaaattttgtaattttgagggtgaaaaattctgaccttcacacatttgagcaagggagggtggccaaatgagcagtggtgatggccgtatttgtttggttgatgtgtgctgtaatgccggaggggttatcagggatagaaggcgaatgagacgttctgtgagtaatgatagggggcggagaagaatggtattgaaatggaggaattaacggggcagggggcgaaaactgaggaaaagttggggtcggttgggaataactgaaattggtggagcgatggggattttccgatcgattaaaacagagcactcgatgatgagatcccttacaattagaacattgggctggagcaggacattgacgggaaaaatggccgggttttaagcatttgaaacaccagttgagagccttaagccgctcgaggcgtgttttttgatcagtaaatgtggtacaaaaacttgaaaagtgaccaggattgtcacagaaaaggcatggtaatttgggtttaggattggatttttcatttgtttgtttgtggttagactgttgacttctcttggaatgaaaagtaagagttgggaattcggggggcgaatgagaaggggtgccaaatttggaaaggggggaaggggtcgtttggaatttgtgccttggagaaacaggaactttggggtgaagcgtctgaatttgctcttttcgcttgagaatggcccaaaggcgtgccttcagtttgtccgttgaccaatcgtcgtcgttttcctttgacatgaaaatttcgtcgagaatgaagcggggaagtctctcctcaacttccatttggactgccacagtatcataggaacaattttgttgtgacatttgtacacaaatacattccaattggtcaaggagggaacgaaggtcatcacaaaaaaattcaccggttcggatttgggggagctttctaagagaattatgaagggcacgagcaacttcctctgggttctcgtagtgttttgacaaaagggcgagagctatgtcatatgaatcgtcaaaaactgggagggaattaatcaaagtcaatgggggaccagaaagacattgttttaaatacgtaaatttgagagaattcgggatgttcgtgtcatgaactcccgctttaaatgtgttccaaaaagtcatataagtcgtgcaatccccggaaaaagtcggtagcgtcgttttgggcaaatgaacgagggagggaggggcggcattttgagtattttgaaccttggcagggaggttggcttctaaggcacggccttggtctcgaagggtccgaaggtacttccggaggttggaaacagtcgaagggaagggacattcgatcacaaaattgtcataaatgggattatcttggattctctcggccccagtcatgttagttctaagggccatccatcggtcagaattgtcattaagaacagaaaaaattgattggacatcggaaacatgatcatttaaagattggatacatgaacgaacggttaggagaaaaacagaatcaggctgattattacgcgctgggatgggaaattgtcggtcgtccgagagaagctcttcggcttcagtataagccaatttaagttgcgcacggaaatgggcagacatgaatacgagaataagtgaaaagcggattacaaaagaaattggaaagggcaattagagaacaaagtgaaaaaccaatggggtacaattagacaaaaaaagggggggaatgggaggtttcccggccgttgtgtcggaattggccaatgagtgctgacccaattccgaattaaaaccaaattaagacaaaatcagaaagacaaacgaattccaaacaaaagatcgctttcaaaaactctttatctccaccaattaagtccaaggaaaaaaagcgatgaatcaaaggcgaaggctatgcgaaagcaaaggcgagcgaacggcgaagaaaagggggataagtccacaaaaggatccaagggaaagaatgaaaaggcaagaagaagcaaccgcagggaaatcaaagtcttttatggccagtcggccgtcgggaacggaagtggtgtaatgaagcgaaaaaaggaggggggataattgtaaaataaaggatttattttgtcaagggggcggagggaggaaatacaaattatttcgcaaatcgcgacaaagacgaagagcagcaacagaatgtaataaatggcgaggcgaatgatggcaaatcggacggtacggcaaaattttatttgataaatgggagtgagaggggggcaggggacagtttcaacaatttctaacagtacccaggacaaaaccaatgttgaaggacgtcgtagagggcttaaaggaaatctgaaaatgcgacataaataaacgttttttagtggcaaaagagttgctgatttgccattcttcctctcccactgcatcgcctcaaccgagcggatgtttcttaacgtccgccaatgtcgtagcggaatcggacggaatccttcgggaacagaacagaagcggagaagcggacggacaaagcaccgccgcaacgacaccgaacgcatcgcgaaggccgagcaattcatccgctgccgcggtgattagctaataaatcattattagtgaatgactcatttaaatttcaattttgtaggtcagtggaagcgttgaagacgaattggccaaaatcaaagtggtcttacgacagcacgagaggaggatccgattgcttgaggtgaatggcatttatacggaaaaactaaaaaaacaattcaggaccaattggcggatgccaacatggccaatgcttatggaatatgaaaaattaatacggacagaaatattgtgattgaagaaatgacgaaaggaaaatatttgaaaatttatagcaaacaaatgcaattttgttcattcacaaaaaatggaatatccgccagctttttgaaatga

SEQ ID NO: 7032 - DNA, 5465 bp, Heterodera glycines
atatgtagggacgcgacttttagtgactaaaaacttgcacaaatcgccaagcggaattttctaacacagctaattgttttcagaatagtttgaaattttgcatgaaaatactttgtataaggcctagcatcttactaaattttagaattttttatgcactgagagatttttaagaaaatccgatttttccagcctgaacgccaactttgtggtcaagttttgcaaacaggcggttttttgtaaaaaagttttaccaatattaaaaactctgaaatttggcagtttgctaggtctcatgccaaagtattttcatgcaaaatttcaagctattctgataactctgaaccgaattacaaaaatcaacttgagcaaaattcaaacttttattcactaaaaatcgcctcctaattatatgaaattccaaccattttttaattgggtctgaaataactttttcattctgaatttagattttaaattattttcaagtttgccattgtataaggatcttttaaacaaaaaattagtgtgaacactgatttcataactcattcaaacagcttaacaaagggaaaaatgaaaatcccaaaaatgtaaaataaaattttcatttgtttttcataattccgagaataaatgaagagtaacaattattacatactgaaaaactaaatcaccaaaaaaaaaagataaagataaatcctaataaatttaaaaaagcaaaaaaaaaaagtgtttctgtctttcttttcatctctcatctgtccattctttcaacaatttttatccatcactttttctcgttttctttttctcatcaaaatttacttctttcaaaacctcccattatttttccaattttttcgtttcttcttcaaaattttcattgtcatctttacctgactgattttcaaatttttttgtaaatgactcattaaatttttccccccatttctcgtaaatttgccaattttttccatttttgtttttctccaattttcaaaagtgccattttcagcattttccattcaacaatttttacatgacttaattggtgcaattatcattcttaaattccacaatcaaagaaggcaaaatggatttttgcatatctgaaaaatattatttttggttatttaattttttaatatttttaagtaaaataaaaaattaattaaattaataaccttcttgatggttgaaataccagtgcttgtttttcccggtttccctatcgggaccgggacttgagatttttaaaatccgggaccgggaacctggaccgtgacctcggaggacggggaattcccgtcccggtccaggtcccgtggcaatctaatttaaatatctgtttattaaaattagaattaaacatacataattcattcaacatatgtatacatcatattttctcatcagcagttagttttattaaaaaccaatatttgtttacatttgaattgatttggaaaaaaatctttccctgtggcaaaggggggggggggggggcacaataaaacattacactcttctgacacaatttcctttacatatttgcatttttttccagttttattcctccaaataatcaatgtgagccttcgccatttagttcattgttattgggcttggaatgggattaacccatggctgccaagtgtccttatttataagatttgtccttatttggaggggccggtaagatttgtccttattttcaggcttccccaaactttttaaattttttgtcttaactttcttttcttaaaaaattcgctcaaaatcgtaaaaattggtcatttttttggtgaaaatctgttaacaaaatagtgtaattgcccaaaatgttttaaagaacaatcacaattttacatttttctgaaatttttttgcaaaaaaatcacaaaatttagacaattttttgggcaaaatctgttaacaaattgctttaaatttttaaaaaaattccccctgcggcgcctatcggcaccgccggaccaccccccccccccccactttaagtttgttgggataagcgctccaaaaaagtgcatatgcggtcaaatgagaaaaatggtcaccggaaacaaattaaattgtttttatgttaataaaatgttgttttaagtcgtttcatgtattttattgcgtttttttttcgcgcaatattagttttcgaaaaaatcctatttttggggtcaaaatcttagcacttagcttcgtttgtccttattttgaaaaaaaaaacttggcagctctggattaacctgctgaattagtccagcagtacataaagattttgccgattttgttttgtgatttttatttattttttaattttaatttattgccaatgattttccacatttaaatagaaaattacgaatttttacattgcttatcatgtccaaacctttggctaaacgaatgaagcttttattgagcgcgggtgaggatgcggatgtttattttttggtggggaacggagacgcaaaagaagcgagtttttaaattcaaaatatattaattatttaattgaaaattggggaaattttatgaatttaatagtttttttgattgttttttacttatattttaatcctctttagcttttgcaagcccataaattgattttgaagcacgcttccgatgtgtttgaggcaatgttccgttttgatgccaataaggaaaaagcagaattcggtaaaaatattacggaatggcacttataatattaaagcattaattatcgattattctctgctaattaacctcattaattttgaattagcctctactaattgccctgttgtggaagtccccgatgttgaagcatcagcgttcaaagtgatgttgagcttcatttacacagaagatttaagtgaattggacggagataatgcaatggcagtgctttatgccggtgaaatttatttaattttacaaaaaacaattaaattatttaattagccaagaaatacgacatccccgccctggttgaccaatctttgcaaattcccatttcaaaactgcgcaatgtgttcatggcttatgtcctagccggactttttggattggaggtgggtacgaacaatcattagaatcagattcggtctcgaatttcactggtaaacaaaatttccctaaacttcgatttttagcaaaattttttttaaattaatttagagcgtatagtaaattaagtattttagaactcatttattagtgctatccaaggccaaaaaatccatgaattttagaatttcgcaaatgattgtttgttttacattgacaaaaatgcagacactttgttcgaatcggaggaatttttgaaaattgaccaaaaaatcttatgtgaaattttggaacgtgacgaattgcaaatcagtggagaaatttcaatttggaattcggtaatttacctacttataaaattaaattaattctaattaatacatttaattattctctattaaatattaatttaaaatttaaagtcgctccgttgggccgatgcgaagtgccgtcaaaatggcatcgaatgctcagcagagaatcgtcgtgccatgctcggtccggcactgctcaaaattcgctttccgcttttgtcaaacgaggaattttcgaagaaaattggtaaaagaaatcaaatttagtaaatctttttttttgagctatcctaaaaaataataattatttttaagaggatttaacttttttttatattttttaataatttaaaataatattttattttattcctttcattttcctttgttttacagttccatctggtgtgttatcaaaagatgaagtgattggcgtttatcaattcaattcccttctaaattgtcgtgagatttccgatgtcttacagttcccaatgcaatttccgactaatggacggatttctgatcggaaaaagggcacacttttgatggacattgaaaaagtgtccgaatttgcacgagaggagcttgagagcagtcggcacagcgaaaaagtgttcataaatggacttccattgaaactattggcacaaataaaaacgaaaacggaaagcactgacaatgagaaatgtttgtgctttttccttttgtgtgattctccagaaaaaggtgctaattatctgttcattaatgctaattaacagcaaaattaattgccattaagattcgccttggcacttctgcgttcattccgcaacttttcgaattatctcgcaaaagaatgggacagagaattccattgggacacttagtgattttgtgtttaacaataactcgaccacgaagggattcaattatttcatttctttttcggtcagtgccaattcaaaaaaaaatgtttttaatccaacgtttgtgggctaataatattcaaaaattaatttaaattctttaacttaagaaattgatggatccgagcaatgggttttatgacaaaagcaaagacaaagtgacattggccattgatgtcacaacagctgatgaaccaaaaatggacaaattcattttggatcaaagcaaatcgaaagggacactttttatggacattgaaaaagtgtcggaatttgcgcgagaagtctttggaagtgaacgtaaaagcgaatctgtcacttctgtaaagggattttcatggaaaataatggcagaaattggaaggaaaacccaaagcactgacaatgatgagaaatggttgggcattttccttttgtgcgatggtccaaaagaaggtgcaaattaagtgcttaaatgttgttaattatataattaattgcctttaaaaagaaaagtggagttgcaaatgttcggcaattcttcgaattgtctctcaaaaaagcggcgtggcagatatccgaagagaattcgaccacatttttgacaataaagaaaacagctggggatattccaatttcatttcatttgcagtgagttacaattaaactttgccctaattggtctaataatggattattaggaactgattgaccctgacaaaggattttacgagaaaagcgaggacaaagtgtcattggccatcaatttcaatatgaaagaagcaaaagcggatgacaaatcataaataccaaatgttctggtcactaaattattatcatttggcctttttttctttttttttctttttgataaactggcactgacaatgatgagaaatggttgggcattttccttttgtgcgatggtccaaaagaaggtgcaaatgaagtgcttaaatgttcattaattataatttataattaattttgcctttaaaaagaaaattggagttgcaaatgttctgcaacttttcgaattgtctctcaaaaaagctgcgtggcagatatccgaagagaattcgaccacatttttgacaataaagaaaacagctggggatattccaatttcatttcatttcctgtgagagacaacattaaattctaaattacccgaattatatacaat

SEQ ID NO: 7033 - DNA, 1346 bp, Heterodera glycines
  misc_feature (68)..(68): n is a, c, g, or t
acattggctatcgatttcactgtaaatgaagtaaaaacggagggcaaatcataaagacccaatatttntgggaaaaatccgttattgaattaccatactatgtacctttttttaataaaattatccacattttgttgtttgccatttggatttttacaaaactgatttatggatttaatatttagtggagctgtttttttgttgagcctcgttcttgagtaccgagtttcaaaagtttcatagtccgggaactacataaatcaaatgttactgttactgaataggtcaaaaaggcatatgccttaaaagtcggtctctagtgataagttaacaaatttggccaaaaactttggcacattctttaagacaatgatacaaatctttaaaatataaatattaataattgatcgacgccgaaaggtcacattgtaataagacgctgatgaatgcattgaaattttttgaagttttaaatgttttatatgattattttaaccgctagataatatacatttatttaataagagttcgtaaataattttgtgtttattttggcctgttttgtgattttttttttttttggaaaataaggagaagtattagcaagattcgtgatcaacttttaaatcagcttatgtatttggaattttaaatttaataaaatatcaatttggattactactgcctctggctctttttacttttaaaaattaaacaaataatgtggtaattaatttaaaatattgaataaaaaataaacataacgaagtgttgtaactgaatgaaaagaacacgaaaattgagtaacataaaaaagcagtgaaaagtcattacaaccaaaacaacaacaacaatcaaacaaaacaataataattaattaatattaattaagcaatgagtataaaataaaaaagattcaatatgattttaataaaataaaatattatttatttgtatgatgttcattctcattgactttcttgcatggcaaaagggatggcaaattgttttcctgaaaaaacaaattttaaaaattattttcaatttttacaacatttatatacagtcatggtcatatgtttaacaacactcaaaattttctaccaaatttgatttaaattaattataaaatctcaatatgactatattgtgtatatttgttttatatttcttgtagcattttttgtgggctttataatgataccattcactatcccctgtcaaaatgttattattagttacaaaccattttaccaactgcactccctttttggggtggtcatatgtttaggaacactacccatattttttttcatcagcattaaaaaatctaaaaaaattctggt

SEQ ID NO: 7034 - DNA, 4657 bp, Heterodera glycines
  misc_feature (148)..(148): n is a, c, g, or t
ttttcaaataatttttaaatttaatacatattccagaaaaatggctatctctttttttgagaaattttctatgcaacaaacgctctcgaacatgaaacgaagtgcggtgcgccgtggccattttatttttcaaataatttttaaattnaatacatattccagaaaaatggctatctctttttttgagaaattttctatgcaacaaacgctctcgaacatgaaacgaagtgcggtgcgccgtggccattttatttttcaaataatttttaaatttaatagatattccagaaaaatggctatctatttttttgagaaattttctatgcaacaaacgctctcgaacatgaaacgaagtgcggtgcgccgtggccattttatttttcaaataatttttaaatttaatagatattccagaaaaatggctatctatttttttgagaaattttctatgcaacaaacgctctcgaacatgaaacgaagtgcggtgcgccgtggccattttatttttcaaataatttttaaatttaatagatattccagaaaaatggctatctcttttttttgagaaattttctatgcaacaaacgctctcgaacatgaaacgaagtgcggtgcgccgtggccattttatttttcaaataatttttaaatttaatagatattccagaaaaatggctatctatttttttgagaaattttctatgcaacaaacgctctcgaacatgaaacgaagtgcggtacgccataattcccctgatcgaaatcatttcgaggagggctctggaatttattaaattaggatttttgatgcataaattattgttaaataattaaatttctttttttctgtttccatgttctaaagcctaaataattcccctgattgaaatcatttcgaggagggctctggaatttattaaattaagatttttgatgcataaattattgttgaataattaaatttctttttttctgtttccaagttctaaagcctaaataattcccctgatttaaatcatttcgaggagggctctggaatttattaaattaggatttttgatgcataaattattgttaaataattaaatttctttttatctgtttccaagttctaaagcctaaataattcccctgatcgaaatcatttcgaggagggctctggaatttattaaattaggatttttgatgcataaattattgttgaataattaaatttctttttttctgtttccaagttctaaagcctaaataattcccctgatcgaaatcatttcgaggagggctctggaatttattaaattaggatttttgatgcataaattattgttgaataattaaatttctttttttctgtttccaagttctaaagcctaaataattcccctgattgaaattatttcgaggagggctctggaatttattaaattaggatttttgatgtgtgctaatattgtgattttaaaatatatttggcgttttgttatttaatttgtttcatttttgtttgtgatttttgtggagtgttggttgttagtttatgctgtcgcagttttcctattgattgtcctcgccctaattttatttggaattaaacgataatcatcttcggcattgggctgtattgttttgtgtttgctttgggctgttgtcttttgccgtgggcagtgcaacaacattattaaaagccccctgacaacaatcatatctgtttttacgacttggcgctcctggcaccggtgaatcagcagtggacaataagaaatttggacgtggcctcgaattgaaaaaagggaaagtaaatccctcgacaagtgttgaagaaatcggaaaaagggaaaacaaattcccaacaagagaagagcctaatcaaccgactgtggacagctaaaaattgtaaacgggtaaagtaaaacccacgattagacgagccaaagcgacattccggtaaacgggaaacatcccccaactttcaacggactgtcgacaaaaagggtgaacaaaaacccgggaaacgactcgaggagcagacgaacaaggcggaatttttttgtttggaaaacgggaaaagcaaatccctctacttcaaaaggaaattgtgaaagaaatcacgcaattttgtcagtccggtaaagtaaatccgtcgacaaaaactgactcgcaaaaccgggaaaagtaaatcccaattcgacatgcagcaacttcgccaaaacaaaacatcggacaaaggcaattttgtggaacaaccgcagaggcaagaaggtctgcaaattggcgcgttagagttcgtcatagcaatggaacgactccccgaactgaatggaacggaaggaccgaaccaaattcggaaatttttccaaaaatttctgttggcaacagaagaatggccggaaagtcgccgcgtttcggcgctggaaagcaaaatcagtggaaaggcagaacgcgcttttgacgccgccatgaaacatcgcccggaaaatttcaacgaaatttgctgcggaatgaaggaaattttgagcgaatgggattggacagaaatgcgggcattcaatgaattgtgggaaggagtgaagcgacgatcggacgaatctttggatgaatttgcggaacggctgtacggcattgtcgagtgcgcttacccaggtttgccctcaaatttcgtcgacgactttgcagtcaagcacctaattcgtgctatggaaaatccggaaatttcggtgggattggaaatagctcgccgtccaggcatgagcttcgacagtttcgtcgctctcgcagtacgcgcagaggcagtgcaaaaagccactaaatcggctggatttggaaaagagcaccggccaaattttcagcaaaaatcgacagttccgccacaaaaaattttcgcgccaaggacaaaccgagtcgtctgctacaactgcaataaaattggtcatacatctcgcaattgtatactttcccctggactgaagcatttcgaccgtccaccaaaatcgccacagcatcaaaaatttgttaagaaaaatgccggttttcggaaattttctccagctgagaataaaccgaatgtttttcggttggacaaccaactagcggcacaacgaacgaacgcggaagctggaaataaattgaaggcacccaatcggcagcgaaattcgtcgtcgttatgcagtgtaaaaagagggaaaatggaggaaaaatcggcggaaattccaaaatggtttttgaatgctattttcgctgcgttggttgtgttcgccggcgtattttcgaaggaaaagtcaaagtgtggacaaatttggaaaagtaaaggctcaatgagtcgcaccgacgaagtgaaaggacggaaagcattcggaaaattggggacaattttttcgccgaaggccggggaggaattggcggatgtcgcagccgccaatcttgaaaatttgttgaaaatcggtaaaagcctgaattttccaaatggccatcgcaggtgtgcgcaagaagctaccgctgatgaatttataaggccagatgaaaagtcggaattccgttttgtccgttgtttttacaggtctgaccctgcaacgcgactttatgccgaaccggtccactgctgacacccttgccgcccctttcaacgccgaatgcactaccgatgagcccaaagcgctgaggacatcgcttcttagagggcgaggatgtgctaatattgtgattttaaaatatatttggcgttttgttatttaatttgtttcatttttgtttgtgatttttgtggagtgttggttgttagtttatgctgtcgcagttttcctattgattgtcctcgccctaattttatttggaattaaacgataatcatcttcggcattgggctgtattgttttgtgtttgctttgggctgttgtcttttgccgtgggcagtgcaacaacattattaaaagccccctgacaacaatcatatctgtttttacgactgatgcataaattattgttaaataattaaatttctttttttctgtttacaagttctaaagcctaaataattcccctgatcgaaatcatttcgaggagggctctgcaatttattaaattaggatttttgatgcataaattattgttaaataattaaatttctttttttctgtttccaagttctaaagcctaaataattcccctgatcgaatcatttcgagtagggctctggaatttattaaattaggatttttgatgcataaattattgttaaataattaaatttctttttttctgtttccatgttctaaagcctaaataattcccctgattgaaatcatttcgaggagggctctggaatttattaaattaggatttttgatgcataaattattgttaaataattaaatttctttttttctgtttccaagttctaaagcctaaataattcccctgattgaaatcatttcgaggagggctctggaatttattaaattaggatttttgatgcataaattattgttaaataattaaatttcttattttctgtttccatgttctaaaacctaaataattcccctgattgaaatcatttcgaggagggctctggaatttattaaattaggatttttgatgcataaattattgttaaataattaaatgtcttattttctgtttccatgttctaaaacctaaataa

SEQ ID NO: 7035 - DNA, 1433 bp, Heterodera glycines
atcaattttatgacaatttgctctaattgattcaatcatttttttgttttgttgctttttcatcattagcaaatgcaattaacttggctaataagtcaccgttttctgataaaaaagcgttaatttgtttcaaatcctcatcagtaatataagaattcgtaaaaacggtcctttcaaaaaaagaatgcaagatgaccaataataagcattttaagccaaaattaatacggaattctaaaaaatatttaaaaagatgttttttagggagaagaaaattcgtaaaatgggatgaattatattttttcaattgaagtgtaagcaaatcttcttcatatttttgaggatcatataaaatgggatcgatttacacattgaaaatataaaaaatatttatagaatgtaggcattcatccattcatgtgattgaatatattttttaataatttttttttgccgcaatatgaaagaaatttacaaaataaaataatgcaaattgaaatctaaaaataatacatcattattaataatcaaagtgaaaattattattatttagctaaaaaagtggcatttttcaacaatgggactttgttgtggccagagcatctctcgcgcccggacgagtgctgtgtcgtaggagttccccgacacgaatgctggccaattcttagaaattcctttttatcgtaaaaattaattaattctaaattgtatggaaatctccattttatgttcagtatctttttatccttctttcttttcttcctctttcttttcctcttcctcccatttttctcagcccctttaattaagattttcctcctccactgctcttcttccgatgcccttaagcaagtttcatggaatttcccggcgtctttttcatatttattttccatataatttgccgcttcttttccctttattttattccctttaccccccccccccctccctctcccccgtttttctccgcaccctttcaaatccctttggctagagcaaattaatttttgcataattaacagaaaggtcgtgtggtaaagtttggcgccgattttcctcccacaattacgctttgctgcgctatgttggcgaaacttctcgtcatttgcgcatacatctgctgaacctgacagaaaactttgtcaaaatggcaaagtgccattctcttaattattttgcccattttttcaggcaataaaaaaataaaagtaaaatttaatcattttttattatcatttttttttgaaaattgagaaaaaatttataatttacctatattaaattaatatttttgttgatttttcttagcacggaaaattgtcgatggaacaacgaacgaagaagcaaacataaataaccattcattctaatttgatcattggcctcgtccctcaagagttctctcacacattccctcacaaaaaactccc

SEQ ID NO: 7036 - DNA, 4387 bp, Heterodera glycines
tcgctcacaggcaatttgttcgcaattctcgtcatttgtgcccaccgttccgtgcgcaccgccaccaatttctttttggctaatctcgccgttgcggaccttttggttgccattttttgcattttccaggcaaactcttctcccgaagcaataggcattctcactttgttgtagaatatgttccatttggttggcaccaacgacggacgttggcttttcggtgagaatggtcaaatggcgtgccattcactcatccttcgctttgaggtgccactttgtgcaaattgtacgcgttcgtgcttcacctcttcccctgcaccagcattggcattctcgtctgcgcctctgtcgagaaatacatcgccggtttgctttccaagtgtgccttccccttttaaagtgaacattcgttttggtgctccacccgcttttggccctcaaagtgttcaccccgcgcttccgcgttttgctaatggcctccatttgggccgtttctctcctgttcagcttgccctattacattttcaccagttacatcttttacaagaatgttgcggtgtgtacccgctttcactggcattctccgatcagtctgatgagcacccgaaacatcgtcacctcctccttcgtcctttggtactgcgttccgttgctgatcatcctctttctttacactcgcaatggtttggtcctgtggcatagtgcgccgctgaagaaactgacccaagtgggcaaattgcgaaccaacagcaacggttggttaagagaagggaaagcaaaggatcagcagaaaaaggcgattgatcattgatcagagacgacgacaattgcctcggggataggcagtgccaaaacaagagccaaacgaagtgcgacgcatccgccgccgccgccacaaccgacggatgacgccgaggagagggccaaacggatgaacaatgccaatgaatgtgcaatggcacatttacgaagggcgacaatgagcagcgacagcgaaacacacggaagcgaagaggaggacgagcggaaaagggatgaagaagcattatttgggaaagaggggacggaggaggaagccgagcgagaggaggcacagcagggagacgcgagaatggtaccatgggatgacggacaaagctcgtgccaaggactggctaaggcgatgaggaacaacgaaatgttggcactgccgacggcaaagaatgacattaccacgaccacgctgggcacacccaacggcacagtgctcatgggcacggtggagtctcgtaaaaaggtgctgggaacgaaacaggatcgcagcaccgtcgctgttcaggtgatccgactttggagcgccattgttttttcattcgccgtgctcaccctcccccaccacgtccgtcttctctatacggtcggtcggctcccttttcgaccaatttcgaactcttttcgtcatgttgaaggtgtggaccgagcagatcatatgctccaacagtttggaggcgttggttcagccactcacttaccttttgctgtttctcttctcctcttgcaaccctttcctttacgcggtattccgccgaattaatccgcagattacatcgttcgttttttttagtttatgagtcagcaatttcggtctgccatccgcgatattttcaagtgcaggtgaatcgaatgggcgcgtgggactgattcggcggcggaaattgaaacattggttaaggagaggacgggcgagacgaaagtcggtgcgaactcagaattcgcatgttgtgacctacacaacgacctttgggggaggcgagacgagaagcgccggagggggtgcaacgacggacgacggattttataatccagatttataaaatacctaattcttttcgttaatgacgaagaattttatggatgtacgagtttttttttaaaaactcaaaccaattttcagaaattttttctccatattttcctattttttgtccatattttgcgactttttcgtccatattataatccatattttggattttttttgtccatataaatccggtcctaactataataagtggaaaaaacatgagaaatattttattatttacaaaaaattaattcgaaaataaaataaaaagtttaattctttaaacttagaaaacaacttggaaatatttaaagcagaatatgggaagcattcacaatcttaaaaatatagtaagtgaaacctaaacgtttttatctctggaaataaattgtgaagaatcacaaaattgcaaaatatcccatcaaattttatgatttagagtggaatttaatcactcattttattaaggacttaagaaaaacaaacaaaaatatcaccagaattgtttgtttaattgaaaatttttattgagtaattttttgctgcgcattaaattaaattattgaaattttcgccggtgaattttagcaaaatgttttagattttctgtaatacctaagtccttgtataattacgaaagaattgcatttaggatacagtgttgaccattatgaagatggccatgctcaaaaagcgagaatcgtcgaatgtttttctcattgatggtaaaaattgaataaatatggcagccaaatgcaaaaataaaggagaattttgactaatgatctataagcaatcaaattttaaaatattaataacatacgattgccctaagtgttttttattagcctagaaaatttcaaaaaaattcgttcagtttcaagaaagttatgaccaaaaaacttgattttttgaccttcgatgtcataactagggcataaaattatatgcacatgcatattttttcctggactgtgggacgtctgaaacgcacgaaaaacatgtttttagcttggtttgaagcttctaggacgtacttacatgtgcatattttgcacatttgtgcatatttcgcgatttatgtgcatatttgcatatttgtgcatattttggcatttcgtgcatattttatgtgcatatttgagcatttttcaacaaaatcctctattaaaacggccattttggcctctaatgaccgaaaatttttcaaaaatatcattttttggtattttctaataaaaaagtaactttttaaaaaattggaaatttatgccaaaatagtcagaaaatagaaaattcattattttttcacaatttcttcaaaataaataaattttacatttattttgtatttttagttttaaattgtttattcatactacatttagatttttcgagatttttatacttaatttaacaaatttgaagagatttggaaaattttgcactcaatttggaaaattttatctgcatatttgtcactttttatgtgcatattttgcaatttttgatgcatattttacgattttatgtgcatataattttatgccctagtcataacttttttggaagttaacgcttaattttatgagtgatgtgttggctccacattcctttagtcgatgtatcgcctcgattcaattccttttggcataaattacacagattttgtctaaagaatgaccaaatttattgatttatgctattttttaagaaaaaataggttttttgggggccggtggtgccgataggcgccgccgggggaaattttttttttatgaattttgttagaaattagccaaatttttcagaaatttcattcttttggatgataatacgccctaaaatcagaacatttcttagaaataagaacataaagaaatcctgcattaatcagataaataaattcaaatgaaaactcaaccggtgtcgaactcctacaagaaggcgaggacgggggtgaggcccaaaaaacctgtcccgcccccggcgggggcgggggtgacgggggcggggttccgaaccctatagaaaacacttgggtgatattaatattttaaaatttggttcatttaatcaatttaacaataattttttttcaaaaattttccatttgatggtttttgactgtgacctcccagcaccgttcacccccccccccccctcccgcatttttcgaattctgcattataatagagaaaattctgggctatcgaatgataccaaaaaattaatttggttgataatcagaaaagttattaccaacggcgcctaactgctttcacagaagaaaattcattcattttttatgcgattttggacctgactccgatcagtttttcctggttcgaaattttttagtcagcaggattttctggatttcccaaatttccattttttccatttcataaaattcggaaaatttcaatttctcgttctttcatttttataatgtatttacaaatcaaacattgattaaaccgagagaatcattaatgagttaaactatttgcccatttattattgatctgttgcagctgctgc

SEQ ID NO: 7037 - DNA, 1096 bp, Heterodera glycines
  misc_feature (9)..(9): n is a, c, g, or t
  misc_feature (33)..(33): n is a, c, g, or t
gtcggcgancaatggataccagtaataaaaatntagtttaaatttaaatttaaattagaaatttcaataattcacttggacgatcaaagtccgcgaaatttgcttgttcaattcaataattttatgattttttgtaccttattttcgtttggtttcaaaaaaatttcaatacgaaatgccaaagcgcatattatcagataaacaaattaagctttttaactgagtaaaaaatgactggaaaaggaattgtctattttaaaaaattacactgtgcaagttttaattttctctcttaatttttttatttacagatttgttcatttacgattacataacaagacttggatttaaatttttttcccaatattctattcaattttctcgccaaaaataatcattaaggcacgaatttttagttacaaaaagtccaaaaatatttgattaatagtgatttaaaaatgggaaaaaatgatgaaaaatagcccaaacaattatttaataagatttaaattaaaaaattttttattcaagaaaattaaacaaaaattcggcattttgcgtttttgtcacccttattgaattggtaataacgcaaaaatgaagcggagggttcagtcggttcaagttttgaaaggttgttttcattttcatcaataaacacttcttcgctttgctcattttcagccggaaaattatcagaaatttccggatccattactctaaaaaagttcaaaattaaggactacaactaaaatatgtgcgtgaaatgaataaaatatttcatctttattttaaattggcataaaaagtctcggtctcgagtctcgaaaatcgagaccgagacttgaaaacccgagacttgaaaactcgagaccgagaccaaaaaaaacccgagacttttctcgagtcgagactcgagaccgagagtctcgaacagcactatttattacatttgtaccgtatgcaacatcaaattgacaccaaaagaaacaggtcaaagctacagcatgatgggcatctctacacattttccaggacaattgccgacgggatgactaattttggcggagtgagttcaaagacagcggtgtggaca

SEQ ID NO: 7038 - DNA, 1292 bp, Heterodera glycines
cctattttttgttgtaacttttttcaaatgcaaccaaaaatgaccaaaacatattcaaaatgtgcaaaaacagatttttcttacatacataaattagcagcactattcataagacggaagaaaaaaaaatgatattatgactttaaaaaaattgaaagcgaaatttgtatttgtaaattttatggatcggcgttcgtacatttttttttctcaatgtgctaaataaagcactatttaaaatttgtagaattaagaaataaatgaaaattcggcctattcttcagcacaaaaccgagccgaaaagttttcatgtgttttcttttaaattgtttgacacaaatattctaagacaattgtttatgcaagtgattttaaaattagtaaaatgatggaattgcaaaaattgccaacacttaaaaacattgataaaaaatgagtaaaatttaaaaagttaaaagtgaccgattggattaaaatgattgatcgttgtgccgttttttcgtatctgtttgttgtttgaatcgaatcatttaatgctcgttggaagatggaacagttcagagattgtaaacaaagtttggaccaaaattggcttggataatgtctccgggagttagcagaccgacgaatggcaccaattcggtttccgatacatcaatttttgtcgtatctgataaaaaatggattttttaaaaatgaaataaatttgcaaaagaataagaaaacataaatattaagatatttaattagtttaatttaactaagctcggtttaagaatttggacccttaagaaaattttatggccaacaacttttaaattttaattccataaaattattttaaaattaataaattcttgactttattggatatatatttcctcactcaattggatgccgttttttgtaaaaaacatctccttcgatgtcatattaacaccgcacccgacagtgtcgccgccgccgaacgcgggaaagcctccaacgatgccaaacgatgtgccaataattataccattattccaatattgataagaagcattttcttttttggcccaaagaccgaagtgaattgtactgaaaaatagaatttatttaaaatttaaaaccaatacaataattatgacagaaaaaaactaatgaaaatttgttgatttgtgttaatttacccaatgccgctgtccccttgctttttgagaattattatttcgaaatacgcattgaaaagcaaatttaacggaaattcagcaaccaagcgacaataagctaaaaagaaatatttattattaaaa

SEQ ID NO: 7039 - DNA, 1059 bp, Heterodera glycines
ttcttttttggcccaaaggccgaagccaattgtactgaaaaatagaattcatttaaaatttaaaaccaatacaataattatgacagaaaagaagtaatgataattagttgatttgagttaatttacctgctgccgttgtacctttgcttttcgttaattgttatttcgaaatacgctttgagaagcaaatttaatggaaattcagcgaccaaacgacgataagttaaaaagaaatatttattattaaaagatttaatttataattgataaaattactgaatatacacgtaatatgctaaaaatataaagtaagaaaccataacaattttataggcaaatgaaaatatataaaaaatttgcaatttttgacaaaaaaaattggattctgccaaatttcaaggacctcgtttttctaacttttttttcgcacgttttttgtacattcacaaaattttttaaaattttgtatgttaaaaaaatttaaaatttcaaattatatttgatctaataaagtcagaacatcagaatgctctctctctctctctactctttacttacaacttttaattccttggtgctgagctgtcaaattgtcgggcttgaaaatggccaactcactgtgtgaattggtggcactccacacattaattggctaaaaagaaaaatatttaaatgatgaaattaacaaatatatatgcaaattgcttaattaagagcaaaagcacaaaaccacctgttcattttgctgctgcacattgacaaatttcaatgaaatttcggtttcgcgaatcaaattaagcgtgggcttgaaatagttggtggcgaattggtccatgccatttgcttgcgcgatataatcttctagttttttgacacgggctgacagattgttaaagcgattttccttaatttgaaaaaatattcatttaaaaaataaattcaaaaataaaatcgaatcatggaatatcaaaaacagaaattgtttttagtttttttttgcttggcaaaaatctaaaatctccataaaaatgataaatctgaatgcaacggataagaaaa

SEQ ID NO: 7040 - DNA, 1200 bp, Heterodera glycines
gggggggggtccgaaatatggatgaaaaaaaatcgataatcaaagtactcgtacattgtagtgataatgaaaaaaaatctcaaggcgctaatttgccttaattcaaacaattataaattttcaattaccatctcagcaaattgatcgcgcagtttttgcatttcctccgccgaaacaggcgccgctgtaaaaataataataattaatttcacataatttcttgaatttagcaaaatctgaccaattccactgccgtttctgctatctttcataatggcattattttccactttttcgtcggtgagactttgggccactttcatttcctttgtcgcaagttgtccaacggcggattgttcattaggagcaaattcttgaaacaaaaaaagcgttaaatttgtagctgcgcgattttaactcaaaaactgcttatttaaaatcataaagatatttattttccgaaaaatttattatctcgaaaatatcgcaaaaccatcccaatgccaatctaatcaaagaatgacattgttcggcatctttcaattatggccaaaactctttagttaaatgggaaattaccctcggcctcggctggtggcaaatgtgatttgattggctgtataaggcagatgatcagaaaggtaagaagaaagtatttttgcattgggtaattgaaatgatcttaagtaattgtgtttcgatattaattatcggaaaaaattgcttatttgaatgtggcaaattaggaaaaataattaactgatgaaatggactaatttatgtttctatattaattatgggaaaaactgcttttttgaatgtggcaaattcgaaaaaataattaactgaatttgcaatacccattgaggattaaaagggataaagaaaatgatgaaaggcaaataattgaagtaaaaaagatgcctaatacacaaaatagtgcaaaaatcaaaactttttaaatttatctatttgcctttgatgaactttttaatatagtagaggtgagggtcagtggcaactcgtagaaagcaggggtggagcgcgcacagaaaaatcccgcggccgcgaccgcgcaaaaaaaaatgccgcgaatcgcgtatcgcgcatcgcggccgcgcatttttttcctattttttaaactattttttacactttttaaattttttcttatataaaaattaattaaaattccgatgc

SEQ ID NO: 7041 - DNA, 3069 bp, Heterodera glycines
ttgcctattgtaatttgcctgtgtacgagttgcctatcgttcgagttgcctttttacgagttgccatgacaccagaggtgaaataaaaaacaaagtctaaatttttcaaaaactgatttcaaattaagatttgaaaggaatttgttaattagtgatgctcgagaccgaaagtttcaacagattcgagatcggaacttgaccccgagaatgagaccgaaaattccgggatcaagatccaaaaatccgagaccctagactttttgcaaaaaaatttctaattcgcttaaaaattaagcggtgccgtgaggcgtcgctgcatataattcttagaaatttgattcatttgttcaaaaatagggttggcaggttccgggtatttgggcaaaaagcgggtccatgtattgccggttctagaaaagccgggaccaggcttggatccaagtttttcaaccgggtcataaaaatcaaaaattaattttttttttttctttaattcgtttttttggacaacttattcatttttgggtcaaattttgaaaatttgtggaatcttggaagccaacggcgcttgtgggcaccgtcttgaagcatggacggcccaggtttcggttcgataggtatggcatgggagggggttggggtgcctatcagggatgggctttcgcgtgtcgctttcgcaaatttcgcttttttctgtaattttgcgtttcgcattttggcgcgaaacgcgaatataagctctaagaatgagagatgaaattaccattaaatttcaaaatttgacatataaattggttagttttcagtgaaaaactgtttaaaaatggtcaaagactttttgttgtttttctaaatttggtatagaattttacaagtttctgacttttttgtcggccaaatgctgattttgaaaatgttcagttgacagccttggttttaagctcatgctggtttttgctttatgattttaactattaaagttgtagaaataaatttcgcgtcgcaatttcgcgttttttggagtatcgcgtttcgcatttattttcattttgcattttttgctttgcaaatttcgcgtttcgcatttttttttttgatttggcccatcctggtgcccgtgctgggtcgttttgttaaatacgccattttatcgaatttttcgacaaaacatagcataactttgcttaaaagcaataaaattttacattattggtagcatttggtagccgagcttttcctctattagctttcaaattaaaaaaaaaattggtcaaatttagaaaaaagttgtatgaaaattagttgtatttctgccttaacttaatgttaaatttgataatttatttgaggtttcgcaagctaatagagaaaaaactctcggctatctaatggtaccaagaatgtaaataattgtctttaagcaaagttattccatggtttgtcgaaaaaagcgtggttagcttaaccacggttaaagacgtgaataatacgttttttggttaaaaataaaccgcggttaaataaaccacggttaaggcataaccgggagacgggaataaggccccagacatttgcgccccggcatttgcgccccaaatatttttgcgcctatgtccaaaatctggttcaatcttacattttttcaagcttagaggtcttaaacaacattaaatttaagaaaactttctttgagtttattaggaagaataattatgatgtttgaaggatttaattgttgaaatcatacggggttgaaaaatgtaagtttgaaaccgatttttgccttacaaattaggcgcaaatagttggggtgaaaatgtttgaggcgcaaatgtggggtaaccgaagcgacttagcatccctggtgcctacctccgtcgacgaccttttttcggctttcaacccactttttatgtgctttttttaaactttggagacatggtggaggggagtccggcgcggccgccgaggaaaattttgaaaatttgatttctggttttttaacagattttgttcaaaaatttaatatttttgggttttgagccaatttatttataataaaattgttcaaattttcaagcaatatatgttcgagttaaaattttttctttaccacattgtcaacaatttgacccagaccccctattcttactagtgtacttttgaaaccgaagctatcggaccgggtaccgggtatttgattttcaaaaacacgggtccggcgcagccgggaagttttccttgtaattttggcctatttattaatagaattgcaacaaattttaaatttcttggatctttaaacaaaatagaaaatttaggtaattttggagcggtagtgccgagcagggttggaacgcgatcgcgatccgctgcgttttttgcgcgattcgcgactacgcccgcggctttttgggactaaatttttataaagaaaatttattgaatatgattgtttaattattaaatgaatattcaaatttgtatgtaaaaagcaaaagaaatatggaaacaaggaaaactgattgaaaatttagatgaaaaggacaaaatttcaaaatgaaatttcacattgactcctattggcaccgcctgactaaaaaataaaaaaaatttttagtccgcttttatgttcgttggcgaatgtccaatttttagtttagttggtcaaatgctcagttagcgataagtcaggtagcaattttttggagatataaagttttatcaatatcactttttttgatcatacaatgagaaaaattttcgatttaaattaacacttgaacatcaaatattaaattttttttgggttcatttattttcaaataatgtccgtatttcgtgcaataacggacttcaaattgactcgcatctcgttgaattgactattgatgtcatctgttcctaatttgttcgacagtttgccgttaaatttgaggaaatctctttttattgcccagtcgaaattgagcaactgcctattgatcagtcgcttttcattggcatccattaaatgatgatcagtgccaataagccatagattgcaaaggtggtaatccgatctgaaaa

SEQ ID NO: 7042 - DNA, 1494 bp, Heterodera glycines
gacaagaaagacaaatcccgatttatgacacggcttcctccttcggccttccaatccgaccacctgtggacaagagtgttcattttgcttgaacaacccttccgggatcggagaaaaacaaccgggattcgcttccggccacaaattaggacaattaaaattcccatagaaatagcatagaatagatagatagagacaagatacagagaacgtgcggcaacaacatatgtaagaattttcacatagattttcaatatacaaaaattaaatgacgtcaccactaatctaattatatttcgaattaacgaaatttaatcaatttcataaattaactgaaatattcatatttttatattattatctgtacatagaatgaatttaaaaagattttattattatgctgaatcagtatccaagtgaacaattaaaattattttaaatcttaaatatataagcaaaaattaaaagaaagttaaaaaacatttaattgatgaaaatccatcataaaagattaaataaactatcagatttgatttcggaaacattcatattatactttttctgaattgggtaataaactttttaattatctaattttagcctcaataatattttgttgagaaatttacttgatattgaaaatgggattgccaataagcgtcgccgaaaaaatgataaaattttaattttgagtcactagttgattgattttaaaataaattttaaattaaaatagaaaataattttcacctctttttgaatttttaggttcattttagtaaaaaattttttaagtctgataatttcataatattattttatattgaataccaatcgactctaattaatgctgaacccaatttgattgttggtgagctgtgcgtgccaatgagtgtcagtggtaaagctatgcccaaaaaacactcccattaaaagaccaaaatttttaaaaaatatattccttaaagtggaaaattaaaaaaaaaacacaaaatgtcaaaaaattttaatgttttaatttttttacataaattttatttgaaaatttatttctctcagtgattggaaatggcactttaccgttgccagcatttcattgtttttgtggagttgaacagaggtgaacagccgccgttttcattggcactgttgttgctgttgtcctgctgctgtttgatggaggcggtggttggaaaatggagcatggatacgcagaaattatttttttttttatcacaaaattctattaaaaaatggaaaatttttttagagactttgtcatttttatgcaataggcaatgggtgaaaaaatttctttaggatttcttaagaaatttaaataaattctcaaaaaaaaattgtgaaactttgaattgaatttagaagattttattttatttattttgagtataaaaaaaactaaaaatacttaaaattgcgaaatataaaaaaaattgcaatattatttataactttttaaatttggtgccttga

SEQ ID NO: 7043 - DNA, 2020 bp, Heterodera glycines
  misc_feature (255)..(255): n is a, c, g, or t
  misc_feature (286)..(287): n is a, c, g, or t
  misc_feature (307)..(308): n is a, c, g, or t
  misc_feature (316)..(316): n is a, c, g, or t
  misc_feature (323)..(323): n is a, c, g, or t
  misc_feature (342)..(342): n is a, c, g, or t
  misc_feature (365)..(366): n is a, c, g, or t
  misc_feature (374)..(374): n is a, c, g, or t
  misc_feature (421)..(421): n is a, c, g, or t
ggggggggggggggggggggggggggggggtttttttttttttttttttttttaatgttttttttttggaagcatactccccttttcttaatttggattttaaaaaaattattattaaaaattggtttttttttagacattttttgtaaattttattccattgtattcggaggatcattttatttaactttctcgcccaacatggttcatttttatcgttcacaggatcgtgccttttccgcactttttttaaantttatttcgtcccattgtacgatgttattannaaattaatatataaatgcanntttctaanttatttnaattatgtgtattttctcntcgttcccaagaaaggtctcgcnnttaattanaatgattaaaaagtaaatagtagaaataaaatttatttcattatgcncaattcaactatttaaggtaaatatataaattaatttttttattcatactagttagtttgctttttataaaccttttccgtgccgaacgtttattttatgttgttaatattttaaacgtttatataatttattaatttaagaacatacacattcattaaaaaactattaagattttgttgcttatttttctagatttggaatatcgctattttctttatttttaaacgcatgctttctgcgctacaataagccttttcctacatcatcgcttttttaacttttggtgtaattttttcattattttttatttcttttatcttttatctttttttcatttctcatattttcgttatttttgctgattttttatttattttttgtttttttcaataaattaatttaattttgtagaatttttttatcagcttcaaaagccttacctattattctttgaccgtctcaatctgatctggtgactttatttttgttaaacaatttaaaatttattaaattcatttctcttttattttccaattttttcattatttccttaaagttgctatacaattaattatgaatgaattatttaattaatgttctgcttaaaatggcatttggattctatttttgatttattttacataaattatatttaagcacatattattttgaattgttttatttttcgcgtttttttgggtatttcatatttttcaatagaaatataaactaagttggaattattaattctattgattatgatagttttgtttatccccctcgttgtttgatctgctcccgggttgtcgctgttcactcttttgggcattgtttttattaattatgatcatttttatttataatatgtaaaaatgtttttttctaagtatcaaattgactcatgaatagaaatttaaataattaaccaagtgcatacaatgattaaaatattcatatgcttaaaaaagtataaaaatttttaacaagccctgtcaaatttatattatcgttgtatctacaacgttcagcattaattgtaaatcaagcatttttaattatataacattgcttccgtgggttttccgggtctgatcacgaatctgacattagtttgacaaaccctaatacttaatccgaactcgaacaaaaaatcgaaaatttccgttttttcatatttaggtcagatattcacatttaattgaaataaatgttagtgattagcaaccctaaaaattcccgcgaacaatttatacaaaatataatcatttacaaaaaaattttcaagccaatgggtgggttcccttaggtttaataaaattaaaaaacatcgatttgcaattttatgcccttgttcagcaaatattaattggatatttttaattcaagcttccccaaactttttaaatttttgtgcttaatgagttatttcgctgatataaatgctaccaaaattactaattttcaaaaaatgttcccggcggcacctatcgacgacaccgccgaccacataactttttttcttaaacaatttgctcaaaatcgtaaaaattggtcattttttggtgaaaatctgttaacaaatagtgtaattgcccaaa

SEQ ID NO: 7044 - DNA, 2033 bp, Heterodera glycines
aagaaatgcacagcattattatcaaagttaccgtttttgaattattgtgaaaaccataggggggccaaaagggatggaattttgaggacataaaaacaattatgttttaacttttgttaaaatattcttattttgatggtgttaatttatttatacttttgatacagttaattggcttatttaataatggaccttcattgaatagtctttcatcttccgacgcattacattatatgggttaattaattaattaatagttattgaattgaaattgaaattacatattaataaatattattcttcttaatttatattttacaaaatagagttttcatttaattttattttgctataattaattaagatatgttttcactttctaaatatttcactagcaattcttacaataatattatcatacatattaaaattagagatcggaccggtcggttttttttcggttttttcggtatttttcggtttcggttttttaaccgaaaccgaccgaccgaaaattttttgagtttttcggttttttcggtttttataccgaaaccgaccgaccgaaataatcaaaaaaccgaaaaaaccgaccgacttttttcaaaaaccgaaaaaaaaccgaatcaaattggagcgatataacctgctaataataataaatttattgctttttttgtgctctttttcattttgatgaattttttgtaaaatattttctgctattttgaaaaaaattattaacaaaaatgcaataaaaacgaaaaatacacccctgagaaatggaaaattttatcaaaaattcatattcaaaatttatttatttatttacttgactgcatttttgatttttaaaatatttatctcatttccatttttagcacctattttgggggtttataatagggttgctccccgaccccgagacccctacctccgactttttatcccccgaccccccgacactaactcggggaattggggactcttgaaaatttttaaatttgtacaattttcttaataaaattaattaaaaattcctaaaattccaaaaactttcggcggcgcctatcggcaccgccggcctcccaaaactccaaattttttttaccaataattggctcgaaaaccacaaaatttgacaatttttggacaaaattctcttaacaaattatactcattttcaaaaaatttcccggcggcgcctatcggcaccgccggacacctccctgcccaccccaagttttcaaaaagtttttgaaaagcgcaccactaaaattgtcaaattttttaggttaaaattgagcctcggaattgatttctgaaaatttttggggcctgggatgccttgtataaaatgccaaattggacgcacttttactggctggcgccaacgaatgaattttaatcagatgattaaagtgaaaaaaggaagatttcgagcatataagagaaaatttggtctttttttgttaaaaaagtttgtcgatcactacccgatcggggtccccgacccccgacattttgccccccccccccccccccaggggtcggggaggaaccctagtttataagaaaaatcaggaagatacctaacgttttttggatgcctctttcatatattttcccaacttttagaccattgatagacctacaaaaactctacaaatttactcataggtgatcttatcccttttactatatgatagaattggtctattgttctgtttgctaacatatatataataagatatatattcaatcctatatgatataccgaaaaatgatcttccgtttttttcgcgtcaaggaattgctgtgtttggattattaatcagtgattgcgaaatgaatgatccgatcgcaaataatgtcaaggtcatgattgacattaattttagttgcgatgtttatttgtgcacgttataacgaataactgctaatatatgatttattaagttggaaaaattttccaaatttttgtgagttatgggagaatttcatttacagttaaatcacatgattgatttgta

SEQ ID NO: 7045 - DNA, 1593 bp, Heterodera glycines
  misc_feature (23)..(23): n is a, c, g, or t
gggactcgatgaggatcccgacntgggatccctccgaccccagttgtccggtctctaatccgaaatttgaatccctcggcaaataattaaatttaaattgtacattcaaccgacgaatcacatcaatgacaagtaattatattatgaaaattatgttccgaacacagtaatttgttgataaaattgaggcattgacaattttgttgaaattacaaacgaaaaatgctccggtaaaaaataatggaaatctttgcgccaattcgtgtcttagtttttgattaaaaatcaacaaggttgatttaattatattcagaaaataaatttaagtttgaaggaaaaaaagcatttgcactgtagagaaaatgacattttctgactttttttatgagagttcggatccgctcaatgacaatagaattttttaaattaaaaaaaattaacatagaagtcgatgcagaattctaattatatcaaaatttaatgcaaattttatgtttagaaaaaaatatttgtagagaagtaaaagtcgcttttttttacaaaatgcgctagcaccacgatttatttataggacagtattgtatatagaatattcttttaagaatatgaggaatttcgaatctataattaattgctttctttatcacctaactataaaatgagagatattcaaatatatttcacatacaaaatattggcaaaatacatattgtgaatattgcttttgtatgatttttggattttttaatccgatccctagtgatcaccaaaatttccggaatgtttcaatttgagtttggcctcttcgcatgggtccagcacaaataaattttccaattctatcggatgcttctccgccatgggatcattgatcaaatgcttgaactgccacagcagagggccaagctcaatttcggtgatccaatgctttggttcgccattgtaacgggcgtcgattttgccataaaattgtcctatcttctttgtggtcatccaaaaatgctttaagatgcacccattatcataaaactttgttttatactctaatgatgcatcacaaattgctaccaagtctgaaaaaatactaacatatttactcatcagtgttttcttctaaataaattcttctttatattaattttgttttgtcattcaattaattatttccttatttattagttcgtcaaccaaatccaacggtgctatgtcgttatataaaagccatcaaaaaaggcgttatataaaaaaccagcaaatgaaaatttccaacaaaaaactgtccataacttttgtctaagtaaactaaatttaacattgataattattcgatagccctaacatttctctattcgcttatctaaatttcaaaaaatttggccaagcttgagcaaagttatgccaagagtacccaaggaacctggttttcaaacatttttggccataacttttttgaatcataatgaaattttttttaattttgaaggctaatagaggaaatatagggctatcgatgtatcaagatactttattttgttcaatctaagaagtgttttgatcagaatatttgatcatcaaaattattttatgtcaaat

SEQ ID NO: 7046 - DNA, 1176 bp, Heterodera glycines
cccattgatttgtgagtcatgtccaagggtcgttctcatacacaaaaaacggcaaaaggggtgaaaaggaaaataattgcaattctgaaaaatatttatttacgaatttcataaaattaaaaaaaaaattttcccgacagcgcctttccctaaaagcttttacgacaaaagggcgagggagtgaactttggacatgcaaaaattatatgcttttttcgttataatttgttttaaggaacattcaaagcgcgaggaaacattttgaaaaattggattgcaagtgagtaagagagactaaaatcattttggttttaaatctaactaagttactaaagtctgtaatctgttgttttccataaattattgggatggttaataagtcggttaatttctttatcttgtgttttaacacataccaaaaaaacaaagaatgccttagaatagagcgtataaatgaccaaaaaattggcgtttaggtcagaaatcaaacaaattaataaatgatgagaaaacagacttattgtccatcccaatactaactaacctaactgcaattctttatagttgtactatagcaaattttatcaaaaagtaacataattcgtcatttaaatttacacatttttataggttggtttaaatattattgacttattgagagatttttgatttaaaaaataaaacaataattagttatatatgggagaagataaatttaacagaaaatccaaaataaattatttttctatcagggtcaatacttatgaaccaacctattactagtagatttcatcaaatatagaattgtttgtttttaatttaaaaaatttccagtctaagattttaattgtattccaaagcattttatcattgttatgaaatattttgagtaggaatttttcattaccattaaatcgttggtataaattcggagtctgtatgtttcagtttctttggtttggtttgcaaagatttcccaaaaattaagtaatggttcttgaaaaatttgctactacctttcttatttcataacatttttgacattcagtccttaattcagtctgctcttaaactttaaaaatttaaccatttaaattttaaaaacagcggatttttgaaaatgattttctctaatcggtcggatcagttcgctgatacgggagctgatccggaaag

SEQ ID NO: 7047 - DNA, 3642 bp, Heterodera glycines
  misc_feature (47)..(47): n is a, c, g, or t
  misc_feature (116)..(116): n is a, c, g, or t
agggttgcaggtgtgcgctttagcgccccaaagattttgagagtcgnatgaggccaaattttcgaaatctggctttgagacctgtgattttttgggtgaggctttttgttattttntaggccaaatcctcaaagatttcatttaaaaatttttttccaagtaaaaatgactaataatttcctttccattttttaaaatgtagattatgattaaactatttaaaaatacaataactgcaattgttatggttagttctatatttgttgtcacgtagttttttttcattgcatgccaagttgccatcgctgataatcagtgcgtattttattagtgtttcgttacaacattagactaaaaagcttcataatattaaacaatatgactgggaattcaagtcgctaaaaaccaaaaaggcttttctttgcaaattttcaaaagaaatatcccccaaaatttgagtttaattgtaggaagcttttggagaattaattatacgaattttaacgctattctttttttatgagaattaaaatgaataagaaacaatgtatgcgtttttttttggggggggggtgggaggattaggcttgctgcatcggatgaatgttgaaggagattctgcattttctcgcgatattttctgcgcttgcaaaaggcattatgtgttggtttaaagaatccttttgtccctttccaacgattctttgtgccacactttcatcacttttcgttgaaataatgccaggggtgaaaatgactgatgccgaagtcgcccatctttgagccgaaacgacaacattagtctgcaaatgaactgttgaactgtccagtcttagaaagtccccgcgccttggtcgatgaaggtcgaaagtctggtcgggatattcaatctaaaaaaagagaattggtgctatgtcgttatataaaagccatgaaaaagggcgttatacatttaaaaaaaacccatcaaaacctcgatttattaaaaattttattgactgaaagaaaccttaaacttgttcacattatataaaacaaaaagaaacttttgggtgttttaagtattttcatctttccctttttaacgctaattgtaaaattttgtgttcctcttcagttttttttgtgtgggttttcgtagtggttttttgaatctgattcttgttttacctatgtagtataaccagtctaaatgggaatagcttcgaatattttaagggacctgaattcggaaccgatttaactcctcgtccgttacattgcaaagcaaaattcggataaatatccccgttggtaagccagcaacgaatcgaatagtttcattgtttctaaattctctgctaggctcgagtaccttaagatttaattgttgctaattcacaatgaataggaaatactctagcagttttagcatcattttccttctcaattgttttatcctccggcccaacagccaaaaaagggcataaaaacggcgaggaatcgcattggtgtaacttttcatgatcaaattcctttaaaaaaatatactcgaaaaatatcaagagctcttacgagaattttgggaacaatctcaggccaagaacgacgcaaataacggtaatgtttcagtgcataagagggaataagcgaacagagcactgaccgatgggatgcagcgttaaggacgaggatgagtcgggccaaatcttaagtttatttaataatggcaaaagcaaatggcacggacgagagaaggctgaaatgacaatgtcactccaatgcataaaaattataggaatcgttctttaatttacaatccttacaaaagtcatcgtcgatactttgttcaggggtgtcaaaaatgggatgaacatccaacaaatcattcaccaaaggctgaactaatgaagaatggttctgcccgataccactgagacaacttaaacattttcatttttggcataattagtgcctaccaattaacccaaaaatagaaaatttgtccatgggaaaacgacgcagagaatgcagcaatttcttaagacattgggatacacagttggaatctgccaaattggactttgccaacaaagtgtgaagtgccattcgattgtcagcagttgcatcctaaaaatgcaaaagatgaaaagcaaagggatcttgcaaaaaagaaaaataaattctgttacatcgagaacggtcagaatagtgtccaattgatcgcggtagagaaggccatgggaaacgagcggagtcagtgcgcgaatggcgtcgagacggatctaaattcctttacacgataatttgcaaagaaaaagttattttgatttttgtccaggcttgggttcagggttcaaaccgggcctactaaagtaaaaaaaagtcccagtcgtattattgaacacttaaattctaacattataaaaccgaaaattaaccactcagaaaaaatttcacctgttggatttcatcgttgaacatatcggccaaatgatcgatgcacgcactcgcaaaaacaggtcggttcctagcaagttttcccagtgagtaaacagctgcctgacgaaccgctaaagaacatttggtaggatggacaggtctcttttcagttaaaaatacccataaattcgtcttcgagtgcggtaacgaaggcgccacaagagccggtagggatcaaagattggctttcgtcctccagcttttcgatcggcatgtcctcacccatttttttgccagtgctccatcctccgatataaccaacaccagcagataacgcatttttcgtatttctgacattagtgttcaacatctgtgattggaaaataacaatttataaatgactgtacgttacagtcatattccgcatcaatttcttgtccaatgtttggtcgaggaacgactcagagacgttttcaaaaaaccccaagagattggcagcttgagcgcgaacttttacttccaaatcattcattgcatcgcaaacgattgagaaagcatcgtcatgaagacgaattttgaaacccttcgatgccatgactttcctaaataaatagaaatggatttttttgtttttgtcggtattatgcgactcaaaatattttaattatgatagaaggcataaaatattattcgggcacattataatgacatgaattttttccattctctattacatactcttcagggtagacaagggcaaattttgtcaaaatacgaagcgcaacgacacgaacattctgctcactgtttttgcataagtttgccaaatgagggtaatactccaagctcaagcattccttctccaacattttcattgaagcatcttcgcacatttgctccaacgcgcttatagcaaaagttcgaattcgcctgtcgaaatggcatgtcaaacgaaataactcggactcaagctcaacaaaatttaagttcgaagggttgtaacaattatttgatttaaaatcctttaagtcaaatttataatccaattgcatcattgtaaataatctaaaaaagaatatgtatgtacataataataacaattacccggtactttacggttatctgtgtgcaggttttcaaaaaaatttttttgaaaataaatttgttttaagggttttttggggttgggaaaaccgattctggcatctattttgacccatt

SEQ ID NO: 7048 - DNA, 1281 bp, Heterodera glycines
  misc_feature (1254)..(1254): n is a, c, g, or t
cctaaataaatagaaatggattttttttttgtcggtattatgtcgactcaaaatattttaattatgatagaaggcataaaatattattcgggcacattataatgacatgaattttttccattctctattacatactcttcagggtagacaagggcaaattttgtcaaaatacgaagcgcaacgacacgaacattctgctcactgtttttgcataagtttgccaaatgagggtaatactccaagctcaagcattccttctccaacattttcattgaagcatcttcgcacatttgctccaacgcgcttatagcaaaagtccgaattcgcctgtcgaaatggcatgtcaaacgaaataactctgactcaagctcaacaaaatttaagttcgaagggttgtaacaattatttgatttaaaatcctttaaatcaaatttataatccatttgcatctttgtaaataatctaaaaaagaatatgtacgtaataataacaatatccttttataatgcctaactttgcctattttggagtttttgtgcctaacttgcgacacccaagccggcgttttacaacccggtatacctaagcaataatgatgaggattgtttaggtcccaagcagataacctcatgctgttttaaacaagaaataaaacgattttaaaatttaattaaactttattcaaaaaaagtttctatcctaattgaatttttttgtgttttattatgctttgggtctgtaatcataataacattttttaagtacctaatgatctcatttgttcgagttcgattgaaaacattcatatttctagtcatttcaacgtggttcttctttatttgcttttatttttacacttatcctattggaaatttggaatataacaaattcaaggaggtatgtttatgtctcgatcaaagtcccaaattaaacattcttggtatcattcgatagtccttaaggttttctattttctatgcaaaattcaagaaatttttttatcatgtttcaaaaaagatggccaaaattgtaaaaacaatttttcatcaacaattttttcaaatatgatcaaattttttgaattttacaaggaaattgagaagcttagggctatcgagtgacacgaagaatgtttaggtaatttgacaagatttatgacgaattttttggcttagtacgaatgcgagattgctttttatcatattatcatttccccattttaaaattttgttaaccgaaaacggatctcacganattatactggctcgtagtggaagaaaa

SEQ ID NO: 7049 - DNA, 1425 bp, Heterodera glycines
gagaaggacgaaaagccaaatgatcgcagaagaagcaaaagaattcggacggagcagcgactgaaagcgaccgaaaggaaagacgacgagggacaaagcgaagcgaacggagcggagacagcgcaagggacgacgggcgcagagggacaaacggtggcgaagccattgagcgaagtgaatctgaacgtgggccaacggaggacgccgaagatggacgaacagcagcagcaagacacccttctgatggcacctcataactgacaaatgcgcacggacaatccggccgcgcactttttgtttttttgttcgttataatttccctttcacattttgtttttttcatatttatttgttttttgttagttataaactcttcgttttgagctccgttccatgatcattttcgtcaactgttttgtttttattttatatctctctctctctgctgcttccttttctctcattttgtcattgtctctctttctcttttcccattcgaaaagcgttaatgaaattcatcgcgctgatttccgtcgcgtgacgcctaacagctctgctgctcatcattttctttcctctttcggcacgattgttcggccgagggcgaattctgtggagataagcgccgctttttgctttcttcagcctagcgctttttcatgctcacccccattcgtccgtgttgcttcctctcttaggtcggctgaatatgggaggaatgaaaagggaaagggccgtcccatcggttggccattccccgccctcgtggaactcaatctcatccaaacaaccttttgatgagcccgggggcgtaagaagtgtcaaatgggaaaagtgatgaaaatgcaagccccctcgtccacttcagtcccaccggcactttgctaattcgtctcatttacttttgcttattaatccacgtcgcttcgttttgattgattgttcctcccgaaaaagcatcattttcgccattggcatttcccatgctggcactttttgctccctaatcgaccccctcccaaatgcgtgtgtttctatttctctgccaactttcgcgcttctcccccttcccttacgttctcttcgtccatttttaatgcctcccaaaattactgctttaacagaaagtggtaatgacctttgccttgcccttttgggcatttgactggctaaatgccattgctcttttaattggtctgccataggaagttgcctgagggcacaactttccgccgatttctctgtgccggccgttgcccccccccctccccgggggatgcctttttctctctttttttaaacaatccctcgggcaaagacgggcgaatttagagaaatgtaaagcaatgaatgaatatgtgcgtgtgcgcgtgaaacattgggcaacataagcagagctctcgccgtgtgggggggggggggggg

SEQ ID NO: 7050 - DNA, 3638 bp, Heterodera glycines
cccctcccgccccctcccctctctatgccccctttttctccccctctgccgctcggttctcaacaccccttcgccccccgccgcttctcacgacggaccgtccacccattcatttggacgctccttccattaatcatccatccatcgtcctaccttcattccttccctccggcccaacctcgcgtcccattccttctcctccctttctcggccaaaatgatcccacggttacgctcccagaaagcctcgcgtcatacccacgcgcaagtccaagcccaacgcctgcatcaattgctgatcagcgtgaacagtcagccgataatgacaggtcaaccagcaacagttgaagaagcattagtagaccaacagcagcagaaggaccgagaggaggagaagaaaacggaggaggaaaagaaagagaaaggcggggacagaaatcagacgaaggttaggtgaggggaaatggaaaaaggaaggaagagtggacaaaagaggaaataaggacgaacaaacaaacaaactaaatgaaggggaagtgcgcttccctgcctgaaactgtgcttttcccaggaccattttccaaacggccacctcagcccgggttcgcctctttccccgacggacatttcgcgtgccttcgatcgtcgaacttcggcgcccgtccaaattcgcatgaatgtcggcggacgaagtgcgcaactgaccctggagaaggtcagcacttcggaccttaaaagaaaggaatgaatggtgccatggctaaagattatccccacaaaacaccgcaaaattcagtcccataaactttttggctttccaaattttaaactctccaattcccatcccaatcaatggtcggatgacctcaaaaagcactttccccacagatccgtcagcgtgccgaccgcagtcgattgtcccaattcgcggaaaaggaccacgcccagcgcgtgttggagtgcgacgcgtttctcaacggcgaatattacttcgagcgttccgccacagttttcgagaatattttggattattacgtgaccggcaaattgcaccggcccatggaagtgaacattttcactttttattcttccgtccggaccattaatcaatctgttcaaaagatatgcccaattcggtggcgtgatgaattggaattttggcgaattccgttgacggcactggcggagtgctgccggtcggatgccttcctgtccaaacggtcgctggcatcgccggcgcttttatctatggacaatgttggtgaacaccaaacgaatggttttgatcagtcagccgattttacccgatcggcttgctgatcagctgctgaacccatccaatgatgtgctgatcagtctgcccatctgatttgtgctgatcaattaccagacgattccgtcctgcttttgctcattcatccctcccccttttgaaggtgtacgtcgagtccacttgccctcccgcagaattcgaggcaattcttcccggcattcgtcctccccccccccctcatcttcatctttcccaatttgccagggcgtcgctttttcccgcgtccgtttaattctgtggactttcctggagaatccgcgctcttccgctgctgcgaaggttctttccgtggtgtccgcttcgttcgtgcttctttcattggccggtctcattctctcttcgatgaaagaatttcaaataaacgatggaatgatgagccctgttttacctcttcaattggccgagatttggtgaatttttatagttttttgatctgatcagtctcctccctttctctcctcttttcatccgatcattttccacttttcgtctgatcacttcccctcttcattgatcactcttccacttttgtttgatcactgtcccaccacgctctcttccctctctcctctttttatcagatcattatcccatttttcgtctgatcaattcccgttcagttgcatgcttttcttcactctcgaataccttctccgcttcgctgttatcccccacaaatggaggttcgttcttcgatcactttggattttctcttttcaatttcttttagtttcgttaaacagcctctgaatataattgaccttctcaccattgtcccttttcttctcgaagcttgccttccccttctcggggttaatgacatcgaattgcgcaactttcgaggctttcttcttttcttctataatttgcttaattaactttttaattgatcatttaggtgctcttattgtcattcgagtgcttaggtgggttaattaactcattgaatgatcaattagcaagcatttaacactaattgccctaaggttggcccgagttgcacgcatattcaagcttgcccggtacagcattggcctgagggcgtttggcgaaacaatgcgaaagtcggttcctttttccctcgtaaaatcaccttaccgtaccaccaaggtcggctgctgagttgtcaatgcttggcatgttcctccttacggtaccttttgtcctactgtcacttttggcatttcccctcagggcataatgcttttctccaccgccatttacttcttcgaacgcgacgaacccaactcaaaattttactctatcccttctgcttggtggtggtgtgttgctacagtaagaaaaggcgaattcgatgagtaatccctccgttccctttcagatgactactgtcgggtcagtcaattttttattcaaaagttttttggccccaatgccattcaattcaaagttacggcgatttggtgccggtgactacgggcgggaaggtcagtcccattgtgccaaaatgtgtttttgggtccgtgccaatgcttttgccattgaaaggtcgtcgctgccattgcctcagtgtgtggcatcatcgttttggcctttcccatttcaatgatcatcgacaaatttgccgagtccacaggccatggccaacgcgtttttgacgaaacggtggcacagggcgaagttccgttggaggccaacaaaagcaatgttttgttggggtcgccgacggggcgaggaatgagcaggaggaggaccaaatcgaggcgatatttgttctaagccggccaaaaggaagaaaggaaaggataaacgggtcgaatgaaaagccaacggacgaaaagccaaagggaagcgaaacgaaaagccaaagggaagcgaaacgaaaagccaaaggaaagccaaaggaaagcgaaaggaaaagccaaaggaaagcgaaaggaaaagccaaaggaaagccaaaggaaaagccaaaggaaagccaaaggaaagcgaaacgaaaagccaaaggaaaacgaacgaaaagccaaaggaaagcgaaacgaaaagccaaaggaaaagccaaaggaaaagcgaaacgaaaagccaaaggaaagcgaaaggaaaaggcaaaggaaagcgaaacgaaaagccaaaggaaagcgaaaggaaaagccaaaggaaagcgaaactaaaagccaaaggaaagcgaaaggaaaagccaaaggaaaagccaaaggaaaagcgaaacgaaaagccaaaggaaagcgaaaggaaagcgaaacgaaaagccaaaggaaagcgaacgaaaagccaaaggaaaagcgaaacgaaaagccaaaggaaagcgaaacgaaaagccaaaggaa

SEQ ID NO: 7051 - DNA, 1850 bp, Heterodera glycines
  misc_feature (896)..(896): n is a, c, g, or t
cccccccccctcccaccctcattatcagtgccgatgtttacccttctcgtgccattctcctcctccccctaatttgattttccctctttaaataaatttctctctgtttcccttaaactttcgcttctctccacttgtccacctcagcccaatccggcaacattttttgcttgtaaatttgcttctttttcttaaaatgtgttgggagcaaaagccgagtaattaaaattaattgctcagtcagtcaaagaatcccttttcaatgcgtttgttcagtgagttgtccgtcacgtgaagaactgttccgtctgaacatcggcggtcgttcgttcagtttccgttgtgacaccgttctcgaggcacgcgagccgaactcatttttggtcagcaaagagaacagcacaaaacatggattaattagcccaaactaattccattcttctttaaggcaagattagtccgattggaccattcgaacagacttttgctgactgatggctttctggcaaaaacaaacgaatattatttggagagaaatgttcgggtcgcggagcatgtggtcgattacttcctcacaggcgagaaaaaggacaaattatgcaaaaattgtgcatttaaagggcaaaggttggatgagtcaccgaattcaaattaattaggaaaattgcataagccaatcgatgtgtgcccccagcgattcagcgaggaattgctcttctggcgactgacccgggtggaggtgaggccattcttctccaaaatgtactttctcccccgttcagttggccccgtgctgctccgttctggcggacagcaaccgactgaagaagggcatcgaagtggagagacagctcgaccaagtcgtggggaaaggtcggaacagcgacacgacgaanccttctcaggtgaagtgctgcccggagatgcgcaaagtgatttggcacatgatggaagcgccgagttcgtccatggtgtccaagctgttcaccattgtctccgtccttttcatcctcgcttccgttgttggacttgtgcttgggtccatgccagagtttcaggcggacaatcgcttctccgaaaattaccatgccttgttgacagctcgcaagggcttcggacaatcacagcgcccgcaggaaaatgaaaatggcacgaaaatgccaagcgaagtgaacggaacggcagtgccaagtcacaaagtgatggggcgggggggatatttgtggaggggtcgactcattctctgatcagtttgtgtatcggcccacggacaatccgcagccgtggctcattctgctcgaatactgctgcatcggctggttcactttcgagttcatcctccggtctttctgcttttgcttttcccattcttctcccttttccttcagttttcttgtcgctccccgccgaatgaatttccttcgccagccgatgaatctgatcgatctcttcacggtccttcccgttttctgtgaagccgctctgtccacgttcggagtgaacgcggaacggcttaaagatttggcaggtcggtcggtggtcaatggcattccgtcccacggcattccttacctaaggggccatgttggtcatccgtgtgctacgagttctgaggtgacagactttccgcgcagtcctccatttgccgccccccctattagaatggcacgcgtgttcaaactcgcccgctactccaccggtcttcaggttcccccttccccccccccccctcctcatccgtcggattttccctcctccctccttttcaaggtgttcggcatgactttgcgcaattcgttgcgcgaactttgcatgctttcgatgttccttttgtgcggcaccggtgttct

SEQ ID NO: 7052 - DNA, 4689 bp, Heterodera glycines
ttaattttaaaattaagatgaagtaatttttttaccaaattttccgtcagaacctatcaatagctgatcctcaaactaattttttcaaaaaataatttgaaaatttaggaaatagtatttttgcttatctatcagcaaccctgttcaaaaatcggcaccactgacccctcatactgtatttttgaaaaaaaaaagttcgaccaaaaccagcacccaaaagtcatattaggtaagtctcgtgtacattcttgaaaaattttgcctcaaaatttccaaaaaatttttcggcggcttttagcagcaacaaacccctcatactctaaaattctcaaaaaaaaaaaaagttttctcaccacttggcctgtaactgtaagattttgctgctgttcgcccagttgcgcaattgtttgattttcctgttaagtaaaataatattattaaaaatatgatagttacaaaaaaaaaaattatttttataaaaattataaaaaagtttttcaaaatttattaaacaaataacaaacttggtcagtaaaattccattcctcgaaacctaaaaaattaaagattaataaattttttaaattaaaaataagatttaaaaaattattttgccccttagaagctttaaacagtaagatatctatttttccacctttttggtgacatttgccaccattttttgaagattttgtcatcattattttaaataccaccatcatgtcacctacatttgtgttttgttattttttagattttttgtaaggagggtgaaaagagaaaatttttgatggcccacagtaaaagtcagtattagctccatctggacccaaaaaccaagacgtaaatagaatcatataacaaaatatctgaagcagaaagaaattttatgaaaaaaatacgcctttaaccaagaattagtaatctaaaaacttctataagctttggtttgaaaccaagaatgtaggtaggcattgaccaagtacgaaaaacgttatagcctaagaaactgaggatagtcattgattggacgcgtaaactgcagtagagccaagaattttgctgtcccgacccaaatcccgccatttttctcctctgaacatcccgggaacagagtgggggcataaaatgcctacaaagtcaaaattcggtaactcaagaccgaaatgaaattcagaaaaacaagggcgctactgtaagtgggcctttttgaaacaaaaaacaagcatacaacatacataccgtcccgcacttcttcccaaatggatgagacaaaaagagagaacccttttattgatcgcattaaataaattagatggaaattaagaattgcggatcaaaaggcctcaagaatgacgaaaacgggtcagaagcgtccgtcgtcttcggagatcggcgtcatcttcttcggttctcaggccgccttcgtgtacacgcgcttggccttcaccgagccggcttccatcgtctggaaaagacgaaatcatcaatggaaaaaaggggtccccaagttgatcacgtacaatgacgagtttgccgctttcatcgatgtagcgctcgtagtagctgtccttctcgtcgtcctgaaaagggggtgaaattagaagatgtgcaatccaaactgtgcacaccaccgccacacccaccttgagcttggactgcttctcggtcagcttgccgttttcgtaggcgaagatggtctgaaaaagggacagaatgtttagccaacagtctcaacaatcaccaccaccacacacaccttcaccgtgcgtccatcggccgtcttcacctcgaactccttgttcaggtcgaactcgcagttccaggtggtgaacgtcgacgtggacgtcatcttccagtgctcgccggcgttggacacttcgaattccagcaccggtttgacacagccggcggccttgcgggtgagaaagttgacgccgacctgtgaaaaagaaaaagtgtgggaaatgaatatgacgaaatttttggggagaatcccggaagccagtcagcacacctccttcatgaagtcgtcaaagttctccgacgactccaaattccatttgccgacaaatttctcggacatgttcaggagagaaatgtcggtgtgaagtttgtgaagttggttgaagttaagaattttggcgaattgagctaaacaaaatgtggaaatgcgtgtgtgagcttacaattagtgcaaaaaattgacaggatgaaatttgatgaaaaacaatcttatggaatgaaatcccggaatgaatggaaaggaagcaattctaatcattccggtgttttaaacaaaaaacagaaatcccacatatttattattagcactcgatggcagctttttctgagatgggaaaggggagtgtaatagggaaaagtgattgattgcaaaaaacaaatataaaacaatttgtgggaagagcggaccacaacagcagaaaagtggagagaatgaaatgaagtggaggggaggaagggggggggacgactgatttgtgaggacagcgaagtaggtatgtgatgaaaaaaggatgtgggaataaataaaatgatgagaacggaggagcggggaagggagagaagggaagctgtttgttgtcggatgaaattgacgaatgaacgaaatgagtggaataagtgcacttaaatggggtccaggcatggctgaggggagggggaaggggcgtgccatatgcaaaacaacacacacaaaaacgaaaacggacggacacggaacagagagagagtgggaatagtgaagagagacagagagagaaacgaggagataatgagagaaagataaggaaaaacagcaggaggaaagagagagagagaataaggaaaagagagtggaaaggagagataaggaaagtgagagagataagaaaaaagagtgagaaataaaatgggagagagaaataagaaaagagaatggaagagagaaataggaaaatagagtggaaaagagagaaagaaagaaagaaaagaaagtggaagagaaagaaataaagaaaagagagtggtagatagagagaaagagagataaggaaatgaaatgataaatgggattaattttttggtgggatgggtgcgtccatttaatgttttatgtcttacctacatataatatgtacgaatgtttgtcacttttggttgattatgtcatttttgagtgattagtgtgtgatgggtggtggacaaaggccaaagaacggcacaaaggtgaagggatgacctaatgaccagctcaaaaaagaagcgaaaaccatttgaaatttgaacgtttctaaccaattttgtgaaattcttcttaaattttggcatttttttctgttcgggctcgtttcggcctccatgggttcgaaattcagcccccactcaatgctgtaacagatagaaaatttcccgcatctccgaagccaagattgggaccaaaactattggtaatactatgtatagaatgtacacccagtcccgcccccatttttcgagattttttttttaattcccaaaagtcattaaaacattttccgagggttttcggggtcgctgatcacgtatcatccatccattttgacaaactccgaactcggtccgaattcgcacagaaagtgaaattttaaaatttcgcatttaaaatggtttaataatttttaattgaaatatttcggagttggtcgaaatggatgctggattcgttatcagcgaccttaaaaacactcggaaatatttttcgacttaaaaaaaaaatttttttcaaaaaaacggggggggggggtatttcaaaaagttatgtgaaataggggggtccggctttttgtatgtttttttttaaattgcgacccacgatgcgaattgaactaccacggattgcaatcgagcaatttgaatttgaatccgcgactttttttgagcgcgcccaaccgcccccaggcaaaattaatcaaaaaaattgcgaaaaaacttttctctagtcgagacttagggccgagactcttgaaaaccaccagcgagaaagagaaattctcaagaaatcccatgaaaaatcccacgcggattgcgcatcgccggttcaaattgtcgcggtcgcggaccacgaattgcgcgcaaaaaaggcgagagtcgagacaggatcttaatcacgccgggattttcccgtgatcccgactaaaaactccgaagcacttttcactggtagtcttcactctaaaagtaaccggtgattagcatttttggccaaaacactgaacactcgactacgacggcaaatttctatcccgggtagttttacagtagcgtaaatttaatttgaacacaaaatctcacaaatatcttttctttcgtcgtcaatttgtctgtcgtagttaatcatttccatgccattttatttggttgtgagcgatgactttttgtgccctcttttcccatcatttcgcatattgtctcttctcatttccaatatttatttagttttaattcagagaaacattttaatgttaaaatttgctaattacttatcgctatttttgaatacattaaagaataatcctaacaaatttggtatcattccaaagctctcaattagctaattgtaagtctaaaaataaagggaataaagccgagccgacgtaacaagtcagaccgagaaggcatcgaatgaattcgtgtgcctaaaatctacaa

SEQ ID NO: 7053 - DNA, 1192 bp, Heterodera glycines
  misc_feature (30)..(30): n is a, c, g, or t
cgtgtgtaaatgaccaaaggtattaattancaaagggacgctttgatcaaaaacaaagggaggaggaagagccgaatgaaaaatcgataattgccagaggtggcaaaagccgaaagccttggtttatgcaaatccagcgaatttttgagccctatgtatacttttgtcgcatactgtatacgcaaatgcatatgcaaaagcattcggtttctttgcgcctctggcaacagttatcgattttttgcattcctccggtggcaattatcgattttttgtcggacctttcccccttccccttcctccctccctttgcctttgatccgacgtctctttgtaactcccttggtcatttacacattaattgctgaattgttgttgcatgaaattcggcacataatttttacatattttaggcacattaatttattcgatgtcatgtcagtctgagttgagaacacactaattatcattaattaattaaaaaactaattatcaagtttgcttgccgtgtagtatgatgatggaccacgtaactgaatcaaattccacccaaatctcaatctccccggcacttgcctatcattagcatcggcgcacctctactttcaattttaaaaatcccccccccaccctccccctaccttcggtgttgaatcacagaaaattggggtggtaaaattaggtaatttgaacataaaatctcccaaatatcttacatattttatcatttccatgccattttatttggttgtgagtattccttttttgtgccctcttttcccatcatttcgcatattctctcttctcatttccaatatttattatatgttgaaatttgtgtcttacaattagtcctcgcaattttatttaatccattaataatttggtttttgccaattttaaagatttctgatccgacatctctgatcgcttaaaagcaaatttttcttctgttgtccctttttgctggtgactgttcacaattcttttcggcgttagcgttcgtactgagactgccaattcattgtaagttggacttggtttcctccgtgaaccccaacctaatttagcagaaaaaaactaaacaaacaatttggttcaatcttttttttctattaaaatccaatgaaaacattttgggttagtattttgatgataattttcaaatccctcttttttctaccttcggaaa

SEQ ID NO: 7054 - DNA, 4637 bp, Heterodera glycines
cttgttcatgtatgatgactaccaaattttttaaaacctttggtagaaaacaaaaccccggtcgtttcggtatcaattcctactcacagtgacggcctttgcttcggcccaagcaacgtaagtgctgctgttgatgtttttgctggtcaccaccaccaccaccgttttgctgacgaatgccgttgttcggcgaaaagacggcacagtaaaagcgtttttcaacggaatagcgcaacaatcggtggagcccgttgaccggtggtaattgcagtttagcgaacagttcaatgagcacaaaatggggctcggtgcgcaaccgatggccatcaatgaaaatcatttgggcgggcgaaaaatggtccaaccatcggtcaatgtgccggccatagagaccaggccacagacaacgtatgaaaattggagtgggttttttttgtttcaagaatttaaataaatttttagttacaaggctttaaaacccgaaaatctgtccattatctcgacagtacttcttcaacttgttgaacgcttcatcaccatcataattgacactggacgcgttggagatgaacaactgttcagcggtgtgttgcaacgcgaccgaattgttatgtgctcgcatgtgctaaatgcgtgtgatcaaaaagtaaatatccttcttcctatgaccattaatggaaaaaaaattagaccggaaaaaaattttaggggcagaaaagcaacaacaaaaaaaaaaaaaaaaatcggaccccctcaattttttttctcgttacaggcctagcttgtttcaccaaaatcacatacacacgcacctgataccatgagtacgcccgctgtgcagggtcatcaagaatgacaattagtcgcgcatttggcaccaacgcgtgcaccgccgcgggcgccctcgggttgtcaaaataatttgcagtcttttcaaacagaacggacatggcggcggtgttgttggcaaactgttctgcgtaccattccatgccaagcgcataatttggaccagcaaaaaattggagttcttcaaatgagtggggaatgggcacattggtgccaatgtttgggtgcaacgacaggaacagaccaagcgcactggtccctgaaatttggaatattattattattagtctcttttgttaaaatggtagggtataaaaaaaatcaagaaacccttacgaaaaatttgtttaaaattatttaaaaaaattgtttttaagtggggactttttgcttaaataaacaagaaaacgaggatgcggagaaaagcatgagaatagtagagagagagttcgatgacagacagagagaaaaaagagaggaaacagaatgagagtgaatgaaaaaaagaagaagcaagaatgaaagatggcaaaagagggaaagtgaatgagaatagagaaaggagatgagtaatacagtgaagtatgagacaaaacacaaaacgaaaacgggacaaaaaacaaacaatagaaaataaaaaaacaactacaaaaaacaaacaatagaaaatttaaacgaaaaaaaacaatagaaattaaaaaaacaacaaaaaacaatagaaaatttaaacgaaaaaacccacccgttttctggggacccaaaatgatcagatttggcaatttgattgcactgcaattgtaattgagtggaagcgtacgcctgtgccgttgatcatcacacgggttctgaatacacacattcattcacccatttttatggataataaaatttgaaaaagttggcaccgtgtaaagcaaagtgcgctcattcggaaaccgtttcatgtacaaatcggccacatttttcggtgccgtccatttcagtcgcaaatttgtccaacaaccaacaaatttggcaatgttcataaaagtgaagccgccaagccgatcatttgcatagttttgctgatgggtcatgaaaacggagaatttgttcatcagaatggagctgaacaggtcaccgccgcccaacacattgtgcagaaaattgtccaccccatcagggtaagcgtgaaagaattgggtgtgcgtgaaaaggccacaggtttgtctggaaatggaaaaaaatttcatggtacccaaactgaacgtttattcgaataggaaaaagaagttatggtcgaagaaattcaaaaaaaaaaacctgggaagcaccgtaatatttccatggacaaatgcacgccttccgcttgctggcttcagatgtgggtattctggaggggataaaattgtataaatgtcgaaaatttttgtacaaaaacaagcactctgatgtgagtctaacccaaaaagggtggcaattttaattttaaaaaatgtagtaaattactaaaataggcctagcaaaaaataaaaacaaattctccaagtgtggtgtcaccaggcctaaaaaaaaattaaaaattttcttgaaaaatttatattctccaagtaaaaattgtggtactgcgccttttaaccaccttcggtagaagtgacttggatcgaccaaattttggaccaggcatcgtacagaggctgatagatcggataaacctggcaaatttagtagaaaaatattgcatttgaaaattccatttttcaacaactaaccccagaatgttgtggcgaaacggcatagctcagattggcagaaatgccaacattctcagcaaacacacgattttgtgtcatcaatgcaagcagataatccgcagaaaattctggcggatggttgtgacgccacatgtgcgggaaccagtggaatttgttcgcattgcctattacagacaaaatgtaaattttcgacaaaaaaaaaacaaatgattttcgtttagaagttgtacaaaaaaaagtgcaaaaaaaataaattcgggtacgaaaatatgtcacgaatcagacaaatcaacctcaaccaatcccggtcactcaaaccaaactctaacaaaaggtcgaaaattagtttttttttttcaaatttagggaaaggattcggaaattggttgcaggtcaaaagggtcaccttgctggcttttaataattttcttaatttacgatttcgaaactagcggcaaaatttggaaaattccaaacaatttcagttttcatggaacatgacaaatgctgaccattggaagttacgattacaatgatttttgtccaattcattcaacaaaacttactgacaaggatttcgtctccttgaatttctgccgggtcaccatgacgaaaaaaattgccagaaaagccaagcgtgaaatgaaagttggcaatgtgttcgcgcagtttgccctgcaaaatggacaaatagtccacgtcatccgcaaccattcgactgccaatggcaccaatgaacacatcgtcaatgtcaatttggacaaatctaaaaggaacaacactatgtacaccgaaaatgtttagttactattatacaaaggcaatttttcggtaatgataaagaattgcgtcttcatttaacttttttaggctcaaaaaccagtttcccagggcttttctaagatactgaccacgaagctaaactcggatttgcccaatgccgaagcccagatcagaactcgatcaaaaattctaatttttataatgtgaattatggtaaaaaaatgagtttctgatttttcgttagaattcgggcccggggttcgtaattagtcgacacggatgcctgatcagtgatcagcgagcgaccccgaaaacctattaatttgtattttaattcgaaatgtgaaaaagatagaactgcaaaagagccaattaacctttccaagtcgtcgtcatgaatggcgggtgcaagaaatgtgacggcgtccaaaagtgcaactctaaccaaccaatgttggtttggtttggcaccaaacataacatgatgttcttccagttgtaaagcgatggaaaaacggtggcccaattcattttccgcttccaaaattggattcatatgacttagtgcatgtttgaacaatgtgaatgcaagtttggcatctccatccttttgcggcaccgaatattccgtgcccgatttggcaacattgtggacaggtgaagtgccggaaaccacaattttggtgaccgattgtcgtccaaatgcagtgaaattggcaaattctgtgcgatgttgctgctcctcatcagatggaagttccaaaaatgagatgacaccaaccgaatgacgcgcacaaaactggctcagcacatccttttcagtcgaagaaagcaaatggaaggagcggtaatcggtgaacaccaccaggccaaagcgtggccggtcaccgagttcaagcagtaagcgttcacccggtaaatgcgcctccactaatactggcactttaaaattgttgaaaaaatccaaaatggttttgtgtgtgtccgtgttcagttggtcaggctgaagcagtaacagaactcgttgtgccgaagttgttgcatcgtgccgttgctgtggctttttgccgttgtttgaatgtgaaatggagcggttcgtcatttgctgatttgggcattgataatcggcaaaaattgtacgctttgccctcggctgtgcccaattgacggatgatgacaaattattgttattccgccataaccaaaggaagaaaatgagcgagtaaatgaacagccaaaacaatatgagga

SEQ ID NO: 7055 - DNA, 2741 bp, Heterodera glycines
aggggtcagcgaaacataaacaccggcgcagataggcgtttgcaacaatttgtgacgggagcaaataacctttcgctgcgaaacaatacacacagtcagaggaatgccataagaacattttcggctgtaaaatcccaaaatttcctcaaacaaaattgcatagtgatacaagaggacaaaccccacgatgcattttgccgaggagtgaaattgacatccgaaatttcgagtttaatcgaaaatgaacttggagattcaactcagactgaaatgtctaaaggaaaggatcgggtcggaaaaattttgatggttaacgtagtgacatacggcacccaatcggaagcaatgttggatgggggaacccacatttcactgattgaagcaggatttctttataaattgatcaagaacgaggcttggacctcaggaaatcggacttcgctcgaacgtcagcagtaattgccgatgtaaatgagcaacaattgaaatgtttcggtgtggtaacaattccgatcacacgaaagggttgcaaccaaataccgatctgcttaaaacggaaattgcgaccgtagagtcccagaaatcattttcgacagtgaaaattcaatttcaggcggaaatttatttgtcaattgcaaaaccgaactcggagaaccgaattgttgacaatgactttaatatcggcaaactctacgaaagtaaaatgtggaattgtcggagctcataagtggacacgccgaaatctttgcttcttctgaagaagaactaagccaaaccgacctagtccagttccccatgggcttcaccgatcgttatcaagccaaaaaggacgggacacttcgtttctgtgtggattacagaaaattaaattctgtaacggttaaagatgcatttccattaccgaacattgacaacacatcttggcattgggaggaaggagagtcttttcaacattggattttgtgtcgggctactggcagatcaaaatggatcatagttccatggaaaaaacagctttttctacggaattcggacgacacgaatttttggtactccctttcggcctttgtaatgccgttgcgacattccagcgatttatgacgcgccttttctccgattgtcttaacaaattcgttttcatctatattgatgacattttgatcgcgtccgaatcatgggaacagcacaccaaacatctgaaagcggtttcaaacggatcgaaaacgctagtttaaaattaaaaatcagcaaatgtcattttgcgtccagtgaactcccatttcttgggcacatcctttcaaatgaaggactgaaaatggatatggccaaagtaaaacccgtcctcgaacttccgaacccggcgacgaaaaagcaacttcaatcgcttctaggctttcttgcctactaccgtaaatttatctacggatttggcgcaatgccgcccctttaaattctctcttaaaaaaggacagcgattttgccctcggcgaggtcgaaaagaaagcgattggtgccttgaaaagcaaaattatcagtgacgtgatgctagagatttttaatattttctattctaatcccctcatttttactaaatattccgccgtaaaaatgaataaaaatggttccgggaccctttctcataaaaccgtggtgtagagattttttatattttctattctaatctcctcatttttactaaatattcagccgttttttcagaacacgtttgaatgttccaattttatatgtattttcaatttattgctataagcaagcttttgtgaaattttaagcatgaaaaatcgaagttgatttttttgcgtcacttttcaaaaaacttttcgtgaacaagggtggtcagcggtacctctggagccggcggcggaaaactaggaattttatcatatttttagcagattttcactgaaaaattcttaattttgtgaattttcggaacaaaaataggcttttttctggtttttatgtctcaaaaaataaacaacagagcaaaaaacaaaaactttgcaaagcaagtgcttgatataggcaacgaatttaaccaaaatggttttattcaacttccatccgaatgcatattaccaaaaaattcaaatttggttaatgaaatttatgatgatattgtttaaatcatacatttagtgaattaaaaaatcgtattattctttccccttataatgatttaactgataaccataacgcaatggctttagaaagctttctgtgtatgtctgcgtatttcagtattgacgaagtagaaaccacgaataatgtcccaattacgcctgaaataattaattcatttaatgatccgggtattcctttacatgtgttatgtctgaccacctatcttgactccctttcccttgttgtctctcacaatttctttttccctgtcgctagtcatcccaatttcccttccttttggccttttcttccacggggcgcccgacccgcccacctgttgccaatataaaaatttgggggagagatcggattgatcagtgtgatcggggactttgatcggcttgttgcgaacttttcctttttgcttttacacatatactcatcgctaaataaaccgattgttgaattaatcggagctttcaattggggaatccgcggctttgggccaatgcccctggcattggcccagggcccaaccgaattcacgcgcgcacccatctaacagctgcctcaaatcccttccccctcctacgacc

SEQ ID NO: 7056 - DNA, 3025 bp, Heterodera glycines
caaaacttttggagaggaaacaacgccgaaggagaaaatcaatctaatttttggaggggcaatcccgaatttcggccaattcgccgagggaatttcacgccaaggggattcacaggataccccaggggactcaacacataccgtggaggatttaatccgcgcggcgctaacgctaatttcacaccacttgggaacaatttccaaaggacaaacaacaatggcaattttcaaccgaacttcaaccaaaaccgaaattggccaagaggacgcggaccaacgggccccaacaatgggcgcggaggaagtgatgctgatcgaggacgaactggctggcgcgtgaacgaagtgaatttttctttcatttgtttgatgaccatcatggcggcgatgctcatacccgctgacggacaataccaactatgcccgtccaagccgacagaagggattaccgttaccatgagctttccggaggaacaaaattgcactcttccggtggaaaagcctccactgacggtgaagtcaaatctttacataccaattcggattccgcgagtgtttcccgcatttaaatgctggaatgtgacaacagtcacatgcaccgagtcttttctccgaatcatgacgttggatcatcctgacaagaaaattgaagccgacgcttcagtcgaggactgtcaggcctcaatacaccattcgccgatgaacagagtaagtgagacaagatgggaaagtttggcgccaattcgaaaagagtacggatggtacggcgtgaattgtttcaacaatgtacagacagtgattgaagaaggaaaagcagggattttggatgggaaaagactgataacttcgtggggagactctttaaaaatcgacaaaagtctgggagaagacggcagctggatacgcctgaaataattaattcatttaatgatccgggtattcctttacatgtgttatgtctgaccacctatcttgactccctttcccttgttgtctctcacaatttctttttccctgtcgctagtcatcccaatttcccttccttttggccttttcttccacggggcgcccgacccgcccacctgttgccaatataaaaatttgggggagagatcggattgatcagtgtgatcggggactttgatcggcttgttgcgaacttttcctttttgcttttacacatatactcatcgctaaataaaccgattgttgaattaatcggagctttcaattggggaatccgcgctttgggccaatgcccctggcattggcccagggcccaacggattcacgcgcgcacccatctaacagctgcctcaaatcccttccccctcctacgaccaggcagggccccatccctggacgtttggagtttttgatcagagctcattaattaattaatcacaggggaaaaagggttggggaaaagaaatttcagctaacaaatgccagtcccgggacaagacaaaaataaacacaaatggcaaatcacgagaaaagactaacaattaacgaaacaaaaatgcgaaaacgaattcgaagaaaaaaatgaggcaacaactgacgggaaacattgcgatcacattggcaagcatcatccaatcaacgacgtccaattgtttcattatttttattacaccaatcgacgaacaattctttaattacttcatcacttaatttcccaatcaacaattactggagttcaacaaatcttttatttttctgagacacttcgacgacataatttctttaaattttaaatttctcgacacaatcaacaaaattctggatttattttctaaattctggtgttaatcagcgaaacatattccgacaattccatcaaaaacggccgacgcgcggagaagatcgaattctttagaggaagaagaacaaaacgaaggacaaaccgaaagggataaaaggctttggctcatccaccaaaaaaggcagctgcgtaatatggatttagacgctctgcggcgtcgaattgtgactctcgagcgagagatgcgtgaaaatggtggaactcgccctgggcttccgatgccgaccacatttgacgggacgactgatttgcaggattatttgaagacctttaatttaatcgcgaccgcccacaattggacacccgcgcgatgtgtgcaagttctcccgctgttcctcagaggatcggcaagggcaatttacgagagcatcgaaccggatattaaagacaattggcgaagtctaattgatgccatggcggataagttgaaacaaatgtctccgagtctgacagcaagacagaaattggcacaacggaaacaactgactggagaatcgctggaagaattcgcgcaggcgattcggaacctcgtcttacgtgcttatcccgacaattctctcgagatggactttggaaatttggtgctcggtgctttggaaaatgatgtgaaacaagcaaacgaagtccgacttcgacaattccgttcggaaattgcgcgagatttttttcgggcaaatatggcaccacgactgaaggaaagagtgatacacatggaagaaccgcaaacgctcgaggaagcagtggcccaggccagacgtgttgaacaagttcaaggaaatttggccgatgacatgtggaaaaatacacaagatgcaaaagccgaagttgctttagctgaagttaatgcagtgcgaaccgaattaaatgagattcgtgaacaacaacaaaggacccgagaaaatcaaggacaaaaccagagagaatggcaaaatcaaaacatttcttggagaggaaataacaccgaaggacagaaccaacaaaacttttggagaggaaacaacgccgaaggagaaaatcaatctaatttttggaggggcaatcccgaatttcggccaattcgccgagggaatttcacgccaaggggattcacaggataccccaggggactcaacacataccgtggaggatttaatccgcgcggcgctaacgctaatttcacaccacttgggaaacaattccaaaggacaaacaacaatg

SEQ ID NO: 7057 - DNA, 977 bp, Heterodera glycines
gtcttccaggcttttcattgattggccaatctgaaagggagtggtggtgccgttatgactccatcttaaaagcaaaagcggaagaagcgatcgcttatgcggaacccaggtccaggtccgtgcctttttcaaaagaccaatcactgtgtgtctctgtaagttttgtgtgccgcacttttatgtaaaagtgaaatttaatttgattgagtttcggggacgggggttcaaattaggcaaaatgaatgtcagattcatgatcaagcgaccaaaaattgtccaaaaaatttaatccaaaaattctttgactaaattaatgaatttctatcaccaattgaccaaatatcgtagcctttttaaaaatatacggccacagttaaagcgctaatggtttctggcatgtgccaaattgccctgcgtattctcaaatggcctaagtcaagcaccgtagcccctcttcgagtacaatgataaattcttcgttcgattcggccacaaattgttggcctaaagaggaaaaagctgtaattgctttttaaaactctaaatgctttaatttgatcaatataattcaaaaaaaaaattctcacattttttgcaaattggcaaattcattcatgacacaaaatcacaaagctgcgattgtggctgataagactttggctagagatggtttttctaaaattaaaattaattttattattttagacaattaaaaattaaaatattaaaaattaattttacccttttttcgacattaaacgcaaagtccaggctcaactttttccataaaaatcacacttctgctggcaaaatgaataccgccaatgaagaaaaaagcatccgaaggtggcgaaacttaataaatttttttaaataaattaacattttaaaaatgtccgcttaaaacaatttttttaattatttgactgtacgaattattaaaaaataatttacgaatgaattgacaaatgaatgaa

SEQ ID NO: 7058 - DNA, 5412 bp, Heterodera glycines
ccggaaaaatttttgaaaaattttatgcaatttgctataagattttgtctaaaaatgactaagattttggagctaatgtttaaaaataattaggaatttttggggcgggcagtgccgataagcgccgccgaggaaaattttttttcaaaattttaacgaattttgttaaaaaatagcaaatttttagcatttcctcttttcccctttgctagcctcccccccccccccgttatgtatgttaataagtagggatgcgatttttaggttttaactaaattttttgctcgattgatttgaagaaaggagctcaaaaaacgcatttctgcgttaaaattttttcatttggacgtcacttttcgtcactagaaatcactattttggcgacttcgtcactaaaatagttaaaaatcactattttggcgttttgtcactattttttcactatttcaacattttttggaaaattccttaacaaaaacgcaataaaaccaaaaaatacacccctaagaatcgacataaaaattttcaaaaatcactcctaagaaatgaaaaatttttcacaaaattcactttctttgcaaaaatttttaattctaaaaattattttttaggaacctattttgtattttttgccctcaaaaatcccagtcctactcatttgcaactgcaaatagtgaataaaaattatttttgctcaatttttggctgaaaatttgtcactattcgtcactatttcggactttttggcactattttctcactattttggcatttttactcactattttagttaactattttgggatttttcgtcactaaaagtcgcatccctattaataatactacaaattaccaagaataagtcagattaaatcgaaatatgggtagccttttaataaaaatagaaaaaaaaattcattttataaaaaataatcttgcaagaaatcgtctcgaaaaataatctaaaaagccagttacggatcaaaattacggaaaaatcccaaaaatccgtaacccgtaatccgtaactccaaaaaggccgtaatttccgtaatccgtaatccgtaattacgtccagccctgatagggtgtctatcttcccagattcccgggaaattttttcaaaattaatttattcttctgcacttacaaattttacgctaaaatcttaataattcttttataatataagaaagtataaaggaaaatatttttagaaaaaaatggtgatcattgaaattgtttttaaattaatttcacttataaaattaactcagggatgcgatctgtcctgatttgtaagatttgtcctgatttggagggtccaaatctgataaatcagggatgcgaaatgtcctgatttatcagatttgtcctgatttggaggtagcgatcaaattttgtcctgatttcttaaataaactcacatttttgaaattttatggcataatgtcactattttattaagaaaataaaagatttgtggcaaaatttggttattttttgacaaaaatctgttaacaaatcgcattaaaatcgcaaaaatttttccccgcggcgcctatcggcaccgccggaccctccgtccatcctccaaaattttttgaaaaacgcgccgcaaaaaaagtgttttaaagcaaaaaagtcgtcgcttgacttaatttaattgaaaaaattggccttttttggtgaaagtctattaacaaatcagaacgaaattacaaaaaaattttccggcggtgcctaatagcaccgcctgaccctctcccctcgcccattcctcagaagttttttggaaaaattacgccgctaaaaaattgcattaaaatttataatttcctccccaaaattgttacaatcgttaatgggaggtgaaaaaatataatatttaatacatttttgattgaataaattgtaaaaataactgttttgaagcaatgaagcaaaatgccctgattttcgaccccaaaatctgattttttgggctcgatgttctgattttgaaaaattttcgatcgcatccctggtataaatacaattgattttttcaattttcgcacatttttgacattttttttttgtttttagcacatatatgtatttcagcattttttaacacatatttcatgatttttagcactaaaaatccgagtttaagtgataatagacccgaaaatttatttaaatgtcaaatcaatcaacttcttctgctgctgctgccggatcgacggcgccgccatcgccttcgaacgaagcttcttctccttcggccgctcaagcgtcaagtcagtcatcgtctgctgctggtgattcgtcagcctctcccaatggaccgcgtcttaagccgcgtaaagtgcccgtcaaccgcttcagggatgttcgtccggcactgcagctgcgactcagtcagttgaagcatccgttaatcaggaaactggagcaggacaccggcattgaccgtgagagggttcgtctccaactccaaacatttccttcccccatcataattcccccatcacccattttcagctcttttacatggctatggcatatttcgtgttcctgctcctgttcactcagtgtaagcttctgctctccactctcattggttggcatttcgacacaaatgccatcctttctctaattcctccccttttatttaaggctcagtctatcccgcctatcagagcattgtgactgtccatactcaggccaaaagtcagtgttattttgtggaattcccaaataaaaggatttgaatttcaggcgaagagattcagtggctcacttattggtgtttgttctctctgttttctctgtgtgacatttccttttccgtcgcccttccgttctatgcccttgtgaagacaatcattttgttgtatttggctcttccccaaacttatggtgcgcacaatttctacgtcatttacgttgacccgctggtggaccaatggatgctgatggtcaacgaaattgctggctgatgcaatgtcatcatttgtactaactaaatgcccagcgaattatgttgtttatttgtcatataatttcatattaaaagatgggtgattaaatcgctttttatatttgtcgtctttggtggtgaattttccaatcccaaaatttgacttctccaatttgtcctgactttcgagaaccaaacgcaattttgtgttcagataggaaatgtcgtcgaaagatgcctccaatccctgcaatttgttcattaaattcccattctcttctggccgaaagaatcctttagtccgttggcgaattgagtcttttcttttgaacaaccaattttgtgctccaattgaggccaaatcagtaccaatgtgcttccgtctcgggaaatccctccaaattataggaattatcattatcttattcacaatttttgttttgccacaattccgtccgatgtgctgagctgatcagtgttttgctttgccattgtctgattaaatggctcaacgcagaaatcaatgcatttggacaacggagaaaggcacgaggggcgggggacaaaatgattttgggaattgtaagcaaatgaacggacgaatggcggggagaaggaaaaaagcgacggaagacgaaaaagcggagcattgaaattcgaagggaaaagagaaatttttgatctaaaatactcaacaaaaaggcttaattaaatcttcccaaacaaattcatatttgttcgtcagagtcgcctcgcgttagctgaaacgaaattggctttttgtgacccgcggcaactaacattggtctaattagccttaatgattattgctccttaacatatgattattgccaattaatcactcattaatcaatgcgaacttcgtacaacacttcgtaatcttcggtctgatcgtccaagtcaatgttgcaaagctgaagcactaaataaaataaaattgcgagtaattttaaacattttcactaattttaattcattccattttatttcgcttttccattgatttgtctctcacttttcacattttccgtgcccaattttctgccttcccatttcgcttcttcctccgcccaccatttgataagcttccgatcactttcactcctcaaatataaaatcgtcgcgtggggcacaaagtgcgactcgttaaacgggttcagcgacggaatgccacgcgattcgaactgattaatggcactttcttaagcatgagaaaaattcaatttaaaattcttaaaatatccttttcaaaatttcttcagaaattattttaaaaagcatcagtttactgtgcagtttgatcaattcttcggcactttgctgctcaattttggcgtacatcgatgcttcgccgttgtgactgatgccgttgaaatgggccttcatttttaaaaaaatctgatcttccttcccattaaaatattattaaatagtttaaattaattaaaaatgaattgattcctcaaaaaccaaataaattaccaccaatggttgagcaaaatgctgcacagtcgcagcgagagcatcacaagcgctgaaaatcacaaaaatggacggattttatgctttttaaaagcattttcaatgtgcaaacaaattttaaagtatgttttggttctacaaaccataatcaatttgttcaaatattttaaaaaagacaatccttcataattaatcatttgctaattttctttaattgggcaagcgcaaattgcataaaaatgtgtaggtttgttgtttattttacaaatttggtaatgctaatttaacatttctccttttgcttctttttttactaaatcatttaggatcattttctactttaattgattaggtttctaattatcgccttaatcggtccatcagattttttcttctcgggaaagtttcttcttctttttttgccactacataatttatttatttatataaattgacttgcttttggaagtttgccttgtccaaatggatgagaagaagtgtgacgtgcagtgattggagtggttgaaaagtgtgcgaaaaatcggagtcaaatcggagcaattcgttttggatggctttgacattggacacgacctttttgggttgggttggcaaatgtttgccattttcattttcaaatggtaattaaccgattgatacaaacccacttcagcatttttcacatgaaaagttacaaaagcagttgcaattttccggtcgtaattactcattaaacatttaattagtattattattttaaaaattaatattttcactataattatcattaattaatatttttgaatgtgcaacatttcttttcttttcttttcttttcttctcatccattcttttctttcgcaatttatttctccgtcgatgagacgtgaaaatcaatgctaatgattttgtgcgcaatgcttcatcacaaactgactaca

SEQ ID NO: 7059 - DNA, 1707 bp, Heterodera glycines
tgacatccattttgactaattacgaaaaccttttacccgcactcgaacaaaacatagaattctaaaccgagttagggttagggatacagaaatagtaaaatattcgaacaattagctatgtaatattgggagaaatttatgaaatgcaaaaaagagactgtgaaaagcatggcctattatttttatttaacaattattttatttgcgtttttttaatgcttaaaagaagagagagaatggatgatcaataatatttattatttattcgattgctggaaataagccctcctattcgtggaaattattagaaattttcttgaattaaatattttacaaattggattgtatttaaattgaaaggtgaagagaactttcgaagcgtccttaaatgttttaaattagttttgtctgtccttggcattcatttgaatttgtctatggaatggcaaggacattctcatatgtccttggacattgttattaagcatcttaacgtgacggatatagaatttttactatgcgaatatggacagtttcactaattgcattgacttttgttccttcaattttaacacacaaaaatttcttgcctcctcccccctccgtaccaaatgtcctttaatttcttaactgcccttgaatttatactctaaaaagttgtcttcatatgcaaaattgaaaatggtacatgtataagtaatttttgtccttgaaaattgaatgggattttttgatgcgtcttacattttatttctatgtctccgaaattaaataatttttttttctaaatcgcttcccctcccgcgaacatccgtcgtcgtctttttgcctttaaatttctgtccttaaaaattgcaagggtcgtccttcctccaccaccacctgttgcttctgctcctgctgtttctgttgttcagcaaaaagttaaaaagttccagcaccaaaagcattcaacataaatcgcaaacaaaaatttgtttttaacttcaaaatatgctctcttaaaatattgaagaaggagcagcaaaattttatttttttcgctcatttggaggcggaaaaagggaagaaaaaaggagccgagggggggggggagggttcaatttcaataacagaaaagcaaaagcattcattccgcccgcccgccccgccccgatcggtcggtcggtggcgatcggcgccgctggcggcggcggtgaaaaggttttgttgtttttgttgtttggtcttccccctctcccccccccccctcggggctcctcacccttaggagctgaaaagtgatcagtcatcattcatccgtcatacacacacatttatacatacatatgtttaagggatgggggggggaggaggagggagggtgaaagaagaagaagatgaatgaatggatgaataaaaaagggaagagaaagaaacaaacggaacggaacgctccaccgccaccgcacgcattggcaccacccgcggcggccattgctgcggctgccatcaaaaagccgcccgcatccgccgacgtgccgccgcctacggttaccggagaagcaccagagatggcggcgttgacggtgccggcactgccaaacggaaaatgttgcgacgcagcggtgccaccaaacgcagacacaacggtgggagacgaagcggaaaaggcaccggcggcggacgaagcggtggccaatgctggagcacggacatcaaatccat

SEQ ID NO: 7060 - DNA, 3955 bp, Heterodera glycines
  misc_feature (42)..(42): n is a, c, g, or t
  misc_feature (3863)..(3863): n is a, c, g, or t
  misc_feature (3900)..(3900): n is a, c, g, or t
aatgtgtgtaataattcaaatttgtacgtgatcagatttganggcgctaattagattaaagtaattaggatgaaacatgggatagcgattagcggatgaaatcaccatatgattaatgttacttagttagctgaccataaaatttaggcgattgtaaaaaatttgattttttattaggggtgatgatgattgaaaaaagggaaagtgtttaattagggtaattagtgacaaaatgggtggcagtgattagctgataggatttaagataatattttgatcatattgtttgaattggaacattattatcacactgattgaccagccgggcagattaatttgacagtgccaaaattagtagaagtcgggaccggaattgggaatcaggccaggatagggttactagatttaaatccattttgtcgggatcctgatcaacatttttcagaataaatcgggacaaggatcccgggaaaatcccgaagggctccccgatcccgttcggtctccaaatatcagtaacctatgacaatcctcataaaaacttgatcaaccacccattagcagagctaataggcgtgaagccccggggccacctgttgctgttggtggatgagtgacgcggcagcagctgcaacattagcaaattgctgttgattctgttggttgtgatggttttgttgctgttgcgggtggttgtgcatgcccagcggagacgacatcaaagagagggccgccgccgccgccgggcttgccggactggcagcggccagcagttgtgccgccaccgaagcggcgaccaccgacgaattgtgccgttggaattggctggccagcagtgccgcagcggccagctcactgttcgcttgttgttgttgctgctgatggcattgtgccgcagcagcggccgactgaacaatgataattaattaattagttaatgagaggggctccgcctaaattgggtcatgataaggtaaaatgacatgcttaattggtacccggatccaggcctagatttttctggatgtttggtccaggaaatccagttccaggctaaatacgaaaaacctggatttcctagaccaaaattttgaatttattattacaagtgaccgatgttttattttgaaaattatcaaaaaccgaaggtaatccaggtccaggtctaacatggaatccaggttcaggtccagctttttcaaaataatcgtctctattaattggataaaagtttccaaaacaattgacgcttgaaatcgcagtatcggtttaaattttttttgtaaaacatgacaatccaattcaggatatttgtgagaattatgagcccgagactctcgagcatactaattaaaaaattctttccaaaattttccaaatgtgaatttaaaaaaaaattcgaattccacacaactgttgatcaacaagaaactcaacctgttgctggtgctgctgatgttgctgctgcagttggagcagtgcagcggtcgccgctgccggcgacccgggcccgaacaggctgtccagcttgctcagctgcgactgcacctgttgctgttgttgctggtgctgcatgacgaccgctgccgcggcagccgcagcggctgctgcggacgcgggcgattgcggtggcatagccatcgccgcccgccggtgatgacgcggcggctgcggtcgctgccgcggcaccgatcagttggctgagcgcggccatcgtggtcgctgtggatgccgctgccgttgacgtcgctgaggatggcgacggttgcggtgaaatttggtgcagcggcgaatgttgcagcgagtgggacggcgtcggcggcaacagtcgcgcgaaggcggacacgctgcttccggtgctgctgctatggctgggtgccgcggatgatgttgcagcaatggtagcggacggttgcggcggcgcgcaaccgccgacaagcgaattggtgctgctgctgttgttgtacagggcggccgcagcgctcagctgagcagcttaaatcggaaaagggaaaatcattattgactgatttttaaatcggaaaagagaaaatcattattgactgatttttataatagctatgaatgaaaacaaatcgataattattgattgattagggatctatgaccgaaataggttgaccaatcaaattaaaattcggcaattattgatcgagaaaaatgcattgatcagtcacatttgatttgaaaaactattgattgattgtgctccaagcagaaaatgtaaattttctttgatggactgatcagagaatttttttatcataaataaatttattttcactctgatcagtcatggaaaggctgcaaaaactcgatttttttaaaactgatcgggcagagaaaataaacgaaaaattttagcgactgatcagtccaaaagttttagaatttaaatgctaaataatgggcactatgaaggtaatgcaacattttgaatttgaaggccattacgaactgatcagacatggaaactggagaaataaaatggaaaaatttgcaaatttactcttgaaattagtcaagcaaacaatattttatggtcgagaccatgattatgtgatttgatcagattgcaaaatatatagcaagggttaattcaaatagagaaagtcggtcttaaacgatgaaattaagaaaacaattccgcttgaaagcccccataaatatgcactaattaggaaaataaattaaacggcttgatcaagactaattagtagggttagaaaaaatttagatataaaatcgcgaatattgacataaaattgcaaaaaaattgctataaattttccaaattggtgggttaaatttctgggctttcttcaaattcgctaaatgtaagccaaaaaatatatggatttattcatttttccggaccctgctaattagggataattggcttttttattcagtgatctaatcaaatcatccaaataatttgatcatagattcaaaaggtgcatgaatgagaagagaaaggtgaatgaatagagttattttaaaagtttacaaaaagggaaaaaattcgaaaaactaattagcactaaatagggactacaaaattgtcgcgaccgtccgtccgtccgtctcccgccaccccaaggttatttatttaatggggaatgggggtgggcaaaaaggatcccaattaaatgttgctaaaatgggcacacaaattgagcattttgcgagtgcgtttaaaatttcttttttatgcttcgccaatttgctcaagggcagaaaaaaaatgtgaatttgaatttgcgcagtgaaaaggtgcagaaaattaagggacaaagtttagtttgagtgaaataactgaaaaaagtacttttattatcttttggtaaaaaatggaaatttaaagtgatttttgtaagatttagtaaaaattgattattattattattaatattttcataatattaatattattactaacatctaaataaatttaattgtaaataattaattaaatttcccaaaataataaaatattaataaattaaacaaaaaataaattcaaaaataaaaaaattcgcatatttttaaacaaatactaattaaaataaaaaaacaattcaaattttgtcaaaaagaaaattaaaaattgaaatattaaaaaatgaattaaaataaattagaatgaaggaaaaataattataaatgatacatttaaaaaataaaatgatacattttatttagaatgaaatgcacaattttttgctttatgttttgccgtctcgccacatcatccgggcgccacccgcttttcccccctttattatgggcggcggcgccgataggccgcgcgtcctcccccgcgggccccacaaaaaggnccaaaaatgccatgccctcctcctccccatccccagngctaacatatccggcgcacaaaatgccacatgtgccaccagcaaaaaaaaatatg

SEQ ID NO: 7061 - DNA, 967 bp, Heterodera glycines
  misc_feature (950)..(950): n is a, c, g, or t
gaaaaaatctgtaaaaatttttaaaaatcaaaaaatatatgcggcttagggaaagtgtataatcctaccaataaacatatagccgatatatgcatttttaaatctgcattattacaaatggatctaattaaatgcttgaagaaggaaaaataatatatattttaaatacaaatatgtggcatatgcaaatgtctatatctatataatcgtaggcgttattaaaaaaacgtatatgaaaggagagtataatgccattcgaattggcaatctgccaagactcgatacatacgggaatgtgtattcagtttgttatattgggaatttttgggatcagtaatatatatcgatcggtaccggtttaacgacatttgtaggaggccaatcactgtgccaatttccgactttttgtggcatcggaccccggttttggattcctgatcggtttttatgcgtcgggagttcgaaattttaaaaagatttttagtgcaagaatctcggggcttcaatgccattctcgagactctcgacgggtggaaattcagtgaggctgaaaagtgatcaggtgcaccaattgcccctcccccggatcagttcctcctctgatcagtctccccccccccgaaatatttatttaaaaaaattttaaacttagaaatttttcaaaaatcatagaaatttttttataagaaaatttcaagaaataaagtttttaaaaaactattgaaagaaatttttatgaatggtgagaactcacccaaatttggtgggctggccgccaccgcagctgccgcagccaacatttgttggggcgagaacggactcaactgctgctgctggtggtggtggttgtggtggtgcgcgactgttgccggtggtgccaaatggtggtgattttgatggctataaaaaaaaattaataaaataaaatccacccaaattgtttgaaaaantatatttaaaatggtaa

SEQ ID NO: 7062 - DNA, 2342 bp, Heterodera glycines
atttttggattttttttgtttattcagaagaaataaaatgtccaacaaaggggtgaccacttacacgttagttagtaaattagtcaagtccaaggagcgcttttacagacaaaattttttgtttgactcaatccatttactcataccttttttgaaactgtcaacagatggagcatctgttatatctttgttgagtttggaccatattaaggccgttctgttgataaaagaatttgaagttttttagtggattgtgattttaacacaactttacgtctaagattgtaggggattcgaccagaaaattgaggaaatatttccttttaagatgtgtaagaccattaatgattttgaatgcctgaactaaatcaattgtttttctcctttcttctaaagtttgaagtttgaataaatcaagtctttgtttgtaaggtatgtaaggaagtctgcatttaaataaaggaatttttgtaaaatatttttggcatctttttaatttatttatatcttttttgtatgtcggattccaaatttcaggcgcatattctaaaagaggatgaatatatttttataaattttggttcaaatacgtatagagctggattttagaattttggcaatattaagaatccttaaataagcagctttagtaattttagtataatgatagaaagccttaatttattatcaattaagatgcccaaatcactaatggattcacctcattaataattttgttgaataatttatattgttgttttggattatttttgctacgaaataaaataaatgatttatttattcgtaaaaaataaaaaagtcatcagaagggcgaaaaccacttactctgacgactgttcagataatgtgtcgtagagtaagtgataaaattttgcttctttcatcacgtgttttgtaagagacataaaccaagaacagaaccctgtggaacacctgactgaatcggatgttaattagaaaattgattgttaattttaactctataaaatatatcctttaaaaattcagataaccaagttagcagttttcccttaatgccaatgttattaagtttattaattaatatgttgatgggaagagaacaggggtgcgaacgaaaatttaccaaaatcagaacacctggctcaaaaaatcagatttttaacaattttttgcggcgcatttttccaaaaaacttttgggaaatgggcgaggagagagggtccggcgcctgttttgtaattttattctgagttgttaatagtagagaccgagatttccaaaaatgccggacaggacaagggctgatattttagaagcaaccggtttccgggtcggcctcttaaaaaccggtcaaaacggaaaaccggtcaaacgggatttctccaaaaaatcaccggaccggtttgccgggtccggtaaaaaccagtaccgggcccggcttagtcaaaaacattgggaaagtaaaaatgggtcatcctagcagattctgaatttaaaaatttaagattttcgactttgttcgagttctgttctgggattcgaaataggatcaaaatgaatgccagattcgtgttcagcgaccccgcaagccttaagaaacatatttcagtgacttaaaaagttaaaggggtcctaacatcggcagttctgggggaatgggtcatttttgcgccgacctttcggcgccagctcgagttttttgactataacttttcattttcgacaagcccagcaaacttttttttgttaattgtcttatctccaagcaatagcttagatacagcttctaaatatgtaattaatatttttacatgtttatttcattttactcagtacactttttcatctattgctagaataatcggcacaatgaaaaggcagaaattaaattgaataaatattaaaaaaaattaaagtgcaattaaaaaaaaactagaatcgtacgggaccgggaagggatttccggacctccgaagtcccggtcccggattttgaaattttgattttcttttttatactcagttggtttcctatcgacaaattatgattcctcatagttttttttacttagggtggaacataatttttgatacccaaattttttttgttaaaattttttttttaaatttcaacaaaacacaatcatgattcaaaatacccgccattattatcaataatatgttgccattattctggcaagagatcaataccaaaggaaaagtatttagggagttagagttaagtaagtaaaaatggtcattttagaggtaggtatttttgatggctgatttaaagaaaaataaaagagatacagagccagagaaatagtgattaaatag

SEQ ID NO: 7063 - DNA, 4422 bp, Heterodera glycines
ctctaaaatcattgcaggtattccgccactcgcacttttgcctctccaatttcgcgagccgattggaatttctggagggaaaattcggaatattaattccattttgatttttcaataacctcaagtaattcgcatgtttttctgctcggatccaatgggagtcatttggtcgatggtttcaaagaagtgtcagagagtccctattgcaatttatcgaacgcaactgaaaatattcgataacgcaaagcaaaactaaaaaataataatgggaaacgacctgaatactgggcatccaaatgttgcaattccttgcacttccgtctaagctcctcaggaaggtgttcaagcacttaaattcggaaaattatatccacaatatttaaaaaaccttcggtacttttctagtttatgtggcagtatttcacatacctttttctatatccactaattcatacttttttatattgtcaaaactttgtctgcggttttcatggggtacatgtacagtttacaccccatagaattttttttaatgatataaacgtgtttcagggtgtattccgattgctgaaagatatcgataattaaaacaatatccattgtactgcccgaaccatatgagaaaggaatagaatgtggacgctgactgcgccaatatgttgtgttctttggttgtgagaacacaaacaccaatatttattgaacacaataaaataagtcagaagcgaataaatataataataaaatagacagagaaagatgaatggcaaatacggactgaatttggaaatgactgggagacggacaaaaagggaagggaaccgtcgctatttatgcgcctcaggcaagagagagagagtgtggaaaaataagagagaaatgactaaagggaagagagcgagagaaaataataatggctgacaacatcccaacatctccccctttaatttgtcttcccctgtttgacataatcatatttggttttggtcacttccatgtccaactgttgtggggcttttctttggcgcgtggaccgtctcggctcaatcggctgtatctgttcgagcggttcgttctgttcgtcagcgaaccgaactctgcgaggtgatcggtttggtgtctccggttgctgttcgccttgtgcctgattgtcaatgcccaaattttccttgtatggaatgggatcgaatttctggatttggtttgcatgacgggttacaacggcatgcaattgtggcgactaaattcgccaaactacaccttttcctgacacaattgtccctcgcagccacgtttttgaagggccgcgataattgatgaattggacaatgtcaccgatggataagttccgatttcgtgctccatggtgtttgttgaattgtttcgccattttctgttctgctcgtttaacacgggtccctgtttttgtttttgggaatttggtttaattaacgatagaacagttcgaacgggccgccctaagaacaattcggcaggcgtacgaccatttaaacttgcgttcggcgtggtgcggtacgcgagcagtgaattttgtacccaatgtggatcgtcatgggggtctgagtgaaaaattagtgaagaaaattggaatgaaaggaaaaaatttaaaattaatattctttaaaagtaacacttccaattgtgcgcaaaggcctactggctagtctccttgactttcccttctgcttccccatggttcaattcctctacagtaattaaaatatttttatttttttgtataatcatgggttttctatcgacaaaatatgattcttcataatttttaattgtctcatattttgtcattttttaaagaaaactcgtacaaattgagcctagtaatcccaaaaaccagcctttttgttgaaaatctgttaacaaatcacaaaagtgataagaaaagcaaactgaattctaatattattcgatcatttagtccgaaaatgattatttgtttgaaataattgaaatatatttggtttgaaatattgattaaatatattataattaattttgctttaactttggattttaaaaataaaaaaccaaataaaaaattaattatttatattttcgcttgaaataaattaaaaattaaggcttgcgcaaaatttggtaatttttttgacaaaaacctgttaacaaatcgcattaaaaattttcccgggacacccctccccccgtcccccaaaatttcctagaaaaagcacgccggaaaaaaacgtttttaatgcaaaaaaatcaatgcttgtctattaattgcaaaaattggcctttttggtgaaaatctattaacaaaccagaaccaaaataaaaaaatttttccgacggcgccatcggcaacgccggaccccctccccccgcccactcaccaaaacttgtttggaaagatgcgccgcaaaaagaatgttaaaaatcttgttcttctgatcccgaatgcactgaaatttacgatttgctaatttcctccccaaaattattgaattcgataatgagagacgaaaaaatataatatttaatacttttttgatcgaatcattttaaaaataactgatttgaaacaattttgcaaaatattcttataagcagaaactattaccacgtctaaccttaaattagacagttgttgccaggtttccatatttacattttttaattttaagtgcatttgggttttttaaggatggaatcacagctcgtgatttagtatttttttaaaatttttttattatagttcacgatgaataataattggatgattagtgagtgagatgttttgttttccaaaattcatttggttttaaaatttttttaacaaatttcatcaaatcatccacaattttttcttaaacggcaaatttttcaatttttcctttcattccttttcattttttgacaacttttgaaataaaagtgcctatttttggattttaagacttttgaagtcaattttttgcactttccttccgtctgtccaaaacaattaattaattaaattgcatgtaattatttactaaatgagggagtaattcttgtgcttttaattatgtttacgatcattttcgagtttgtgatcacaatacagaaattattattcattattaaacaattaataatggcaaaggcaaaggcttctcccgcatttcttccgccaaagtcaaagtgattcccccgccgcccatcgtttggcaataaaaagggcaaattgaaaagaagcgggagggagggggagaagaagcactaaaacattgttattattattatattattattagaggtgttttaaagagacaaaacatagaaaaaagcagcgaaagcgcagacaaacgccgtcggcacaaaacgcacattttatccgatcaaaatcagtttactgacaataaagttgcatttgaaatataaattttaaccaatgaataagccaatcgatggcacgtcgtttaatggcaaaaaacacagaatttaatttatggcttatagactagggcccagcttcctctctttgaaacctttatttaatcattaaaaaagtagattacatactattttaatttcaaaactttaaatatattttttagtcaaaatttccaatttataattatcacaaatttaaaaatgtaaaaaatgctattaagattattgttaatcgattcttgcttttgtctgccaaatgttcagcaactttttttgcctcgtaatagtggcactcatcggaatggttcagtcaaaatttcaaaaaaaaaacaaacaaataaattttgcttattaagtaggggggggggggggtttccaataattttataatttttcaatttacaaatggccaggctcagcagacattgcccggcaatgccgtgctcgcgttcaccactccgtcgacgcccttggccaatcagacgctgatcaaagtggccatgatgttagcccaaaataacacggactacggcctgccacggaagaatgccgcactgcgcgattcggggggcgcaattccaatggcattggaacagttgtgggcggacgaaatcctaccaaaaagcgtcaatttttcgtcagttaaatattttaaaattaaaaaaaaatgaaattaaatcaaagatttcaatggcattacggcaattgcaacgaggcgtcggcaatgggccgaatttacaaatatgtgaaggaattcggtgccgacgcaatcatcgcaacgccgtgcatggacggtgaaacaaaaaaaacatataaaaataataaacaaatattttaaataattaaaaaacattgttatttgtcacagtgccaccaatgcttgggcatttggcctccaatttcaacttgccaatgatggtttggggacagagcatggcgtcggtgtgagttgataaaaaagcccggctccaaattgggcttagcact

SEQ ID NO: 7064 - DNA, 6247 bp, Heterodera glycines
cggtcaatttgtccgggctaaaacgggcttaaattccgccagcgaaactgcccaaaatttgaaaatttaaataattattttggcgaaatgtcttaattcaaaaatttcaatagaactttggatttttgaaattttgggcaatttcaactgttaaaaagaccccaaaatccatacgaaattgaacaacattttcataactttctttttacaaaaaaaaaatttcaaatttcatgaaaaaccaaaaattttcttaataaatttcattaaaagtcaaagtttttcttcagcgtcgcctagtacaaaaagctaaatttttttctaaaatgtagctcaaaatagcaaggttttgtcattttttcgtgtaaatctgttaacaaaccaaactcaaattttcaaaaatttacccgtcggccctgtcggcactgccggacccccccccccccccaatgtcgtcaaaatctttttgaaaaatacaccttaaaattcttttgaagagtaaaaaaggtcgatttacaatggcttgacatttctaagctaaaataaaggactataaatttttttcgaatttttaatcaaaattccaaaaattttgaaaaaagcccggtcccgtacgggcgcccggtcaaaattttggaccgggcccgggacgcccggtaaaacgggctttttttgaacgggcggcccgccccggtcaattttcgaagcccggtcccggtattttcaatcaaaattccgggctctagtagacaccccaaaccaagcggaaaatgcatttttcgtgcttaattctgtgcgtattaagtgcgcaggaattttaggcatttgcctaaaaatcgcatccctaattattaatattaggtaaatatgagtttgtcatatttgttttcaaaaaatgagaaaagcaaagaatgttgccgggatcgaaaatggatattaattatatagaattgactccttctggatctgtaactaaatctgaaagaattttttcggcaacttccctaaagagttacagaggactaaagtatcgttaaacgcgcaaaaataagttttttgaatcaaaaaatcttaaaaatgctgagaaatgcaaactgaggtggaaattactgagcattttggataagacaccgtacactcgactaacggtggccagttcgtgtcccattacttgctccaccatcgcatactcgccattggcagccggccgctcaacggccccaaaatgaattttaattttttttttttttttttaaatcctaattagggaaatatggtaatgaacagggaacggatttctaggttttcaccttcttttttttgcggatagcatatggtgagataaacgcaaaaaacatattttcttcgaacaattttcgatttagagtgactttagcaactattttcgcttatgaaattttttaacaactaatttgcctttacaactacaaacagtggtttttggtatgttaataaatattttttcatattgaataaatttaattatttgattttttccaccattgtatggaggggcgggggcacattaaatttttcttgtccattttcttcgatgtcattgacaaaacattgggaggagaaatgctgagctaacattaataggatggaatgacaacggatgagagcgctcctatccatcacaatgagcccagacgactgactctcccctgccctatctttcatcttcatttattccactttattttatttttacaaatacagttggtaatagctttgccctcctcccacccctccattttcggaaaaatattggttttcaaaagctgtcaaagcatattcgtcaaaaaatgggctcccagatgtggtgatatcagcattttgactgaacgggtcaaagatgatattagaaaacaaaattggttcattttatatctatttacaatttttgtattatctcgacattaggtattttatttttaaaatgtaagctttggtaatccttcggaattggtgtcccggcagaaaaaaataaataaaattttcttacaaaatcacttatgctagggtaaaaaaggcgctgatcacgaatccgagttcgggttttgcaaaattactgattttgtcaatgatttttcatcataacatttttacagaataatgaccacgggctcggaccgaacacaactccaactgcaattacattttaacgcaaataattcttccgaggcatcccaatcacaaaattcctccgaacaaatgcaaaattgttcaagtatgcatttcctaatctttcataataatctgttgaccattgtttagccaatgaaagagtctctggagaagattcggtgccattcatcgacagagagacttttggagacgcggagagtgacagaggaaggggaccgccgcccgatcggtttcgactggtctatctgatcgtgcttctacatggaatgggcatgttgctgccgtggaacactttcattacgatcgcaggggatgtaagacaaaaaaatttcgaaaaacaaacttcaattaaatgttttaatgggctttaaggcacttttataactgcttttttaagtattatttgcaattcaaattcgcaaatgtgagcaatgaagacaattacaaagtgtactttttcaattatctgacggtttgtgcccaaattcccgtgagtttattcatgtttatctgattgtgagcatttttctgcctttttcctattttagaatttgcttctaagttttctgaatttatttgtcgtcataagaggcggcttttaccgtcgcatttacttcactttggccgtcatttttggcatatgtctcgtcacaattgcgatggtttacgttccaaccgataactgtgccttgccattccttatcttttttatcctttcttttcttagggactttcggctttttcctcttcacaatgctatccgttgtgcttctgaatagcgccagtggtgtttatcaaaacagtatttggggattggtcgctgattttcccggggaattcgccggtgccattattcttggcaacaatttatgcgggattctgatggcggtgctatacatcctcatcattgtgttgggtttgcgattcatccgcttcgcttttgttcggttcgcttttagtcggtgccaatgccgcactcgccgccacagtttacttcggtctcgctctgtttaccgtcgtcctttgcattttttctttccattttcttcaaaaattggttctattctatttattttcaaactttaatctttttaaacataaagaatttctacaattactatgtccaaaaagcggcgaaagcgcgcgcgaacaatggaacgaatattctgcacgaggaggaaacgggcgaagcgaaggccaatagaaaagtgacgcatccgccgctaaaaacatacatcgcaattttctctgaggtaagcaccaattaaagcatgatatgctgtgaaaatatcattttggcaacttataggtccgtcgccagttgctcgatgtttggcttgtcttttttgtcactttggctctgtttccgaccgttttgttgaaagtgtctttaattagtccgttcaacgaccagaaaacttccggtggcattttacacattaattgttttttgacatttctcttaagaatcgctctacaagcagctgacagttttcctcaatttcaatgtttgggccgctgtcggctgttggctgtccggcttttccccgagggttttgtccatcggtgttttatttccctattcccctcccctccctccttcagcctttccccgattatttgtccctgccgatttgcctccgtctgctctttcttccgttgttttggttttgcgattaccaatatgacaatttgactccgcgtcgcttcgtgttcatccacaaccaatgggtgttcactgttctgatcactcttatggcactcagtcacggctattgcagttctttggcgatggtttacgcgccgaagtaacataattcattttaatacttttctcagaaagaaatttatgcagaaaagtcaatgaatccaagtcccaagttgttggcatgatgtccggctttttcctcgttctcggcattgcatctggcattctgttcactttcgttgagcctagccttgtcgatgcggcggaagactttttcggcattttttattaatgggactttaactagtcgatctgttaaattttttaattcgtaacagggaataacattttactctgcatttcacctttttctttttccaatttttgtttgttattatatgaaactattttcttaactcttcgtttgtttcatatctttctatctaacttttcgtcctctccctaacctgtcatttttgtgccattatttttgaaattataaattcattcatttattcttgtaaaagttattgttttcacataactttaataaaaccgattaattttcttagaatttaccagaattcgtttgtttcatgcgataagcataaaaatacaattttacaaactaacaccatacgcaagcactgcatttggtaataatggagctactggtccattccgatcgcaaattcaaaattcgttcattttcgaccatttgttcgaaatcggatccggggttcggaatttaagaaatggatgccagattcatgatcagtagggttcgtattgtatgattttgcatattttttctgcgcatatgctatgaagaaaggggctcaaaatagaatttctacgttaaaattttttggtttggtgaaggttttttagtgcatataaaagcatattaaaaaagcgaaaaatatacccctaaggttagtgcatatttgggcatttttccggtttttagggcatatttgggggatttttagtgcatattttatgcgcatatttggcattttttagtgcatacaacttcgagccctaatgatcagcgaacccgaaaagccctggaagcatgttttcacgacttttacaaataaaaataattggggtcgttttggcagttcgtctgttttgttttcgtctctctttgcccttcttaacatttttccatggcaaccgaatttataaattaacgggtcaaatttttgatcatcttttcattttcaatatttttttctgctgtttatggatcacattttatttttagaatttctttgtggcaatttcagcggttttcgtgtcaccgcaccaaagcatgacgaatgattaattggccactttgcttctcctcgcttgctgctggtttctctcatcccccttctaccgccctctgttttttcccgtccccccctctctctctctctctctcccccactctctctcctctctctctctctatgtatcatctcttttctctctctcacttcctcccgcctctctcctgtttccattgtctccaacggtgacttccttcctttgttttgttacgtgttcaaccacacatctccaatagcagcagcagttggcccccacccgtttcggaaaatcgcatttgtgcctccaatctttgcttaaatttatgcaattaatgtttatatttagttacacttttatattctgtttgtctcttttgtctgtcaaatttccttttgttctttcaaatagcaaaaccgttgctgatcgattccgatcggtcggtgcctttgctttggtttgcgccatttatcgcgcggttataacaataaacgtacaaagtacgcataacctgtttcatttgagcagaactttgctgctgcaattgcgccgatcattagcttaattgcaaattgtaagccttccattcgttaactttctcatccaacgttagaaggaacgaaaaaaacaacagtaatctttcgttgctcttatcgaatttaacagaaaaattaaaataagtaaataaagtcaacttagaaaagttttattttgttgcccattggctttgtttgctcttttggtctttttcttttgtcagctcaattccaaaagatcgcgcgtctcactgattgcttcttaaagtggatccaaagtgtgttgtaaaaaggttaaggaggagcaaagcacctgtggggctgacaaatgaggggagggtgagagacccctctcctcctcctcctcctccgcccccccccttccgactccacccaattaaagtcagcagcagcttcctactaacgagctccaaatttggcgcttgaatttgttcacatacatacgacgagttgtgcgcgagcaacgaattttggagaaaaaggtgagaaagga

SEQ ID NO: 7065 - DNA, 4657 bp, Heterodera glycines
tttttaatttagggattaaaattcaaaaaaaacatgtcatttttttgggaatcaatttcattcaaaagggaaaaaagaaaaacagaccaaaaattgtccggtgaattcttcttcgacgacattaaacccaacattggttttcctgttgtgtgcttcaacataggtgttgaaaaacctaagaaattcactaaggtaaaatatttagtttgattcgaagtctggacatgccaaaaaagatcgaccaaaaaaataactgactgggtgagatgccttactgaccaatattttctttccaaaagttgtttttaaaagtttaggtggttttttgccatgctacggacgcaacccttccgagacaatggtactctcctgagcagtttcagctatgtcatgtttcatacgagcgaataaataccataatgtcaatttcatgcagctgaatctatctttttcataaattttcaactttttgtttgaatccgggttcgaaatagatttcagaaccgagttctcagaccccggtaccctatttcataccaaggacaaggggtaccatacatagtctaagaaattagcttgatcacatttccaaaatgactcacgatttgttggtgtccagatgtaatttcccatttgtgaacttgtttcgggttgtagccatttcgggtttctgtttaaataatacataaattattgtttattcttaatatatataattttgtaaacaaataaaaaggtgaacaaaataaaattgttttttgaaaatattgatacattggacaaatggataggtatgtaattgcaagataataattggatgaataaacaaaattgcgcgtgtctaaaaataatgggggcgaggacaaagatcattatttattacacgttgattttcttttaaaacctaagcctcccgataaaactttgacaaggcgacaaatccagtgaaactaaaacattatttagtgaacaacagagtgtgatctatttctcgaaacatttattgatgaacatattaagacgccttgatacttttagcctgaattatgaataaaacgtgagaaacaaaggagatattccacaaagaagctgatgagttctacgttgtaatccaattaagttccattccttgatggggaagactaaacgaccaacccgtgatgagactcgaagacggtaaaaagaatataaaacgcgaaagaatgagtgtaatacaaaatggaaaacctttttaaaaaagttaaacacaaaaccaaccgttgtaagcagaggtatgttgaattgcgggtgccattcgggggccaggcaccgtttcaatgcggcatggtcctataaatatgaccatttcttgccgaacagttcccactcctatttaccatggtgttgccgccgttgctgaatgggcgggaaatgccgccattctctttgcttccatttgatgatgacgtgccgtggagctgttgcatctgtactttctgctgttgttggaagtacatgaccaactgctctttgaccgtaatttttgagttttttggaggcggcggaagcggaagagcagaacgggtgcactaatagggggaaatgcagttagtttttccatgaaaatatttttcttaattcgaccgtttttccatattttggtccggtaccgacctttcggcctatttcgaacaccgtccggactcgaacaaaaattcgaatattagcaattaatattttgcaataaattcatttaaaatgcacgaaataaacagaaaaatgcttagtaggcacgtgtaaaattgcgaaacaagttttgatggcatatttgtatttaaataggcctttggtacgcaaaagaacaataacttttaagatttttaatattttttgagataacccaaccccatcataacacttaatagagccccacattgggtttgtacagcgccgtcatgtccagcgggcgctcttgcataatggccattgtgacgccaccgccgccggcggttggctgcacgaaacgctgtttctgttgctgaatcgcacccattttggtgtcgttggtggcgctgctgtgcaaaggtatttagtgtaggatagcttaccgtattttctctaattatacatccgtctacaaatatcttccgctttctgaggaggttgaaaaataatatatccgggcatataattagagaaaatatggtaattctattttatgatttgaatttgtggattcattattggtttaaatatattgtcattttccttgagaaattttaccatatttttaatttttgaaatttttttagttaattactttgggtttttttgccacaaaataccatccccatcaattaatcacccattctccgttttcagcaactcggccagcatttgccgttgcgtttgtgtcggctgctgttggcatgggcgacgctgattttgaagcggaagattaacgtttttggaaatgattccagtgccgagagatgataccgttgattggctgaaagggaatgttatcgataaaaagttcagtaaatcgataaaaaccgattcctttaggcttcttaaaaacaactttcaaaatttaaaagttcgccactaaatgccatcccatcaattaattacacattctccgctttcagcaactgtgccaatgtttgtcgctgcatttgcgcctgctgttgttggcgtgggtgaagctgattgttaggcggcagacgtccatttgggatggcggcgatgttggacgattggcagtcgccataatactcacttaaatttccaaatttttaattgtcagggcaaggattatattcataaccataatcaacggtattctttgacttcgaccctcaaatgcccaacccattcttttttgttagtaagttgaaaatagaacttattaattttatgaaaaattataaaattatagcccttggcgccaagactccacttcgccaaaaaaaaaatccccgtccgtggggacagattctgatgtgattgtacgctaattcatcatgaaaatgagttttaaccttttgtccaaacaattatttacattaaaagtgcccaacttaggaattgaatcattcaatgtccaaaaagcataattaacaaaaaaaaatccagaattcgaggccgaaccatcgagtgagatttatgtaaaactatttcttaaagggtttcacgaccaaattaatcccggatcacaatgtaatattttgttcaaaaattatttgatttattaaattagtaaccgaaagaaaccaaatttgttactccgttgaatattttgctttttggaaatttaatgattcatccgagtcccagctatttcgacacttcagtcccgagtgtgtaacaatgcaggatgtctgtcccggtcccctgcttgcaccctcaattacccaatggtatgtatgcgtacaaaccaacacccacgcacaccttttttgaagaccatgctgtcgcggttggtggcgctgcacttgctgggccatcattggctgttgttgtcctccatcgtcgtcacttagcgtaatcacttcgcaatgcttgttggataacataacaattggcataaaagctgtaatactttattatttttgcattattttatttttccatctattccataaaagaattcgaaccccagttagagcttgtgcctcaatgtccacaatctaccaaatataatgtgacattctactggccttatttaataaaaaaagatagaaaaaatcgtttgaattctgcatatcgaaaaaagtgaagaatatttgtacctcagcagatgaccaatgatacatcattcgacacctattagtctctaatgcatgaatccgaaagaatttttggtcaaaaaagaaattaacaacgttacggaagaagtcaacgcgtgatccgcaggcggctgactgattggcggaggccctttgtgcccacgcagtcaacaattatttttttatcacagtcattttcagaggtttttgatggccatagcttatgtcaattttttttgtccaaaaattctttcggattcaagattggtccataactcgaccagaaatgttttccatcaataaattcattcggattcatgcattagatacatagaggcgtcggatgacatatcatttgtcgaatttggtgaggtacaagtattcttcaattttaccctgcttatctgagcgattttttcagaatccgggtatggggttcgaaatgggtgtccaattcgggcagacagagagaatgagagattggtggaaattcttaaacagggagaaatgtgaagtcaggagtaaaaaaatcgaagggaaaatcaattcaatcaattaatgtaaataatttattcctaaatattatattcgttttatgcgtccaatcattttcttcttactttggtcaatgcttacattcttgtaaacaaacgaaagcttgaagtctattaaagttttgagtataagtagattctggggtaataacaatagacaaagattattcttgaatatactcgaaaaagatgaatttcgtattttctcgttgaaatttttcctagtgtcagtatttgctcttttctcgtatatttctgagactttaagctttcatttgataccaagaatgcaggcatttaccaagtaagaaaaaagttatggcctaagaaact

SEQ ID NO: 7066 - DNA, 2115 bp, Heterodera glycines
gcattaagcgcagagaaaagggaggaatcttctagatatcgacccaacattctcaagtgtattgttaactgctaataatatcaattacatagctaatagaacttgtgttattaaaatttcgaaattaacaagatgtctatacggcttatgtataatatatgtacaaatatagacagtatattcatgaaatatgcgcccattcccactactaatcttccgtgggggtgtgcgagcgtattcgcgcgttttaatccacccacacacaaaaaggagcgaaatgctccgcattcaccacacatttcttttctaccgctgctgtcgttgtctcttctccacaaaaatcaataaattgcggaggagggcacacgatgcatagaaaaattttgtgtgcataggcacgagagagaacacacatcctctcttttatatacaatatacacattgaatactaaaaaataattagggagagaaaaaaagaaagagagcatcagacagactgacaaagaaaaatcaatccaaacgtttgctttttaaaaaaggcactcatacatttgtaatttttgcaagttatcgactaaagcacctcctaatcgatgaacgaatggaagaagctgaagcgcctattggatgtttcgcctatcagtgcaatcctcttgattaaccaaaactaaatatctgctgaacaacttaaatggattttgttcacacttttccactagtctcccaaatttttatgaagttgtaaccatctcaaaaacccttaatattccaatgccatcggttcatcatcatccccagctttctagacttccctcatcaagaggctttcgaatgatacaaattcatcattattaatccctcagattgtctccatttttagagtcttgaaccagttcaaaaaccggctctttggcatttccgcacctggagacctatttttccgtgcttagatcctcgagacgaatcgattggtataccatttgtgcatttttcccggggattgactatatagatcaccctgcgactggtatttgcgttgagtctaatgattagatcttgacccccaattaatattttttttatcaacattttatgcgtttattggatttcatactttatcaattggatgagttgaattcatcaaagattattgatcacgcgtctatttgtgatccaaagtattaaaaaaaacaaatacctaactttcaattggatttatgaggccaaagattaagcccacccaaacactgatccctgtcaatctttctcacagaacaaatgacccctaatttgaggaagacaaatgagtaggagcatcaattacgaccgcaattcgcacgtaccaaagcgaaacagaatccgcagctgcccaaacagccgccaaattggtgagaaacgcggacgaacataaagaaaatgaggagacccgtttctcaccgctgctgtgtctgtgcacaatttatgctttttaatctctgtgtgtgtgtgcctttggtgtgtccgacgccgcgggggacggagaatattgatttcccattttccaatgtgaaggaaagagacgaaaaatatgtgtaataattagggctgggaatttaagtcaccaaaaatctcaaaaaactcgactaaagtcattaaaatcgacaaaaagtcacgaaaaaaatacaaaaagtcctgcaaaaaaaagtcaatcaaaaatcatctcaaacagtagaaaaagtcaaataaaaaagcatgttagaagcttcggaaaatatgggaaccggccactttggcgcaagactctatatcattttgatttcacagcaaaattaaataatcttggtatgattttaagtggcttgatagtgcctattaacctgcaaagtttcaaaaaatttagctgagaaacaaaaaagttatggccaaaaaacctcaaaaaattgaattttcctggccattttggcgcagcgcgccatatcttttttaaaacctaatataattttttgaaattttgcaagctaataaagaacatttagacctattgattaatatcaacattattttatttggtcgaattaaaaaaaagttatgaatctttaaacttgcccgcgccaaaatgaccccgacccgaaaata

SEQ ID NO: 7067 - DNA, 4848 bp, Heterodera glycines
taaaagaggctaaattacagatgcttttcaaattttgggtgtatccgaatagaaagaagtggaaaatcagaacttttcacgcctataaaattcgggccgaaaaatattggtgtttgtgactagaaaaatagcagatgcatatcaaatgactacagaaaattacagcctccaagaaaataattgctttgcacaagcaatattttgtagagcccatcaaacacattgtgcttataggaaaggccgaattaaacaataagggcctttttattatgattacaacaaatcagcatggcgtctcgctgatatggtatgtttcagttaaggtttagccgatctacaaatttcggcactgtctattttgtaaaagcgaatcaaattcctttggattccaaagtggaattacagaattgcgacggcaaatcctaaatagacaacgacgctttcattataaagctttaagggaggaaaagtaatacgaatatttcaatttcttacttatccgaatagacaaagataggttacacacgaacatttttatagaaattccggctgaaactaaaatccctcttttggtcttaacttatgatttttggcccattatggatgaattaagtatagaaagcgtcgcagaaatacattcatattttctaaattcgggtttcagaaaattaagatttaaaagaggctaaattacagatgcttttcaaattttgggtgtatccgaatagaaagaagttggaaatcagaacttttcacgcctataaaattcgggccgaaaaatattggtgtttgtgacttgatgaatggacgcacagttcagcaacactgtcgaggaccaccctcaaattgttcaacaccaactcagatgccatttgcaaaaagtgaaaaaatagcaccgaaaaaggagacaatattaaaaaattgcaaacaaagaatgtgattccaaatcgaaactccgaccaaaacaaacaaacaaaaatatattatgaaatattaacaactattctgagggacggcgttacaaacaaaaaaatgacacaaaaaggaaaaattttcatgaaattttttttcgtcattaataataatccatccctgtcctccacaattgactctcttcgggcgcttaaagtcggaccaaattgttgaactcggccaccaattgtggcaccgccgcattgccaaagttgtggctcaactgctgcttggtgagcgtgaacttctgcaacggcgccggcggcggtcgcactccgtcaatggtacacaggggcggattacgcggatgttccttgcctaaaggcttcgaatatacgaacatccggggcctaattttgcaatttgatattatgcaatgtgagacatttccatggataatgccaaaggaagtcttcggggcacttttgccgtttatgcaccccatccaaagggggaacctttttgtggggctttggattggttgaaggaggtgtcacgtgttagcaaccccgaaacctcggtgaacaaggtttaacgacttataacaaaaaaattttaaaaaattttggtggatatacagaacaaaagtgccgacttcagttgtccttggacaatgccaagtccaaggatggcatcttaaatcccccttcacgcactcaccctggtattggtcacggcgccgtttgctgggcccgctggccatgcgaaagccaaaccgacgatgcatttgggcagagccccaatgctttttactgtcaaaaaaaataattaaaattgaaatgaaaagtaacgatgttgaacccactcccagtccacgtgtgacagttttccaacaaccgccatgcattcctttaatgaataagaactttagagctgaaaaacaaatccaaatcaactcaccttgcgcaatacgtctcatatttgtttggcatctgaatctcggaaagcaaattaaaatgtcaaaactttggggggttaaaatgtccaattttgttttgaggaaatctacgaaatttgggaccatccgacagactaaccacgaaaaaaaaatgaattcgtccatgtgtcgagtctggaacagctcttcctggccaagctgaagttcgagcaacgcacggtccatcttgttcatgaacagcacgggtttgatacgctcagcaattgcctgacgcaacaccgtctccgtctgcacacaaacacctaaagattggatgcagaaataagaataaacccaatttaatgtgactgcaatgaaatcggtgtttgcggatttcatcagactaacgaaaagcatagttttcaaaatcaaacctgacacacagtcgaccaccaccaatgcgccgtcagtgacacgcaaagcagcagtaacttcgctggagaagtccacgtggccaggcgagtcgatcagattgatcaagaagccgtttacaaattaaggagaatagacgaacttttgctgtcaacaccgaagcgtaaaaacgatgcgccgtcggaatgatttggccaccgccacggtgactggcatcggcgtgcagcgtaacgtcgtggatgtcgaaacggacaccgcgcatgttctcatcacagagcacaccctccttggtcgctcaacaattgcttgacgcaacaccgtctccgtctgcacacaaacacctaaagattgtatgcaggaataggaattgaaactaaaaagccaaatgaaaatgaaatcgcgtaattgtagacaaattaatgtgacataaatgaaatcgatgttttgtggatttattaaattaacgaaaagcatagttatcaaataaaacctgacacacagtcgaccaccaccaatgcgccgtcagtgacacgcaaagcagcagtaacttcgctggagaagtccacgtggccaggcgagtcgatcagattgatcaagaaaccgttgtatttttggctcttcccatcgacctgctcaatgtcagcttggctttcgcccttgacgaacgccaagtctttgcgctcgagttcaaagaacatcgaaatggcactaaattttaagtgaagcaaaaatattgaactttgcactaacccaccactgctagtatcatcaccataccgttcatcatcattccccacccaaacccaatcactagctttgctgtccgcacccaaactacacttaaaaaggaggaaaccttgacacctgtaaccagcgccatgtacggcgttcggttggggtcacggcgcacttcgatcacgcgctcgtcgtacgttttgtcggcaacggttggatcgcgcgggtgcaagttgagcatgaaatcgccaaaattgacaccgccaacgatgtgtatgcacaactaaatgttgaacatacaatttgtttaagctaatcacgggaaacgacaaaatttgtaaggggcaaattgaattccaaaaccaaaaataagatttttacttaatggcaaaacgtcagattttttccccaactttcaattccgatttcggatttttgaaatggccgatttgtaaggccccgtcctaatttttcaatgccacagtattccattctcagtcctaagcaaacattccatgtcgtaccctttttggtgtataccacttcaatgtaccacctttttattttttatctgctacaacaaaacaaatgaacaatggaaacattgattattcaagactgcgggagcgatgagcaaaacgggttgtgaatcgaaaaaaatcacaacattgtccataaaaactattgctcgtatttattatttgctcgcaactggtcaacatgttcagaatcggctggtgaccgctaaaaagttgaatgattcaaacaaaaaaaaattttcaaactccggatgctcagaaaagttctgaatttgcagaactgcatcggaaatcagatcaccgataacaatggcaacgttactaaaagcttcctggaagcaaaaagaagtcagcacattatataaagaaaaaaactgacgattcgttcacgcggaaaatcagttccatcatcgtgctggagattggtagctgttggcaacaattgctcaaagagagtaacaattggcgggaaaggaggccaagcttaaccaaacattttatgagtaagatgggaaaaaagacattttcaaacagacaactcactgagaataatttttatctcatttaagagaccagaaatgttcggcaaaacaacgggaacgggcacgttcgacaaacgctcgcgcagtgacgccaaatgcaccgcaaaatttctcacaggcatgacaaaaaattcaatgtgctaaacaaattaactctgtacatttgattaacaaaatttgtttgaacatacttcacgggtatgcggtgttatgcgaacgaattgttgtgccatttcaaatgcaaataataggtaaattaattaactaagactaaaaacagttacaaaattaaaatgtcaaattggcagagtttcaatcggaaatgcttagaaaattatgagaaatgaacagaaaggtcagactattttaagaaaacatcacggaaataatgaaagacaaaaggattttttcttgcttattaatagggcccggatttatatagaaaaaaatccaaaatatggattaaatacagataaaaaataggaaaatatggacaaaaaattctgaaaatttgttcgagtcttaatttttttttttttgtaagcgaatgttgctaatgaatttttttgcacaatttttgtttagtgtattgactgatttggccgtttgattgaaaccatcaatgtggctcgtttggatgatgggggagaagccgagaaaagaaaaaaaaaattttgtttaaaaaatcgcaaaattaaacattacataggcacaaaaaatcctcgaaatagcacttaaaataggaaaaaaa

SEQ ID NO: 7068 - DNA, 1931 bp, Heterodera glycines
aaaaaagttcatgatacgtaaaacaacaaatcatactctctttatatccaaaagttcctccgaattatgaaaagacgacatttttaaattaagataggtatataattttgaagagtttttatttccaaatcaattaacaaataataacaattggtgaaataagaaaagaaaaaacaataatacaatcatgttaaatcagttatagccgggatgtatcaaaaggaattcacgatacaaaaagaaaaaagcattactcttcgagctccaaaagttccaccgaacgtgtcaaaatatttacagcaagtgttttggcctcgtcaagcttgggaatgataaagttctaaacgaacagctcagatacattgacaatgaaaaccaaaatcaaaacgtgacgccgagacgcatcaaatccaacgtcaagcgtccatcaattcgagttgacactgcggtgtcagggcgttgttgaatgcaacgagtgtcactcgaagcttaacatacctcttgagcgattgttcgtattccgcaatacgaatgaatcgtgactgaaaaatttattcaatggtacattttacaacgcgaaacaaatggactgacgcgtttcaattcgggcaaatcgtttttgtccggcttgagagttggggtgaccggttccaagctattcaaaaaggaacaattggcgggaatggacgcgctaaaccaaaattatttatgaataaaagatttaaaattcgaataaacactcactcaaaatggttttggtcttgtccaagtgctcggaaacggctgaaggggtgatggcggaatcgagcgaaatccaacatcagcgtcatcaatttcagttgtcactgcggtgtcagggcgtcgtcatgctgattgttgtgacttaaagacaaagctgaacaagacattgatggtggtaattagaaggccgataccgtcgcgtcgaagggcgcggatagaagagaagtttgacgagggaattgagcggcggcaatccatgacgtttattctccaaggaaacggcaaataactgcacgtctttgatggcacattcgatcagctacacatgaaaataaattttaaattttgagcaacaacaaacaaacaaacacaaaaacatactttaaggtcctccagtggaatgtgaagaaaaatgagggcagggtccgacattttgttttttagaagatttttaataagaaagaaattaaagtttagagagagaaaggaatagggaatgaaaagccatattttaagcgaccaaacattttgtgtagaaaaaagcaatgctcagaaaaaaaacaacacatgcctattcatttttcctgtcaaccgtagaacatgtttggtgattgttgtgacttggtcgagtgatgtcacagaaaacttctaaaaaatgcgatacaaatcgtcaaaataaaactaaaatctaaaccagggcatcatgatgacgagtgtcgtagccacagtcgatgaatgcaacgaaaagacaatgctgaacaagaaattgatgatggtaattagaaggccgataccgtcgcgtcgaagggcgcggatagcagagagaatgtcagccccgatattttccaatcgggctcggtgatcctgaagcgacccaacacattggaaagatagatacggctaaataaatttttgactttgatcatgcaaaaagaaaagaattatgtacctcaaaggccaattgcattttggcaaaaacgaaatgatatgctccgttaagaaattataaggtcaaaactttgaagacaggtaactttttttgtagggcaagaaacaaatctagaaaattcatgtaatcaaactttttgtgttgatcaaaaaagtcaattgcaccaaagtgagaaaacccttaaatggcttgaaatcgggaaattttcagaaaaaaaatcggctcttatgcagtttagagg

SEQ ID NO: 7069 - DNA, 4873 bp, Heterodera glycines
  misc_feature (4826)..(4826): n is a, c, g, or t
cccctcctcccaattctccccttcgtcgtttgccctcctttccctttgctcctccatcctccgtcggattttgttccgcttcagctgatcatcattcttaatgcccttaattatcatttttatttaggtaaatgtcagttttttgctcgtttaactcacttcgtcctcctcccccaatggctcgctgtatattttgtcgacgagatccttgcgcaattcgacttccttctcaaattctttggcaccaaacacgcgtctctgtgaaagaataaatataaatcaaatttctcatcttattcatcaattcgaggcccgattccgtgcaactctaatgccaattgatacaaatgcttgtttttgtactgcatggaaatgaaagtccgaaaaatgctacttgttgtgtcttttgaattcgctaatcaaaatcaagaaatggttattgggtatattgtttttgcctcacctttgtcacgggatcaatgaaattgccatgttggaacacaacctaaaacatttggtatttaatgacggattgttgacagatcctttagacaaagctaaacaacgcatttattaaattcgaaaatgaaaatcagtcggcggcgactaaaaggcaaaaaacaccaaaggatttttgaaaaaaactaatgccatttgttaattgcgtgacgacaaaatgatgaattccttgccttttccacagcgtactggacagtttttgatggtctgtggatctctgagaggcgtctgatcaacacaacgtcgcccaccctaaaagccaaaatcaaaattaaaacaaataatttagtggtcttttccacctgcatttggactcggggtcgagcgaccattcataggcagaactcatgaagaacattcggttgtattcgtagaaactaaatgaatgaaaaaatgaaaatagaaagaagtgagggagaatgaacggagaaaatcaggcacttttgttgacggagccccgaaaggttttggaattttattaaaaaccaaagccagggagtttttggtttacttttttcagaatagtgaaactcgtttacaagttttcaggacgttgatcacgaatatgacataattttaaccaatttcaaatcctaacccaagcttgaacaaaaattgcaactaaaaaaattgaatttaagatttttggcgaaggattggtaaaaatgagtgtaagagcataatcagtgaccacgaaaacccctatgttttattctgtcaaaaaccaataaaattctagtatttttcggggggtggggcaatagcaaaattgctgaaaatcagctacatccctaaaaacacttaaggtgacaacagagaggtcaagcgatgaattgccatgtattcagtttcaattaagagactcataatttgaaccatttgctggccacatttttcaaattgcccgatttacatattccgaaaatcaatgaaaatttgccatgtagtaccccccagaacccacttgtttttggagattttgactttgacacaggtgtccctctgcagtccgatggtggtgatttgcttcactttggccaacagcaactcgcccgaaactttggaaacccaagccgactttttagacaattgttgcattgatatattgattacactaaagctgaggaaaaataaaattaatataaagcggattaggtgaccaattctatgaaaagcattttattttcgagcaatcttttctagcggtcattattgttagttattgtgtgttcaattaagcaatattctgattgtgagcagtttgcacacgacaaatttttcagggaatcgaaaaacattaaaacaaacaaaaaatcattttgattgtgcagcatataaagagcaaaaccggctaagcaattggtagcagtaagcaatgctttaggtaggaatatgatggaaaaaaacctgttatttataacaggttcctgtagtgcggcagagaagcgaaataaaagtaaggcaactgttgcaaaaaatcaatgacagaaacctgtaatcaaaaagcaggaaactgctattaggtattacgcaaaagtccaaaaatttaaattttttgtagctgctccgagtagatagacaatggactatttcctccgactaaccactacgggaaggagtaaatagtgcagtgcctgcttgtctgtctacgcggggcgccgcgggtggaaggggcagatagtaagcagacgcgtgcgtgtggggagggagtgggaaaaaaggagggtaaatggcaacagaaaagaagcgagagtaaggtgtaatagcgcactgtctgtctacgcgggcagcgccgagcggaacgggacaactccgtctcagccatgttttgagcatcataactttttaccttattgaccgaatccaacaatcttgacataattcgaaagctcttcacaggctctattagcctactaaaaattacagagtatataggtagaactgtaaaaaaaaatgagaaattataaacttcaaaaattttggatttttgcggttttcaactgacaatttttttgtgagtgagaaaaacagttatggcttcttaagttgtcagggacggagttgacccgtaccggcgccgattggaaggggaaattttgaattagcggggtttttggcataatgaagacaagtttctgcaattgaatattctgttggtcagacactaaccacaggaacctgttgtaaataacaaatttttccaccttaggtaggaagagaatttgactgtgacaaatccaggccgccaaaactattgcaattttcaaaaaaaaaaagcactgtcaaattataacgaaaaagtaacaatgtaatgcaaaagggcctggatgaaagcgaataaatgcaaagcaaatacaacaacactctctctggtggtggagcgaatattgcgaattccaacggagaattttacattttgtatatgtcattggaagcagggctccatgtatcatcaatttgaccaaaagtgtgcaaagacaaaacgccaaaaatcctcgttaatttaaaaaatttccattgtaaaaacagaagaaccgatctcaagtttctgctacttcttcacatttcttgttttttcgcttcaaaatcatttttttttgtaatggtgcgcacttttaaccaaattgatgatatgtggggctccgaatttttacgttttcaataaaagtaaaatttggagcaccgacaaaacacaaagtggggaagaataatgtgcagacattcaattggtaaatgtcaagggatgggttgtgatgaataattaaaggaggaaacgttgtcgctcatcgcccgccactctgtgccgcttcatcgacattcccacactttgatgctgttgtccacagagccggtgaccacgaagggcaatttggaatggaaatctgaaggaaggtaaagggctgtgattgttttattacaagtagttaaccgtcattaaaaacaaataatttgtttacccaacgcggtgacaaattggggatgtgcctgcagcgttttaatgcaccgccggtgctcaatgctccacacgcgcaacgttttgtcgtcactgacagacacctgcacaaaatagacagtttaacactcaaattgaataaaatgaataacaaaaaagccgtaaaaaactataaatgggttatttcgcctccttttttggtaccatttccaacccccggggttttctcgcaccaaaaatttgccgttaggatgcagtcgaatgtcgcgcacccaattgtcatggccagccaaggtaaacagacaacagccggacaacacctaaagaagggatggaaaatggcggaaataatgaaccaaaaaagccaaactcaaaaaatggttacctcccaaaagcgaatggatcggtcacgcgatgcggagaccaacatggccgttttctgctgttgttgctcaatgtctccgttagtttttcctatggtaatgcaaattccattaaataagttcggcattaaaaatgaaatttgccaccttctcgcgacgactcgccggaaaatgtgagaatttgagcagcgcttttgtccgacacccaaatgatcgactcgatgacatgttcatggccaagcaaagtcattttcggcactttggtggccaaacaccaaataataatggactgaaaatgcaatgaatggtccgaatatatacaagtaaagtggttaaatttttagagttttttctaagtggttttaatcctcatttaaaaagtttacaaattgcgagtaagatctgcttttggagcgaagaaattgcaaaaaaccatatgaaatttcttacggttgggggagtcgaccgcccattcccctcacattttggtctatgatttgtataaaataggagagtgccatcgttgtctttatttctttaattcccatactccgcctcaataaaaaaaatgcaatttgttaccctgtcattgctgcacgaagcaaaacactttccgtcctcgttaaccgccaccattcgaacccaatcggtgtgtttggagaagttctgcacgcaataaccattcgcaatgtcccacagtttaatcagcttgtcccgcgacgcggacaaaataaaatctccggagggaagaaaaacgacggaagaaatattatgttcatggctaaaggaaaaaaggtaaattagcaaaaaaggcgcaaaatgagagattaccctttgagtgttttcaaacattcgtaagtgttcacaaagtcccaaattttgatggtcatatcagcagaacaagaagctggaatagaaaaataacaaaaaggaatcgtgaaaagatttaggtgcaaaaaatccaaaattanattttaatgaactaaccgagcaatttgccagacgcattaaagccgat

SEQ ID NO: 7070 - DNA, 1107 bp, Heterodera glycines
aatcttttttaccgggctctagtgctgagaaaggtttttgactattcgacagtcaaaatccggggttggctttcatggaataatgccctttcgggatacctgctcctgacaaatcggactcctgccatgaagtttcgcattgcaactagtcaaaacttcaacagctcgcaaacaacagtatacgactgtgaaaaacaagaacaatcggaaattcgtggacatcatgtagctattcgagcagttgtacacagccaacgaacgagccctcattgatcatcaaaacaaatagtcgcttaatgaattagaaacctttacccccaaaaaagcactacaattttttttgttcgagttagggtccggggttcggaattgggcaaatccgagttaagattcgtaatcagcaccctcgaaaaccccaaagaactggttttgaacccaaaatttaaaaagaaattaaaaattagggacacccattcttcaggattgccggttttttccttcaaaaaatgcacaaccaagaagccccctgggacagtctctgcttcccacaaaacctacaacgttggcttcctgtcggaaaatggaagcagattgagcatatccatgtgactccagataatcgacaactgccagatttctaaaaagtgatggtataacggttgaattgaaagtttcgttttctcccacatatcatcgcgctgttttgaggacgacatgaccatttctggtacaataatatcaataagtggcgctgctcgctaccgcaaattttacccttaaaaatttaggcatgaatttaaagtctttcattatgtcaattatgcggaaaacaatttaaaaaactcgtgatcaggcagaaagaacaatcctaatcattatcaaaagattatgaatggcgaagcgtgtttcttcattgaatagaaactgttaatttggagacacgaatttttggacaacggcgaccgcaaataaaaaaggaggagaataaaatagtggaaaagagggagagagagaaaaagaaaaagatggggggggggaatttaattaaagagaaacccaaagaaaaaagatgcaaaataaaagaatgggcgtcagaggagggggaag

SEQ ID NO: 7071 - DNA, 6709 bp, Heterodera glycines
  misc_feature (16)..(17): n is a, c, g, or t
  misc_feature (28)..(28): n is a, c, g, or t
ttataaattttacatnntatgcttcatncacttgtttctccatgaaagtctgacaaagactcaagatcactcaatgtcgtctcattctgctcttcaaaatttgtggtgtcttcattgttaactgtaaaatgttattttaaatatttttgaaaaaatccatcatttacttttcccatttgcaaaatcaattaagtcttcttcaataagattccaatttgcttttgaaaacatagattcatcataagcaaaacgcgggtccattagagaacaaatacgaattaacatattctggaccaatttcttcaccctttcatttaatgagtccaccaaactgtcgataaacggttgaataatttctggaaattttccctcttgcaaaaaaacatgaagtcgtttaagagtcggcaaaatcactgacgccgttgacacctcgcgcgacagctgaaattcattagttattggatataattgcttatttgctgagaagcaggtattgtttccatctctgccaggcgaggccgctttgacaagcacaaaagtccggcatttcgttggtcacttctttcgtcttgaaaataatttctgaaaggcactctgtcttcattgcatcactgacaaccaaattgagaaaatgtgcacaacattgaaaactaaagatttcattcatttatcactgatttccttggcatacctctccttttccaactgtctgatggcagattgcatattcttcgcatcatcacgcacacaacacgccattttgttcaatgtcaatccattttgattcaaacatagtgcaattttctccgagatcagttcaccagagtgaacaaaattttccatggaaaaggcagcgagtacggcatcgtggcgagagaaacttttatcaatccaatgaacagtgacactgaaattacaattaaaatgattaaacattattaaaaaataattatcaacctttgtaattgtggtgacagtgtcggcttagaccaaccgtcactcgtaattgcataatgatcagatccaactcccgattgaattaaacaacggatttgatcggacatcctgggaatcacttttcggcgaaaatgttctcgtgcaccaagatccttcaaaaataaattcacaatgtataagatatattatgatgtacaatgttcggatgtgctttttgaaacaaatcctttaagtctgggtcatcgaaaaaatagaatgaattgttttgccggaccattattcgcacgatgcgttcttcagcaatttccgtctcattcttttttgtcaccaaaaaagattgtatttgcttttgtttctaaaaattagtctctattacaataaaaatcacaataaaccttatcctcccccatttgccctaaattttctgtgttttttaacacagaaaattccttttgatgctttgcttccaaatgtttccacattcctgtagtagagccgtcacttcgggtgactttttttgcgcagattttgcaagttgcaccagtcaaatttttgttgtaatgtttccaaatatcagacattttaatcaattaattctaaatgaaaaaaagtagatggaaatcaaaaaatgaaagaaataaatgaggtggacaattgcttgacacacaacccactgactgtaaaatttggcgaaatgttattcaaaatacaaatattttcccatttcccaaccttctctctttcttttgctctcagaactccattcttaccagtgcatatttagtaccggttagtaccggtaccgccgttactcaaaaaccgggaccgagacttgacttttttcaaaaaccgggaccgagaccggtaccggtacctgaaaaaaccggtaattaccggatcggtatcggtaccggtctcgtgctaccctacttgatatcattcgatagttctaaatgctctctctctttagtgcctgaaatattccaaaaaaaaaattttcaaaaaaattatggcgaaaatgttcaaaaaaacaaggttttttagtttctcttacagagtgtgtttaaggccatcaaatggcatcaagaattaaaaatttggttgctttagagcaaaattataaaaaaaatttcgtccaaaattttcattttgaaataacgactccgtcccatcgtgccgactaaatgcctgatccattctaagggcctcaattcattaatctatctatttaccctattggtgcccaatttaccggtccccctcccagacagatgtttataccccaattgcgcaatggttttgatttatttacaaaaaattaacaaattattataattcattttaaatatatgaccaaaatttaaaaaaaaaattagcaataatcaaaaattcaattcgtatttgtaaaaataaaaaaagatcaataattcactttaatatacacgtaaaattataaaaaaatatcaacaaaacaataatcaataattcaccatgcaacatcagaaagtaatttgtataaattaagaaaattcaatggtcctaaaatgactaattttttttttgttgtaatttttatgtaaaagaaatgctctggaacccggcatttacgaccccgagttttccgctccccgtcccccgaccctttttaacatattttttaaaaaccaaaaaaagcctcagggcaagaattttttgcttttaaaaattatttagagcacaatactgagctggctttatttttgggtcggggtcacttcggcgcggaccatttcggcgccgcaaattttgaaatgctataacttttttatttgtcagttagctttagccaatctagcatcatttgaaagctctatgtgtgctctatatttacatgtaaaaatagaaatgaatgattcaaaaataaaaaaagttatgccacgtggcgcctaaaaagccaagaaaaagtcaatttttgaggttttttggccataacttttttggaaactgacgaaatttttttaaattttacaggctaatagagaatctgaagagctatagattgataacaaaaatttttaatttggttgatcaggaaaaaagttgttagcaacggcgccgaaaggccggcgccgaagtgggcggttcccttattttttacacttttgaataaatattgtcacacccctaaatgtgaaactttttagcacctatttttttaggttttttagaacctaaaaactaaattttttggcagtttttagcaactataaatcgtagccatattaagaaaatatattatattaatgaattattttagcatgttcattattaatttctctgttattttatttgttttaatttcccccgttttgtcatcatttgctacaatatgcgtacgaccgaacacttttaattatgtggggcgactgtggtgtacacgcaataacattatgcacatgatttatcaagataagcccaaattgcagatgaagaaagtggaagatattcatgcattgccttctgggtggatttaggcatttgtgatcagaatgacacgaacgcaatgatccaaatcatcaaagcagataccaatgaaacggttggtattgcaaatggatgtgatttatgtaattagtagggctctaatttttagttttttacccattttttcctgctgaactctccgtgtggcctgaaacgcacgaaaaacaattgtttttttggtgtgttgttaagctacttttcgagttattagttcctattttcggtttttatttcttagagcctaaaaagaaatttaaaaacttattttaacctattttggcgttttgcccaaatttattaacaaacaggcaaaataaaaacgaaccccttaagaatcgatctaaaaaatttttcaaagaatatacctatgggaattgacctgaaaaaatttcagaaaatatatttatacgaaatgaaaaattttctcaacaattcatctcaaaaaattatttgtttattttcttgacaagaaatttttgcgttttagtccatattttggtccatatttggcaatttttgaggaaaaacccggggcctattcaaattagcatcgtatcaacgatgcgatgatacgacgatcatatgcgtgttcaaattaaaggttttcatcgtatgatgagcagtcgtttgcagctcatcatacgacgtatcgtacgatgaaccaatcgtacgatcccatcatacgatcgtatggctgttcaaattatttttatggatacgatgtgatggttttatacgacgagtgcatacgatgagcattaaaataactaagttatgccataaataataaaaaataaatccaatggtaaattaaatttcttaaattattctatttcatttatctaacgcgaaaatatgaaaatttacaaattctgactaaaatttaaaataatataaaaattaaattatcagtgaattttaattttcaatcgttgaaaaaaattgatgaattatttttatttttatttaaaataaaaactgaccaaattaattaaaattaaaattgaaaatttttacattaaacctaactaatagagggaaaacgcaaaatgattaaattttacattatctttatgaaaaataaattacttttttaaaaatatttggaatgttttatgtttttaataatttggctgacttttagtggtaagaaaaatttaaaatttatatgacaaaatagctgagactttaatctataagaaatatataaatattatttattctggtgtctcccgaattttttacgaatttttttcctacatacgatgtaggaaaatcgctggttccttccatgtatgtctacatacgattttcatagagggaggctcatcgtatgatgggctcgtcgtatgtagaaatgttttaatttgaacgcacatacgacatatcgtacaaataatcgtctgccgcagacgattttacgtgcgatgtgacgatcgcatcgtagatgcgatgatacgatgaatttgaacgtacatgcgatgacttggtgtgataaatcgtatgcgggagacgattttaatttaaacgggcatcggggctatgataagccatcacatcgtatcatcgcatcgttgatacgatgctaatttgaataggcccctggattttggtctcgaaaatccagacccagccagatccaggttagacacgaaaaaaattccctaggtccaagtctcaggctttccaaaagttgaactcaaatgttcaaaaaatatttttttaaatattaaaaataaataacaaatataaacttattcataatttaattaattttagttaatataaatgacaaacatgttcatcgttttaccaagtatttatatgctttttgcgacccgaattttcattaatttattttcggatgactctttccaattttttttttttggatgattcgttttgcgcaattcgtcgctgacgtcattgaatgcttttacacctagcaatttcctagaatattttttggagtacctaatttgtttttaataaaatttaatatatttttttaaataaaatgcattgatttccttaaatccgaaaattattattttttattgggtttttggaaattaaaatggaaaataaataaatgtttaattatgtttttaatttgattttctcactaataattgatataaataattatttttcttttctttaattttcattaatcagtttatttttttaaagaatttcatatttaacatatattcatgtaaataaagattgaaaacccgaaaaattttgaattttttgtaagaacttttgagaaaaaaatagttgatataagaaaaatgtcttttgttttagcataatgataaaaattttaaaaattctagattgcatatataaatttaaaaaatcaaaatttttttgaagttatctaaaaacgctggtgtttttatgtatttttataacaatttttgcatttttgagggttcaaagctatttttggcagtttttaacgcatattttagtgaatatttgggcgtttttcgtgtttttaggtcatatttgggggatttttagtgcatattttatgcgcatatttggcattttttagtgaatccaacctataactctagtgatgataatagatatttaagcaattcaatattttaaaaaaaattaattttaaaaaatttaaaattaagtttaacatttttacggtcgatcggttactgataattggaattgcaaaaactttgccccattttagcaaattggaattgaccgataaggtaattttcgaacttgtaaattaaagtaaattagaaggtatccaattataaaaaacatgatatgtcgatacattaacgaacgacccacggacaaaggaattaattaaaaaaaaaatattttttttaaataaaataaaaggtaataatcagggttgtcaaatatgcacgaaaaatggccaaaatatgcaccaaatatgcacaaaaaaatcttgaaaaggtgcaaattcattaaaaaattttattccgcataaattttatcggttttctttttttgcaagcaaatcaaaaatttctcaaggttttcggcagtgaagtcactgttgatccactcgcgcatccattcaaatttgaatttaattttaggcataatcaaattttttcctaagggatattcaaatcagaaaatatttgacgaaaaatggcaaaatatgcaaaaaaaaaataagaaaatatgtacaaaaaaacccaaaatatcaaataaaagt

SEQ ID NO: 7072 - DNA, 2344 bp, Heterodera glycines
  misc_feature (2200)..(2200): n is a, c, g, or t
  misc_feature (2337)..(2337): n is a, c, g, or t
atttgactaaacaattgatgattgaatgggtggacaaagtgttgtatcccgctcttcgcccacaacaaaaaagtctattggttgttgacagttggacgggatggaataattttaatccaccggacggaattgaattgaaaattaaacaaattcccaaacatggaaccgggatttgccagcccttggatgtttaagtttttaggtttgaaataagggaataaaaaatcacataatattttcagaatttggaaacaatttacaaggaaaattacggaatttgttatggtttatgacataaaaattaatttacacgacagagataatgttgtcaaattacaatcactaattcacaatcagtttcaagctccatgttttaatgattggctagtttttgcttggaaaaaagctgggtactacggtgatgacacattgccaaatttttgtcaccccaacaaatatgcgttcgatgtgccaaaagaaagatatttgcgaaaaatttaattgtgaaaatattattttattgagatgtgcctattgcaaaatgtatttgtgttttaaatattttttgacgattatcacatatgtgaaaatgaataaattttaaatggaatgaaaaaaattttccgctgtgttggaatcgattccttggccattcatttgcataaaaggcaaatataaaatgaggaaaataaaattacataagaggattcgaacctatgggggcaaaaacaaaagtcaggagcacaacctccgcaccaccgaacaacacaaagcagtgcaattgattattcaatttattgggataaaaaaaagtttggcacgtcataactcggcactcgggctcattccgcaaaaaataaaaccacttttcttaagaacccaggggtgctcgatccacccaccaaatttcattcggaaatcccactgacacatggggaccttcctttgtaagaattcaatgagagaggtgacagagactcagaaaataaagagagattaagagggggagggaaagagacagagagaggaaaacagatattatgcggcgacataaaatgaattgtgtgaagacaacattgagagagagagtgaaagagagagaaagtgagagaaatagagagagagacagagaggtggatagagagcgagagagcgagtgagagagacagagagagagagcgggtgagagagagcgcgagagagagagagtgatacaaagatagagttacagaaattagaggaaaggagggagagaattttcactgggtcttcaccattatatcaaaacaatcaatccacagtgtaaattagggttcctccccgacatgtttcggggaattacgaaagtcgtaaattgcacttgaaatgagatggaagaatctttaaatgggtttttaagacttttttgttctggactttttctttttgtgtttttttagactttttatgaaaatttcctccccgacgaaggtgttgctccccgacattttttaaatttctccagccatccccgacaaattctttcggggaatttcctccccgttccccgacattttgctccccgaggctcggggaggagccctagtgtaaatatacgtagtacaatttatgaaacaaaatccgtatattattttaattgttttaattttctgtctaattttttattttagtctaattttatattttctttcatttttagattgcaattaattggcttacattaaaatttactaatttagcaaaaaatcaacctgaacagcgaaattttcgcttttttgtttattttgacataaattaaccaatttttaagaaaatttatatttcatcaatattttcataaaagccgtttaaatttaacaaaacgttaatgattcagtttctataatcatttaaaaagaaaaccaaattaaaatattagatagtttctgtctacgaaaatggccgaagcacatgagcaagtttgtaaataatataaaaatttatattattactagatattatattgaaaaatgaaagaatgtttaataatataaaatttccgcttaaaaataatcaaataaaaaaatttcatacaattttaaagtttaccggctggattctcgttaaaatttatggaattttcggtgaacggaaaaaggcgggaatcccgttcggaaatctaccaagtccttttgattttatgttccctttcccagaatanaatctatatataaacaaaataaaaatccttaatatacaggattttgtaatatgtgtgattccaaattctcaaagtgggccaacaaaaaatttcaataacaaaacatccaaaaaagcagcattgattttacgataacnataaatt

SEQ ID NO: 7073 - DNA, 2965 bp, Heterodera glycines
  misc_feature (62)..(62): n is a, c, g, or t
  misc_feature (80)..(80): n is a, c, g, or t
  misc_feature (92)..(93): n is a, c, g, or t
attacgaaagtcgtaattgcactgaaatgagatgaagaatcttaaatgagttttaagacttnttgttctggactttttcntttgtgtttttnnttagactttttatgaaaatttcctccccgacgaaggtgttgctccccgacattttttaatttctccagccatccccgacaaattctttcggggaatttcgccccgttccccgacattttgctccccgaggctcggggaggagccctagtgtaaatatacgtagtacaatttatgaaacaaaatccgtatattattttaattgttttaattttctgtctaattttttattttagtctaattttatattttctttcatttttagattgcaattaattggcttacattaaaatttactaatttagcaaaaaatcaagctgaacagcgaaatttttattttgacatacataaattaaccaatttttaagaaaatttatatttcatcaatattttcataaaagccgtttaaatttaacaaaacgttaatgattcagtttctataatcatttaaaaagaaaaccaaattaaaatattagatagtttctgtctacgaaaatggccgaagcacatgagcaagtttgtaaataatataaaaatttattaattattactagatattatattgaaaaatgaaagaatgtttaataatataaaatttccgcttaaaaataatcaaataaaaaaatttcatacaattttaaagtttaccggctggattctcgttaaaatttatggaattttcggtgaacggaaaaaggcgggaatcccgttcggaaatctaccaagtccttttgattttatgttccctttcccagaataaaatctatatataaacaaaataaaaatccttaatatacaggattttgtattatgtgtgattcccaaattctcaaagtgggccaacaaaaaattcaaataacaaaacatccaaaaaagcagcattgattttacgataacaataaattttataatccatttaattttataatcttagtttggaccagggatggcacggaattccgatttccgatttacgatttccgaaaaaattttggacgtcggaattccgacttccgatttccgaaatttttgataaaaagtcggaaattttcggaaatttttattgttgcggtcgaaaattttaggatggtgtttgttgtaggggcaatgaatgtgagtttcttttttcttttgaatttagtaattttttttaattttagtcaagcctatttatattttagatataaactcaaattttagatttaaattgaggtatgtgtaaattttacgaagttcttgcgtatacctataattcctgtagagttcctcagttggcaaccaccctcaaagatttattcagtatttaaattatttacagtttttttcatttgattttattggttataaagcttttaaatttatttataaattaactttttttttgttattttaattcaaggttcagttttaatttttataaagctattttaaattcatggaatattttttatttctttaattaagtttaaataataacaacaatttcgacatttatgctcgtttaatcctggaaaatgatttgaaatattaatctttacaatagaatgaactttggcatatggaatattcaaaaggttttgataacaggattaaattgaaaatttttatgttacatatagttatttttttattgaatgctcatagtctaaaataaatttttttaattaatattaatttatcaaataacattccattataaaagtgatggagtcttaaacatcaagaatttttgagctctttggttaggcttattttcgataaattgcccacatgatcattttggggcatattaattttatttggtccattttaatttttttttcaaattttgttaaaattttaatttaattgcatttattaataaaaccaagtcaattgaactaagatttccttattgtttttgtttgtaaaaatttatttttgtaggaattatttcagaataaaaacttttaatatgcttgtgcaaaaaatttttaaattataatttattatgaatattcatcaataatatttttaaagatttttttcttttaattttaaatcaaaacatatagtattatgtgaatttaagtagttagatttatatttacattttgtttgaatttttgtaatgaactcttttgctaacgaattttttaatatcacagcaacattaaatcacttggcttgtaatttgtccgcaattgatgcgggaactttctcgccaatataaacgacagatacccaccctattgtgtaagagctaatttgttcatttgtaatattttatattaaattattttttgtttctacttctagtaagtgttttttcttttcgttaaattatatgaaatgttgtcaattcaataatttcgatttttataaattttcaaattttaagatttttcttttcttgaaatgaattcgtatgtaggtatataggaatatgttcaatgttatttatttttctcaattttaaatcatttcgtcttcttgaaaaagcaaacgtgaataaagcgttcgcctcaatagcgacagaggcacattaattcatgatgtaaatcctctgttctcattaatttaatgataattataaattttaattgtttataattagttaaatataaataagataaagcaatattgaattttgactaaaataagcaaacaacgaccaattggttatttgggaaaggattgccaaaggcaaggaacagcacagactgacccacctcagacatctcgcagcccccgagggggaaattgagtggacttatatactggcacaatggggatgaactttggatgggatgaggggtaatgactagggttccaatttttaggcaaaagcctatttttttcctgagctccccgtggcctgaaacgcacgcaaaac

SEQ ID NO: 7074 - DNA, 1989 bp, Heterodera glycines
tgggctgttgttaagctacttttcgagttattagtgcctattttctaggcttttatttttagcgcctataaagcctaaaaaattttgaaaggacctatttttgcttattttggcgttttgcccaaaattattaacaaaaatgcaataaaaacgaaaaatacacccctaagaatcgacccaaaaatttctaaaaataaaccccctaagaaatgaaaaattttctcaaaaattcatcttcaaaatttatttatttattttcttgacaagaatttgtgatttaaaaattatttatctcaatactgatttggcctatttttttgaatacattttgtcattttacacccctaaatttgaggatttttagtgcctattttccattttttagtgcctattttgggggttttttagagcctaaaaattggaaccctagtattgacggtaaaacacaaaaggaatgagaggatggatggcatatgcaacagaggtgaatgagatagaaatggcacgataacattggaaatgagaggcgtaggattgtattgggatggaatttacagagggacaaatttatgacgggattgggtcggggaaagtagggcaatttacattatgcacaaaatataaattttgattgctgcggatacaacaacttcccattttttagttatatattttctcatattgtaattttaatttatttatttaaacttattttgcaataattttccaaaatatatttattctcttttaaattgaagcttttataaattcgtaatgtatagtcggcttatttttaaatatttactttattttccatcatctcgcttcctagaaagtattacatgtaggccattagttctctttttaatatttaatttatcatgattttaattattattccctaaaaaaacaaaaaaatatatattttccaattttttaatattaaaatttaatgtaattggaaatttttaattatttatttattttttataaaacatttctaacagcgggtattattttatgtcagaattaaagaaatttatttggtatgtaaaataattttgaatttttttttgcaatctaaataaatattttgctgtttaaatattatgccaatgaatagtaggattttcttttaaagaaaaaattaaataacaacaaagttcaaaaaaattgttgaaatgtaatttaaatttctcaaataattatattataaaatttttttctttgaaattcccgctagaatataaagagcttcatcataaattaattttgaaatttggtatttattgcttgatttgcttatattaattgctatatattgtaatttttatttcttgtgtgtaaacttaatttattctttaattcaagcatttttatttcaaatttaaatcataaacatcttaattattatctaaattaaggtttaggctttcaatattttaagtgtttattttaaaaaaataagttggctatgcctttgcttatattttttttatcaatgcttttctattttaggcatcaaattaaaaccaatttgataactttggatcagtgaagaaaaactttcaacagaaatcatttgacgaaatatgttgggagatgggaataaaaagaagcaaaaaaagaaataattgtaaaattataaaataaaaaataaagcaaaaaagaagaaatactcaaaaaagaatgaagtaaaattgaaggaaaattcggcacaaacccaaaagaaaatttatgataggattaaagaatttgggcttaatcaaaacaaattttacaaatcaacaagtaatgacaaaaaattaaagatgtgcaaaaattcaatatgcattaatttggttttaatttattttttatatttttatgaaatactttacaattaactctcaaataaatacaaaaattatggttgagtcgcagattacgaaatgatacaacatttaataaaggcagctttgccaattttgttctttagagttaaatgat

SEQ ID NO: 7075 - DNA, 4445 bp, Heterodera glycines
ccgattttggtaggaatagattctgcaacacgtagcgcacgactggcatgcaaaggctctttgtgccaagcattgcctgcccaaatgtcagtttcgaggtccacagggttttaagccgccccatgaactttcccctgactgactcaagactgtctttgcttacaatcatgaatctctcgtgcattcccaggtacttgtaagtgccgacaagttctggtacacccaagacggctttgccacttttcccgccgtcctggtcgagccacgcagatttcttgtagtggatcgtcagaccgagggcagaagcgctcttctgcacctgctgaataactgctgtcaacacttccctgtctgggcaatagcatttcaggtcgtccatgtaaaacacgtgtccgacactaaagccctgctgaagatggtttgcacaacgaaactgatactgaggaaattggtctagggcgaacgagattggccaaacagataggcagaaaagcaggggcgatagggtgtccccttggaatacgccggttcgcaccgggatggtcttgggcatgacctttccacctatctttaacctcgttacccattgatccatcacagagacaatgacagacaagatgaccggggggagtccgatgactctcaggatccagcgaattaagttgtgcggtactgagtcaaacgctttcttgaagtcgaaccagcagactccaagtgggcgtttagctcttctcgcgtcagccaccgttagcgcatcgatcatcagggacacagaggtgccccaaacgccttttcgcagtgctacttgttgtctaggtaggccaccaagaacatcaacgtaacttgcggttatttgtgcgataacggcagtgaagagtttgtagcatgtatttaggcatgtgattggccggtagttactagggtcggcattgtcactactcttaggcagcaggacagtgagcccattgcagatccagttagctactggttctgcccctcgtattacttggaccacccacgtagccacatacggtgcaattcgccggaacactccccaccacgcggcacggataccatcaggaccgggagctttgcccttcttcattttccgaagggccgcgctgaacatctgaaccaatgagctggttccgacgttcgtcagatccgtgtgtcgcgcagcagaaagctggtttttgaattccctcagttgacagtcatccgtgttagcacggaggctctgcgcccaaaggctatgccagaacgtgtaaacttcattcccgttaaggggtggattgacaggtgcttcagtaacagaacgtaaagaaggtcttagtcggaatctccgcctagggccttcataagacgatctattacctctcccagctattctttgccggaccaggtcagctagttgtttgagtctctcgaccctcacaccaagtatcctgatccgcctgctcatccatggttgttcccgggcacaccggagtttcctttcggctttagctcgccgtctggatacttcggacagagtggcagaatcgttgatgtgcagccgatcagcaagagtttccactctctcccggcggctcagaaccctagcggctgcaaagaccgcgacattcagttcaaggaaccaatcaagtcccctgttgatgtcacgctccacgcgcgccacaatgagttgctcgagtagggctactcgttcgggctctcgtttctgtgggagtggtggacctgcgccacgcttatacatttggtcgggaggcgttcttccgacacgcctcacctcccggttgaactccctcttcagctctacgtccatcacgacattcccgagttccatctcctcggctgcccatcccattgcccggcctaattgcggctttaccagttggacaagtgagagtgggtcaagcatcggttctggttcggattctgtgggtgggtgtgtcaacacatccgtaggtgcaggcctgtccacctctggaaccaaatcttgttccttacgtgaagaggtggatggaaccctgcgtttccgaggtggaaccacatcgcgaacggcgttgcgcagccgcttacgcgtgatcctctctgtcgcccctaagtcgagcggctcgcgttctccaaagggactcgaccgggatacctcagctaaggcagtctcggtctcatcggaatcgattacaccatgaccgtctgtgccacaagggacagtacgttgaggtagctcggccaccgtatcatgggccaacctggctggttggatttttacatctgaaaggtcttgtgagggcccggagccttctttcgaagggcatccaggaccaacatgggtccgccgcagagatgcccacttattggacagcgatggagacgatcgagccatgtacatggtcgggttgagctggcacaatctttgccattcagggagcacacctttggcccaattaatgagcccccggtcgtctgtgtttcgcaccactacatcctttaaagcggactcctccacggctgaccactgctgaaccctctgggtccggactaggccggattgagcgcaggcatttataggaatagttataccgttttgcctttgaatcgctaccgccttaccacggggggccgcgggattggttcggttttggccgcaccctccctctcggacctcatcaggggctggtatcccggcgtgggtcggcgtcttgtcactgcgggctctaaagagagccatttgggttaaggtttctctttccaaatcacaggatatcatttcgctttgatcgcttttcaaatgtattggttagaccgtatacaagtgatcttgcgccaccccagctccaagggtggcgcgccaagctagtaaggccagccccagctcaaagggtcgtaccccaagctagcaaggccggccccagctcaaggtggtaccccaagctagcaaggtaaaaaagagtggtgatcctccactcctgcgatcagcgagggaggagttgcacaggctccatcctgcgcgcagtgcaagactctggcttcaagaatccgcacgtgggagacacacgtgtggtcgcaaggtccttcatagccggagcttttacggccctttctcgtgccctgcttactagcatattactctatgctacctgttagcaagcaggttggtacactcggccatccgaaccccactagctcacagttctgaaaccagcaacgcagccttcgcctacgagggctagggctttcggtgcgtgtgggattacacgagactgtcatgttcctaaccagtgcgagccaacaccagaaaggggcctggacttaggttcaagttacagggtgaggctggagtctccatggccattccccttcgggctcgttatgacagcttcgacgtggtgcagcggggtaacacacggatgcccccgagctcactccgaagtgagtctgtccgtgccattcggcccgaccatttttaggtttcacgaaataccgccctgtaatctttcgccatatccgggaagaactgtcaagctcaacagaaatactggacccgcagctaagaaggcccagacgtttttggccgatgggaaggtaacccagcgccctcggattagcgcaacccgtgcagcacctagggactttcgcgacctgtaggccaactcctaccaggctccccggaggttccgagtatcgccacactcgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacacagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacaaaacgtctgcgagttcatttgcgttaccgcgcaaaacatagggagagaaccgtcatttccctagcctggcgtgggaatgttaa

SEQ ID NO: 7076 - DNA, 3116 bp, Heterodera glycines
  misc_feature (2446)..(2446): n is a, c, g, or t
  misc_feature (2467)..(2467): n is a, c, g, or t
attcaggggaaaagtgttggcaaagtgtgccaatctccgcctcccaaatcactcccacctcatcacaaatcaccaagccaatttccttctcgtgcaaaatgtccgtgtaaagtcggaatgtctcatacgaaatgataatcaccggcgtcggcactctttggcccgtctgactgacaaattgttctgtcaattgaattcgcaattgcttctgccgcccaaaaagtcgtacttaaattgcgtataatgtcctcgcgtttgcccgagtcaattggcaaagaattgactcggccgtggagccatttggcaatttccttgtcccaattcttcaccaaactgctcggacacacgatgatacaacggttaatggccggggcagcttggggactttgacgctgcagaaaaaggggaccaaattaaatccaaacgcattttaacaattcaaatatttgaaaaggccttcgccatacatgcgcaaagggggcagggacggtcccaggatttcggcttggggggtggggtacctccccccgggcgacgacctttttcctcttttttttgttgttggttttcacaccagtttttttttgcggcggtttttccaaaaaactttttgtggaacaggggtccggcggtggggagcagctcgtttcccccccgcatcgtttcccccccgagaaaattttaaaaaaaaaattgctaacttagaaatttttcaagaaaaaaatcttagaaagttttttcataagaaaattctaagaaaaaaattttttcagaaattttcagcaattttttggaaaattttttgaaaaaacttggtaattcaccataaaatttctgaaaaaatattttttttcttagaattttcttatgagaaaactttaagatttttttcttgaaaaatttttaagttagcaaattttttttttttggctttaagaatgtttattaaggattttagaggtccggtatgctgactttgctcaggaagtaaaaggaaatactgattatcatataaatgacattcgatgatgcaattgttagagtggtaaaagacaacgcgaagtgatggacaatcgctgagaagtgacgggacaaattgtcacaaacggcggaaaattctggaggacaatccatggcacaaatattttttccaagcattggccaaatgttgcgcaaaatgaactccaaaaggcggtcactgcccgtaccgatggcaaaattaattggacagacatcgaaaagacgatgaaaacggtggagaaaagcgatgacattttggtcgatgaaactgtgaattgacgttgaagcggatgaacaatattggccatttccttctgatccgttgtccaattgtgcgcgacgaaagcaaatggacaaaatgtgagaaggaagcgattgactggcaattttatgatcaatggaacagaatcgacattccagtttcgtaatgcaaagatcggcccaagtgatcagaagcagtgaattgtttgaatgatcgatcaatttttaattattgatttattgtcgtgtgctcatatactaaagcctaggcctagcctaacagtaggggtcagttccgtctggccagttccgtctcgccagttccgtcttagtactcaaagggccggttccgtctcaaatatttttggactcaaattttttaaaatcaataactaatttagaaaaaaaagtaaaaattcttttactacgcagcctaccgcagcctaaatatacctggttttttaaaagttgtggttaattaaaagtatattcgaaaataaaaattttttgaaataaatttaacattgcaaatgtccagtaattctgctcgggattctcagtcttggtcctcgtgtcgggaaatttagcagccttaatgtgtccagcacttttgcagcgaatccggcacccattttggaccccgaacccgaatataaagattaatttacataaatttcgtctaattttcaaaaatacacccctgagaatgaaaaatttcctcaaaaattttgttattttatacccctaaattgaaactttaacacctattttgaggtttttagaaccgaaaacctaaatattttggcagtttttagtttttaacacccaaaaatattaggcatattaaatatcagggctgccaaaaacatgcaaatgtatttttttcctgccttttccatgctataaataataggaaaaacacgttctttttttgtgtttgcgtagaaaaatcggtatttttatttgcatattttgcatatttcgagatttttgtgcatatgcatattttggctacttttcgtgcatatttttggcagcactgttaattatatctcaactttctgtttacattctgaaatttaaaaaaatttgggtccaaaaatatttgagacggaaccggctcttttactactaagacggaactggcgagacggaactggcagancggaaccgggcccagaccganctgacccggtttgatcgaccccgccaaaatctgttgaaactatctccggctttatttttgagcaaaaaaattcttaaaatttcaatttttatgataaactgcaaaatgatggcgaaataattttaattttgacaaaaatattcagaaaaagaggcagacattttggcatttggccacatgataaagtgcaaaaaaattggccaaatgaattttgtgtatttaaatgcaatatacgattattaatttcacattcgacgacaattatccaatccaattttttcaaatccatccattactgaagaatgaacccctcttttgcaatgcttacgagtgccgttctcctcttcgcatttgccaatgccgtttatggagcaaaagagtgcactttcaaattccaaataaaaagaacgtattttgttaaatacacttttgattattctccggtctatagctttggcgattgtacagattcttttgaaattcaattggatgggcataatagtattcaaattgcatataaaccaaaggatatcaaaggagcaaaattggttgatttttggttgattccgtgttgattgtgagccggacataaaaaatctcaaatttttttttgtaatgatcagggaaaggatttttaggtgctaaaaat

SEQ ID NO: 7077 - DNA, 3086 bp, Heterodera glycines
taataaatttaaattatcaaattgcaatttttgttaactttaggccgctgggcaagatgggaggaggaggactgccctcgctcgtacaaacaatggactggaggcaactcatctgcattttatggtttttaatttactacgggcaaatttttaaaaatatatttagaaaggtctctgtcacaacccggcactctctgacttaatctgtggagtcaatgaaagcatcgacagacaggtggacgctgcccgatctgctcgccatttcattcacaagcgacacaaacgatacatcctccaggatgctgtcattatgagaattttggcggacgcgtcatacaacaacaagggtgaaattcgtgatctgatgacggcgctcggtctacaaattgaaggatatgcagcaaaattgaaagatttcgtgaattttgatgattcgattgttcgtattccgtgatgaattttttattgaatgtttaataaattcattcattttttatatttatatttgggtcctgggttaggaaatgggttaggtaaatgtcatattcgtactcagcgactccaaaaaccctaaattagatccgttttccgggtttttatgtgctttttagacttttggacatttcgtgttttttactcttatggacatttcgaggcttggacatttcgtggcttggacatttcgttggtcagcgcattaaaaattattgaaataaaagtgaacaaaacgccaatgaaaaacagacagcggaattagacactatatgttttatcattgattttaactaaatttctaatacttataacttggtgaagggtaaaccaaacaaaaccattttgtgctcattttgatgggaaaattcttaagaatatttcaaagttaaaaaaattttgaaaaaatagtttattagcaagaaaatgaaccatgtgttatcttatatgttagagacatggaaatagtgcgtcaaaatgagagaaaaagaaaaaactttgcccttggaaaaaattttttcctgtgggtaactttttttgaaattttgcataggcccatattttgaccccctttaacgattccaagtttattttatggaacttaagtttttaactcgagatcggctcttcagtttttacaagggaaaatcttggcaaaatttttaaattagtggagttttttggcgttttgtctgtgcgcacttttggtcaaattgatgatatatgtgttcatgatcgaccggatggccaaattgattggaaaaattggacgaaaatggtggaaaaaagcgatggcatttcggtcgatgaatctgaaaatgaatgggaagtgttaccgaactttttgcataatcgcctattttacaagatgtcgatgcgttcgaatccgacgattttctttggcaacggattttgcggaattggcatcgatttccaatcagaattgacaatttccatttcatttgtgccattctttccaattttgcttccaatttgaatatgtttcagcgtccatttgcgcgttttgaagtgttcgtccacgtaaaagtcaaatcggtggctgatcagcgcaattccaaggccaagttgagaaggtggcagcaaatcgaagacacaaagccaacaatcaccggagatgaagcagaaaaaaggaaaacaaaatttaaaattcaaattgaaaaattgcatttttaattttacattgcttttgccatcttttcctccgcctcttttcggttgtctgacattttgttgtggcaaattattaagcacagtttttgacggatttcaattagcttagcatatttatttttaaaaaaattcaagagaaaaaaaccattaaaatggtcaatttaaatggattagttttcgtttttgtgtatgaagcaacaaaaaaccatttttaattcgttcaaattaaaaaacgaaactaacaaattaaagagcaattggaatttaaagaaatatggagggtatcaaaaacaaagtgactgtgaaacatttgttagacaatatttttgtagaaaaaatattggcaaaatttgaagcaatttcaatcaaaaatcgatgggattggggcgtgctgagtcgatccacaaaaaatctcagtgtgggcgatccacaaaaaatctcagtgaataattaaataattaattttaattatatagaacgtgtcactgaattaattataattaaatttattttataccattatatttcaagataaatttaaaaagaacaaataaaaatttgtcatttttgttctaattttttgcataaatatcttttgtcatttatggcaaaaaatgcaaaaaaaaaaggtaaacaaaaggaatggcatgaaatttcatactaaaattgaaaaaagaatattttgcagttacaggcagcgaaaattatttaatattgagtgttattgatttgacacatgaattttgtgaagcgcataatataatacaaaattattattattcactgagattttttgtggatcgacctagcaccccgcacgactcttcgttctgcacactccgtggtgcatggcactcttgggccttctcgaagtggtaggttcgggtcgattcccgataatcgaatgaatggttggccgctgatcattccggcaatgttgatgagcatgatcaacagtgccatcctcgttcttggttgaattgcgcctcgctttcgtggttcatgacgctccggggaccaaatctcccggtttctccgagtccttgccgatttcttttgttcagctccaggtactgcttgaacttcttggatgtcttttccgtcgtgtttattgggcgttcgttcgagtttattttgatgctgttcgaccgcaggtgcttcgggaaattcgcccctctttcgtccgtttcgcccatttttggcggcgcttcttccagcggcccaattttgttgatcggtcgtccccgaattcgcccgttggcccttccgatcatggcgcttctggcatgcttgctcactcctttggtctcgactatccgtccaatggtccgctgtcgctggtttgggtccatttccccaattggctccgcttgaggcttaatggcttcgttcgtacccgaccg

SEQ ID NO: 7078 - DNA, 1248 bp, Heterodera glycines
  misc_feature (1225)..(1225): n is a, c, g, or t
cacaaaaactgtccccaaactcacctctttccggggcatatccgatgtccaaatgcgataccgatccgcttcgtagccaagcgttgcggcgtagacgatcagcacctccaaactttcacactccctgaaccgtcgcatcttggcttgaccgtttgggaagcgaagacggattgtaatcacttccggctcgctctcatctggttcggtgggcaacaacttgaccaagcagtccaggtgttctttgcgctccttctcgttctgtgcccggttttccgcttcctctctgtgaagcaggggaggggagaactgttacaacaaacagacctttacaagatgaatgatagcataagacaccgaaaaagtggaattttgcgactttttgttcgagtttcgggtcatgagaatcggaattaaatgaatcggtcagtcatttggctacaagtcgtctcgacaactcaatgaaaatgcgtcatttcgctttgaaattgtacccaattgaggtgagtaaggcctgccataggaaggataaagaatcgatgaatagtgataatttcttacctcaactttcaaaacccaaattaaatctttaacaaaaatcgtctcaaatttttcattattgtcacaattttttcttgtgatcacagattgcttttgttcattttttaaatatggtctccatcgaagaacaataaaattttagactcaattcttaaagttgttgaacgaaggacggtcttaaaagtatccattttactattagtagacgaaacgacttgtagcgaaacgatatgaagccatgagtgcctatcaatgataaactatcatgaaacccctatggcaagtgttttatgtcgaaataaaattttagtaagccaaatatgggacctaaactggactagaaatggttcagctaccatcatttgctactcaactgttccttctgctttccggggcatgtccgatgtccaaatgcgataccgatccgcttcgtagccaagcgttgcggcgtagacgagcagcacctccaaactttcacactccctgaaccgtcgcatcttggcttgaccgtttgggaagcgaagacggattgtgatcacttccggctcgctctcgggcggttcggtgggcaacaacttggtcaatcagtccaggtgttttttgcgctccttctcgttctgtgcccgttttccgctccctatagcaggatttgaaaaactttttgtanaaaaaatttagtagtcagcacca

SEQ ID NO: 7079 - DNA, 1034 bp, Heterodera glycines
  misc_feature (1003)..(1003): n is a, c, g, or t
aaaaaaaggaaaaccgtttgagcaaagatgtgagccgcaacggcacagtcgtcgtggaggtaaatggccaaaggccgacgatgttcagcgccactcgcgggcgagtcgaacgcctcggcaatggcatcctgcaagatccatggaagaaaggcgcatgctgggctccatatctgtacaaatgatggtgaaagcacaaacgaaaaacttataaatttctcataacgcattttctggacaccaaacgagttaaatgcacgattgaatcccattttgaagtctacaaactaaagccttctcttcggtgattgatgccatataaccaacccaatgacaagccggcccaaaaattttgaacccacaaagaaaaacctcggtcaacattaggattctgcatggcctccggaatggaagtgaattcggtggacaccaacggcagttggttgacatcgtttgacgatgtgctccgctccaactccaagtccgtgtcgcaatagctttcgtcgccgtctccgtccattttttgcacgacaatcaaattttaatagagaattcggaagagaaggaagtaatatttattataaggggcttcaatatgctgaaaaaagcaataaaataagcaatgaaggaaatgtataaaagcagccatttaattgtaaatagaaaattaatttatccgtggataaggcagcacgaagatcggcaataattgttacgcgcgttatacgcaagtaacgcaattccatgggaagacacggaaatcccgtttcccgacttttttgcccggacggattttgtgggaacggaaaaaagacggtgtttcgttttcccgtttccatattggaaaaattgccgaatatggtatcggctcaaaatcgcacaaaaacacttttaggcaatcatggagtttactggtcccgttttttttttctttaaaaatcatggaaaaatttttctagggctattttactgtgctgagcacgaatccgaccttattattgaccgnattctgaaccccgaacccggattcgaacatt

SEQ ID NO: 7080 - DNA, 2693 bp, Heterodera glycines
  misc_feature (2674)..(2674): n is a, c, g, or t
cctgcggatcacgcgcggacttcttccgtagcccgtagtctcgccccacctactggccgccgtagtcgagtgtgcggcggttttttagcgcaataaccaaaatgacctatttgcaccagtttcactgcattttcgagttttaaaccggttcaaaaaccggtttaaatgcttttccgcgcccaattttaagcttttatatcgttctcagcacctaagaaaacctataaaagtgtttttgtgcgattttgagccgataccgtattcggcaattttaccaataactttgctgctgaatttgaatttgagacaagcaattatgtgccaggaaaacttaaacctatagaaagagacggaaattgtggatttcgtagtcagggatgcgatcgccaaaacccaaaaaccgggcgcgcgagttgaaaaacccggcaaaaattttcaaaaacccggcaaaaaacccggcaattttttaagccaattattcactgtaaaaaaggtcaataacatttaaacaatatatttatcaccacttttcacctgtttgaacaaatttggcattgaaagaatgtaaccatgagcgtttgggcacaaaatatttgaattaaatttgattgaaattaatgagtttaaccagggttgccagattaaaattttcaaaagcctcatttggtcggcaaaaaagcctcattttgggtcaaaaagcctcatttttacaaatttattcaaaacacattaaaaatgttcaaatattatatttttattttccatgatcaatttgagcaattttttgttagaaataagcattttgtgaaattcttagcacgaaaatcgaagttgattttttgcggcgcttttttctaaaaaaaacttggggaaaagggaggccggcggtgccgataggcgccgccgggaaaaattttgtgatttttaatacaatttgttaacagatttgaccacaaaaatgaccaaattttgcgattttgagcaaatttttaagaaaataaaggatccctggagctcaaataaatgaattgaaataggaaacccggcaaaaacccaaaaacccggcaaaaacccggcaacttcaaaaacccggcaaggacccccaaaacccggcaaatgccgggtttaccaggtaaaatcgcacccctgttcgtagtataagctgggcaattacgggatctgaagctaatcatgatgagattcgaaaggatgtaatggaatatcttgaggaaactttgtatcagtactcgttagaacccacagtaaacgactggtggggtaagttagatatagtttgcaggatttgctatttaattatttagaaatgttttttgaaaatgttgtagctgccagaaggcgtgcaaccattaaaaagtttccggctgaaagtgcggcagaagacgataaatggatgaacgaagccgacatgtttatcgcggcaaaaatgtttaaaattaatgtcatattttataagctcagcgacaacccagatcatatttggcaaatttttacgccaggcatgcaaaaaagcgtaagaatttttagaattttgttaattaaacaatttttggacggttttaagcttttaaatccggagcaagaccgtgaagtaccatctatctttatttataatgaaagtggtcgttttgaaatcattcttgaacccgagcgtttgtctcagaaatctatgacgaattaacatttaaaaattagcggaatttattaaaatcgtaaaattttttactgttatttcattatttatggttataaaattataaaaatattttgagtcacattaaatataggtaaataagaaaccatgtgaaggaaactaaatttatttatttaatataattttctgtactgaaatgaccccatccctcttctgaaagtctctcactgatatttttgtcacttcggctcaccacgctattctcatgtctctaaccttcaaagagcattttgaaaagagacacataatatctctttcgctccctttcaatttcctttcaatcatttgttcgttgttctaaaattggccattagaatttttacaaaaaaatttaattgccccctaatttaaatcttaaaattattttctaacaattcattacaagaaataaaaaacaaatataaggtgtgttagtttatgaaggaatttgacatgttggcacacaggcattagtcggaatgccgtttcggatttggggtcggaaaaaagctgctccgtttcgtaactcacgacatcccttttcgagaagcatcatgaattatggcatctgaattcgctcctctctcctgctgctgctctgtccaatccttttttccctaatacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacttgtccagaactttttaaaaacccaatgaatttttttttaattttaaaaataattagagaattcttagggctatcgaatgatttataacttttctcagaagcagttaaattattttttttttttgaattttaactcctctatatatctaataaatattaaaattccataaaatgtcattgggtttcaaaanaagttctgggacaatcaat

SEQ ID NO: 7081 - DNA, 1964 bp, Heterodera glycines
  misc_feature (1947)..(1947): n is a, c, g, or t
gccggatttttaaaattcactttcttgcggtttaaaaccctttgctgtctaaaaaaataatttgcagaaaaaatattaattttttcgagttacaggaattcagaatacacagaggaaaagctgctgttcatgaaaagggtggaggaaataattttggacaccgcgtcaccgcccaattcgacaaaacggcgacagtttgtggaggaggcggtggaccatctgaggacgcaattgggacacggtcccccacccgcggaccccgaatggacttttctgacatcgatgtaggcacatcgatagccatatggccggtgctaggtcgaaccgaaaatggtctcagtgtgaataaaaatatttaaatttaattatacgattcactaaattcatataattatataaaaaaataatagcgtgtgaatcaataattcctaatacgtataattgaatgaatttgatgcatttgcttgttcaaaattatttaaaataaacattattatttgtacaaaggcactaaaataggcactaaaaaattgaaaaaaaggcacgaaaatcccgaaaaaggcaaaaaaaggcataataaaagtcaacgtagaacctcaaaccaagtggaaaggtgttatttatgcttaatatatcgaaactacttcgcagaaaaaaaaggcatatgcctcaaaatgcgagcctctattcatcagcaacagacggacggacggacgatgtgtgagccgcttgtttttgaagccaaataaatgcttttcaccttactctcattcatatccgatgtctgcctgctgctgctgctttgtctcttccatttttttgggctggtgcgtttcttccgtctcaattttcatttcaattaaaaattttgttcaattttaacgcttgcttttttcaaaatcaatattttcgccgccaccggcgccgtcattttctgtgccaaaaaatgaatgcttaatttttgagggattatttttgtatttggccatacactgatacgatacacattatgtttatgtttagtttatggcttgtaccgctttatggtttgaaaaaaagaaacatatacctaaatgttttcttttttaacgaaatggggcaaaaacagctcttttcctaaatgaaaataattttaaaaacataatttttggcacagaaattttcctttcaaccgccaattcatttaaaacctattaattttactttgaacttttttaaatctatttttattaagatattatccctgatattttttagcgcataattaaaattaagatattttttcttttttgctcatccaaccaaccaatcaacgaactcattaaatcatcatttttttaaattaaattttgaaaaatttaatttgactgccttccacctaataaagaattcacagaattaaacccacgcaaaaatttcttcgtgtctcaataattgttaagcattataatcaaaataggtgggaaattaacggcaaactttgcaaattattatcatgaaaaatacaataattataatttgccatttgttcgcgaaaatgtcaaacgacggcattggcattggcatcggcatgaaaaagaaccgcgccaaattacacatgtacaaacagatacatttcaaaagggtgcctaccacctcttagcaacaaatttttgttgtcatttccgtccagccttaaattttttggtacaatttttcactaaaatatattttataaattgttcatttgtccaatctaaattgtcaattaaattaattaaactaattaattggcaactgttattgtgtgtctgttggcgtcatgaacttttcacgcaaaaaagtttcacgcacggcttttttattttgcacgcatcgaacttaatagatagattttacttagctatgtctcattaatttttaaagacagtttatttaatgaaaaatttaatttttctccttttccanaaagttcatttcattgt

SEQ ID NO: 7082 - DNA, 1707 bp, Heterodera glycines
ttttcccagggatccctcttatgctaattacgcttaatgaactcggcaaatttctttacaaaaccatcaacgagttcattgcaatgctgaacaacagatgcaaaatgttgcacaaattttgtaaacgcttcaagaaaaagcattggaaaaaggaagggaaaagcggagacgaagaaatggacgaggaaatggagaaggacagcaacgaaaagaggaataaaatgcaggaagaactgaaggcggtcagcttcagactgtgggtggccaattagcaataattagcaactttgaattgggcaatttcaataggatattgcccaatgaatgtttgcttatcaacgaatgaatcgcaaatttatttagacttatttttgttaaaaaatttagaaattcgacggaagaacaatcgcagacggaccattcggagaagtcgacaatctctgccggcacttcgcctaaatcggtgcataaaaacagcaacaacaacgcggtttggagcacacaaaatgcgtccgattttggcattttaatggaagaagcgacggaaagtgaagaagaaaatggagaggaagaagaagaagaagaggatgaacacggcattgtgagccgagcaaagggtgagaaatgagagaagaggagggacaaaatgccaaagctaatgagcaaagagcgcgattttaaatgatggggctatcgaataacagtaggtggtgagtgagttaatggagggtattttcggcacttagtccccccgggactcaattgggccgaaatgggaggcttattaagcccggcattgacttaatttaggattttttctggaaatttcacccctttcgcgccaggtgacgcgtcaaaagcgcatcagcaaagcgatgcgccacgaatgcacgtaatggtggccatagtgacaacatttgcttggatctttctctgtgccgcactgttcaaattgtgggaaaatgtgagaggaagcaaaattcagaaacatttaagaaaatgaaatttaaatttggatatatcggcggacggtgccgaagggaccatatgggaattataaaaattcatgttgtttttgacaaatatttttggcgtcaaattttgcccaaattaatgaaaggaatttgaaggaatggacttattggaattcactttacttcatgtttatctctctgttaaccattggtcttggcgatgtgaatgtccatcgacgggatttggtagggattttaattggtcacaattacccatttctgatcactctgatcagatggttttctgtttcattttcgtcatcattggcctttcccttgtctcaatgtgtataaatgtgatacaatcctcgctggaggacttctacagaaaaatgctaatgaaaatacttgcggattaccaagcttcgcttaacaaaggttaaaatatgtatgggcaatttcttggcatcattcaatagccctaagtatcctctattagcctacaaaatttcaaaaaatttcgttaattttcaacaaacttatgaccaaaagtacatcagaaaccgggtttttcagcttttttggccataacttttttgaaccttaacgaaattttgcaggcgaatagagcatgtgaagggctttcgaatgatatcaagaaaattagatttggttgacaatggaaaaagttatagttcaaaaactaggctggcgcgaaaacgaccccgaccca

SEQ ID NO: 7083 - DNA, 3466 bp, Heterodera glycines
agcacaaactacggcgaagacgatgatgctgcccggctggacgctgttgttggtggcatattgcgtgtgtttggcacttggcattgttggcacaatgggggcaagcgcggaactgataccaagcaaaatgttcaatcacaacaacaaccacaacttcaacaacaacaatgaccagaagcaattaggggctaatgattttgcggaaaaccctcagcgacaggcgggcaacaacggaggcgacaacaacaacttgttgctggcccaaccgtcggcattccaacttcaaaaacaaatgatgatgagggcggcaatggcagcagcagccaaagtggcacaacagaaacaacggcagcaccaccaccaccacatgccgcaccataatcatcatcaccaccagcagaacaatgtggatggaagcagcaaatttggggtggtggagcaggaggagaaaagtggtgaggaattttttatgtttaatacagggatgcgatctgttctgatttatcagaaatgttctgatttgaagggtccaaatctgataaaataaaaatgttctgattttggggtagcgaccaaaatttgttctgatttcttaaacaaactcataattttaaaattttatggcctaatgtcactattttacaaaaaaaatataaaatttatggcaaaatttggtcattttttggacaaaaatctgttaacaaatcgtactaaaatcacaaatttttcccggcggcacctatcggcgccgccggatcccctgtcctccaaaatttttgggagaagggccccgcaaaaaaagcgtttttaaaagcgaaaaaaaagtcgtcgcttggtttttaattgcaaaattggcattttttggtgaaaatctgttaacaaatcagaacgaaattacaaaaaattttccggcggcgcctatcggcaccgccggaccctccccctcgcccatttcccaaaagttttttgggaaaatgcgccgcaaaaaattcttaaaaatctgattttttgatcccgagtgcactgaaatttacgatttgttaatttcctcaccaaaatttttaaagatgataattggaggcgaaaaatataatatttaatgatttttgattaaattaattgtaaaaataaaagatttgaagcaattttgcaaaatgttctgatttttgaccccaaaatctgattttttgggcccgatgtcctgattttgaaaaattttcgatcgcatccctgctttatttataaataaataaatgaaaaataaagaaataaaaccccgcaattttgatttggacatcgtttggacacttctgacaatatattcatcgtttcttcgtcaattgagtcgttttcccacttggagagtaatgaacaactaaaaatcgattttatttgaaaccaagaagcattatgtccgtttacctgattggagcatgcgggtacttggaatcaaaaaaaaaatgttaatttggtaattcccattatcgttactttagtgcaggcaaaacaaaaggcccgtttacaggtgcacttgactatgcagggcccgacttcattgactttgataattttcgagcacgtactttgggggcatgattccacaaacggattacgctaaaacagattaatttaatacattgacaatgcctaaacaaccatactttgacaatggttttcagagccaacgccaagaatctcggaacaagtttttttttgttcgcagccaattcagcatattctccaatgtattccacatcattgattttgttaaattcttcaaacgtttgactgatgaattgttcatcaacaaaatgggaacagccaaagcaaggcaaaacgactgactgtttaagatttatctaaaaactttgtaataatttaataacgtgaattttcaatactcgcctctttccaaaaatagcgactccagcatccgacacaaaagaaacacccacatggcgacattttgccaaattgttcaccgtcacacgtttcgcacttttcaccctccgccggcgcctttgggttcccagtggcaatttttttttcttcaaaaatgcctccttatctgctgctcggttatgcctaaatttaggaaataaaataagaataaaaatgaaatattactctgctgtcaatgtcttctcgtcccaattataaatgttcaacatgagttttgtcattgattcagaaattcccaaatctgctgctgtcaattgcgtaagtttctgcatctctttcaaaaattcttctcttgtcaaaatctacaaataaattatttcaataacaatatacccccggacaaatgaccgtgtacggtgccattggctccattcttttgctgagaaaatttattagcagtaatttctgtaactatctgaaaatttttcataaaatttgatatattttaaatctggtttttaaatgtgaccaaaaataggaggcaatttcataaatttgtcaaaaattatactggaactttcaaattcccttgagcgcctatcggcaccgtcagaccctaaaaatgtgccaatttttgtgatatgattagatgaaccatgacattactcagtagggcttcgatttttaggtaaatacctaaaatttttgcgcacttgtaacgttgagataagcataaaaaacgagtttttagcttggtttggagcttctacacccacttttataatacctatttttacctatttcgggatttttctacctattacctaggtacctatttttatacctatttcggcattttggttacctattttaaggattttcaaaaaattcttaacaaaaatgcaataaaatcaaaaaatatacccataagaatcgaccaaaaaaattttcaaaaatacaccctaagaattggaaaaatttctcaaaaatttatcccaaaatttatttattttttctattgacaaaatttttaatttaaaatgtcaatattatctaagaaaatattaatttatttaaattttcgtttacaaagagatatgtagaaccaaaattttccctctttgtttgcttttttccactaaaaaattgttaataaaaatttttatttacctattttggaatttttgtacctattttgagatttttttttaactttttaagtacctattctgcaatttttttttttggcaattgaaccgaggcccaattattgttggggagacggcggtggcggttaaatgggaagacgcaaattgggacgacaaattgaacaatgtctattttgctttatgggctgatcgcacttgtattgggtgagcagcagtaacaaacacagcatttgaactgagaccggacgggatcgggatcccgcatgattaaattcgggatccgtcccgagccttttttaaattcttcgggattgggagaggtccctccgaccccaaataccggtcgctcgggcggtgggaagagaattaaaatttaattttaaccgcattgtcgc

SEQ ID NO: 7084 - DNA, 1165 bp, Heterodera glycines
taaaaataaataaatacaaataaataataaattaaatatcatttataataataaaaagaataaattaaatattttggtaaaattaaaatattgttctgcaatgcgccagacactgatgactttctttctgccgcttttcatcttcttcgcccatctgacagcgagtctcttcggtaagcaatttgagtccacaaatcatcattttaaaattatgtttattttttttatataaattttcaaggcctcaagtgcaaatttggagacgaaatgcggccagcattgatcaaaaaattcatggactccggacagtgccctcctacaacggatggacaggagacgaagcattgtgtggcaaaaatctgtacaacaggtccaccatcacccgctccaaatgggcgctgaccaaatggacgctagctagatcgggaaaatctcgaaaaatttggttaaatttcaaaaaagttacggccaaatgatttttcgaatcttttggtcgtcactttttttaaacttactaatttttttttgagatttcgtaggcagatagagagcaaacacttacggctatcgaatgatatcaaattcattcaattaggacaactaagaaatgagttatactccaaaaagcgagctggcgcccatttgctcggcgcccaagaaaaatgggtcttaaataatattgggattgattgcactcattgtccttgagcagtgccagggatagtccttgaaaagtatacttgtctgcatatttgaacaatacgacttcaatcatgttcttgaacaaaaaacataacactatattttaagtgaaatgtccttgagaattcattttaaatacaattttccaaaattttgtatcatggacttttgagttattgggctgatggtttgaaaaagaactcggccaaaacgaattcaaatcccgagaaaatccggcttcggattcgataaaacaaacgttcggctttggtgtttacgaaaaaaaatattccatcgctaagagaacaacaaaatggcaccaaaatttagatgaggttcccaattttgccttcattagttggatgtgtgctggtgaacagaatgccaaacaatgtgcggatcaaaggaggataatatggtagagaaaatggggctcaaaaacatttcatgcgaatgccattac

SEQ ID NO: 7085 - DNA, 2992 bp, Heterodera glycines
tggttggcatagttccgttttttgattggaataacaaattcctttgttggcagttttccaactccctggcaattagcctttaattagctagagaccgagagaggtcgattaatttaggcttttttggggtttttagcaactatttcagcacttttttagcaactatttagataaaaatttctcgatttttagcacataaaaacccgggccctgcggatgaccaatgggatgttttggtgtggggatgtgctgaaacggacgctggcacttgtgccgttttggaaacaaaattatctcaagtcatgaacaacactgttgcgttctcttgcgaatgccattatggcgccagggatgttgatttggcaaatgagcaactgatgctccgtcatctgttctcgcccattgccgctcctaccgatgccgtttcaattgcagtaatggcattcattatatgaactaaattgaaaatatatatatatatatatattccaaattccgtatatattaaattaaacccccctccccccttaattagaagctccaccccctgaaataaagtccccgtttcgagggggttgaaaaatattgccccgggaggctaattgagtaaatacggtagtagcgggaccgggaatttttttaaagttgttttttacttaaattttgcgcgaaatttaatcggattgccagcctaaaattccttcgaatttttgaagatttatccgaaaattgaagtatttttattcaaaatttcttgataattggaacacaactttacacaaaaaaaaaaattccggtgatcgcccaatggacacccatttaaaatgtttaaattattatttacataaaattatattttatttttctgcgaatttagcaatgtaaaaatgagtgtacaaattttttaaaatatatttaacaaaataaaaaattagtcgaataaatatataatttttattacagccatgactgttggacatcattctttgattgcgagatggagaaataagacgaattttttattaaaaaaaactaaagaaaaatcgaattttacttatttaccgaatatatttccatacatttattatacatatactaaaactatgcgaaacattgctttgctgttctatttattgcattttttatatgaaaatttgccaaaaatagccgaaatatgctctaaaaagcaaaaacgcaaaaatggcaaaatatgcatttattcttgaaaagccccaaaatatgcttttatatgcactaaaacattcaccaaataaaaaactttaacgcagaaatgctatttttgatcccctttcttcatagcaaatgcgcagaaaaaatatgcaaaatcatacaatttataaccctaccctacttatggagcacatatcaaatttttgtggaacgggctcccgcggtattaattctgcaattcatgaacatccaaaaaaggcggggttgcggactgggatctcgcaaatccagcgcgagatatcctcccgctgtccatccctaagtgaaaaagacgaaaaatttattgtccaaattacgtaatgtcgaaacttggtgatatgatgtgaaattagacaaaaagaatgaatatgtgccattgattttttaaaaatatttttattttattaattctaaaaaagtaattttttaaaaatttagacgttgaaacgatccaaaaaaaactcagtgtttgatgagtgttcctaattatatgaatttatgaatagaagtaattaaatttaattatttataaaccactgagttttttgtttgaccgacctagctagccaccattctcgaatgttcattttgatgatttctttttgttgtgtttgcgcatcatttgccgtcctttggctttgcctttgcccccgccaccctctcgagagaaaatccatgtgtccgcttggtacccaactttctggtgtccaatttaccggtcccaccagtcaaaagtcaccccgaagcataacattttgcctcttttaaatatttttaaaaatcattgcctagtgataatttggcatgcaatttgtaactttgtcatgacaataaatgcttgcccaattttattttctcatgaaatttttttaattacaattttaaatagaaaaatgaaaaattttgatacaaaattcatttctcattcatttgaaaagcaaaaaaaatggtagaagcaatattatttgtgaatcataaatttctcaaaaattctattagttttttatgttcgttgtcgttatcagtgggacgatggcttcgggtgttcgatttggtcggccttttcagctgggcctcgacattgcgttgatcacttatcagccacccatcgatatagccgtttaccaaaaagataagatgtagaggccgtactgggtcgggatcccgctgagattttccctggatcccggccctgccatcccgattcccaacacagactttttcaacctccgggccctacaaattgtcaattcctaattggaacctccatcaattccccaaaagccatcaaataacaaaaaagtgatcgtcgtcattttccttaaaatacagtaggaatccgtcattttttgagttgaccaattttgacacccttctactggtaggctgaacattttgccaatttaaaatttgtaaatcgtttccctagtgataatttggcatgcaatttgtaactttgtcgtgacggcaaaagcttaccaacttcaattttctcattaaattttccaaatacaaatcaaacaaaaatgaaaagatacattaaatcacaagacagacgacctcatttagttgtcagccaattcaacgaaaggctttgtcatggtcattaaaggtaaatgtgtatgacattttggcaaataaaaatttaaataatttccaatttcacgaaaattcaacaaaaaatttggccaaattaaacacaaaaatggcagacgataggaaaaaaaaattttgcttaatttgatattctcggaattttata

SEQ ID NO: 7086 - DNA, 1569 bp, Heterodera glycines
ttttggcatttatttcttggcgttttattccttttcgaaattcaaaaaatactttttacagtaacccaacagactaataaactagtattacggtcattgatcatcattttgtccattaatattggcggatatctaatcaacttggtcatgtatcagttgctggatgcatttggctcaattttggggtattttaaattaatttgaattttaaatttttcaaatttacctaagacccccaattcgtgggtggcaatttggttttattgctggcattttgttgaatgcttctgccggatcaaatgcgattgtcctttatttgtgcaggtgttaatttatcaataaaaaatatattttttacttttttcgtttatttattacttaaaatattaaaatttaattaatatatttctttttaattgttaaatattttatcccgcagcgggacccgcaaatttgattttttgtgcgggatctcgagggatccgcgttgcatttttgaaaatttttcaaatacagaatgccaaatatttttgaataaattaaataataaatttaattacctaactcatttttcatcgcaaatttcattcaaaatttgtgaaattttcccggcagcgcctattggcaccgccggatgacctctatcttttattatctctttttaaaaattcaaaattgtaaaattggtcacttttagacaaaatctgttaacaaatcgcattaaattttcaaaaaatttcagggcggtgctgatgggcaccgccggaccccccccccccccagttcctagttttttgaaaaaattgcgccgcaaacaaagcggttttgaaaagcaacaaaatattcacatttatgaaccattaacagattttattcccgttctctttttaccgtctaatccattcgaaatagtcgtctcattagccccttttaatgcatcccgcaagcccctaaaaatttctttttcaaaatatcaggtatttttttgttttttggaaattttttgaaatttaattgtcaactatttaaaaaaaaataataattaatttaattaaagtaacctgtcaactattaaaaaaataataataattaatttaattaaagtagcctatcaacttgaagtgtttcgaatttcaaaatccgcaatcccgcgcgggatcccgcaaattttaaatgcgggatttgtacgattaatcccgcgagatcccatcccgcaaaaaattttaagttccaatcccgcagagggacccgcaaatttgaaatttccggtctctaattattatcgcttttaattattatttttaatttattatatttttattttctttaaatttaaattataattttagcactgaatatcgtcgcgtgttcaaaaaagaatttcaagcgttgaagggctatttttgtaacaaaaatggtattctaataattaatttttaaaaagtacaatataaattttattttagccgtctacacaattggcgcaaaaaaccaagtccaaaatgccaacccaaaaaacaaaatgaacatcatccgattaagccaacagacaaatgtgaaaaatctgat

SEQ ID NO: 7087 - DNA, 7797 bp, Heterodera glycines
  misc_feature (13)..(13): n is a, c, g, or t
  misc_feature (27)..(27): n is a, c, g, or t
cactcgccaaaancggaaatgcaacancgtcggcaacccctttatgggcaacaaacgaccaacttcaagtggatttccctggaccaatcactggactcttcaaagggaagcaaaccagctcagtaacaaattgttttgcgcaaccagcaacactgttcgtcaaatggcacagtctccaactactgtcgccaacccatcgcgcagaccactgcaattacgcttccgagtattgccagctgcaagacaacagttcactcatctggacttcagcatgtccaaacgacaattgtttcatgtgcgatttccaagaagccgaagaaatccacggagaattcacaagctcaacggtcaaataacagcattttggatctcggatgatcgacaaaaggcactgaccttcaccgagacgcatgccgtgcaagcatgcgacgggagacaaatcgtcttatcagagcagaacttcggcattccaaaagagcaattcgacatcatgatgagcaaccacacaagagcgaaacgcaacgtgcaacccgaacaactcgcttcacagcttaccgctgctcaacttgccacaacaatggcactctcacagctttacttaaaggaatgccagcgcaacgtgcgcgtcagcaacccaacgcttcaggcacgaaaactcctcaagcgcgaaaatctgcaagcccgatagatcagcgaaacaacaatcgaagtgtttccctgcgttccaatctccctatccaacatcagctaccgaacaacaaaggactgctacaagttcatccctgtcacaatccatctgccaaacacaacacaagacgcattcctcgacccggagatgcgcatcctcccactcatctcaaagatcgcaagttgctctcaatttcgctaccatcatctgcaagtgcaacaaaaacccaacttgtgggtgcgaatcgactcaaaaaatggaaacgtccaacgattgtcacaaactgcaatccatgagctctacgagacaatcctcaacaaaacggacaacgacttggatctccacccactgatcttccatcagtggcaactcgacaacgacaccgacttcgctacctttccacacatcgacgaatccgaggattcggaagagttcaaaaataagctggaacaacacacgacccaacgagccgaagcactcggagctttacccggcggaatcgaaggatggaccgtcagatggctccaagaacggctacaggaaataatccaatggtggatgcgtctcgcctcggcatattccacattcatactctgccgcgacgttatcctaccctgcttgatcgcctacttcctgaacccaatccgcatcacactcatgaccctgattggatttcgaccaaagaaacaaccaacgcttcaaatccaagcacaacacgaggacatgccattgagggaaatgccaaacacaccaatccggcggaaacgacgtcaattgcccgagcaatcgactccaccaatacgacaggacacgacgacagcaacggcctcattccgaacaagagcaagagcccacagcgcaacggaagacacgcccttcggacgcttgcgaccaatgaaactggcagacgactgaagggcccaaaagaaccaagaagagagaagaaggaaggaagaacggacgagcctttccttgccgcctcgggagtgtcgcgattgccattcgcgaaaatcaaataatttgattttgcaattgtgcacaaattgtgcaaaattgaattggccccaaaaaccaaaaaccaaattaaacaatttttaaatttggggccaatgttcgattgagtgacattccttccccaatccttatcaccggctgtcactccccccagcaattctccgttcctcccgccttatcagcttcaactcgcccattctctccccactttttggccaatataaataagtgctcaacaccacgcttcatcaacacaccaatcatcagcagcacaccaaagtgctgcttcaactctctctctctctctctctctctctctcttcctctcgtcccccacaattgttccacaagcgccccgctccccaatcaatcaccatcacggcgccccccaagccatttccatgcattgattgcgccccctcacacatttccgttgttgtactgctccaactccttgctctcccaatttcccccatttttgaccaatttcaatgcaattttttgtgatgggctaatagggccaaattgttcacatttttcactttgtggcccatttggccgatttttgcccccctcaattgtcctcccccattgctcacccatttcggtttaattacccaagtttgagataaaatttggtggtaattttctgtgctttctttctgtgcggccccaatccgaccgtagtcccgtctcgatcgcccccggcccctttgtgctctccctccaacttgtcaaagtcctgcacccaagtgcaggcaattgtcggactccaccgcgcccacacccgcacacaaactcggagtacgacaagtggcgacctgggcagggacaaccaagcaacgacaaacagcaacaagtgcgcgacaagccgcggcggtgcactcaacggaaaaggtgtggtgaatttggaaaaattcactcggtgttccaagttttcgctctccgtggcaaaacttggacacaacaaggaggggggaagcaaaagtgggagttcggggaaatactgatcggtctccgtgccatcagtatttcctaggtcaaattactgctcggtctccgtgccagcagtattttgtcaattactggtcggtctccgtgccgccagtaatcggtaatattactgatcggtctccgtgccatcagtaataggggcaattactggttggtctccgtgccgccagtaatcaagcaaagtactgctcgctctccgtggcaacagtaccggtccttgccaagcaaaggaaggacagttggcgtgaactgctcgctctccgtggcagcagttactccaacccgacgcggacaagtcaaacggtcggaacaacacaagtgtactgcttgatctccgtgtcagcagtacaaccagagcagccaatcaatcaacaagcaacaagcaagaagcgaaggcaaagcacaacaagcaacaaggcaaagcacagcaagcatcaagcaacaagcaaagcacagcaagcagtcaatagcaacaagcacagctacagcaacagagcaaacaatggccgcaccaattcaacagaaactcagcgctgctctcaaagttctctcccgaagccgaactgcggcggaactgaacatccaagccgaccaagcggcatcaaacctcgaaaacgcattcaatttcgaggctcaactggagaaggtccaaaaagaagcaaaaacaatggacatcttcctcgacgacgtacgagaatcgctcacagcatgggcggatttactgcgcaaactgcctgcaacggaacgcgatccagcagaagcagatttcaacaagttcgagaaaaaggagcgaacaacagacaaagtcgacgaagcagcactgaagctgcgcgacttgcgtgacctcataagcacactcacagttcaatcccgactctaccgcagcaaggcggacaaagaagagcgggacgctcaagcagctcatgcaaacgcaatgcaacacaccgcgcagcaacaaccaaacaagacgccgtccttcactcctccgttctaccaattccagccaatccagctggacaagttcttcggcaacaaacgcaaatggccggagttctacgaatcgttcaaatcagcaatcggcacacacgcactcagcaaagcggagaagttcaatctcctgcgcaacctactcggaggagaagcccgagaactcgtggctggctttcgactggaggacaataattacgacacggccctccaattgctgaaggacacatacggagcaccggacgaacacatcagggcacttcatttcgaattggcaaacctcaagccctgcaaaaacctgcgcgacaccaaagaattcctcctgcaactcgaacgactcacacgcgaactcaacaatacaggagaagacatcgaaggcccaccgaccttcctcatgcttgaaaagaagctcactcccggattcctgcgcacaatcctaaccaaaaagggagaagacccggcacgctggaacacgacaaagttccgagacgtactcaacgaagcggttcgaaaagaatcccaaatccaagaagtcatgggcgagtacggacactcgccacaacaacggccgcaaccacaaaggcccaatttctcggcatcaaaattccgagaccgcgcaccaatcccacagcaacgggaacgcacattcatcacctcagcggtggatgacaatcacaaaaggctgatcaatcgacagcctcaacacaggccacagcaacaaaggcctcgcgcaccacaaccgcaacaaagaaacttgcgcactttcaacaatcaaaggcaatttccaactcaacgtgccaatgcgaccaacaatcaacgacaatttccaactcaacgtaccaatgcgatcaacaatcgaaggcaatttccaactcaacatgccaatgcgacattcaatcaacgcaagccaccaagtccatgcatcttctgtgacaacgatcactggaatgaagaatgccggaaatacagtacaattcaacagcgaagagaagtactacgcacaaaggcattatgcttcaaatgcctcaaaagcaatcatcaagcaagcaactgcccgcaaccgaagaaatgcttcaaatgcaaacaacctcatccaacggcattatgttatgcagacgaaaaaccaccgaaccaaatcacagcagcaatgttggggcaaacacaacaaaatatgtcaatcacaactcaagacggaagcaacgaaccaacggcatcgacatcgcaaatgtgcaatgccgtaaacggaagcgacactcgcgcactcctcatgaccgcaacttcaacggtcttcaatccagcacaaccgcatctcagcatgactgcggcaattttcatcgatccaggcagccacagatcattcatttcagcaaaggcagcacagctactggatcttccggtggtccacaccgaagaatgccacttgaccagtttcggagaacgcgaaccaaaaagatacatcagcgacctggtcaagctcggatttctctgcacgagcggggaaaaactcatcttcaacctcaacgccatgaaattcttggtcaacgacatgccaatgattcaactgtcagagctggacaagacagagttgaggcaacaaaagcacaatcctccgcatgaacaacgacaacctgacatcatgctcggaattgatgtctggcacgaactgcaggttcaaccaatcgaaagttgccaagcggtttcacactgtgccgatccaaaatcggcaaaatcctcagtggatcaggacgcatcgaaatgcatcaaacgccaaacgtgacatttgtcatgtcaatccacggcactgaacaagaagaagccaatcaatcagtcacgttcgaatcaaccaaagaagagacggaagtcttcacaaccgaagatgatttcaaaaaggacgagcagctcaacaacttcttcggattaaatctgattggcatggacgatacatcaacaccaatcgatcaggatcatgtgatgatccacttcaaaaagaacctcacgttcgtcaacaaccgataccaagtcgctttgccctggaacgaccgagttgatgctcttccaagcaacatccatcaagccaaagccaggctcgtctcattgatcaaaagactgcgcagcctcaacctgattgacaaatatcaggcaattttggacgagcaagttcaaaactcagtcatcgaatacatcggtccacccgagtctccatcaagtgcatggcctgtgcattttctaccacacagagcagtcatcagagcggataaagcaacaaccaaaatccgaatcgtcatggatgcgtcagcaaagccaaagaattgcccatcagcaccatccttgaacgactgcttatacacaggaccacaactgctgaaggatctcaccggcatcctcctgcgcttcagacgcatggaacatgtgatcctcgccgacatcgaaaaggcatttctgcaacttggaattcgacatgcggacagagatgcctgcagattcatttggctcaacaatcccgagacatcagagctcaatccaatcagccactccgaattgcgcatctaccgattctgccgtgtcagtttcggtttgacggtgtcaccattcctgctcaatgccacattacgggaacacctcgcgctattcgactccgacctagcaaggcggatcgaaaagaatctgtacgtcgacaacatcatgttcgacgccaagccaacggaaaagcttcaagatttggtgacgcaagcaagacaatcttcgaagcagcgggcatgaaactccgagaattctacggaagcaacatcgaagagctaaaaaagctgcaaccagacgacttggcaaaggacctagaagacaacaaagtgctcggcattcgatggaaaccaaaacataatcggctcatcttcaaattgccaatcttcgaaggaaaaatcacaaaacggacaattctgtcgcaaattgccaaagtctatgacccgctcggactcatgtcacccgtactactgccagccaagctcattcttcaagaagtgcaaaacttgaacccaaaatgggacgacgaattgccagcaaacatcaacaaggactggctcaaattgatggcacagtggctcaacagaggcgaagcaatcacaatcgaatttccacggcacatccaagccatcgactcagtggaattccactgcttctgcgacgccagcaaatacggcatgggaattgccgtgtaccaaaaggccaaaacaataatcagaaaggatgaatgcaacctcatctacgcaaaaagccttgtcaaaccaatcaaagtggcagcgcacgacggcacaattccaaagttggaacttcaagcactgactctcggaataaaagcagtcaaattcatccaagctcaaatcaaattcgccgatcatcaagtcatcatgtggacagacagtcaatgctcagtcgaacgacttcgagaaaacaagcgccaagatcgatttgtggcaaatcgattacaaaaaatccgagaagcgaattttcaagtccgacacgtcagaaccgactcaaacccggcggatatggcatctagaggcgcagatccccaatgccttcgaacatcactgctttggcgctttggcccgatttggctttcaaaagcagacaaatggccagaatccaacgtcatctaccgacccagagatgaactcaaagaagtggaagagccaccaatcatcgaaatgacaacaactgttcaagtcgaggaacagttcgaaccatcaatccaattcgaacgattttcgaattggaacaggctgaaagccaccgcagcacacgccatacgcttcatgagcaaacttcgcgcactcaaaaatggaaaattcaacaacgaagaccacagcaatggaacattgacagtggaacaactgcagcaagcagagaaatggattttgagagaagcgcagcggcttcatccaccatccaacgaccaaatccgagaattgcaactattccaacaagaaggaatttggagatgcggcggacgactcgaggaagcacccggacttacatacgacagcaaacatcccaatctttttgccatcgcaagcatggatcaccaagctcatcatccg

SEQ ID NO: 7088 - DNA, 3151 bp, Heterodera glycines
  misc_feature (38)..(38): n is a, c, g, or t
ttttaagcgaggtaggggttgtagagctcaggaatttnaactaagccaagtgcgaaagtgataacgtaaaacattgaaaatgaataaaaaatggaaaagaaaaacaatttattcacaaaaaatatttgtccaaaatattaattaaaatttggcattttgccaattaataaagtgaagaaatgatcaaacttttcattatgaagatgccattcccacattttccttgtaggcccattcaaaatgtgatcggatacatttggggcagtgaacggcccgacgagtgggtgatgctcggcaaccatttcgacgcgtgggttttcggcgccatcgacccgaacagcgggacggccgtgctggcggaggtggccaagggattggccgaaacggtgcgcaccaccgggtggaggccgaagcggacgattgttttctgcgcttgggacgcggaggagcccggactgatcgggtgggaagcactcactgattatgcataattaacttactgatcacacacattgacaaaactatatctagtatattcgtgtagctttactaagtattcgtttttttaatttgtttcatttttttgccacagatcgaccgaatttgtggaagaatttgcggaaattttgcagcaaaaggccatcgtttatttgaacgtcgatttgatctcctccaaccaatcattgtctgtccgtgttccttttgtgctcatttcctgtggccaatgttctgtttcaggtctgtctccactgtcccttcgcttttccattcggccgtcgcggcggcaaaagtcgtcaaaaacccattggacgaccaattgaccgtcttcgactcgtgggccaaacatttcccatcaaaaacggaatggcttccggacattcctgaaatgagcatccccgggggcggaagtgaccatatgtgagcaaaaactattggggaaattgaaaaaaagagcaaatttacaaaaataaggcaaataaaattaaatgaaaaaaaccaaatccatgcttaggtaattattacctacaatttcaagtacatcatcatcataattaatgtacggtattttagcacttttctgaactttttgggcgtcccggtgatcgactttctttacaaagatgccgaatcccccggatattcctaccccctctatcactcgcgctacgaattgccatttgtcaacgagcaccttttcgacaacaatcagttggcggtccgtttctcaaacattttttttgcatatttcgaactcaattctttaaaattcaggtgcataaagccgtgggcgaatattgggcggaattggcacgtctttttgctgattcgctgcttttgccgatcagtgcgaccactttggcacatcgattattggccgactatttggaggggatcaaaaaagttgctaaattaaattcaatttgaatttcgttattatttattttattcagccaatcttggatttgagcagccaatttccgagtacgtgtggaccggcgaagacccaactggacaatctgatccaaaatgggcaccaatttatggcgcaggcggaagagttcgaacggcacgcccaaggccaaagtgcgagtgccaatttggcccaattagcgtgggcaaatgaccgactgagaaaattggagcaatgttttgtgaacccggcgatgggactcgcgcgggaagaaccgctcaaaaggcacgtgctgttcgcaacatcgaaggacaatttctacgcatcgaacacaatggcaattgtttataaaaaggtgacaaaaacgaatttgtaattaaatttgaagagacaattaagaaagaaaaatgctaattaaactgcattaatttttttaatgaaattaatgctttttatgcttagattggccaatttcgcgacgcaaaaagtgccgaggagcgcacaaaatggtgcaatgaattggccttggaattggccgttgtgcagcaggcgattcactgtgccaccagcacactcagcaaaggcatttgataatgcccacgattaatattaatgccaactaatggatcatcaattaacaatttgttcacaaatattcatgaaaattttttgatcgacaataattaattccggtcactttttctgatcacaattttgtcccgatcgttttgttcgtcgatcatttccaaactttccaatgcttcgatcgcctcctttcgggcactttcttcggctgatttaattaggctaattatttcgttggtcttttcaattgtcccttcccattttgaattttcgcttaatctttgcaccattttcacaattttgtcatttttctcaattccatttttcccaattttgagtacattttcttccattcccaattgataaattcccaatttttccaacatttttttcacattttcctcaattagtttaaaattttcatttatattttctattgccttttttgcatttctttgctcaaattcatctgaactttcatttgcaattctgaacaattcggccattggatttgagaataaatttcgtgaaatgttttgcaacccgtcgaataatgccaagactttttcctcctaattaagaaatttaaaatttaattagtctgaatttttattgttcacttgacatataaattaccaaaattaatttcggatgatcgtgatcattttctttttctgccttttcaatcctaaattttatttgtatattttttcatcttaattttaatttcaaacaaaccaattctttagacggagacaatcatcgccaaagtttttctatgataaaatttgtttgttgtcaaaatggttaattatttattatattgcataatataaattattttactgaacctctttgaggcggtaaattttcaaattgagaagccaaataatgtgcttaaaaaggtggtccaaattcacgggaattgacaattcaaattcggacagctaaagcagccaaaattcgttatttaataaaataaaaaagaaaacattttttgatttcttccgtcggttttccgtcgtcaaattttgtgcagaaatgccattgtttttgttaagcaaaagaggggcacagcccaagaaatattcgttttcgtgttgttcttcctcttttccatttcgttggtgccgttttgcggtggcgagtaaaaat

SEQ ID NO: 7089 - DNA, 1303 bp, Heterodera glycines
tagtcacttttttgcctaaattcaccagtaaccaaaaagtacccgtctcatcggaatcttcgtttcgagaaacacgcgcgatttcaaaaatagttcggtcgggtcaatttggcccaaattgaccgtgtacagcttggaaaagttgggcctgtatagcgtgacataagccatgcggaacatcgtccgaatgtcttccaattctaagttgaattttggatcaaagaaagggccttcgtctgacggattttcgtcatcgatgtcagcttaatgggacgcaattatagcacaaattttgtaaatttgtactatctaactctctatatccttttgcaataacaaacggataattatttaaatgatatttaatgtaaattaaatataaccgagcgctgagatttatatgtttgcatatacttttctgcgtataatcttatcgcattaaagcccaaaaagcgcattttcattcaacaattcacgaattagagcgactttccagcacatagaatcattttttgggctttttgcacatttttttactatgtttatttcagcagattttttggcatttttttttgttttttagaacatataaatcccagaaataattatcttttattaatttgctaaattaataattattataattacctttgtattcgtttttcgttgattttacataaaagaaaaagaaaatgttaaaatttgcggtctcttcgtcaacatttggcaaatgcaaaacgaaagtctgtccattttcggcatttgttctgcacattttgcgcacatttttcgctctgtccaaataccgtacaaaaacgtcaagtcttacggtacggagtgactccgattggccaaaaatgggccgcaattttaagagtttggcatcagaaactgaacatttgttgagaagggtcagcagaaagaagagaaaatgaaatgcaagagacatttaatttaaaatttcgaattttgcaaaatataaaattaaaaatgataaaacgaagaaaaaattaataatatattgaatattttatttaattttatttgaattttatcattcaatcgattttcaataagagaaaagaggaaaaattatggggtgaaaatgaaaaaaaagagaatatatgcaaataaataactgcacattataaaatatccgaacattataaaattgaattatagcaaaaaaaaaaaaaaaattgataatttgtaaaaaactttcattttattattacaatggcaaatcttataatttggtttgaatatttgtaaaaaatttgtttcgtttgatcattttattaat

SEQ ID NO: 7090 - DNA, 2036 bp, Heterodera glycines
attaatgttttttaagaattatacggaattattgtaaaattaaaatttcattttttaaattttttaaaattacttttatgatggtattattattgtttttgttattgctgttttttttatttattctgttcagtaaaactttctgagatcctttttttattccttttcaagtgtttctttttttgttcaaccttttccacttaagtgttttgtttatttaaattcttttttaatttaatttaatttttcatttttatttttattttcctttgtcaattatttccatcaattttctttctctttaccttttctgatggaccaattctttgtacgttcagccaaaaagagtgcttaaaataaaatggagccaattttcttgggaaacattgtcaactttccatttattgtaacaaatgtttttttacgccgatgggttaaattttaaaataaatttaattttttaattcggaattattcagaaatgcgttccaaaaatcatttcggctttttctttgccctttttttcgtcattttaacagcgaatgctgtgaaattggagaggaaaaaagtggtggaaggatacgccgtgaaatcagattggggccaacaacagccaatggcacttccaattccctttggaggcgacggagcaatgggcgacgaattcggcacttgtgccattgaccaaagcgagtccatttccaggggttttctaaattgtctaattgcctcaaatagtgccaactgttgtgcacacaatgttcggaccggtcaaaggcttcaccgacattgacggggccaactcgagtctcgtcgacgttttcctcggaattccgttcgcccaaccgcccgttggccatttgcgatttgaggcaaatgctaacgaattttgacaaactttattaattgcaatttcactgttatgccaaagaaatgaaaaaatctgctcagaagccgcgtcccctcgtgacgcattgggacggcattttggacggcacggagcacagaaaaagctgtgtgccgcacgcacggcccgattggcaaaacgaattgctgggccagtacagcttcagcgaagactgcctctatatgaacatttttgcaccacacggagcagtaaataaaataattaaaatatatttaaattaaatataataattattatttaaaaaaggaaaaaaatgaaaataattaatgacaaaatgccgcagaacaaaggcagtgaggagcagctgctgcccgtgctggtgcttatccacggcggtgccttttccattggcagtgtccgccaatttagcgaccacagagacatcggtgctaaattcgtcagccacggcattgtcgtggtggccatccaataccggcttggggtttttggtaagccgagagaaaatttaaaaaacggcacaaatgaatcggttatttagcaagtctcattaaggtaaataatgatgattaattggatagtctcaatttaccaaaggcttcgcctcctccggtgatccccaaatgccgggaaactttggcctttgggaccaactcgccgcgctgcaattcatccgacagaacatccgacgttttggaggaaacccggaggacattacgctttttggccattcggcgggtgccgcgagtgtcagcgcattgggcatttcgccacacagccgacgtaaaagcaaaggcatcccgaaaagccaatgagaatgtaaattgggagttcagatttgttccaacgagcaattcaaatggccggctccgtgttcagctcctttctgctcggtgcccacgtgcaccgtttgacccttggccttgtcgagactctcgactgcgaagagccgccaaaggaatgcctaaagcgcaaaagtgtggacgaaatccacgccgctgttgaacggatggtgagggaatatttcgagaattaacaatgccaaaattgttgtattgagggccctgccaaagtgcgacttgggccgcgcatcgacggcgactttttcccccgcgacattccctccctcgtggacacatcgcccaaaaag

SEQ ID NO: 7091 - DNA, 2421 bp, Heterodera glycines
cgccccccccccccccccccccagatgcgccgcccataagattttccggtgcacttcctaatggtgcatgcgacgtaccgggcaaaaggcccggttcgtatttgctcggtacactcgctcgtcgctccgcttcgctccgctcctcgctcgcgcacctcgaggggcagggcgcttcgcgcccgccctttgtcatgaccagcatcggttggcgcttgctcggcgtactcgctcgtcgctccgcttcgctccgctcctcgctcacacgcctcgaggggcagggcgcttcgcgcccgcccttttgtcatgcagagcgtggctaccgggcaaaaggcccggttcgtattgactcggtacactcgctcgtcgctccgcttcgctccgctcctcgctcgcgcacctcgaggggcaggccgcttcgcgcccgccccttatcgtgcaaaacagctcatttttatttattttgatttgatttgatttaatttaatttaatttattttattttattttatttaatttaatttaattttattttaatttattttaatttattttattttattttattttaatttattttattttattttattttattttaatttaatttattttattttattttatttaaatttaatttattttattttattttattttaatttattttattttattttattttatttaaatttaatttattttattttattttaatttattttattttattttattttattttattttattttattttaatttattttattttattttatttaaatttaatttatttaaatttattttattttattttaatttattttaatttaatttattttattttattttattttattttattttattttaatttattttattttattttaatttattgaattttatttaattttttattttcagaacaattctgacgtcttccagaattttcagaactgttctggtgtgtttcagaattatcagaactatttggacgcttaccagaattttcagaattattctggtctgtaacagaattatcagaactattctgaagcattccggaacaatcagaattattctggtgtttaaattgtaaaaattgaatgcaaaaacacaaagcaaaacacaaggcaaaaattgtaaaaatactcgaaaacacatggtaacatgttgaaacacacgttaatgtaacgaaaatacacgtaaaatattgaaaacgcatgcaaacgtgttgaaaatacacgtaaatgtgaagaacacacgtgaaaaaccggaactggtttaaagaattcacgtcaaaaacacacgtaaacgtgaagaaatcacgtgaaaaacatcaaattccgtgaaattccggacattccggacgaatttacaattgtaaacggattgtaaaccggaaggcgaaaacacaaaaaaaatcggcttttttcgacctttgccggggtataactttgttcgaatttgtcgtagagctacgaaatttttttctcacccttcctctcgacgagctctacaaattgttcgcttaccgcaaaagcgtagctcttacggttcctgagaaataaggtgaaaacacacattttacaacccatttttgccaattgtaaaaagccgggttttttttctttaaccctattttacaaaaaatttttgctggtgcgaattttttccacacgggccattttgtagagaaaaccgagctctttcgattggtaccggtcccgtggcgatccgttgagcccttaaggagagggaaatcgtttagtgggtagcccccccgttatttttatatatagataactagccgctctgagggcatgcgtggggagcgtgcacttgcttaccctagccggtcgagttgtagccagtaacgggtgcacagtccaggttgactgggcagtagcagctaccgaaagatgcgtgtctggatgttcgtgcagcagcagctaccggcacatgcgcgtggcacccgtgctcagttgaatgggcatgcgtggcacccgtgcagcattggaacccgagggcttggcgaatgggcatgcgtggcacccgtgctcagttgaatgggcatgcgtggcacccgtgcagcattggaacccgagggcttggcgaatgggcatgcgtggcacccgtgagcagttggaatgggcatgcgtggcgcccgtgcagcattggaacccgaggacttggcgaataggcatgcgtggcacccgtgagcagttggaacccgagggcttggcgaatgggcatgcgtggcgcccgtgctcagttgaaatgggcatgcgtggcgcccgtgcagcattagaacccgagggcttggcgaatgggcatgcgtggcacccgtgctcagttggaacccgagggcttggcgaatgggcatgcgtggcgcccgtgctcagttgaaatgggcat

SEQ ID NO: 7092 - DNA, 1304 bp, Heterodera glycines
  misc_feature (1291)..(1291): n is a, c, g, or t
tgccatttcagtctttcatttgtgctgctttttccatctttaagcccttttatgggatgtgtgtcagcgttaattacagcttgacaatggcaccaatttgccgccatttatctccgtcccggcgccaccactttcgtagtcggcggaagaggaaggcgcggaggcggcggaattggggacaagcggtgggcgtgattcgcgcgggattggcaccaccgccgacgtcaaactgtgatgtgcttcattgccaccaattggtgctgggatggcaccggcgacggcattttgagtgccaagcggtggcggaccaccgagtaacagagtctcgcggatgggcgacgagaagcggccgtcaatgcggacggacacaacagtccgggactccaacggcggggcgccattgtcaacggcacgcaaagtcagctgatgctcgcccaaatgtgcggcattcagcgggccgttcacgcgcagttcgccgttgtcattgatcgagaagagcctgaggtaatcagaaaaaaaaagattagcattgaattatgaaattttcatcagacagcatcttggatgacccctgagttcctacttctacgggaaagtgataaatctcaaacccggaaacaaatttaacgattagtcataggagtgccaaaaatggtccagatgacctaagacgatgattaatcccgcagaaaccaggaaacaatcggaaatcatttggggttgattaagcccataaaccgtaagcaccagggatgttgatcgctttcgtgtttcgtattttcgtgttttaagacttttcgtttgttttcgtattttggcacgaaacgaaacttttatgcactggtaagaaaatgcaaaatctgttaacaaattcactctaattttcaaaatttttcccggcctgccctcctccaaaaaaaaatttaggaaaaatatgcgaattttgtgtgaccaatgaccagaaaacatttggaagctttgttatttctccaatcatccaatcgtatcggctctgctctgatcagtctttggtgatcactgatcattttacctgtccaatggtggcatcacattcaatgtcactttgccattttggccttggtccgcatcattcacttcaattcggcccaatagcatatccatatgcgataacactgctgtgctgttattcaatggagactaaactgataaaatcagagaattatcaataattaaaaataaataaatataagttaaattatttttaatttattatattttacatttaaattttacctcatccaattgcacngtgaaccgaattg

SEQ ID NO: 7093 - DNA, 5865 bp, Heterodera glycines
agtatgggggtgcatcatcacccgtcatgtatggtggtggccagtgatgatgatgcatattctgctgctgcttctaataacgtcacccccccccccccctctcctccgaaatcatttcctccttttaatacagacttctaacacattggatagctgacatcataatgagatgcgtcgtctatgtaatctaactgcttgtacgttaaaattagtatgacataatagctgttggtcaaatgatgacaggacatcagagctctaattgaaggaaaatgggtcattaaaaaaattattaatagttaattgatcaaaaaaatctaaaaaaatatttttgaaaaatttaaatttattgcatattgcgacaaaaaaatgcgctgaataatcagtatttgcctaaaaaattccagccctactcataacacttaatgatcctttgagcacattcagagattatgttataaaatttgaaattattaaaaaattcagaaataaaaattttcgtttaaaaattttattattagaaaagaatttgaaaaaatcttttgtaaagtacttaaaaataagaaaatttcacaaactgatcggttggctgggttttccaattaaatcggaccaaaatttcgacactttttttataaccatattttttgaggggcttttctcctgggacaagaatcccccccccccccccggcattatgctttcccacttcaatgcgcaatttgtattgcgcagtctgctcccggtcgagagtgccttttgtcacaattgtgccctcctgctcgtcctccatgccaaacattgtgccaatgttgccttcttcatccagcagcacaaaatgcacttttcctgcactgaactcgttgcccaatgaagtgaccaatgtgccgaccggcgccgactcggacagctcaacaaacaaagtctgctcctgaaaagggcagatcaaaaattggaactgaaaaaaaataaataatggaaaataaaaatgatactgtatgaaatattatagtattcaaaaacggatatcaattatgtatatagggacacacaaatatatatatatatatatatatatatatatttatatttaaatctaacaagaacaaagggtccttcaaaggcattggcacacgatgcatttttttacagtacgctgcgcattaatgccaacacatttagcatagatttaaagattacgttaagcaatctattccatcacttgtgattacattccggtaaaaagctataaaaaacgaagatacgaggggccaaagcatttacatcatcgcttcatctgttgacatactgtccgaaacatggccaagtttcgaattcaatgcccaaaaattgcagacttttcttgaaccttattcttatcgagagactgtctttttcgatcggtgccaatccgggttaagcccgaatttcactgaacactcaccgtggactgacttggcggcggtggtacggcagttgtggtagttgcgaatggtataagcatcggattcaacttcactgctgctgctggtgttgctaatgttgttgttggatcaactcgccaaaatgggttcggcttttggttggaatttgctttgttgttgccgccgttgctaatcggctgccaatacccaccggccgaggacgcaatcagtgccgatgacatcatctgctgcgaacccgcagctggtggcacattttgagaaagggaggaggacatttgtgccgacggtggtgacgccggtaaagccgggggtatgccgacgccgacggcttttgctaatggtggcacaaatgcggacgatgaaagcggaaatggctgatgatcagcaatgaccggaacttggccactgccgaacagcgaagcgcgagcagcggaagaggagggggaggaaaaagcagcttttgatggcagatggtctgcggccaatgcttggaccaacacaacagcatggccaacaagcccatcggtgtcccgtgcctcgatcaccacctaaaaatgaacaaaattagggtaatagacgaaaaaaaagaaaaattttttaaagtgggaagattcaaaaaagccatttacattttttgaatgaaatgatttgaattaacttggtattaccttataacgatgtcccggatacaatggaccgatcgcgctaattaaagagcgtaaatttaatttatatgacctttaaattaaattggttggcacctgagttcatgctttgtgtggtcgtagcgaaatgagttcacagcgccgtcactcacttccacgatacggtatctgagaatgtacatactgtattcaaagaggggcccttggtttgcaattttttgcaataatagctcatgaaaacttgttctggggggagtttgagttagtgcctaaaactttatacaaaaaaataatttttaagcacttttttttgcaaaattccaactaattctgaagcgaaagcccaatctcccagtacttacaacacggcactgttgctctcgctctcgcgtgccttcacttgcgcgatcactcgccgctcgcccggcccagcggcggccgacacattggccacgtacaccgtctgtggcagtgttggtccaccgccaacggtgccttgtaaatgttgtagttgttgttgttgcacgtgctgctgcggttggtcctgctcctgctccgtctccacgccgtccacctcgtcgttgtccatgtcgtcgtccagcaaatgtatagtcagactgatcggagcactgctgcgctgtggcgttgtgtcgacctctctctatattaatagtgatgctcaaaaccaacattttccgagaatagaggccgagaccaggcccaaaaaaccgagacttttctcgagtcaagactaagacttcttcaaaaatttatctttgtaacttaaaatcgaatcaaaattctgctataaaattcaaaaattattatttttttgtggctaaacgaaattttgccagactgaatttcaccatttaataataaattaatttaatttaatttatatttgaaataccgccataacatgcagaacaaagagcggtgtgccagttgcatcagtgtccaattcatccacgttcagatacaaattgcccagatggtcaaccgcaaagcgttcagcaccgtaaccggttaaaatataactaaaaacgatcgaatttttgcactaaatataagccatataatttattttaattggcatttttattttaaaaaatgtaagaattaaactcactgatacactgctgaaggcattcctggcaactgaatttgaaaatgtgttaaatcaaagttaaaaaaataaattaattgactgtattttaagggatatttaaaataaataataattttaaattggatattttattcaactaaaattacttaccaaatctctgtcctccaccaaaatttgtaggggtggcgcattggcagttggcccaatgcgcacaaaagtgccctggccagctgaagcagacaaatagccatcgttggatttcgtctgaacaaagaacacaattttcaaaaattattgttcgaaaatcggaatttctgcctcgtaaaaaacggaagtttatgaaaaattaaaaaaaaattaataatttattgataaagtttacatcataattctccttgtgatgggtacaaatggaatggattaaaatatcgtaaagtcagcaaatacagaatatatgattctatctttaagtcattactaaaaggtaaaaataactcaataaaagttacagaaccatccatgtaaagatagattgtgataatcatttaatgacttttctctttttttgcaatttgttaaaatattacaagtaaaaagcattgaatgatgccaagttaatttgaattggtcaactaaaaaatggctcatgatccgtaattacgaagtccaaaaacgccgaaataattcctggtaatccttaacacgtaatccgtaattgagcccaaagtttcacaatttttttttaacctttaatgtcggatcaaagcgcgatatccgaactgcttggccagcttgttgctgctgttcttgttgttggtgttccgtttgttgttgttgttccgctcctcctccgttgtacattatctgctgctgctgctgttgttgttgttgttgctgtgccgtggacgctttaaaagatataatcggctgaaaaaattgggcagcccccaggggctgcgccggcggcatttgctgctggacccaatgcgcagttgggacaacaaaaaggcaaagcacgagcaaaagcatggccgagtatggcaatggcaaacacagcaatggacgagcatagcaatagcaacaatttgttgggccaagtgaatggtggcggtggtgtcgatgccaattgttgttgttgttgtgtgacttggccatggacagattgcaaaaaatgctaactggggaagagcaattaaaaaatggacattcaaaaaacagtggggaaagaattggataaaacaaattgatgaaaatacgcatatgcatcagggatgggccaaattgaaaaataaaaagcgaaatgcgaaaagcgaaatttgcgaaactgaaaaatgcgaaatgaaaaaaagcgaaatgcgaaaagccaaaatatgcgaaaatgcgaaatgcgaaaagcgaaatttttttaaaaaaaatgaaggcccggcggtgccgataagcgccgccggaaaattttttagaaattgtaataaaatatggtaggaaaagttgcaaaattttcaaaaaatttaccgttttttcaaaaaaataaatcgcaaaaaaagcaaaaaaaatgcaccaaaaagttcaagataaaagcttcaaaccaagttaaaaactcgttttcgtgcatattaggctatagcaagttagcaaaaaaggcaattattagagttgcacgggaccgggacttaccgggaccagaaaagtcgggaccgggacctcgattttcgtccgagactgggatcaaccgggaattttcccaagtgaaattttttgaaaaaaaaatttgaaaatttgagtgctcattgttacgaaaaattgcctatattcaaaaatgtacccattttttaattctcgtttgtggggagaaattcgaagaatttttccattatgcaattttgagtgtaatatgttaacagaaaataataaactgaagcttcgttttaataattaaattttcaaatatattcatttcttaggggtggaaatttcgcatttcgcgccaaaaagcgaaatgcgaaaagcgaaatgcgaaacgccaaaaaatgcgattaatgcgaaaggcgaatgcgaaaagcgaaacctcggcccatccctgatatgcatagaataaaaaaggcaataattgcagatattcacaagtgataaaatgaataattgttgtgctaattaggcaaaggcactaggctcagatgaaagctaatatacactctcattatctgctaattgaaccgattgacgacagataaaaaatggacacgtttaggaccataaaatatttttggcacacattgacgtgcccgttttgcaggagcttaggtagcagcgcaaatgttacaaatggtagacaaagtggtggcgacgacgtttttgatcggtgaaaaaataaaagtgatgacggggaaagagaagaagcattttgctcggccgaggaattgcggacaacgcaatgggaaattaaggcttatgatcaattggaaatgatggacggggcgaggagtgatcagatcatccgtggccaacacacacactgtgttcgcgcctctcccaatcactccatcacacaaatcctccgccgccgaaggcggacggagccgcagcggtttaccccatttgccgtttggtcttggcctgcttgctg

SEQ ID NO: 7094 - DNA, 1372 bp, Heterodera glycines
aaacaaaaatctaaggaaagaaaagcataatttgatcttatctttggcaaaattattttttaattctccatattttgtctattatatttaaaattaaattcttagacatccgatttatttattaaaataaatttttcttggcttgataaaattttaataatgtatgtgtttttcttcaatactttatattttaaaatatttggtataaaataggcctatttaaattcattataaaacatcctaagaatattttgtttacacattaattcaatctaatatttatatctaagatgtttctttgcaatcatcctacaagttcagcctattgtttcactttgaacctttagcaataccgattttatctgttatttatatatttttttactattattttaaattattagtatcattaattttttctcttaaatcttttttatttcttgcattttgagtagattgcaatgttaatcaattttagaaggtttttatttaaatcttaatttaaatgatcctaaattaaagagttattttgtctgtactgggtcttttatttagttattatttgtatgggtgttatttataatattcttttgatttttgatcagcaaagtaattcagctcacgtatccgctccagtacttcattgagctaatatgaaatttctattaaaaaattaaaatttgctttaataaatttaaaattcttgattatttctttccacgaatatgaaattcagagttataatattctttagatatagtatttttttttacaatacagaatatttttcatttaaatccatagataaaagatatgtgtttttttgtcatgtgtttcttggtaaaatttattaagtagaattgggttaaaaaatataatttcaaaaaataagtaaatgtggaaatctaagaatgaatgagcaataagagaaagcgtagaagcggtcactatgggtcaagcccagtgtcagacaaaattgctcataacgccaaatagcacatttggcgtaattttttgcgcgctaattcaaacacactgatcactgacatttttgattgtttattttgatcagccgtaactttcttcatttccaactaaactaaacaaaattggtatctaaaaaaagttttgaaaaggtgaatctttttctaagcgaatgctaagcaatttaactcgtttcaaaccatcaaatttttcgaaaatgtgaaaaagatgaaagtgaggtgaaaatgtggtcaaaaatctgggtatttgtcattttctttgttgttctcaacgcctcggtcatgcagtgcattcaacatcgtcgtgtgcttcaccagtttctcaacgatcttctcttgtgtgccgagatgagagtagcggtctacct

SEQ ID NO: 7095 - DNA, 1340 bp, Heterodera glycines
ccaaatagcgtaattggcgtaatttttgcgcgttaattcaaaagatatatctgatcactgccttttttgaagaccaattaacattaataaactttattcaattgactaaactctttatttaataatgttatagaaatcggaaaaatgtgttcaacataatattcagatagtgaaaatgtttggaaaaatgaaattttgatcaaaagtttgggtatttgcttccattctcttgattgtttccgacaccttgatcgtgaagggcatttagcagtgtcgcgtgtttcaccaacttctcaacaaccttcattgaccgcctcgcacagctccgccttcagacgcttcatctctctcgtcggtgaccaaacgtcaagtccttggtcggtgaacaaccgcttcagtgcttcacgggccttgaacgagatgccagagtccaaggtgatgagcaggtcgttcgccgcgctcagcttgttgtccccctgctgggtgttggtcacgtcggaaagggccttgcgctggcggcatgctgaagccgaacgctcgaggctcgtcgaacggtcgcgctgtgccttgagctgtttccggaggaaagcgtttgatcggcgctgccgttgcagttcctcctcggtccaaacgtggcgccgtcgcagttcgtcaaacatatggacttaaaaataatgaaaatgaaatgaattaaaaaaacaaaatttttgatggaatttctcactcaccatcgtcaagaccaaaggcaccggcgcactttgaagtcgatggtgtcgccatgaggtcacagcgtgccgtggatgttgacggcacgggctcggcttcttggtcgtcgtcggctggtgttgaagtaattggtacatcggtttccaccatgtccaccgacgggacgtccaattccagtggtgtcaccggtgttggagttgatggtggtcgtccgtcgttgtcccgcgccggtgcctctgatgccggcggctcatcttcggatggttgtggcgtgtcggcatctgggtcggtctggggagcggcttaaatttgggaaaattggagattttatgaaaaatgaattgaaaattaacttttcttcgtccatcgaacttgagcagcgatttgggccttcgccctacgaccttctcgcattcgccaccgcttttgggccgcttttttgctttgcaatttaattagaacttttcttttagccataaatcctattaaaaagaaaaaataatctaattttaatgtaatatctttttaaatgttagcagggttaataataaaatcagcattaaacggtgcagaattttatcgctatagatatgcaaagttgaaaaggattgttt

SEQ ID NO: 7096 - DNA, 3810 bp, Heterodera glycines
  misc_feature (27)..(27): n is a, c, g, or t
tttgtccgagggtgtcgtcgcacgcgnacatccagacagtcgtttccgaacaacgtcccccctctttccacgaggtccgcttccgaacaattggcgtcaataatgcactggccattgcctgaaaatactgaacagtttttttaaaattcgctttcttcaccgtgcaaaagatggaagctcgggggtacaacatccgccaacgcaatgttgactagtggagggccgatgtacgaattttgtggtgggggaggagatgggcgggcatccacaattttgtccgacaattggtcccttcggactgtgcaaagcggataagggaatgtcaccgccgatccttgccccatcagtgtcgatgtgaatttgaggtcggcaaagagaagcctgaaaattaaaattagcattcctgattttatttatttacatttggactgggatgatccgcttcctcccagcaatttcgaatgcaacggtctccagctggttcaattgtgcaaaaatcgagccaaatttgttctccaaattttttcggtcatcatgtccaaaataaattcccaaaatggacaaattttttggggaatttgggtgatcaacgttgacgatcaccagtcccaattttgtcgttgctgccacaccgttgcctcccttgtcacccgtcagcaccaacacaatttaggaaacaaattgctggtggagttgcagactgcctttgttaaataattattcattttcctctcaccactttttgccaacacttgaagtcgcccctcaacaaaggcacggacgtcggtacaggcaagtgctcgagtctgtccttcgcccacccactaaaaatttgccccctccgccagctccctcttcagacgcttcactgcccacatcggtgcccaaacgtcatgtccctggccagcgaacgaccgcttcaacgcttcacgggctttgaactagattcctgcgtccaatgtaatgagcagatcgttcaacgcgctcagcctgttgtcctcctgttggttgttggtaatgtcggaaagggccttccgctggcggcatgctgaagccgatcgctcgaggctcgtcgaacgatcacactgtgccttgagctgttttcggaggaaagcgtttgatcggcgctgccgttgcagttcctcctcggtccaaacgtggcgccgtcgcagttcatcaaacataatgacttaaaaataatgaaaatgtaaaatgaattaaaaaaacaaaatttttgatggaatttctcactcaccatcgtcaagaccaaaggcaccggcgcactttgaagtcgatggtgtcgccatgaggtcacagcgtgccgtggatgttgacggcacgggctcggcttcttggtcgtcgtcggctggtgttgaagtaattggtacatcggtttccaccatgtccaccgacgggacgtccaattccagtggtgtcaccggtgttggagttgatggtggtcgtccgtcgttgtcccgcgccggtgcctctgatgccggcggctcatcttcggatggttgtggcgtgtcggcatcggggtcggtctggggagcggcttaaatttgggaaaattggagattttatgaaaaatgaattgaaaattaacttttcttcgtccatcgaacttgagcagcgatttgggccttcgccctacgaccttctcgcattcgccaccgcttttgggccgcttttttgctttgcaatttaattagaacttttcttttagccataaatcctattaaaaagaaaaaataatctaattttttaaatgttagcataattaataataaaatcagcattaaacggtgcagaatttttttctctatagatatgcaaagtttgaaaaggattgttttggtaattgtctaatcgtgaagcagtagcttagaaaaagcttctaaacatgttaagctttcgaatgtatcaaaaatgttggatttggatgacattgaaaaaagttatagaaagctttcgtggaaaaacatgctggcgcccaacgagcgcgcccaaacgcagtggacccgggcttgccccaaggggacccacgcgtttcggcgcccgcgtttcggcgctcgcgtttcggcgccgcgtttcggcgctcgcgtttcggcgccagctcgtttcggcgcccgcgtttcggcgccaaacaaaaatataaaaattcaaatatttggttaaaatcaacaaaaataaaacttttttagttaatcaatttcatcgaatatggcttcacaaattgaaacaaaaaaacaaaaactgaagcttccccacggtggacatctttacacattcgataaaatgagtaaagatgaaacgacaaaattttggaggtgcgaattcaaggatagcgtcaacaaatgtaaaggccgcatttggacggacctaaacaataacttcattcgtcttgcaacgccacacacttgtcccgcaaattcttcgaatgttgaagctcaacgagttaaaactacaatcaaactccgtgccatcgccaccttggaaccgccatctatcattcgttcagaagcattgcagaacgtgccatcaccagccgcacttttggtgacaaaaaggctcgcgaatgacgtacgagaattttttaacaaatgaaaactaacaaacaacttatttagttaatcaaaagggcgcgccacgaaatcaatgcaccaccagcagtcccgaccaatttgaattttgagatcggccaagcatacaggacctacacatcgacgggtggcgctgaggagctgtttctattgggcgactccggggtgtattttgaaaatggaaacgaaaacctgcaacggtaatttgtgaaaaaatgcaaaaatttttttcgcagagttttattgtttgggcgcgaatcatttggacgctttgcggacagaatgactgagtgtttcggtgacggaactttctcgctcgcgccaacccaattttatcaaatttatacgatcctggcaaagtctgttcgtcttaaatcggttttcaaatttgtaaattaaaatatttagacgtgaaaaatggattttcccagtgtgccatgccctaatgacttccaaatcgcaaacatcgtacgaaagaatgtttacacttttgcgtgctgcgtggccaaattttgctcccatttctttttccgtggcttttgaaatggccatgtcaaatgccgttacgacaatctttcccggatgccagatccggttttgcttttttcattttgtacggaacttacaaaagaaagtgaagcagcaaggcttatggcaggtaattttctcccctttatttaaaaatttttttttcaaaatttaagcgttattgttctgatccggtgtttgctttgaatgttcggatgctcacatcagtcgcattcgttccgctttgtgatgtcaggaatgcagtgacagcacttgacatggaatttggaaatttggcggcttttcgacctctaattgattggtcagaaaataaaattttcaattttagaataagtttttaggcttttggacaatatgttgggcgtcctcgtcccaatggcacatggtcacaaccattgttccgtccggagcagtggaacgtctaccaacggacattggatggagatgcgaggacgaacaacaccgcagaagcggaactaaaaagcgaggcaaatatttggcagctgatagacgaattctgaatatggttcgcaattacattccattgaatgcagtgaatgatcatgattatcttccacccattccccagcccaatcaatttcacactattttggaatttcttcgaggtatttcacaccattatcaaatgaacccttga

SEQ ID NO: 7097 - DNA, 1263 bp, Heterodera glycines
ttagtttattaagaaaaacaaaaacaaaataaagcaaaattcattaatttttacgaaaataaaataaaaaaatcgaaaatttccaatgttttgaaaattttagaaagataatttttttacattaattttctcgctattttaccattacttttttttgaaaaaattttcgtatttatgggtcaaaagagccgatttaatagaggggccaatttttttcgaaaaataccaaaatatgagcaatagccggaaatttacgaaatttccaaaaattttgccggattttttttcaggagagttcaattatgccaactctgttttttaggctcaattcgtcctttgagccgtccaaggcattcccatccgactcgccgttggccagctcaatcagttcgctccgtgaagtgttcgaggagttctttcccatccacggtgagagtgatcaaattgtctgatcagtgatcagagtgagcgatcaatagtgatcattgcttatattcccctcaaattaagtgatcgtcaaccgtcccccaaacatctctgatcatgctcaggtagatgtacttgaaattgaaaatttccaaggataaaaaaaagtcttactacgtccggactgatcagtgatcactccaacaaactcagtcacattttctgatcagttcatatgcttgggatttggttgaatatttgttaaagaaaaagttcttgagtctccaaatttccatcaaaaattgaagaactctctctctctcttccagtcccatcatgagctatagaattctgaaaaaattttcaatattttttcaaaaaaaacttgacatatttattcaaaaaatttgaatccgcgattgccttctattaactaattatcggaccatccaatgaaaacaagcaaattttgggataaaaaagttgacaaatcgcgtcaaatgtttgacttttcatgcggcatctatcagagatgtatcggaatttagaatgccgatttccgattgcttgttgccgaaattttcagtgaaaatatggaaattttggcctaaattcccgacgaaaatggaaaattttggaaatttggttagcattggtatgcttccaagaggtaaaaatttgaaccaaaattaacaatttttactgaaaaccgcaaaaattacgtatttatcaaaacaattttcctttacctaccgtattccattcccacgccccccccactcttctacagtaagccaacatgaacgtaatggccgctcaactggactcactgaccga

SEQ ID NO: 7098 - DNA, 1903 bp, Heterodera glycines
  misc_feature (1883)..(1883): n is a, c, g, or t
cctatttcttgggccaattccggttttcggagttttttgagcttggtacaacctccgccccacctcctctaccgtatctgcccatttttgccttccgaatttaaattataattatttaaaaaaataaaaataaattttagaaggaaaaatggaattaacaatttttcttttgaaatatttagaatttgaacaaaattttatattttttaacatctttttatttccgtatttttaacatttctttatttttatcaatatttcaacattttcacaaaaaaaaatatatgaaaaaacaccccactaaaggtcaaaaatttcagttactctcttagagatggaaaattctgaaaaagaattcgaaattgtcgaaaattttcttgttaaaatataaacaaattttatttgaaaattacttttttttagtttctaaaaattaatggtttaattttttcaataattgaaattttttttgtccatatttctgaaatttttcggaaattttaaattaatttttgtttttgtccattaccggtgtctccattaatttctaaagaatttttaaaaaattggctcggatcagatgttacaaaatccctcccccccccccccctcgcagtgccatcctgaacatgctgttgaccgtcaaaagtgatctgatcggctccatcgcggtcaccatcgtttgcatggcggtcgtctgttccctgttcatctacagtcgacttggcgtcggtgccattgcgctgtgcatcacctcaatttgcttcagtcagtagtcgtcaatgttttttattttacggcattttatgccattttgtgctttttttctgtcattcatttcaaaaatcactttttcagcgctcgtcggtgtactcagttggtgcggcgctgacttggacccggtgacaatggtaagaagctttaaacgctgatcaaaagttaacggatatgggtttgatcattgatcaatttattgcattgatcaaacaatgcgtcagtcatcgattggattacggctatttgatcaactgactgattatagttttcctgatccttaatgacggatcaatgattcatcatcaaaccatttaatctttttggctaaactgattgattgggctgcttcccctgcatcgttttcaccacgagagaatttttaaataacttttaacgaggacataaaaaaaaaattttgattgaaaataataaaataaaaatatgttttcgattggccatgttttgatcccatcgatttgttcctccgatcattactgatcagaccagttatgattgcttgaattcgtgtgctcgttcaaatgcctttaatgtccccccccccatcaggtggacgtgctgttggccaccggatttagcgtcgattacactgcccatgttgcgcaccaatatcacaccaagaagggcacaagcactgaccgaattgcgcacagtctccatggtaagtaaatgatttgttttcttgacaaaagctttctcaatatgggaaatttttttttgattttttacaaaaaaaattactgtaagaaatttagaaaataaataaaaaggcctgaggtttatatacatatatttttttttgaaaaaagacattttgaaaccctgcatttattatttaactttttttgtaactaggcagtatagtaccttatttaggaaatacgagatacggtaataggacacgatatgaaattttaagcgtgctaattggaatggaaaaaaccgaatttaaaatctttgcacggcgaaagtaatttactccaaaaagacccttagtttgttctctttcttataaatctttaaaaccattttggaaacacagcatcttaatttccaaaagcagaaaaattagttttttcaatattaangtcaacattttaaaaacaaa

SEQ ID NO: 7099 - DNA, 2471 bp, Heterodera glycines
attttcattatatcatgatttagttaattaattaagcccggcacccccctccttattcatgtcctcgggggcaatgttggatttcaattgcgattgaattttctttttatcatgatttagtataattaattaagccccccaccccacccctttattcatgccctcgggggcaatgttggatttcaattgcgattgaattttcattttatcatgatttagtttaattaattaagccccccaccccaccccttattcatgccctcgggggcaatgttggatttcaattgcgactgaattttcattttatcatgatttagtttaattaattaagccccccaccccaccccttattcatgccctcgggggcaatgttggatttcaattgcgattgaattttcattttatcatgatttagtttaattaattaagccccccaccccaccccttattcatgccctcgggggcaatgttggatttcaattgcgattgaattttcattttatcatgatttagtataattaattaagccccccaccacaccccttattcatgccctcgggggcaatgttggatttcaattgcgattgaattttcattttatcatgatttattttaattaattaagccccccaccccaccccttattcatgccctcgggggcaatgttggatttcaattgcgattgaattttcattttatcatgatttattttaattaattaagccccccaccccaccccttattcatgccctcgggggcaatgttggatttcaattgcgattgaattttcattttatcatgatttattttaattaattaagccccccaccacacccctgttttttgttgttgaactgatcattataaccctttgttcttttgcagaaatgtgccctccaatgcttcaagccggttggttggtgtttgtttggttgacacgagtgggagggagtcaagggcgtttttcaaaaaaaaattttgaaaagggtgtagggcagggatggcacggaattccgatttccgatttccgaaaaaattttggacgtcggaaaaatatgcttttaaatagatcaaaaaaaagtttgaaaattttgacgaaatttgttcgggaaatgtctactttttcagggattgtcccattttcataaaaatttgtttaccatttcggcaagtgggattaggggattttcggcggtgccaattataaacctccaaagaaaattttgagcaattttaatgtaatccatgactgaactttggtctttggccccttttcattggccccaaaaatttgtgccaggaatttccaccgctttgtgcatgttgcctttggcatttgtgcccacctatgcaattgtggcatttgccaaaacaatttttgccgtcatttcaattggccttctccacgggcttttcctgctccctgtccttttgtgtgccctgccggcagagaagcggaacaagcgaaagagcaaggaaatggaagagaggaggagagaaagaggaggagggaaacaggaagaggaagagagactgggcgaggaagagagagagtgaaggacgaagagcggggaattgagtaggaggaggaagagaaaaagaggaagaaggtagagattggagaaaaagagagcgattgaagaagaggaaaagaaggagaggaaaaatgaagaagaggaaaagaaggagaggaagaagcgagagagagagagagacgaaagatggacttaaaatgagagccagagagaaaaaggaattgaaaagagttaggacttgagaaggaatgagaaaaagaggagaaaacaatggaaaaacgcataacctcatcaagaaaaaaaaagcgtaatttatgtgtagcagcggcaagggcgtagcaacacaaatccccaaaaaaacttaaaaatgaaatttaattgagaaaaaataattaaaattttttaaattattttcaaatttttttctcacccctggcgctacgtccttggcattagcagtacaaatttgttttgtttttgaattgttttttttcgcgcactcacacgcacaacaaaatgccattatcattcccaattaatcaatgtttgaacgaattaaataaaatttattttcaaaaatgtttattaatagggatgggatttttatgtgctaaaatcctgaaataggtgctaggcgttatataaaaaaccatcaaatggaaattttcaaccaaaaactgcccataacttttgttaaagtcaacaggattaaacagtacacaaggtgccaggttttcagacatttttggccataacttttttgaaacctaacgaaattttttgaaattttgcaggctaatataggacacatagagctatcgaatgatatcacactttcttaattttgttggttctaagaaagttttgatcataatttttgatcatcaaaaaatgcttttttaacgcaaaacaaaacagcacgccacaataacaaaa

SEQ ID NO: 7100 - DNA, 2670 bp, Heterodera glycines
ttactagagaccgacatttccaaatctgccggaccagaccggactggtattttcaaaaagtaccggattctggatccggtctctcataatccggtcaatccggtaatccggtcaatccctatttttcaaattgccggatccgtaaccggattccggattggtaaaaatttcaatgttaatttagggaaaaaacccgcaaaatgtcatcaattatatgtaaaattcggggcaccagaaaatgtcgccatagtaaagacaacgcgccgaaaaaataaaaataaaatttcaagaaaaaattttaaaaaattttattttaaagttttttatttttgaaaacctatgtttaatggaaaaataataataatgcttttttgcggcgtccttattacaaaaaaaactttgggaatggggccggcggtgccgataggcgccaccgggaaaattttttgaaaatttaaggcaatttgttaacagattttcactaaaatgacaattttttgattttttgggctccggtcaatccctattacaactttttaaggaagctgtgatacaacctaaactattaccaaaataagggagggttgcgcgacaaatttcccattgtatcttcctttcctttattttactccattgtcattgactctccctttttcccactccctccctctcgcacacacacgcacgcgacaacagatacgggattcaaattgtttgagtgaatgcatagtataaaagggagttgtttcagcatttccggccattcctttccaaataatattaatttattcctgcatccgtgccatcatcaaacgtatttggcgcaccaccgcggcgacgcatggacaagtgagaaagcggaaatgtttttgaaacatttaaaatttgtttttttcggcactttaaacgaccaaatttggttggacacgttggcatggcttgggcgtggagaggtcggcacgcacatggcgctggtcaacgcccgcttcaccgttctggcgtacacgcagctgcagcaaaggcaatggtggttgaaggagttgcacatctgtcagagggaaccgagagggacaggcgccgaactgatcagcttgaacagcgacggctcccgcttcatgtcgccattgcccaccgcacaattgccggaaaatgtcgtcggcttctccagcacattcaacatctggtcgacttcaacaattcccaattttaatttaaattgttccccatttttgcaggtatttcgacggtgaagtgatcattttcctgcaccgaattcgccgcctcttctccacggacgtctctctgcagttcaacattcggcggacgcaaactcgtggttggaaagcgatggcacgtcacatttggcccctgctgaagaacggactcatcatgctggtcaacgtaaagcggctgcacctcatcaggatgcacaaatacgtgtcgccgaccgtcctcttcgactgcgcagaacttttccaaatcagcggcactgttttgcccgagagtccgacaacttacagcaattcgccggacttgtcgacacgtttactgtacaactggctgcacacgcctcgccccgatggtcgtccagtggtattcaaattgagcaaatggaaatcaggatgggaaaatttcgtcaacgaattgatcacggtgggtgtggggtgggtgtttgatcgacggacggattttacttttcctcgttgctttttaattgttctgatcacatttttccgttttttagtccttcactcgtgcggtcggcccggtcaagtacatggtgctcgcttcgttcgacgtcaactacacccggcgtgaacaaatggtgaacattcggacggaggaaaagctgacgctgtcgagcgatgtgcatcaaaggccggatggtggctttgtgtcatctgtgaagattctacgctgtccagcggtgttcacggaagcgaacgtgatgtcctggttgcgtctgccgcgtgtggccagcgaatggcacccaaatttggtgaccattggcttttcagatgactaaattgggtatggacgagttgaacaaatttaagattcagtgttcttatttccttcgttttcagaccaatgccttcgaacagagaaaccgatcgggctgagaactgagaaggataactgcggatcaacaacagatgagccctaagcacaatggccatcgaatgaaattatctctgatcattattattcatatatatatatattgtatttgtcttggcaaaggaaataaagcgccgaatacttaatgttgtatttggcattgtgtagaattgtggtcccgaccgtctctccccacgattcgtctggtcccacgcgttttggcagtcacgtttcggcgcgctcgtttcggcgccagctcttttccactatacttttttctatggcatccaaatccaacaatcttcgtatcattcgaaagctcttaacatgctctattagccttaccaaaagcgaaaagattttcaaacctggaaaaaatgttattaagaaaaacttcaaaaacttcggcttttcgcaattttcatgtataacttttttttggtaattgtcaaatcgcgaagcaatagcttagaaaaagcttctaaacatgttaatcttttagaatgatatcaaaaatgttcgatttggttgacaaagaaaaaaattata

SEQ ID NO: 7101 - DNA, 816 bp, Heterodera glycines
ctcttaacatgctctattagccttaccaaaagcgaaaagattttgaagtcgggaaaaaaagtttaattaaaaaatttaaaatttccgactttcgcaattttcggtaattgtctaatcgtgaacaatagcttagtaaaagcttctaaacatgttaggtttttgagtgatatcaaaaatgttcgatttgtccacaaagaaaaaaatatataatttcagcagtttttgggcaactttttgctcctcgtctctcaattttaatgcgtttttcaacttaaaatattattactttttgttttttttgattttaaattactttatcggtttcaatcagttagttttccatctcttccgtaaatttcaatgcgtgccatttttcggtaggaaatatttgcgcatttttttcattaaaatttattttgtctttcatttcaataaaaagtgtcaaattttcgttgtttttgtattcttcaaatatcatttggtctgataaaaattttgtttgtattttaaaatccctgaaaatttcctctcttacccaatttttgctgtgcaaatgcttttttcagtaattccaatttttgctcaaaagtgccaacaattttacttttattttcggcatttttctggcttccaaataggctcgaaagtgtcttttccttttgcctttttggcattttggcccaattttttacttttcctccaatgattgctctgccaaattttctgctatgaatttgtttactgatcagctcaatgcctcttctctgatcacttttcatttgctcctttttgtttcccgctaatttatccaaattt

SEQ ID NO: 7102 - DNA, 1349 bp, Heterodera glycines
cttttctggaatttttttaaattctggcagaaacttctctctcatttctattgcgactcatttttaactaatttaagagattttaaaatcaattccatataattcattaattaacctaaaattttaatcacaaaaactttgaatatatttttttcaagaatatatgtaagaatattcgatgaattgaaaatgcttaaaaatggcaacaaaatttttggaaaaaaaacattaatttatgtcaattttgtcgcaaaattagttttgtaaactaatattcatattcaaaaagaaaaattgcatatttctatgaaatctttaggaaaaagcatctctacccataccaaatattagaaattttttccaaatacattaaaagaatgagtgacacgcttattatttaaaaaaattgttaatgcaattttaatgaaaaatttcccaaatttcaaaggcctaaatttcacacctctgtctcatcctaatcggccaagagagttattgcgttatccgtgccaatcaaatttttgccttatgacgcggctggatgggccaattgatggccgagtccaatttcatcccctctggcgatggatcggtttcaaatttctcacccatcaaaaagaaatttcggtttttcaaaagctattgaacttttttgtgggttagtgccccttgttgggcttggagggaagtgaagtgagccgaaagtcccaagaataatctcggcggcggcggcaagggccaattgctctgatcactcactcattgaaccatggtcacccgcccccggggtgcttcctcacaaccaatcaacaccatctgcatcatcatcatcatcagtcggggtcggtctcgctgatttcgaatgaatgggccaaggagctggtggttgggggcgggaaggggcagggccaagtgaagaaaaaggtcgtcgagaatggaatgggaggggagagaatggatcggtctcgaggaggcggaggggggggggggggggtgataaaaaaaaaaaaactttttagtctgtgatttgatgagatatttatgttacaaaattctgattataaaggttaaggatttttgagtaatcgttggacatttgattatctctagttccttctatctgacctatacagattcacagcatatgtatcgtcgagtccagggtttttctcatttcaaagttatattaatcgagattcaatatttatagattgcttaatgcaattagatgtgacagcaattacgtattttattattttatgttcccattatccatatgacaccgccttgatcctcccattactgtatgtcctgtggcaaattagtcaatatgacgattcattggcttg

SEQ ID NO: 7103 - DNA, 1612 bp, Heterodera glycines
ggggaccatggggttccgtcgcgcttctaaaccccaccgcggcgccggaggggaaatgtttcttttgggcccgagacaatgatttattacttacatcctctcttctcccccccccccctctcttggggacacctgtaaatacatcattttagtggatttgggatacggtaataattatggttgggcagcgggacattgtaaaaaaaagcattcactgattttggcattttagacaaatttttcaagaatatattttgccttttttaatttttgtacggcacgtaatttttttacaaatgccaaccacttgcggtaatttatatgcaaaacataaataaataaaaattccggcatttttctaggttttccaaactgcaaatttcgttcgaggtattttttgtctcccatacagccaaaatctaagtgtcattaattttttccctcccaaaggtatcgaggccaagaggacaatcggcacttttaccgtatcccgaaaagaccgcccattctgcgccaggcatggctttgtgccattggaagaagtgaggagacggtggtgagccaggcaagcaaaagcatcccccgtgggagaaggggcgggggacggagaggcaaaacaatttggcactaaattgctttttattgacgggaaatgccgcgggcgttggcgtttttcgcagactttttcgttttatgtgttttgttcgattttaaattttatttataaataaaaaaacattttaaatgtaaatgatgaatggcatttcttcagctccgaatttgttctgcccatttttacggaggtgaaaagcacgaaggcgacatcccggtggcggacccccaggcaaatttttcttaattggttattaattacaattaatggttcaaaaattgcagattgacccacccgaattcatcgaacttccgccaaaagaagtgcgctcttccgaaagaagggcccgcttaaagggtaaagtttaaaaaataaaaataacagattgtcatgatttaataaaattaattgaaaatgtttatttaattaggggggggggggaataatgattggattagcagaaaaaacctgcgctattgtatatctcatttatgatcaaattaccagatttaatattatcaaagtgagctcctctgatttggattcatttcgttcaagaattttttgggtgtcgagaattccattttttaagcattgtcgagaatgagctgcaaaaattcaagtacaatttataatttcatcattttactatgcctttcctttctgacgagcggaattttaatttattgaactaaaaacaaagaatatttttcaattttcttcgcgattattgcatttttcttcttatgacattctgatacgcatttatttcccattttttttgctttcgccgcttaaaaaacaattattattaaaaattcattttctacacttcgggattcaatacatatataatagcagatcaaattcacatattcaaaaaatagattttaaacaattatttccatgtaaaaaaagaagaattaattaacaaataagaaattaaaaattatgcatagaaaaaacaatttatcacttatttaatattttcccattttt

SEQ ID NO: 7104 - DNA, 1933 bp, Heterodera glycines
  misc_feature (1837)..(1837): n is a, c, g, or t
  misc_feature (1847)..(1847): n is a, c, g, or t
aagcgcttaaagtgctattttttgcggcagaatttaaattcattttttaattttccatttactaatgctttttttttgtcttacttaattatttacattgggagaacaattttttaaagtgcactaaagggcgaaaatttcaatcaaaaaaaaacttaataagtcaattaaaattagcgctttagcccatttttgtgagcaacagcagtaaaaaaaaatgaaaaatgccaattcggtggctttgcccttctgtccgtccacttcggctgcttctgatggggccaactccgaagcgaaccgtacggacaaaaagcgacgaattcacacgcgaaatgtccgatcagtgatcagcagcatttactgcagacggaaaaatgcgacgatcggcagaccgtcgatcggctgttggttggcactgctgttgccgctctcctcgttggcacttgtgttcaacgatcagttggaccaacagagtccggtgttttacagtgccaagaaaaagctaaaggaacaggtggaaaattcaaaaaaaaaaaaccaaaattactggaaattcacaacttttcaggaaatcattcagaaggtcctccgagattatggtgagattatttattttcatataaatttataaaaaaaagttattttaaagattggcgggttcgtccccgaggcaaaaatgactcttggcaaggtgaggagaagcctaattagtgacgaattgattagacaattaacgataatcattccctgctctgctcagatacgggtggccctgtgattgtttctgtaaatgtctgttaccactgttgttttttgaccccatttatttatgtcgacagatttatctccgctcaatctccaaaattgatgacgtcaacatggaatgtaagcttttgggaagtgattgagacaaaacatcaaattcgttcacagaaaatggacatttgggcatcaaaaaattaaataaaaatgcagtgcattaattacaaaaagattttataactttgccaaaaaaacaaaaaccgactattttaatggagagtctcgggtacagggctggccatgattgaatttccaatcacggaaatccgtgagccgtgatcacgaggctttaaaaaaatccgtgatccgagatcatggcacccaaaaaaccccgtgatttccgtgatccgtgattaaaaaatttttttctaatgatttttttatttaaatttatttagaaaaacggaatttaatcgctggaaaaattcctaaaagatattttaaagaaaccaaaacacaatacgctttttttgctgcgtaccttttccaaaaaatgactaagtttacgattttgagcaaattttttgatgaaaattagagctttttgtagaaatctccaaggaaaaattttattttttaactaagtttattaagaaaatttttcttaaatttaaccaaaaatctatttacatagagaaaaaaatcagaaaaatttcctctaatttgtaggctaacttttgatgctaacaaaaaaatcttttggaccaacatgatcagattactccttcatggcgatctgaacaccccaaaagatacagaaagtggggaaaattttagaaaaattcatagggtgtttggaaaatttttctggaattttgattaagcctttcattataatttaagcaacggagagaaaaaatagagaattttagccgtttttgcgacaaaaatggggttattttttgctattttggggtcaaaatttcaaaaataccggaaaaatgggggcccgtcccggccgatggttgccgacaggcgccaccgggaaaaattttgaaattttgagtgaaattgntaacagattntgtccaaatatgtcaaatcattggttaattattgttctatagacgttgtaaaatagagaaaataattttcatgttaggaaatttct

SEQ ID NO: 7105 - DNA, 3094 bp, Heterodera glycines
taattaagaaattgcgcatcatcgaatggcaacacttcttccctgctcaagttttatccgatggtttgcttttcgtttttctaattcattctgtgaggcgtctaattgggggttttctccctaattatccgtcctaattacggattatttacccccccccccccccccgccttttcccgtcacttttctcttaaggctttggccacttcgtgcgcagtgcgcggctttctctacccgttaaatgttgtcaaagcacggctacaactccagaaacagaacaatgtctattctgggatgaggtgccgatgattctgattgtgagtcctctcacagaatcccactctttgtcagacatgcgtttgtcgacattgttcgaaacgagggaatggtggcactgttcagagtaagtcggagaggatggcacggcacatgcggggggggggggagggtgaatgaggttgggtcggtggttttgaaatgggtttagtggagtgtctgtccatcgtttgaattaattagccatttttgacccctaatagggcttttgggtaacaatgcctcaacttggcgtcagtttcatctactccaccatttacgagaaattccgaaatgttcttcatgttaatgccaatattcaatccgcgcccgttgtctctgctttggccggtgagaacaatcaaatgccattccaaatttgttggtattcaggcggattttctagcattttcactcaaataatattcgtccctaccgacatcataagttatcttcctttttcattttgcaaatccgtcccattcactacggtttccctccgttttagtcagcatatgatgatctacaataatcccgcaaaatttttgggctctgctaaaaatgttgccgttttggacttcgtgcgaacggatggaaagtcgggccgtttgacctttgggcttcgaattgtccgagcggtttatcacatcgatggtttgtaaagggaacaattggaaagaaaaaaacatttggaattcttggggatttgtttttcattaatttatgggaattccttcagtttttaattgagaagggaatttcgccaattgtaactcggaaaatacatacggtttttatcagtggatagagcatgaccaatttgtaatgtgaatttttaatttttttgcctaagaaacttccctgggagttaaaaagcctcgaaattgggttttttagatctgaaggcacatttcatttctgaatgactgccaaccagggctggaatgggggtccgtccgccggtggtgccgacaggcgccgccgggaaaaattttgaaattttgagtgaatttgttaacagattttgtccaaaatatgtcaaatcattggttaatttattggtctatggacgttttaaaaataaagaaaaataattttcaatgttaggaaatttcttattaattaaatttcaattaaaattatcaaaacaaaatataaaaattctcctatcccagtggtgaattgaacccaagggatagacaacgaaagacagaaggcttaaccaccagaccaaatatatatgcgtccttctttaacagaattgaatttatttatttaattttttctaaaaaatttcttttcacacaccaatttcctattttcgtctcagtaaaaattccctatataaaatgcatcacggatcaaaatcacggaaaatttgaaaaaatccgtgacccgtgatccgagatcacggcaccccaaaaaccccgtgattcccgtgatccgtgatcacggccagccctgctcgggtatcacaatgggtttaagcaggttgaattaagctattcaaaaattttaaaaattagacagcgcccaattcacatttcgcgaggaatggtgggaccctcggctggcctatggccgttttgcggacgatgaaactgaagtgccggcttttgttgtgttggccaccagcgaacaggctgatctgactcaacagatttgggcaagtgttgaaacttaatcggcagagatcggcgattgtactgacaaatcaaaatagacaatcaatgctttgatattgattgatcagtcgatttatgattgacgaaaattatcatttcaatcacttttagatgccggacactttcttccaaaatgaaaagtaacaagcaaaaaatctgttcattttgattgtttaaatggccatttagagaggcgagaaggcatttgattgataagccaaatgtgctgatcagaatccatccggacggacaaatcctttacagtgttcggtccgattttgttttggctttctgtcgtgtttaactgtgctgttttcagtctctctctcgtcctttcatgtcccatgtctttggagtactatccgttggaccgacaaacatgcttaatcgacttggccagctgtaagccaaaagaaataaattgaaatgtaaattttaaaaaaaaaactaaaattaccttttgggtaaaattttaatatttccaaaccctcggggaaggaattgtaaaagttaaatgtccaaccccaaatttgttgctttttcatcaatttgaagacgcctacacaacggatgacattaaatatgaatggaaaagggagaagccgattcagcagaaggagggcctccggcagagtttgccttccttcgaactgcaggatgtgctgaccgattactgcaccagcaaaacgaacacaggtaaagcggacattttcattaattgagcaatttggcctgctgagctaacgagagcggcggctacatcaaaggggtcggcattttcggatcgcatgagtatttagtgtaaacccttttgatcatcaagcggactgttcgagagccgcctttgattatttcgtttgtcgagatttggactgattgtgtcggcttctttcctaatttgccttttttgcgggtgtttctcccttcttttgcctaattatgcattttgtcctccccaattccctccctttgctgttcttttaaggcgaatactcttgtctccggacaatgctcattctccgtcgcgagttcagctattatttgttgcaagtttgtccaccattagcacttttattttacttaattataattta

SEQ ID NO: 7106 - DNA, 1370 bp, Heterodera glycines
  misc_feature (21)..(21): n is a, c, g, or t
catacacaaaggtacaaatgnagcatacaattatttgcttaatttgatttttttatttattaattcataattatgtgcaattaaggctgtggacgtttggattggcgtttgtatggcatttgtaagatgttgatcattttgttgcactgaaagttcaattaattttaccaattttaatattttgcagatttttggcgcactgctcgaatttgcgctggtcaattacgcggctcgtaaagacattagcacaacgcaacagcgaatggttgtgcctaatgagataaataattgtcaaaaataaacatttaattatactttgtctattggcacacatttgccgtgtccctttttgaaaagccgcttaagatcaaactgcaccaccagtacagcacggtggtccaccaccaatccgtcgatgcttctgccgccgacgcgaaccaaagtcggccgccgcccggccacacgttccaatcgctgctccatcccaccccaaccaccggtgccaatttcggctctgtccgtcactcgtccacggcatcgcatcgcttcgtgccgcagagtccgtcctccttgccttcccggcgaccgctcggcatttgcttccgcctgtgctgtcggctgttcgttcgacgatacaaagagcgctccaaacgcattgacgtcgtctcgagactggtgagaaagcgcgggatggggccgggaaatgggaccaaattggacggagagaatggcacggagtcccgagagggggcagaagaaaggaagaattagatgcctatttaaaaacatttttttaggtatttcccatcggatatgcatgtttcaatggtatttgaaataaatatttgtaaaagataattgcaaaaattaatttaaattttaattttctaaattatatttttaaataatattatatagattatttgtcatttaattataaacattccctgcaaattcagtgctttattgggccgtctatttgatgtgaattggcaaatgcccgctgattaatccgccgattgtttttcatttttgccgttgttgactctcttctgctgatctcacctcacctctttttcatagcttcttctccattatttgcaatttataatttaattaaattttgtgtaaataaattttctttttgttttggcatttttatttgctttttctttttttttgccaatgctttttctttaaacgattacagtgacaaaaacttttttaaataaattaaattgtgaattttccaggagagtactcatgcgtgcgggttaagcttatgttgcgccgtgaatacaggtcaatattggggacacgattatttgcaaaaaaaattaaatgctaaaaataggaaatgaaactctaat

SEQ ID NO: 7107 - DNA, 2123 bp, Heterodera glycines
  misc_feature (1964)..(1964): n is a, c, g, or t
ttttataccggtccaatcgtaaaatggcgtccacaatctttttgctaaacattgctggacaattgcaaattcgccgtgcaaatcgcgcggtattccacaaaaaaaattgccgaaattaaatattattaaaattgttttagaataatttgctgacatcagttttaattatcaatgaattatttatctcatttttgccacattttcttccctttatttgtgaaagggtaaatttaattaattatttaaaaatatatttttcttatactaacttaatgaatttaatctcggttattttaactttttgtaatataacaaaaacatataaaataaaactatgctttttttattatcatttgatattaataattgatattaaataattgcaaaactatatttgttatttttgtttaaattatttctttttttaatataattaagtcatgatttacatttattttaaataatttattttatattacctaattttttaatttaaaaataaaaaaatcttttatttcattttaaacgatatttcgcaggtttttggtgccggttcatcgcttggcacaggacctttgtccgagttgatgaactcgttcgaagttttgtttttttcttccatatattcgtacaagttttcggcacggaacaacacatcaatgcatggcacgggaggaacatttaataacaatgccgtacaacaatatcaacaacagtcatactgtatggagatgaattacagtaggcagaatatggaacgaagacgggctgatcgtgtggtaccaatggcaccgggacaacctcagccggcacaaatcctcatccgccaagttacgccagttgagaatgtaaacggcaggcctagaacatcgatggcacgcttttgagaagagtcgagaaattttttgaaataaattacgattcaacgaagtgtgtgatttgtcatttttttctgaatttgtcctaattcggagtgagtcatatcttaattttatttttatttcattgattgtaattatttgaagaagacaaaaacccttgattccaagttttgtctattaaattaatttaaaatctcattacatcattattttaagtgaaataatgaaattttaaaatatttcaaaaatattcattataaattatactcaaaaactcaaaagttagcagattttttaaacgaaatctattttttagttttacaaaattcttgattattgaaatctaatttttgctataatcaaaatttttaatccattagagatgagagattacaattgataaaatatctctttttttgcattggatattttttttgggaaagaaaaaatagcttggaaaatgcccatccaaaaggagccgtagtattggagccaaaatcgtttttgtgctcgggtcaacaaacaaattagggtcgatggcattgaagttgtctttttcgttagattcaagtatctgaaggatttctgagtcaggcagggtctggaaatctagattttttggcttataattggatcagaatttgcattcagtaaaaatccaatgaaaatggttaaattcggaaaatagattccaatgttattcactagattagagtgaaacttttttggtattctgaaccgcctaaaatcagtttgagatcatgatttccagtaattttcatgcaaataaacttaattctaattcgggagacaagaattgaattccatgatacgttattttcaagggatcattctctggatctatactaatctaaacaggatgttgccactttgtacgacttacccgtcctaaatcttgccaagtgcccggccgaccactgctactcactgcccgtccaatcaccgcggtatgagtgagcttttgctgaggattcattaatgtgccgtcaactggcacgcagtagaaaagccaatatcttatccttgccctcgccgtacggccccgaaacgtcgggtgcccanaattcgttgtttcttaccaaccttaacaattcgttcatgatgatttgaatgaagggatttcggattgtgccacttgagtctcgtgttttacaattttaaaatttaatagattaaaatgataacaaaattatagatataaatgagtaattttttctttaa

SEQ ID NO: 7108 - DNA, 1512 bp, Heterodera glycines
tggatcagaatttgcattcagtaaaaatccaatgaaaatggttaaattcggaaaatagattccaatgttattcactagattagagtgaaacttttttggtattctgaaccgcctaaaatcagtttgagatcatgatatccagtaattttcatgcaaataaacttaaatctaattcgggaaacaaaaatttaaatatatctctggactgaattccatgatacgttattttcaagggatcattctctggatctatactaatctaaacaggatgttgccactttgtacgacttacccgtcctaaatcttgccaagtgcccggccgaccactgctactcactgtccgtccaatcaccgcggtatgagtgagcttttgctgaggattcattaatgtgccgtcaactggcacgcagtagaaaagccaatatcttatccttgccctcgccgtacggccccgaaacgtcgggtgcccaaaattcgttgtttcttaccaaccttaacaaattcgttcatgatgatttgaatgaagggatttcggattgtgccaacttgagtctcgtgttttacaaattttaaaaatttaatagattaaaatgaataacaaaaattaatagatataaatgagtaattttttctttaatgccacaaaatttcaatttaacaatgtttaacatttttccatttcttttgtccaaatatattttaggttaaccaggaaggaggctaccaattttccaaaaatattgggttgtaacataaattctgtcatagttgtgaatttatttatttgcatatttttaaaaaatgtctccgttgctccgctggccagctctcatttgcattttgtaaagcaatgtctgcggtttcaaaaaatgacactttttaattttttcatctcatttttgattttttagaaatttttgaatagaaccctcaaaaatcaaaacccgatcacttttattgtacgggtcaaaactttgctttgatcagttggaaatttattaaaagcggtttttgtggccaaatcaagtccggagaatccaaatctggcctcagatttaatctctgaattttctctggcattgtactgctccatgtcgttaacaagaagttgaaaggtcttttcagaacaatgttgtacaaagtgggatgctgaatcttggcacttttgagcacccattttcagacaggacaatttaaaaaataacccgtcggtcttggtgactctttttcagcttgttagatagtcccaactttgctctacaaaatcataatttgttttgtacctttagccttttcttggccaagaaatcagtggttgaatttggccacttttttaagtagaccgatcagtttatttgagtctaactatcttgaatttaatcgatagatcatttttaaaatctcaaaaatgggagaagattgtgaagaataatggggcatattttgattaatattggcagtagttaatttgttacgatttttttaataaaatttttggtcgctatgacagaa

SEQ ID NO: 7109 - DNA, 2128 bp, Heterodera glycines
ttattagccattaaattaaaattctaacacgcgttccccttttttgtctatcgaattgtctaaatatgccttaatttgcccctaaggtgaaaattctgacaatttatttaaaaaatcaacagaaaatcaattagaaaaatttcctaccttcattgtgatgagacttgcctttgtgctgaattcagagatttttaaaatgaatttttatttttcaattggtaaaaaataatttcatttaaggaaaattggcttatatttgtcagatgaatcattaaattttggatttggcactttcggtaaaaaccaatcagaaaatatttttgaattaaatatttccgcgaatttttcaccattattgcttactttatgtttcttggacagcttctgttcaccatcattcatcatcacaaagttcgtggtatttggcggcattggcatttgctgttttcctatgccattcccattttcaaactttggcattagtgatgacaattctatgccatttttaacttcccaatagtgccgttttgggctttttggataattgacctttccaaaaatcggcatgcgtgccgacatttcgatgccactttgcaaatgccatggtgtcccgttttgtgccaatgcaagttctgtgtgccgttcccattttgatttatgccaaatgcgcccgttatcgaggccatcgccccaagtgtaccaaccacggcatttgacaatttacggatgtatccaacatttgtggcaccatcaccattttcatcagcagcttcattatctaggttatttgatgttaaaaactcaaaaaatatccaaattttctaaaaatttgacgaagccgaaatatcaaaattaaattaaattaaaatatattttaatttgaaaaaattcttttttttattaaatagtcagtggaaattctttttgatttttttttaaatttcaaaaaataaacaaaatttcttgattatattgcagataaatgtattaggtaatttgttggtgcacctccacaactcccaccagacaatgtggacataaaaatgaaggcagtagcaacattcgtgagaaaattcatttttacctcgtaacttaatttttaaattaaaaatattttttggtattttttaaagtgtgtttttgtcaaaaatgatgaaattgaatacaggaaaaaaggcattttaatgaaaatcattcaattggcgtttcaatagcggaagtcatccgtttttcttcctctcttcttggccaacacatgcggcacttacatttccggaaaaaatataaataataatatcaattaattcaatgtatttttttttattaatttatgcacctcaaaatatttatttttgtataattattaattttatttcttatcaatatttttcaagtggccaaatgccacagtctcgactccttaaaagtcccgggctttttgggtcttggttttagtcactagagtatcaggaaattttcgatatcgagcatcactaaatattaacccaagctcccttatccccgtcgggaaactcttattggtgagcggggtccgtcagaatgacaagtcggggatggttctatgtcgtttctaaaatccggcattttagcgaattttcgacaaaacatgccataactttgcttaagcgcaatcaaattttcccggcagcgccaatcggcaccgccggacgtgaaattctgttaataaaatgcatttaaattttcaaattttttcactgcggcgcctaccgacatcgccggcccgctgttcccaaaaaagcgtgccgcaaatttttattcattttttttaattggaataaatttttgcaaaattgctgattttggattctaaatgctgatattgaagatttgcactaagtagcactgtttttaattgttttaacaatttaaaacgtcgttttttcaaaaaaaatcgtaattttgggggcaaatcttagttttaacctcgtttgtccctattttgaaaatacatttttggagccctgcgaaataaacttgctggattcgtctggacattcactttatttaaaatcacccaccaaacaacaaaaaaggaggaaggtcggggaaaaccaaaaccaaaaaaaatatgaaagggcacggacaa

SEQ ID NO: 7110 - DNA, 1649 bp, Heterodera glycines
ccccgcccttctgtgacttatttttcttgcttaataaattaaatttaccacatccctagtcataataaatttaagtattttttaaaattttcccattagatttagtcaaatgtcccttgtcctccttcgtccatcatcatcattaccttcgcggttaacatttctgctgttctttttactggtcaatttatactacctagtcaaatctgcaagtaattctctcatcaatgacaagtgcatgacttgcaaatttttgtcgaaaacttttttagaagtaatacttcaaaatttaatctgctttaacacatattaatattttagggactggaaaaaactgagaaacttcattttggtggcggaaatactgactgggaagagcgaaatttgggcagatttaaaactaggtaattctgtcaatcattattacatttaggtaattaatttagtgaaactcgtttcgttgaaatattggactacgtttgcaaaagggattcatctgctgagattggatttagtggaattaaggatttgcaatttaaggtaatggaacgaaatttgtggcaaaaattccattcaaaatattcttttaagtgtcattctctgctggaagcccatgaagaactgcttggacaatggttttttgagcatcaagagaacggaccaactctcgggaaatatctttgcattgagaatcttaaactttgttgtgacgaaggctattttggctcggattgttctccatgtcctggaatgaaactctcgggcaaaccttgtttcgggaatggacaatgccaagtgcttttttccataaaaataattataaaaaagactaaaaattaagggcaacggaacacggaatggcaatgggacgtgttcttgccatgcgggttatgtcggcaaaatgtgcagcaattgcgattcgtcttattttgcagtttcgcaaaattcgtcttacatcgaatgcgaaggtcgaaaattcgcttgacatttttattcgttttctttaattgaatgttaaattaatatatttatctaattttttcgtaccctttcagaatgtttcgacggatgttctagtggttgtggcggtccgagcccaaaagattgtcggtcttgccgaattgggtataaaatggatcccgaaatcggctgtaatggttggtaccgcacggaaacaatgccagttgatattagccttgaaaaatttttggtggttatttttccaattgtgtaattattactgcagtaataatttgcacggtttcattatttaaggggtgggtaatccactattttaacattagacaccaactcggaccctttttattatttctgtttatttaaatgtccatctcttacattatttatccgctaattttgaatttctttccctcagatatcgacgaatgtgcagaggaagggaaatgtgacaagtccaatgaaaaatgtgtcaacactcctgggtaacttttaaaaatcgcatttgtgactgacaatttactcgttccctttgagttccttcgagtgccaatgtgtcgatgggtttaaacgattggactccggcgaatgttccatcgatgtcgaaggtgagcaagcggttgattctctttgtgagtaacgatggacgggctgtaggcgaactgtttaag

SEQ ID NO: 7111 - DNA, 1985 bp, Heterodera glycines
ctttgagtgggcaaagtgattggacggcgacaaatgttttgccttttgccaggccgagaaaaagctgaagtcggtcaaacagtcggagatgaaccgcgtcttctccgaggaagtgattcgctttgcgcaccaaatcagcaaaaaccattcggtggccagttcagtctattggcagcagggcgacccgtcgcggccgtacccaacggaggcaaatttcgccgtgagcaatttgctgttgagcagaacacaaccggtaaaaagcgaacactgcgtccaagagtgatccctttgctcttattttcagaatgttcccctgtcatttgcagcccaagcgactcccggcggaatgctcaaatcggtcttcaatgttcccggaatgccgcaaaaagcgttttcgccaagtcctcgctcggcaatgtttgtctccaatttgggcgcttcttccgcttcaccgagggggcgcccttccggaagcggtaaaacgggcgaagtgtgtcagtttaaatttcacctaaataggcgcgcggatggcttccccagcgactcgtcctaagattctccagcggagttcgtctcagcaaagcccccgctttgctcagatgggctttcttcccggccaacaacagccgtcgttgatccaacagagtccgagcagttctccgatggttcaaccgcctcagtccgtctccaatttcgtgtctccttccggacagatgatggtcaacctgccggccaatctcaaagcattttcccaggcgccatcgctcgacgtacaaaaaatagagcaaatgtcatccgaatcaagctcaagttcgagcagtggggacgaagcgagtccaagcggacaatgaactgactgggaacggaaacggaggggggaatgaaggatagaaccgccatttttactttgttttgttcctttgtcaatctttttctgtttgttcaatttccaatgagtgtaaaaaattgaaaaattttgctataactaatttcgcaagcacattatttaattcgggcctaaaacatgacttgcttcatctttttcccgattgtgtgggaattcctttgtccgcttctccacacctgctgattcccaaacattagtttcaaataatccttacaattagcactaaataatgaataacatacgtaaaaaaatatttattaattttaaatttaaaaaatgcaaaattaattgtttgggtcgtacttttgtcagatgatcagtgtgaaaatgattgtccatccgtaagtgaaagtgaaaagacaaaacaacaaattgttcagtgtcagcgcaatgtccgcgtaatttccctgcggcaaattttcctccgtcaattctttggaacccttcggcaatggcatcagtttgtcgagaatggaggccaaggcgtagacggagcggggcaacggaatgttcgaattcgtttgtgagaaacggcggagcaaaagagtggctacgaaaagggcgccggtggacagcaaattgaaagcggcaaatttcactggccaaatgggcacgtcagtggagaagggcacggctaattgctattaatcaatcgcttacggatggccggtgccgtgcccgtgtaggatggcatccgcgtgttcattagctgcatggccagcagctgggagaacagactgaaagcgagcagcagcgcctggggcagtgccaactgaaagagcaccgcgcagagtgtcagtgccgcggtgacgagggcgggcgcgagcagttcggccagccaatagaccgcgttccgttggagctgcacgcacagctcgcagttggtggattggatgtcgaaagggttctgccgccaatcgcccagcagttggacgacgtatttgctgtcctttttggggagggattcattcgttcgttcatcggcactttcgctgtttggcgtgccacctgaatctccatctgctcgatgtcccatcccgacacgtgtgcttctgcgatggactcgtgccgtttgttc

SEQ ID NO: 7112 - DNA, 3539 bp, Heterodera glycines
ggtagggaacaacgaattggagtctgaaagagtttggcatggcatcgtcggtcgcccatttgtccgctttcttctgtgctcacctgtccacatgtacacttggcccgtgtaatttgctgccaaaactttgccgtttatttgtccgggcgttgtacttgcccttaaattgtgccactttaaacacgtgtaatttttgtgccgaaaactgacgaattgatttgcatcaattgaggcgtccaaatttggacccaatagaagttcagccaggaaacgccccaatgttcgcggtcccaactgactttcgagtcgttccaggacagcaccaaccgcccaaagagacgcgccaattcgcgcgtttcatcctttttcaaatatttggggaatttgttgactgatcaaaataagttatcagtctttacgatttccatgtgtgatatgcgtacggactcaatgcgtacagttcgagtcgcattggtatttgtcgtgttgtcataacttttggccaattgcgtgcgcagttgccaggcacggtcgcccccctggcacgattggcaagaacggcgacagttggacatcatcctgatttgttggttggcaagtaacaaatgctaattgtacgattattttcatggtcagtcgtttttagagtaaattgggtaaaaattgaatttgtcaattttgccacaccaaatcgcattggtttggcattcgccctgactcgcccaaaggctgcacttcgggtccgaatccacgcaattgctttgcactgcgggggaagcggcttcttgcggcggtttcggcggcggcgcttcgcctaagcaaaagggcacaaacgaaaaatggcaatttgccaagaggatatagccattaggcttaagaaaaattgccaaccttttgcaatggaatttgctaattcgaagagcaaagccaaaacgaaactccgacggcttaacattggactgacgtgacaattggaggcgccaaaagaatgaaaggctctccttaataagacatgtgttgggcttgcttttcctgttctcacgattaatgataatctcgtcagtcggctttttttataaattaatctcgaccgatccaccgcttaaccgattggcgaaaagctgtccgaaatcgcccttctgacaccccgccacacttattacccaaaaaaggactctttcttctccaggggggggggcgggggagagagtttgttggtggatttgggtcggaagcattcaggaagggcaagggtcggttttggactggatctgctgaaggattgacggggaatgagcgtgaccgcctcaggggcgatgttgggaaaataattgcatattttgtggaaagagagagagaaacgacgaaaggggggagggaagagatttatttgtgatgggatggatcaaaaaagaatggaaagcgaagaaaacgaaagtttggggaaacgcacggcgaacgaagcgaaccgaacccatccaatcaccgaccatcgaatcaaagtaattgttcgaataacgaaaaaaaaaaactaaaaaattctaattgggaagggggggaggacattgggacaatgaaattggaaaggagaaaaaaccattttcaaaactttttttgttgctttcgttgtagtcatattggagcattttgcaatttattaggaccattctcggcactgactaaaattctaccatccatgtacggtatttgatattttctgcttttttaaattttcttcatttggctttatgtctcctttcttgggtttttcatttgttttgcgtttcaattttgttccagttgctttcactactacagaattgtctaactatggtctttcatttttaattccaatttctttcctttagttgaatattagcattgtcattaattcttaaaatgaacaaaactgacgatcaattagctgaatgtcgcgaaatcttttgctacttcgattccaaaggcgacgagaaaatcaatgtgaaacaggtcgagaaggggcagtgggaaagtttaatgctatcaaatggattgattgttttttccgaatggtcacttttaataatagacttcctctgatgtattttatttaattttaggttctttttaactttaattaacattaattaggcgaaatatctcaatacatttactgttttttgtaatttggtttaggttggcgatgttttgcgggcactcggccaaagtccgacggagtccgaagtgcgaaaatgttgtgagcactggaccgaaccaggtgaaactgcgaggttcagcattttcggggcaaaatgcgccaatcctgaatgggttccctaattttaattattttaaatttggggctcaaacccattttaaggggtttctagggtgttgattacccgtcttaactagggttgccaattctggacgccgggcccgaattcgaacaaaacaatgggattccaaggaatttttctggggtaaactattgcgcccaaaataaaatagttaaattgggctttccttttttcagatacgcgcatttcatttgaggaatttgtgccaattttccaaacggttagcaaatcgcgcgctcagtacacaaaggaccaatttgtggagggattgtctcatttcgaccgcgagggcaatggcacaattgccgttgcggaactcaaacatttgctgaccaatttgggtgagtcggatgggagccgaatgtccaacagttcgaactttaattaccgttgaaaactcaaaaacattttaaagggttttctcttttacgtaacgtgtgaaatctttgtttaacatttccgagagcattaaaataaccattttttaaggtgaacgtctctccgaggaagaggtggagcaactgctcgccggccacgacgtggccaatggttttgtcagcatcgattcgttcattgaaacagtgcttcggtaaatgcttcaaaggccgtctccgaaaagcgttgtcgtggaaaagaaaacaatgaatgaatgggcaattgcaaatgccaaaaatgagagtaaatttcagaggaaaatctattcaaaaaaattttacagacattggaattgcccttccattttttccgttttttgaatttaactcaatttggcaaattttaactattttatgtgtctgggcatatttacaaatttcaatggatcaaatttggtggcaaatgttttgatctttacggaacgtatctttttgaatttttatctgtcatttttctgtcccgaaaagtggcggtttcggattttcttattgcaaaatcaaattacaaacttttaattgaccacgacaacctccatcatttgtcgataaaatgtcacttccccccaaatctttcgatttatttatatttttttcgaattaattataatttttgtcgagttgttctttgccgattctcctcctaattatcacttcaacagttaattgttttctctttttttcttcgttttcggttttcctttgacccctccggacaggggagaaatgcggcggttccgtcgccccccagccaaaagagcgacctgca

SEQ ID NO: 7113 - DNA, 864 bp, Heterodera glycines
  misc_feature (40)..(40): n is a, c, g, or t
ttcttctaattaatctggcattaccatcttctgagaatgncttaataaatttacctatttgaatttcgctcgtaaagaggatttagtcttttgtttttcaaagaattaaatcataaattttaaaaattcgggtccttttctgctggcgatgtccgtcaccgttcgttgataaggccattttgttttttgcgtggctttaacatttcgtccatccgacaaactcttcgttgtgttctgtcgtcccattggcattttgtgcccaattcggtgtttccttttttgattgccatggctttttgcctttggccaattgttcgctgtcctccgtttcttttccttttctccttttcccctccaattccgccttttgccttcggatttcttctcttaatctctccaaattatcgtatccgccgccttccgaataaattcgcatttttggctttgacttttgtccgtttgacattgtcgaataaattgtcggaattggcgactgttccctcaaataatcggctgcttcgtaaatttgttcgaacggcgtttgtgcggaattctgaaaaggagaaacggtggttaattaataattgtccttgtgaccctcccctcgcttctttctttctctctccgcatcatctctcctcctttgtctctttgtttcctcctctttctctctcccctctctatccatcactctctccctcccttttcttctctctctctctctctctctctctcttaccctctttcttttccctctatcttggttcatcactctatccctccctctctatttcctcaattctctcatcttctttcacctcaaaagattccctctcctctctcttccccactctctctttttgt

SEQ ID NO: 7114 - DNA, 1978 bp, Heterodera glycines
tatgacggaggaggaaaggcgcaattacttacgaatgaacccaaaaatcatcaccaaccaacagaacaagggcaaatacaaattcctgcagaagtattaccatcgtggtgcctattttctggacaaagaggacgatgtgctgaggcgtaactttgccgaggcaacgggcgaagacgtttttgacaagtcggtgttgccgaaagtgatgcaggtgaggcgagaaggaagagggagtggagggaaatggacgagggatagactaaaaagatgagaaagagagagaggcagtggaagaaaagcggacaaaaaaatgagaaaaagagagagagagggggggggggggtgagagagtggcaagagaaaaaggggaactccgttcagttagaaaatcattgtttgggtgcctttggccctgtccacctctgatccattcgatttttaggtgaaaaatttcggcaaagcgagtcgctccaaatggacccatttgacggcggaggacacaacggaccaccagggagtgtgggcaacgccgaccccactgagtgctaaatttgtggcaaaacacgcggcggggatgaaaaatgtattcgaaaagccatcagcaaaaaaacgaaagattggtggggattgaatgactctgtgcttaattaaatgataaatttggcatttaaacggatggataaaatttgaaaaaaaagtttttttaatcgacaaaatcttttacatgaagctgtaaaaataataagtgcaatttgcgcttgacttcgtttgttcgtttgcttgtcttttgaaaagttcggtcattattttgtttttaaattaaaaacatttttgaatacaaagacgaactccggttaattcaactgtttcgtgcaaattataaaatttcagtgatcttatgaaaagatggccattgattgggccgattggtcagcccggggctgcgacgaggggacccattttgggtgtccccgagcccaacagaccccagaccagggcattgtcaagtgactattcgaaaaatttagatagtttccctctctattggaatagtttaatgagtgtaaattaaattcaacgaaatcccctgctgatttaactgattatgagtcactttccctcccccctccccctccctttccatttgtctcatccgtcgtcgattttttggaccattttactgacaatccttcaaatatttgtgactgttaataaaataatccaaaatttactacaataaaataacggataataaaatgcgttcttttcgccgtttctttgaatttctcatcgttttaaacttttggtcgcacttttcgtatgcgaaagaggtaataaatgcagacaatcagttaacaatggacccgaaattgtacttcgattcggacgatccccaatggctgagttggatcggacaattctcaaaagagatgagtcggtgttcgttgaacacggacgagctgaattctgtgcgttttgtgccgtcattgtcggcttaaaaccattttgaaattgtgccgaaatgttcaggtccgagtttgtaccagggaacagttttacggtccggcgggggtcgaggccatgaaacgcagcggcgaactgtacgcagagcacagaaacggtgcgaaacagtacaaacaaattaaaattgcattccacttttattactgtaattaattcatttaatatacacaaattccctaaaaatattttgctattcttaacaaaaaaaccctaattaatttgtcggacatcgattgtggccgcgtgttggccaatgacagcgcttacattgaggagcgcacacagtccgagccgttgacctttgccaacgccggcaataccttggcggtcgactgcgccaccatccgttcccgttactttaactttggcaacgcggagcaaaagtacaaaaacgagaaagggaagaaaacggactttccgttggcattcatccgattagtgtacaaggtgaacg

SEQ ID NO: 7115 - DNA, 4522 bp, Heterodera glycines
agttggatcggacaattctcaaaagagatgagtcggtctttgttgaacacggacgagctgaattctgtgcgttttgtgccgtcattgtcggcttaaaaccattttgaaattgtgccgaaatgttcaggtccgagtttgtaccagggaacagttttacggcccggcgggggtcgaagcgatgaaacgcagcggcgaattgtacgcagagcacagaaacggtgcgaaacagtcaaattacaaattaaaattgaatttcacttttattactgtaattaattcatttaatatacacaaattccctaaaaatattttgctattcttaacaaaaaaccctaattaattgaccttttgtggctaaatttgcaagaattacaattagttaggttttgtccgtctttttgttacattttcggcctttgccccccccccccttaagacaatgtcctcgtgttggtcagcggtgcgtcgtctgtccctcggggttcaaccaaagtgtaattaacatgcaattggtacaattgcacctgctgaaggttccatgctcacctcgtgctaccaagagtgggaaagtgtgaggtcagtgagagaaggaatgccaacgacggatttaaaacattcgcaattgcccaacaactaaattcccatagttctaagcattttcactctctctttttacttaatttttaaagtgccatcgaattcggacgcccattggctccaccacgccaattccttttatcatcggcgccgttttctcggagcgtcgctgccccgggctgttcagcaaggatgcgcttcgcatggagttcttctcccattatcttttgctcgaaaatgtccaatgcgtttcgtttaaccaaaaacggtacggtaaaaactgtgatactgtacaaaagtacggtgctttacggaggactacgaaaaccgcgcgttggaatatatttttgaaacgccgttggatttgagcaaaacggaccgaaatttgcgaatgacgcaaatttggggagtggtgattagtcggaagatttgatggcattaaatggtttttttcgtctattagccccccgatcgtggccaatccaagtggctcaaactgtcggacatcgattgtggccgcgtgttggccaatgacagcgcttacattgaggagcgcactcagtccgagccgctgacctttgccaacgccggcaataccttggcggtcgactgcgccaccatccgttcccgttactttaactttggcaacgcggagcaaaagtacaaaaacgagaaagggaagaaaacggactttccgttggcattcatccgattagtgtacaaggtgaacgaacggacagcacagacatcacggcattggcatttaccccctcccctccctcttagtaaaacattattggatcggcatttggacttaagaaattagaatacttttcttatgaataacagattgctgattggtcagctttgcctagtgttttctttgacaaggaattggcccgtcagattcgtgatcagcgcactttttagcccagaaaaaatgctttttgaaattttattatctttttccgtcgggaccacaattccacaccattgccgcggcatagcattcagtcataatttgttgctaaacaaaatctgtgccgccaaagaaagttttgtcaattggacaacacacaacaaaatatattcatatgcatcattttataactttttgtgtaaagaatctttggatggcaagacaaaagaatggggcaaaaaagaaagaaagcaaaggacgggcgaacgaattaaaggcatttgcaattagtacacaattcagatggacacgccactttgttcgttgctctccagtcggctgaagttcatatgggcgtaaatcatcacgccaatgtcccggtgttggttttccaccgcaatggaaagtgccatctgattatcctaaaatagtttttggacttgctttcgcttagtccattccgaatgccattcccttccccattttcctcccccggcacttacacagtccgttaatgacgcgtcaacgtttggccgcttcatcaaaatcttctcaatctcccgctgtccatgttctgcggcgcacattaacgctgttgaaccatcgacgtcctgggaattaagtgtaaatgacggcaaaatttggacagtgactgatcagtgatcgatccgtcagtgcattgattcatctgtcagcacctgaatgttcgtgtcggcgccgcagctgacaatgagcagaagagaagtggcctccactcggccatgcgaagcggcgagcatcaaagcagtttgggagtgctgaacagaggggaggggatgatggttaggatatcgatagaaaaaagggggataatggtaattggggatgaaatggctaaaaacagggataggtgagcggaaatgatggcacaaaggggtgggccgggcactcgctcgccttcatcgccttggcattgcccatctgaaacagtcgttgcacaatggcacattccgtttcgttccgcagctcacacaacgcgccgagcaccaacgcactgtaccctgaacagaatgagaattggtggtaaagaacacccaaatggcacgtgcccgctttgttcatttcgtctactcggcaaactttggagtccaaaaggacggaaacgacgtcgaagttttcgttggacacggcgtagtgcagcgcggtgttcccgttctggtccgtcatgttcaccacctgaacagcagcagaacgattcgaacttttccccattcagtgaatgtttggcgtgccttttccatcaatcggttcgaaaatgcctccaatgcgtcgatgaattgctccacgatgtaggcattcgcattttcctttatcgtcagcttcatccactcgtgttgacagtgcttcaatgcaataccgtaataattgtccccttcctttgtatttttcccaaagtttcactttgtacgcccattccatctccgcctgctcctcttttgtgttggcattggcaccgcccgccaaatgggtgtcgattgtctccagcgcatcgcgtaatggggcggacacttcgaactcggccctctcttcgtcactcatttcgtaagtcctaacttttcgccccccgccggccgtcgttggctcagcctcgcgcaatgtgtcgcttttcttaacggttttccgattttcagggtgtatttaccagtggattacgtgtctttcggtgatgtattccaagtcgttggcctttctcttctccgcccggtaggaccgataagaacaagcgtctctttggaacggttgcgcgaagcgttgcggctcctaaaaggcttttaaagggtcaaaaaatgatgccaaatcctccattggaggacgaatatttgtgggtgatagtttccgtaacaaaatgtgatggtccaacttctcaccgtaaacagttttcgcagtgcttccgtgcgcgaggcagcgaatgccgaattcacttcattcaaatgcgaagagacggaagagtctggccacaagtcggtcccttctgtgcaaatcaccgtttgtgcgttcgtttcgacggaaatcctatgacaattggctttgtttttcgtctgcttttccccctttttggcacctgtccaattccatgggttcgcccattttctcctctccgtcttcctccccatcagcaaacatgtcaaagagttgttggcattgttgaggactgtccgactgaaaatggaaccttcttatttattcgtatttggcattttgccatttctcaccgtctgtttttcctccatttttttgtcctcctcaattttctgttcgactttctcttctctttgtcctacttccctttccgttttggcctcttttccgtactcttccttctccaactcttcttccaattcctcaaaagaacatgaatcttccccgcttttttgctgctgagtgcaaaaaaagcaattagcgaaaaaacattataatagaaatgaaaacaatcaaagattaagaaaataaactaattgccgagtttccactcatatcagatcgaaactgaaaagtaaaagcgtgtcgcaaaatagcgttattctcactttgtttttaatttttcccaacgggtccacttttccactagagaagatttgaaagaaaacattattaaaccttatgttgcaatttaattttttttttcgccccagaaacctcattgcgtggcatgatgagccggcggtcctccttcgtcgtcactgtcagagtcaggcacccatcgatgtggggatacgctacggtgggtttgttggcgagcttgttgctaaaagcaagtgtttgtttcaaagttgtttcttttcttattaatcccgttacctgaattcgcaattcgttaaattcagcctccaataattccaactgcggacgaagatgcgccgcacccaaacggatctgatttccccatcgaacgattcgcacggcgatttggaccattcttggcgtgaatataacatttcccatatatttatgtggggaaaaatttgc

SEQ ID NO: 7116 - DNA, 1076 bp, Heterodera glycines
gagattttgaaaattgattttcaaaatatttttagtagagatcgacattttgaaaaaagcctggacctggatttcctgaataaaaatccaggtccaggaaaaatccaggttgccgaaaaatggcctggacctggatccaggaaaaatccatgcctggatccaggtccgtatgcaaagggtgattggtttttatgggtatttttgtttaaaaaatcctattaatcgcaaaaaaaagacaaattaaaaaagacacagtcaacctgtatcgaacttgtgacctaattgtaaggtaatgtaaatgttgatgcactaaccacaacaccaaaacacagcatggacggtaaaaaagaaaaaaaagcgacaataaatctttttatggataattacagaaaaaaattggcgttctgtcacaattaatttttatctttacttatctcaattttatgtactatctcttcattcttaataatgtaaaaaacaacatttatttcgccacatataactttttttctactcatacaatttacaccaaattttgcatatcgatagagaaaaacattctgcatcaattaataggtcaacaagttaatattaaaataggtcgaattagaaagttatggagtgattaaaatttttgcatttcttttcctctcgtgttggcgtactattttcacatctctaacacacaaaaaacatcaaattcgtaaatgctaacaattttggttataaggatacaaaatcactttggaaatttagaattaatagagaaattaatagttttagcatttttggtgaaaacagcagtttaggacttgagttataacgtgataaaaatttgaaagtatcacaacttttttctgagatgtcaaattgcttagcattcacttagaaaaagattctccttttcaaaatctttttttagataccaaatttgttcatttttgttgggaatgaagcgtgttatggctgatcaaaataaaaaatacaaaaaaggcatttaccagtgtaagtgcatatactttgtttttgcgtgtgttggcgttttgttttacgccaattattttttggcaattttt

SEQ ID NO: 7117 - DNA, 2962 bp, Heterodera glycines
  misc_feature (2917)..(2917): n is a, c, g, or t
  misc_feature (2940)..(2940): n is a, c, g, or t
ctattttaggggttggggtcaattccctaccgccaattccctaccgccaattccctaccgccaattccctaccagccaattccctaccggccgattccctaccggccgattccctaccgccaattccctactaaggcatttgggccatttccataccaaaaaattttttcgaaatttttcgtcaaaattttaaaaatagaaagggaattttcaacaatttgatgtttctcatgaattataagacaataaattttttgtttaagttatagattagaaaatgcaggcaaccctaacagaaaagagccgtacaaagcttcaacacaacggtcattcatacatttttcacaagccgagtgctgacggtgaagttcgcttttggtcatgtgaacgccatcacgcaaaagacatccgttgcaaagggcgccttcacactaacctcaacaacaacgttttgcgtgaagttggaaaccaccagtgtgaaccaagtgcagctcgaatggaagcgcaacgagtgatcactaaaatcaaacgccgggcggaacaaacaatggaaccaccagcgacaattcgctcattggcactgcagaatgtggccacgccagtccttgcgcaactccctacaaagaatgcgatcaaaaaagttttttctgtttttttttgttatgagattttgtgcttaggtaatcaagcgtgtacgtcatgaaataaacgcaccaccgccaattccaaacacgctcacagacttaatcatcccagacgcatacaaaacgtatgggcgcaccgaagaacaaaccgaacaatttttgttgtccgattcgggagtttaccaagaaaacgggagggaacagcggtagtaccatgcgcactttttaattatttaaaggcaatttagaatactgatatttggacgtgagtcgaatggtcggtgggcgcatgagatgaaagagtgcttcgccgacggcaccttcagcatcacaccgatgcctttccaacaagtgtacgcaattttggcgcggtacgaaataaacacttatcaattttgaacttattatttaagtcggaatcgctgggtcatcccagtgtgctactgcatgctgtcgaacaaaacgcatactacatacgagcgtatgtttcgtatgctcgttgctgtgtggccagacttcaacccggacagcgtgtcgatggacttcgagacagcggcgatcacggcgttgaatttagtcttcccattcactgaagtgcgcggatgtctgttccacctcgtccaaaattttcacaaaaaaatttcagaatttgggcttaaacaggttgaattcatgatcatggttgacagaataatttttttagcgttatcaaagtgacccaacattcgccgaaatggcacgatgtgtcacgtcgatcgcgtttctccccattggagatttgacccccggaatcattgctctggacatggctctccctgacgaacttactcccgtccttgactggtaaattgacaatctcacaaattgtttactatttattgttctttaattgtttaataggttcgtcatgaactacacgggtcgtattaagcatgatggaagccgaacacgcccgcgatttgacccaaacatttggagtgtttacactcgaacactgcaaggcgatgaccggacgaataaccattcagaagccgcgaacagacgcctacaatgcgcatttgcctgttcacatccatcgatttggcatttcattgaccttctgcgaaaggatcaaaagttatcagatgatgacttcgcgaagtgttcaactggacaagaaccaccgcaaaaggcaaagaaatatcgtgaagcagaccgccgaattctcacgatggttcaaaattatttgccacttaacaacgcagacaccaacattttcccaattcatcaccctttcaatcatcattttattattacatttttgatcggaatttctcgaaattatgaaatgagaccgtgatttgaaacaaataaattttttaaaattttcttggatttttaatttcactgtctctttaaacttttggtatggaaatggcccaaatgcattggtagggaattggcggtagggaatcggccggtagggaatcggccggtagggaattggctggtagggaattggcggtagggaattggcggtagggaattggcggtagggaattgggtcgatcccgattctgatgggtgtcgtttttattgaatttttttaataaaagagggcataacgccaaacatgttttataaaatttcattaggcttttagggttctaaaaaaacttagaaaaaaggctccataactcgaaaaatagcttaataaccaccaaaaaacacatttttcgagcgtttccggtcactgggagctcatttgccaggaaaaaataggcaaaaacttattaaaaatataagccttagttatgtatgacgtttgtcaaaaaccatcaaaaaaccattaaaaatttcattgctcaaaagcaacttttttttcatcagcctgcaaaatttctaaaagtttcattaactaactttatttatattttttctcctaaaattctatttaataccatatttagttattcgaagtttttactcaattttacgaattatagaattttcagaaatgcctgtttttcattttttatgcgctattttgtcattttttgaaaaaaatgaaaacaattttaaggaattttagatcattggtcattattatttgaagatggtttaccaccaaaaaaggattttccgcaacacgaaaaaaggaaaatcaaaattcaatgaccggaaaaaacattgtacaaactctaccaacaaaaattgccgatggtaagttgtttttctgttcgtatgtgtacttggctgacatggcaaaacaaaaatgattcaaatcaaataanaaaaaaatttttttttggcattntgattccctttttcttgccgct

SEQ ID NO: 7118 - DNA, 1537 bp, Heterodera glycines
tgatgaatattttttacttacttggtccatttcgtaaattcccgctctgctgtaccattttttgtccattttccgtcaaacatgacgccaccaaatatctattcaatttctcttttcgtcattgcactgacttccggaaattgcatggggccccagataacatatatgtagtctcgagaagaagcggataaagtcatcaagcgatatcctaacaaatttttccatttattttttgttgaatcaaattcagctgataaaagatgtatttaccatatttatggcatttgaaaattttgcaaaaagttttttgaatatgcagaaataccaataaaaaataaattttcgaaatacatcccaaaaatttaacagatcattttttgaaaatttgattcatttgaaattagggttcgagccccgcccccgtcacacccgccgggggcgggacaggttttttggcctcacccccgcccccgcccccgtgactcatttgtcagacccccgcaatcccggcgcccccgcgaccgtcgcccccgcgggggcgcgggggtgaaaatacactcctaagaatggtatattcgtgggataaatggcaaaaaattgatacaattttgaatattttttttaatatcttgacaaatttttataaaatagtgattttgcttttgttttttaattttttttttgttaagtggttagtgcttcttcttcactaactgtacttttttgacgttttcttttgaatttatttttatgattaatagggtgcgcatttctaagtttttccttatgttttctgcggcattaactcgacgagaaatgcatgaaaaacacattttttgttcgaaaattttgcgttttaaagtccttagcaatttgaagaattatatccctaaatttgtaactttttcgaccttattttcgcccttatttcccgttttttttcgcccttatttacggcattattttggactttttcgccattaaaaatccgcaccctaataattaatatacaaaaacacgcataaaaaattgaccatgcttggcataatttgtaaacaaattgaactcaatttttcaaaaaaaaaatttctggtggcgccgttagtccgccgctggatgaaaatttcgttgaaattaaaaaattcaattttccttgagtaaataaggaaatataatttattttaaaggtacacaataaaaaaccgaagaaaaatcaaaaattttcggaaatattatttttttgtgaatatctcttagaaaatagcgcttaaatttcaaaattcgcccgacagccatatcgacaccgccgccccccccccccaaaaaaaaacatttttttcttaaaaaattagccacaaaatccctaaatttggtcattcataagacaaaaactgtgcaatttattccaaaggaattgaatcgaggcgatacaccgactaaagaaatgtggagccaaaaaaatcttcacaaaaattaattttttgtgtgattttttggagcaatttaaaatcaaaacccccgcccccgtccctgggga

SEQ ID NO: 7119 - DNA, 1255 bp, Heterodera glycines
agtttttaaatgaaaaaaactaaatatttacattttgctcatttcctcaccaaaattgttaaaatatttttgaccccaaatttttatttttgaccttcaatgttcttatttcagcaaattctcgatggcaaccctgttttaaccaattttttctttctgcatatcgttcgcaatttatttctttcattgaaaaggtgcagtttttcaacaaatattaacaatatttcgagtttttttttcgtgaaattttttaattttaagaatttatagtaaactgaaaatactaaccgcaacgaggcctgctcgcgtgagatcgctattctcgggccccgtcgcgcaaccaaatatacagttctcacagaaatttttcacgccactattccgagggcgctttaccaatatcttttaaaatgttaggattattaaaaagaattcaatttatcatttttctttatgccgagatttttcctaaattccgcaatcaatgagcctttcccaaatcgaatgaaacaaaattaaattgacaaactcagtctaatttaatattttttggtgccactcgatagcttttaggggcagtcgatgccgccgggaaaattaaaatttaattcatttatgaaaggggctcccatgactagggctgggattcttaggtttttacttaatttttaagcggctttaactcgacgataatgcacgaaaaacactattttagctcagaaattcttcgttttaacgccccctatccgaccctaggaatccctatttggatgttcgcccctaaaaatccctattttaaatgttcgcccctaaaataagtttttacccctattttggcgtttcgcccctattttcgcccttatttcgcgattttttaaatttgcaaacttaaaccggtcaaattcggaccaatttggtatcatttgaaggctcttgacgagctaagtcgaaaaaaacaaggtataaattcgaaccgggtttcatcatctaagcactgggacaactgagtcccagtaaaaatcgacaattcagtaccaagaaataacaaattaattttacttcttttaatgccaaaattttattttctagcattggtggtgggtattgcacgaaaaaccagcgcacactcgactagagaccggcgcgggacgggatcccgctcgggattttgcgggatcccagtccgcaatcctgcattttttggcaaatgcgggatttgtgggattaatcccgcgggatcccgtcccgcaaagaa

SEQ ID NO: 7120 - DNA, 2644 bp, Heterodera glycines
  misc_feature (1845)..(1845): n is a, c, g, or t
ttcatgtattttttcttttttgtaattttgaaatttaattaaagttttttcaaatttcaaaatcccgcaatcccgcgcgggatcccgcagatcccgcagatataaatgcgggatttggggattaatcccgcgggatcccgtcccgcaaaaaattttggattccaatccttttgctttttcctttttttggttttaattattattttcttccgtcattatttggtactggaatgtcgatttcgttgggttgggactcagttgtcccagtgcttagatggcaccggttcgaatttataccttgtttcttagactgatctcgtcaacagctttcgaatgatatcaaatttgtctgaatttgaccgttttaaaaggttaggagacccctttttccctcaattttttgagttttgtaccggttcaaaaataagtttaaactcatttcctcaacgggagaactattttttcgtgcatagctcttcgagacggaacgattggtatatcatttgtggcattttttctggtgggttgactaaagaacacccaaaatgtgcactcaacccttttggtaccagagctaggccaagctcggaatacaatcccaaattttttttattgattggttcagcttaagcggtttatcattttatttttcattagtacccttttgcggaatttaggaaaaatggcttatattttaaattttttttattaccaattccatgtcccttcgtttggcgacatcgagactcttcaagtcccattcttccgtaatccctcccgtcaagtccgagagggagtcgctaacttttcctccgctaagcacagcataaccgccgtacatcttggcatacgccttctctaataggatggcccaaaatacatttctaaaaataataaaatttaaaatattttattttattttaattactcagtcggaggccgactgtaaagcaattggccattgtcgtttcggcatggaagtcgatcatcgatgatgacttccgtccaccttccataacgccaaaaatggaagtggaaaatgcctgtaatttggtagaaattttgatattaactctctttttgacaaaatgttattataaaatctcctaatattttgtagctaaacaaattcacttcaaactaattgaatttcaagcaagttttcttttttattattatttaatcctaaaaaacacttaaacaattaattaaatttttttattttcccagacatattaatttattttttgcctttaaaattgttaatattttgtttactggattcatattggtaccttaaaaaggtaaaactcagaggcaatcactaactacagtacttcacaattagtgaccgttgttttattaaataatttttgttttgttctttgtttcaatatcctttaaccagcgaaaatgttttttccattttcatatcgaattcatgtgattttaaatatttttaattttaattgagttttataatggcggatgacaaggaaattacatgccctgagacacttttcgatcaaatgaatctcatttgatcgaattgatgagctattagaggccctgaatccaaaagctttctatgttgaaaacgaaaattaatttctccatttattcaatttagattttcaaaaatttactccgcgaaaattcattgaaattttttaaagtttcaatgatttttatgttttccaaaaatcgcaagtcaacaaatttgaatgagtttaataaatttgtaaaattaattttatttaattttattaaaattttaaacatttcccatatcaaccatatttgggtggggttctttcggctgaagctaggaaattctcaattttntagagcgtaggaattccatcaccagttattgacagtcggtaggaaataaatttatgggtgacattttgctgacataatttatcaatttttcactcagtataataaggagaaaaaagagaactaattatgcaacgaaaacagtacaatcatacgtgaacaaggagtgcgccagggcgaggcccatacgacggacgattggcgcagggggctgcgccaggattaattttttgtacgaaggccacacttttctccggttgcggccattttttttttttttgctattcaaaccaccttttttgcggcatgattttttcaaagattatggggaaccagagggggtagcggggtccggcggtgccgataggcgccgccgtgaaaattttttaaaatttttctcccttcgttatggcgcccacgagagtcggcatactccttgttcacgtatgagtaagccatataaaaacaataattgcaaatatttcattttattcaagcatttattttaacatgacaaagaatatttatatattaaaaataaataaaacaatgaattatttttatggctttttatgacataattaagagcattgaaaagaatacattggtaaatgaaacaatattatgacaacttcaattaattgcttgaggtggtggaattccgattttcgagaattttgggcctcggaaattaaccgattttcgagaattttgggcctcgggaattaaatttcccatttaagaaatattttgggtaacttcctcctctgaattccatcactccattcttcactgttgtaag

SEQ ID NO: 7121 - DNA, 1333 bp, Heterodera glycines
  misc_feature (56)..(56): n is a, c, g, or t
tttgtgccagatcagacattgactccgtgaatttctgatatatatctataaatatntattaaatataacttattttttgcgactttaattcaatgaaaaaagcatgaaaaatacatccatattttgagattttcgccttctaaagaggagggcgtccttattttggcatttcgtccctattttgtcatttttgaaaacattttcgcctatatttaacccctaaattggaatttttggaccctaaaaatccgctcccttttcacattacatttgttgaaaagaaaatcaaaaattagggaaaatatcaagaattttccataggttttctcaaaaaattttgatttcaactattttagggttgtataaaataaccatgaatgatagtttggttgaattactgtaattgcctcttttgtttacatcaaaacatgtgaattatttcaattttttctcttagtttaactttgtgaaaaaaattgaaaatgttagagcatttatataacatttgtcatatactgtatttatgtatttataacaagagacgtagaatttgtatgcacgaaaatgccaaaatatggattcaatcgggtctaaccacaaaaaatggtgaatttctaaatccaattgaaattcaatcaattaataaacctgaatgcttttccggatttaatttgactctttgtttaaattttttaaagcgtccaaaaaagaaaaaattgcattgattgatttactaattggaaccaatggactcattcgtgcttacaaattcgtcggtctctaattataaacgaaacgggtaactccacccatggacggtaaaaaagaaaaaaaagcgacaataaatctttttatggataattatgggaaaaaattggcgttctgtcacatttactttttatctttatttctctcacttttacgtactatctcttcattcttaataatgtaaagaacaacatttacttcatcctgtttaacttttttcctacttgttaaatccacaccaaattttgcatatcgatagagaaaaaaaatatgcatttttcaatcgcttttttaaagaaaacaatcgcttttatttaactaatttttattttaaggcaaatttattcttttcctctccttttggcgtactattttcatgtctctaacacattaaaaatcatgaaattcgcaaattctaataattttgggtataagggtacaaaatcactttgaacatttagaatcaatagaaaaaagaataaatttagcattttagttaaaaagagctggctaggactttgagtataacatgataaaagtttgaaattccgacaacttttttctg

SEQ ID NO: 7122 - DNA, 2394 bp, Heterodera glycines
  misc_feature (1175)..(1175): n is a, c, g, or t
gtcattatcacttttttcattttagaaatgcaaaattgggccataagataacaaattataattttataatttaaaatgtctaccaaattgttgtccgatgaatcctttcaaaaactgttgtttgaccttttctgcgtgtggaacgatgttcaggtgccatttcaaactttgatttgcatttattacgctaatgactttatatttccattttagcgtcattatgacccgcccattacgcactcggaggaagagaaaatggtcaaagtgagtttcataattcaaatgtttttttgacatttgattattggcatcattccccaaaggtcaaacaaatgatctgtcgtctgttgggtgaaattgatggtcgagttaaacgaattcaatcgatgcgacgcatttccacggaggatcaagtggtgggcatttattgaattgaattgaattattttgataataaattggataaccgtttttttgcccagggcttcatcgaggaatggtctttgcttacatggaatgtgttgtgcatcaccagtcgactgcaaaacgatttcaatgcgtctgtgaagtcgcaggaggaccgggtcatcttcaacaagttgaacttggctttggtcgacctcgtcaacaactcggggtacaaccaattcataaataaccaaaattatttgacccccccccccccctcatttcagagaagctctgagtccgcctttgcttcacccggacgccaatttcgacattttgacgaattcgctggctgagaccatgcacattttgcacggtctttaccggacactgaagtcgaacatgcacatgacgcaggaggaggtggaacagttcgccatgaggtgggtttggctttggatcgggtggttcccaaatgattcatgttaatggattcatttggtaagttaattttttggcaataaaatgccattttcttgtttgccattttcctgccattccgtttcttccttttttacaccatctgctccctttttagacttcagtccttctccgaccagaatttgattccgtttgtggagatgtttaaggtgggtgcactttttggccgttcgttcggccttttctccccgaaccctctcgcttcagtccttttgcgttggacaaactgtccgtttgtggcaggacttgcgagatgtccagattgngtggtaatacacttacgcagtcactatgatatacattaattgcaaaacacacagaccccggggcatttttggccatccgtgggccattaccagtaattggaattttgtttacaaaattggcacacatttttctggcaatggattttcccccacttggccaatgcttttggggtcagtgtgcgcgggtgtgcccaaatgttggcaaactgtgcgctttcctttcccattccaatgcgcagcatcgtcaacaagcaaacgctgccggagcagcccgtggtccgattggtcactttttactccttccaaatgcatcgtttggccattttggctgctcggcttcaagtgagtttttccatctgtgttattacttggaacagattccgatttttaaataaattcaaaataaactaaaattaccttcaattaaatttcagggctttcgctatgaactgacggtgaacaatcggcaaatgtttggcgactacgaccccgtccgcccgttgtcggacagtgttttctccgcgttggaactgttgatggccgattgtggtttgtttataaaaatttattaatttttccccaccccctttttaatgtatgattaaattgttaatccaattagtcatttcttcaagttttggccaccgagccgtcgctgaacccaattctggtgaccaacaaccttttctccatcaattgtggtgcgttggctcgtggcgtggtgttcaagcagttcgacgtgcaggtggtcagtgaagaaatggccgaacatattcaggtcattggagtggagaggagaacattgaatcagccatcaattgacacaaaaaaaattcaattgtctttcagtccgaaatgcgtcgccaacgtttgctccagcagccgtctccgattgcccaagtgccggccgccgcactgttggccatgaaacccaccagtgggacgaagcgctccaacagtcaggccatcaccggtcagagggatgggccatcaaaaattgccatcattttggacgagtaaccaaattttcgactgacagatgcttccggcaatgcgcaaacggcgcacaagaaaagcgacataaacagcaaagaggtggtgaccatttacccgatgtacaacaacaaaaaccgttattgggccgcgagttatccgcatttgctgtgcacgacgcggcaaaaggggcgccagtccaacaacaactcgtaccaggtcgcat

SEQ ID NO: 7123 - DNA, 2145 bp, Heterodera glycines
tgcacttttttcaaaaatcttggggaacgggggttgggtcaggcggtgccgataggcgccgccggggaaaatttttgaaatttttattgtgatttgttaacagattttcaccaaaaagtcacgaccccccccctgcccccccccttgcacagctatgccaggtcgagcattaaatatttaaattcagcggattttccttctataatttttcaatttttaggatttgtcccccaacggaatggacatgaaaagtgccggaggtggcagcagcggaaagcggccgatcttctacttttacattcgtgccacgatgttttctccgtccggacggtttgcggatgcgcacacactttcgctgccgttcaccatcgccacacggcgtaaccaggactatcaggtggggaagggggggcgagcagtactttaattgtacaataatattaatggcatctccaaccaacccatgttaaggtgcaacgtatgatgagttcgtacaccgccacctgcttttggctgtacggaaacaacattcaagtaattttaaaattcatttttaatttattttcaaattgaggacggtttgctgttgcaatgggtggagacggcgatgggctgggagaagttcaagtttctgttcatgcagcattttcggatcaacgccgaggtggagcggggtttacaggacaaggacttcgacctgctccaggttgatgaacccttcttttgatatgaacatttttcaaattgttttagtataaaatccaatgcaatgactgttcccctccttcgtccacatttagtggagatcgtgagctttgtttcgcttaaaaattggatattttttgaaatttgataatttaattaaggcaaaatcaccttcaaaaacattctgtgtccccatttgcgttacgaatgtggctcaacgaatgtccgcttcagtgtgtggcgtggactgctcgaactgctccaactctttcaggttcaattggccgccgcgtcacaaataaaatttcattcaatgatttgacaatttaacaaaggacacaaaaacgtgcgtacgcaaattgtgggagaagcagttgatcatgggtttcatggaatttgaccaggcaatgccataaaaacctctaaaacgcgcccctccataaaaagaaaaggttaaggtgtccgacactctctcctcctatccctccgctttgcttatgcgtctgtcctttgtcaccggcggtaccatttgcatcactctcaagtcaaccgtccactcggaggatcgggcgccaagtgtaccaatgcatttggagccgttggacctgaaaaagctccaagccaaaagtctcaccgattatttgcgggacattgccgttgcggagaaggtaaattcaaaaacattaatccaaccaaatttaattgtaaagtaatctttcagatcaaatatctgatcaactcgcagggagagccggtgctgatcagcgacctgttggagcagttcagtgagaggacgggcggtggtattgaggagttggaaaccagccgatgcatttcttccaacgtcacacacagcggcgacattgacgccatgcaacaaataacgtaagtgcaattcgggaatgtttcgatggcgcgtgattattggtcacttttcccgtttttgttcagtttcaccgccatgcgaattgctgtggtgacgtgcaaagtgaagccgcccagtgccgatctgatggaatatgaggaggcggcgttgcttcgcggcgatgtgcagccgaaggtgcactcgccggtcccgtcctccagcaacggttacccgtctccgtctttcaaccccgcttcggtgttccccggcagcgccggcggtggtggcggcggctatcggctgccttcggtcagcgcagcaaatgacgattttgtgcgggaagtgacccaattgtgcaacttctggggcaagtcgaagcaggtcaattcacagttggcaaatttacgcatgtgggtaatcgattaattggttttaattgtttgaaggagctcattgaactgatggagaaggcggctgaggagcaattcgccactttgtctttggtcggcggttgcagcacgggccccccgtcacgttcccaccaaaacattttccaaagggacgggcagcgttgg

SEQ ID NO: 7124 - DNA, 3640 bp, Heterodera glycines
ttcttgacagttaagcaaatgaccgaccaaaaaaaattcgcatttctacgcatttggctcgtcgtatctaactgtcacaaatgcattgttctcataactaaaagttaaaaaaaaatagatacgacgatatcgaataaattttctcactcttttctccctttttcctaatttattatattttctaaaaaaactttttgttgtgttatataatcacagttaaatatacaataatactcattaatgtactgtagaacctcatgttaccaccaactctattattgtttcacgagatgggccgttttagtgcggcgtgtttaattgattatatatacatttatcaaaattttaactaaataattgagtacattggagctttccaaatgatacaaaaagaaattatattgctaaacgctaaaacgaccccacccaaatttaatgcaataaaataggcactaaatttaaatatttattaatttgttttccttttatggaccttaaaaaataaagaattaaattattttaattattatgcttctttaacaaaaattgcacatgtaaaaagcaaagttcgcggggcattaagccagtttcgctgtttttgtgaagctgaccgaaactgtttatagcaaacgaaaagtgagaacaaaacacgaagaattccccctccattgagtcaaaaatggcggggtgaagaggcgcggcgacagcgcaattcacacaattgggctgctgtcaagcgacgctaacgcagcaaagcaaagcgctgaaaacattccattctttccacaccttctcccaactcttttttttacatgaatctgctcaaaacggcacgcataacacattccattaggcacacaaatacggttaataattcgggtgaggccttggcttacaaaaattaaaataaaacaactttggacgcaaaaagatggcagcgcgtgccaaaataacccgtaccctcccatttgtgtgtgccatttgaacaggagggaataaaattgaatataccgtatttgctctaattatcccccaatctccattaatcccccaatctccaattatcccccagtctaggaggggtttgaagaataatccctctatcttaatcccccagtctccaattatcccccagtctacgaggaggttgaaaaataatcccccatgggggataattagagcaaatacggtatgtatagtctctatcggcacctccccctccaaattccacaaaaaaaatatattttttagaagcgcgccgcaaaaaaacatttttgttgatttttaaccatttgtaataaaattttgaaatgctgatttttaagccaaaatcaaaatgctgatcttgaaaattttcagtcgagacccctgtttaaaacctgatttactcaccgaattttttttgccacatgccgacgtcgatttccggacaacgtcaatttgggcttgggaattgcggggaatgcctccgggtaatgttggggtaccttaaaagaatgaaagattagagaaataataataaaatttttaacaaatttcgttttattttatcaaaatttccctcccgatgtgcccagcgctgcccaaaaatttctttatattcaataaaaacccaaaaatatcaaaattatcagtggacaatccgtcactgatcaattgatcagcactgatcaattgataagtggacaatccgtcaacaaaaattaattttgaaaacaaattttatttaaattatattaaaaaattataattatctaatttgataaaaaacttaaaataatatattttgtataatgataaattaattatttttaaaaattaaaaaacctttttaaattcaatatgtaaaattggaaaatccttgttgttttttaaaattttaatttttgccaatggactttccactgatcgattggccagtgatcgattgtttttttcgcattgagcttttgctcttaccgtcagcagcgaccggttgcatcggatgagcttcagcaaacacatcgtccgggcccgatgactcgtcgagctgtaaattgtttaaaaatgaaatgaaatgaaataattaaattaaatttctgaatttaattttaataaaaaaattacgaaaattttagttgagcccgcgacatttgtaaaaattcatttaataattaaacaattaattaaatttcaaaattgtaaaaataaatttgtttttttgggcctaaactgtataagtgccatttttatggcctcaaattttaccgcccaaaacttacattgaccatgcgctgacgaggcggcgtcaacggggcagcgtcagtgccggcactgcgcgtcgtccgcggttccttcgggttctctgaaaaaattcaaaaaataatgatcaatttttaaattttttttatcacattaaaagaaatttattttaataaaaaattagaaaataattttccctcgctttttgacaaaaaatttgcagcgccgcaataaattttggaattttatcaatttttttttcaaaaattcacaatttcttattaaaaattctttcattttttttcttcaataagcacattgtcatttacccaccttttttatgtattctgttgtgtaggctcaaacttctgtgtgaagagaatgtcagtgaacattttgggcaaagaacaacttgctaaaatttgtaaaattatgtaaaaatttgatacataatttccgtttttctgatcaactcaccgtctcaaggcttagcatttgttcgggctgcgttcggcgtggctgggcattgtacatgggcttcgctccacgagatttgctgcgcgactgaaaaacagtttttaagttgaataaaaaaaaatatgttttttggtccttataaaatgcttatgtcagtaaacagtttaaaaatacaattattacctctgcgctaaggtgcccttcccgattatgcgaccttgtgagggtattgagccttgaaaaaatggaaggagttaaaggaaaatagataaagtatttttcaaaaaagcaaaaaatccggcagttttcgcatggcctgaattttttgtctataaccttgttcattgtcgaccaattccaacaatcttggtatcatttgatagttctaagtgccctatattaatctgcaaaatttcgaaaaactttgttaaggttcataaaaacttggccagaagaattcaaaactcgttgttcgaacatgttttgtcataacttttttgaaccgaaacggaaattttggcatgctaataaatagggttgtaaattatatggactaaaaaacgcgaaatatggacattaaatatggactaaaaaggccaaaaatggccaaatatggaccaaaatatggataaaaaatgccaaaatatatgttgtaaacccccaaaaatcccaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaagaaatgatttattgaaaatgccaaaatgacgacgaaaactcaaatgtttcgtgttttgtggggtgtaatttttaaaaatttccaa

SEQ ID NO: 7125 - DNA, 1908 bp, Heterodera glycines
  misc_feature (1263)..(1263): n is a, c, g, or t
tgccatttgatctgatcaacgaatttactcatgaacaattgacgcttaaaagaactttcaataacagtcgttttttgttggtccgttgtccaattgcgcgagacgcgagcaaatggacaaaatgggaagaggaagtgattcactggcaaatttataaccaatggaatcgaattgacatttatttatgatgaggacaacattggaaacgggtaagtgaatgttatattcaatttcattcatatttgtttctatttttaggcttctcgacgcaactcccggcccgagtgatcagcagcagaagtgaatgaatgaattgttaagaaatgatcgaccaatttgaattatgaaattattgacgtgttcataaatattgttttatttttgttggattgatcattgatcaacttggatttgtgttatgccattatgataaattcagtgattttgtgggtcagcggagcgaatgcgttgtctttttgcttttctcattaaagccatttttgggtattctctgaatccgaatccgtcaccccgggtaaaaccaaaaagtctcagaaactcctccccttaaaataatagtccgtaaaaacttttctcaagcacaaccaaaataaaatgatcttcgtacatatcatacgacaactcttaaattactctattatcatgaaaattttcagaaaatttcattgcgttttcagaaagttctgagcgtggctattccggaggcataaatgccacaatatgagtctcaaatttactttttttaattgggttgtgggaatggcttttgttatttgtgcggcttcttgatggttgcttttttaaattttgtagtctacgccaaaaacggaaatatcgatcacttctcaacaaatcaaaaccgacgattaaaaagaagaatatttaatgatcagtctaacaaaaaaaaacaacaaccacattataattccataattaaaattgatcgatcatttctcaacaaatcattgattcacttctgctgatcacttgggccgggagttgtgccgagaagcctaaaaaagaaaggcaataaattgaattaaaaaaaaccatttactgacccatcgccgatgtaatcctcactataaatacgaaagtcaatttgattcgactggttataaaattgccagtcaatcgcttccttttcccattttgtccatttgctttcgtctcgcgcaattggacaacggaccaacagaaaacgatggttgtagtcttcagtccttttcaattccaattgtntcccgtgtaaatccattagtcagatcaaagggcacaacggagtaaagcaaaaggaaacgaaatgacgacaatgaaattgacgggagaagaagcattggcaaatgcctaaaacatagggaaaatgattaagaaatattaaatgacaatgaatgaaactttttggttgggcgggtggggacacgaaaacccaaagatggacatttgggtcatttaaataataaaaagccctacagatggagcgtttttgattcgcaatgttttttgggcgaaaaacaatttatttatttttgtaagcgaaccccaaaaagcgtaaaagtaacatcaaaatcaattcgaaatcaccgctttgaaggcttcaacattcgtcgccaaattcccatcataatccatgtccaacgagcattttaacatcttcggcacgttgttttgaagtggagtgaaaagccattttgccaacgcttggccatcggatgccatggcattgtcagcagatgggaattcgatgaagaaatcatcgtcacatgaaatgacaacgcgaagcgatggacaattgttgagaattgacgggacgaaatgtcgcaaacggtagaaacttctggaggacaatcgcaaaacatgaatatttttcccgagcattggccaaat

SEQ ID NO: 7126 - DNA, 2403 bp, Heterodera glycines
cgccgatgatttaataaaatgccaacagatggaatgtttttttgggcgaaagacaatttctttcttcttttttttgtaagcgtttaatcacaaataaaatcaattcgaaatcaccgctttgaaggcttcaacattcgtcaccaaattcccatcataatccatgtccaacgagcattttagcatctttggcacattgtcttgaagtggagtgaaaagccattttgccaacgcttggccatccgacgccatggcattgtcagcagatgggaattcgatgaagaaatcatcggcacatgaaatgacaacgcgaagcgatgaacaattgttgagaattgacggatcgacgaattgacgcaaacggcggaaaattctgacgcgcaattcaatggcataaatgttttttccgatcattggccaaatgttgtgcaaaaggaacaccataattcggtcagtgtaaatgtaatatatatcgatggacaaattgatttgacatttggcgaaaagttgacgaaaacggcggagaaaagcgatggcattttggtcgatgtatctgtgaaaatgaaataattgcatcatttacatttgaaaattgttaattaattcattttactctattgaaatggctttgaatccgacgactctctttggcaacggcttttgcggaattggcaatggtttccaatcgtaatatttgacaattttcatttccttggtgccattttctccaattttgcctcgaattcggataaatttcagtgcccatttgcgggttttgaagtgttcgtccacgtaaatgtcaaaacggtggctgatcattgaaatgccaaggccaagttgtgacggctcaagcaaatcgaagacacaaagccaacagtcggcggagatgaaactgaaaaaaaaaaaaaacaaaatttaaaattgaagttggcattttaattttacattgcttttgccattttttcctccgcttcttttcggctgtctgacattttgtggggcaaattattaagacggttcttggtggattaaattaaattagcaaaactgaaaataaatttgtaaaatcaacagttaagaagggcaaaatggagcctcgacgatgaaagacgacgtaaggtaaacaaataggaaaagtaagtacctaaatgaaaaaaaagagagaaggaagggcttttatagtgattaaaaatttttgaaaaagccggatatgctgctggtcttctggtcccttaaaagcataaaagcgaccccttcataatgattatttgggtccggcgtgctaccagcgcagattagatattgatcgggacgggaaacgggattcccgacaagtgaaactattataattgaaactgttaaaaatttctttgtgtaaaatgatcgagtatatattttttaatttaatggataaaaataaaaaatttctaataaaattgaattttcttaattatttgtttcaaagaagccggataccaatcttttcaacggtaccgcaaaaactggttctgattcagaaatttctgtacatttttttgcggcttagttatggcgagagaagcattattttgacaaaatgccaaaaattttaaacttttataaatgtacatatgtatttacattcatactcaaaaaacacgatttccaagtacaatcttggaaacgattgagctttttttaacaaatttttttcatttcagaaaacgacaaatattcaaatggcataacacaaatccaaattgatcagtccaacgaaaaaaaggacaatttttatgagcactttaataattccataattattaaattgatcgatcacttctcaacaatacatattcattcacttcttctggagaacacatgggccgatcattgcgttgagaagcctaaaaagataaatgcaataattttggattttttgaataatttattcactgacccgtccccaatttgacgctcattatcaattcgaatgttaattttgttccattggccattaaattgccatccaatcgcttccttttcccattttgtccatttgcttacgtttcgcacaattggacaacggtccaacaaaaatcgatggctattgttaatccgtttcaatgccaactgttctcgagtaaattcgttggtcagcacaaatggcacagcaaaagaccacaaaaacgaaatgacaacgatgaaattggcaggagatgaagcattggcaaatgcctaaaatatgaaggaaacaaattaataaattacttagttcacggtaagtaccgctttgaatgcttcaattttcaacggccatttcccatcatctttttccaacgaacatttgagcacttttggcacaccattttcttgaagtggagtgaaaagccatttggccaccgtttgtctgtttttgttgagcattgg

SEQ ID NO: 7127 - DNA, 2573 bp, Heterodera glycines
tggactttctttgtatttgagaatccaaattttccaaaccagaaactttaaaaaattgttatttcgccggaatcggtatccggtctaaattagccgagaacgcgattaagaactaatgggttccccggctccgcctttattccccgctgtttctttaataaggtaagaaataaaaacatacattataattctgtccattgggattggcattggcgagaaccgcagcaacattgaccactaaaatgtgccaaaaatgagcagattggtaaaacgaagggaaatgacaacccaccgttctgttgctgtggcataacagcagcaaagtttggcaagaagcctcctaaatcgaggaattttctgtaagatataaatttaactactttttaaggtataatggatatgggctccataaaaataattttctgttatcgataaagaccaaccccgctgctggggatttcggggcttctgatcacgcactaataacattgatttgaaaatcagtgattttgaaaagcatagatttagggtcaataattaattagatttgtcaaaatttctaaatatatgatataaactatggtaaataaataattgcaaatccgatattcatattcgtgatcagaagccccgacgaccccctggtttaatctttttgtttaattttcaaacaatgaaaacaaagggtgagctgacaatgcgcgcggtttgttcaccattaaactgctaaaattggatatcgtttttaaaaataacctgacaatcgcacaaccacacggaactgagctccgttcaaacgacggaatcgggctctttcagtgtccagacgaacgatagagcgtcgctgacaggcaattgccgaaaacaattcctaaattttgacggttggtgttatgagatattgaatcaaaacccaatttataaatttatttcttcctcaactataacaatcttttagcctaaaaaatcaaatttcattattctcgaacatctctattaggacgaaagcaagaacgaagcggattgaataaaaccagagagtgctcatctggagattctaactctcggatgtacatcactaattaaaataggaatttttttttggtagtgtgtagtaaacatataaaccaacaaaaactttaaaataaaacgccaaataattttaaaattggcgattattgcactcaaaattttttggatccttagttaattatgattagaaaatgcttttaggtcttttttgaatattcttgcgttcgatacgcttcagttttatgctcataaatttttacaaacttcttccactaaaaattcattccggcccatgataacaagctgtgaccaaattccccacaattatatgaaaataaacttacgtcacgagtcaatcgcgcattatttcctgcggccatctgcagaatttcataattaataaaaacatttcagtgctgcaattcaatggtagagggatattggtagaacaaaaaaggaagacaaggcaagtttacaatttcattttcaattggaaaaaagacaattgtgataataattttacgaatcgaaagaggatcgggtcccagaacctaaaggcacttgggggtcaaagtcttatgtgaattcatacccagtaaatgtccaatggcggctgaacgatggtgcaaatgatagtccggccagacaaagccagggcacgcattacgctgatcacactttccgccattgaaaagtcgaggccctaaaaattggatttttttcgaaaattagaccaaaaatcagaccgtggtcggttcatcagcaaaaatgatttgcggattgttcacaagttcggaagcgaacagcaaacgacgcgtctcaccacccaaaatgctcttttcgacctagaaattgcaattgtaaatttttaaaaatgataattactccgctgaatccaacgagctcatggcgacactcttccagaccaaactcgtcaattaccttaaattattcccattttgccactgccactgtccaccccccccccagatcccacctcattgacgcgtctgcgcatcgtccgtttagtgtctccgaccatccaatcctgcgccatcagatgctccttcaccgtcaacatgcccatgaacaagtcgtcctgctgcatgtatagtataaggatgataaaaaaagagggttcgcaaaacgaggccccaaaaacccggggaatttcctagtcaaaagaccgaaccgcaacccttaaatcacaacgactcgccttgatgacgtaagtgatgaaccgacccaaggagtgcgcgttgatcgacactttgccctccacgctaagactcttcaagtttcggttcagcaaagtgttcaacagcgttgttttgcccactccgccatcgcccgtcagtgccacgagttggcccgcgtcggccatgccggacacgtcgtctaaaagtcgaaaaagtatttgagataagggacacaaatcctactggcttaccagtgattttaccaacggtgagaccgtgccaagacaatgccacgggttgtacttcctggacactcttcgtcggcgacatcgctccataatt

SEQ ID NO: 7128 - DNA, 1955 bp, Heterodera glycines
  misc_feature (84)..(84): n is a, c, g, or t
gctttatgttaattgaaaaaggtcaaaaatatttttttattctataggagtggaagagcgaggtttaggggtttaataatggangtggcataagaggtgggaccgcatttcgcattccggcatttttttaatgaaaattccggaaaatgcgtgaatttttattttttcatcaaagcttaaaaatatccttttttacactaaatctgtcaaaaactcaatctaagttcaaagaatttccacggtgaaatttggaaaacctactcagcacatgggtagatggatgcttgttttttaataatttaatatgttatttctttaattttttcatttagttatctcaaccaatgatttttacggaaaatgtggtgccaatttgtttggccaattccacttctgaaaaagttttcaacaataatttgcacattgtcggctggggacatcagaatggtaattaattattaaatgctgtttaattaaaaatgattttttttttgttgattcgctaattaggtataagatcatccaagaattaaacaccaattaacattgaatatggacacacaaaattctttataaaagtgggcatgtattttacagaagccgactatgatgaagagggcaatgaacggtgctaggtcatttcgcgacaagtgcaaaaataaaaatcaataaaattgggcacttcgcgacagtgcaaaaatgggcacttcgcgacagtgcaaaaatggtgtataaatggggcgtttcgcgacgggaccagagcgtttgggcccccgtttttgggcccccgcgtttgggcccccgtttttgggcccccggggtcgtttgggcccccgtttttgggccccggggtcgtttgggccccaacccaaaaatcgaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatgtacattctgatttggacatttttcagaaatggctaacccaattgcaaccaaaaaacaaaaagtaaaattgtcttacgaaggccacctttacaccttcgctaaaatgagttctgatgggatgacaaaattttggagatgcgagttcaaaaacagcaccgacaaatgcaacggccgaatctggacggacctccacgaccaattcattcgcctcgcaactccgcacacatgtccagcagatgcgtcacgtgttgatgctcaaatggtcacgaccacaatcaaaaggcgcgcaattgccaccttcgaaccgccttctgtcatcagagcagaagcgcttcaaaatgtcccgtctccgtcggcaattttggtgtcaaaacaagcagcaaaagatgtgaaaaactgcaccgattctgtatttgccgagaacgctcgaatgatcacgtctgttgcgttcgtgcccttgtgtgacattagaatggcggtagcggcacttgatacggagttcggaaatttggcggttttccaaccgctgattgactggtgtgtaaactttttttaaatttaaaccccactgaaattacaggctattaatcaattacgttggacagcccaggcccaatggcacatggtctcaaccaacttttcgccctgaacaatggaacgtctacacacgcacgcttaatgccgatgcacggaccaacaaccactccgaggcggagcatcatcgtctacagggcgccttcaattgccgacacccgtcgatttttcacttcattgacgtgctacgtcgtgagcagaagccaacagacgtcaaatacgcgtcattcatggccggagaggaccccccaccaaaagaacgaaagtttttgccgacagatgaacaaattcttaatttggtgctcctctacgtccgcgatgaatgcag

SEQ ID NO: 7129 - DNA, 2746 bp, Heterodera glycines
  misc_feature (2107)..(2108): n is a, c, g, or t
  misc_feature (2118)..(2122): n is a, c, g, or t
  misc_feature (2133)..(2134): n is a, c, g, or t
  misc_feature (2138)..(2139): n is a, c, g, or t
  misc_feature (2146)..(2146): n is a, c, g, or t
  misc_feature (2160)..(2160): n is a, c, g, or t
  misc_feature (2163)..(2163): n is a, c, g, or t
  misc_feature (2177)..(2177): n is a, c, g, or t
  misc_feature (2189)..(2193): n is a, c, g, or t
  misc_feature (2203)..(2203): n is a, c, g, or t
  misc_feature (2209)..(2210): n is a, c, g, or t
  misc_feature (2213)..(2214): n is a, c, g, or t
  misc_feature (2216)..(2220): n is a, c, g, or t
  misc_feature (2252)..(2252): n is a, c, g, or t
  misc_feature (2256)..(2258): n is a, c, g, or t
  misc_feature (2270)..(2270): n is a, c, g, or t
  misc_feature (2273)..(2273): n is a, c, g, or t
  misc_feature (2277)..(2277): n is a, c, g, or t
  misc_feature (2285)..(2286): n is a, c, g, or t
  misc_feature (2289)..(2289): n is a, c, g, or t
  misc_feature (2293)..(2293): n is a, c, g, or t
  misc_feature (2298)..(2298): n is a, c, g, or t
  misc_feature (2325)..(2325): n is a, c, g, or t
  misc_feature (2333)..(2334): n is a, c, g, or t
  misc_feature (2340)..(2340): n is a, c, g, or t
  misc_feature (2342)..(2344): n is a, c, g, or t
  misc_feature (2368)..(2369): n is a, c, g, or t
  misc_feature (2380)..(2381): n is a, c, g, or t
  misc_feature (2386)..(2386): n is a, c, g, or t
  misc_feature (2389)..(2391): n is a, c, g, or t
  misc_feature (2399)..(2400): n is a, c, g, or t
  misc_feature (2403)..(2404): n is a, c, g, or t
  misc_feature (2409)..(2409): n is a, c, g, or t
  misc_feature (2418)..(2418): n is a, c, g, or t
  misc_feature (2425)..(2427): n is a, c, g, or t
  misc_feature (2431)..(2431): n is a, c, g, or t
  misc_feature (2435)..(2436): n is a, c, g, or t
  misc_feature (2449)..(2451): n is a, c, g, or t
  misc_feature (2454)..(2454): n is a, c, g, or t
  misc_feature (2461)..(2461): n is a, c, g, or t
  misc_feature (2478)..(2478): n is a, c, g, or t
  misc_feature (2480)..(2481): n is a, c, g, or t
  misc_feature (2487)..(2487): n is a, c, g, or t
  misc_feature (2491)..(2491): n is a, c, g, or t
  misc_feature (2494)..(2494): n is a, c, g, or t
  misc_feature (2496)..(2496): n is a, c, g, or t
  misc_feature (2501)..(2501): n is a, c, g, or t
  misc_feature (2506)..(2506): n is a, c, g, or t
  misc_feature (2515)..(2515): n is a, c, g, or t
  misc_feature (2518)..(2519): n is a, c, g, or t
  misc_feature (2522)..(2522): n is a, c, g, or t
  misc_feature (2527)..(2528): n is a, c, g, or t
  misc_feature (2537)..(2537): n is a, c, g, or t
  misc_feature (2547)..(2549): n is a, c, g, or t
  misc_feature (2552)..(2553): n is a, c, g, or t
  misc_feature (2556)..(2556): n is a, c, g, or t
  misc_feature (2561)..(2561): n is a, c, g, or t
  misc_feature (2567)..(2568): n is a, c, g, or t
  misc_feature (2571)..(2571): n is a, c, g, or t
  misc_feature (2580)..(2580): n is a, c, g, or t
  misc_feature (2586)..(2587): n is a, c, g, or t
  misc_feature (2592)..(2592): n is a, c, g, or t
  misc_feature (2594)..(2594): n is a, c, g, or t
  misc_feature (2596)..(2596): n is a, c, g, or t
  misc_feature (2601)..(2602): n is a, c, g, or t
  misc_feature (2606)..(2606): n is a, c, g, or t
  misc_feature (2615)..(2616): n is a, c, g, or t
  misc_feature (2619)..(2619): n is a, c, g, or t
  misc_feature (2622)..(2624): n is a, c, g, or t
  misc_feature (2629)..(2630): n is a, c, g, or t
  misc_feature (2634)..(2636): n is a, c, g, or t
  misc_feature (2674)..(2674): n is a, c, g, or t
  misc_feature (2687)..(2687): n is a, c, g, or t
  misc_feature (2693)..(2693): n is a, c, g, or t
  misc_feature (2695)..(2695): n is a, c, g, or t
aaaaatatggatataaaatcgcgaaatatggacataaaatggaaaaaatatgcacataaatttttccaaattgagggtttatgttctcaaaatttctttaaattcgttaaatgtaaagtaaaactgcaatcatgtttctgatccctagtttttttgtaattgaaaatcttggaaaatttttttgcacgcagattctgactctctgactagcgaaatagtacagacgctgcactgaaagcataggagagcagcagaaatgcgatggcaaccctgattttaaatttaatcaattatattaaataataaacaattatttaaaattaatttattatttttatattcttttattattttttaatttgatattttaaattttggcgatttgatatagtcgtaatggtcattgtcgaaacggtcattgtcgaaatgtccagccacctttttgggttaaatttagcaaaaattaatatttattttgacaaaatgccaaaaatttgaaatttttttcataaaatgtatattttttacattcatatgcaaaaatcccgattccaagtacaatcttggaaataagtacagttaaaattttccaagcacaaaagccgaaatctaagtatgtacttggcatcgaagtacgaatccgagccctgtaataattgtttaatgcttttcatttgacttacacttaaaaaattattttgaagcttttttcaagataaatcattttttgacgggatttgctaaaaattacttcacaactttaatatttttacaaaattcaaaaccgatgataaatattctttttagaataatgaaactctccctacaatttcacttattagttgtggcattggcaccttcgttttcttctgacatgctattttttgcgcaagtttttcgtaaaaatgtgattaagaattgttacatggcgtagccgtattagctattttaagattagtttttttaaatgacccaaaatttattttttaaaaataataaaatatgttcagatgaattgtcgcaagtttcattttattcattgaactcttccatatttattcttttttgataatttttcttttgatattttaatgttatggaatattttaaaaagttttatgaatcttatcttttaaaatttatttaatcaaaaatttttaaattaaagtattctctaaatttctttaaatatttttcaatttttcatctttaacccccgacatttgattgtgtacaaaagtctctatctgttgcacattgtgaagctatttcttttgagaaaatctctccccacatttttgggtcatccgttggagaaaaggcgtattttcggggagggactttgggatttgctggggtttgggttgagattttggggtcaaggaaagatttacttaattttcaacaccactttactgacaaggaattagagaataaggcaaattgcaattaggaactcaaataacagtaccaattaagcctttgggcgtttgttgttgctgaatgaaagtccacggggaaaagcaccaaatttttgtagttttattacaataattcaaaagcacaaaatatataaaacttgagagaacacgaagaccgaaaacgaagacaacaatcaaaaggaaaattaaatgaaggatgcaaaaatattttaaattaacgcgaaaaacaatcgttgcaaaaaacaataaaataaggataaatcattatttatcctacgtcccccgccgtttgaagaccagtgtcctcacggtctgatcgccccgcacctcccccggatccagcagaagtcgagcgcctgcgagatggtgtcggtcgaggcggtccagcagtgaaattgtcacaacggaaaaacattctgaaaaaataaaaaagggaatgattgtggggggggggggtgatcaggattgtggcaacggattttggccaattggagaaaaatataaaaagaacaataaaaatgcaataggccatgtatgagaataacattatggtccgaagctgaagaaataataacaaaataagtaaatttaagtcattgcgagccgcttttccacgttttaaactcttataataacgaactgggggcatttgcaaggattggcgnntttctgttcnnnnntgggcgggggnntttnnttgattnttggcttgggaggnggnttttttggcttttncttggttggcgnnnnncctttttgtncttggnnttnncnnnnncccgtcgtcgttcccgtttggtctgtttttgntccnnntcctcctttttntgncggnttgccttnntgncttntttgnttggtgggctcgggttctttttggggnttttttgnngtttgncnnngggggtttgttcggttttgttggnngccttctttgnnttggntgnnnccttttgnntgnnttttntgcgtttgnccggggnnnttgntttnntcccttcgttggnnntgnttctcgnttgtgtggggcgcggtncnntttttngggnggngnttcgncccgngtttggcgntgnnttnttcgnntgttttggnctctcgccgnnnttnnttntttcntttgtnnttncctttccgntgtttnntcccngngntcttnncgcnttttgtccnngtnctnnntcgtnngggnnnggttttttggtggccgcgcgcttttaaagccttgcccntttcctttttccntcggcncnttcagtttaaaggtcactggtactcttccacccgtaaaagattcgacttca

SEQ ID NO: 7130 - DNA, 5128 bp, Heterodera glycines
  misc_feature (2573)..(2573): n is a, c, g, or t
  misc_feature (2636)..(2636): n is a, c, g, or t
  misc_feature (2815)..(2815): n is a, c, g, or t
  misc_feature (2848)..(2848): n is a, c, g, or t
gggggcatttgcaaggataggcgaatttctgcttttaatgggcgagagaatttaattgataataggcttgggagaagaattttttggctattacttggttggcgaaaaacatttttgtacttggaattaacaaaaacacgtcgtcgttcccgtttggtctgtttttgatccaaatcctcatttttatgacggattgcattaatgactaatttgattggtgggctcgggatctttttggggattttttgaagtttgacaaagggggtttgatcggttttgttggaagcaatctttgaattggatgaaaccttttgaatgaattttatgcgtttgacaggggaaattgatttaatcacttcgttggaaatgattctcgattgtatggggcgcggtacaatttttagggaggagattcgaccagagtttggcaatgaattattcgaatgttttggactctcaccgaaattaattatttcatttgtaattacatttccgatgtaatatccaagagaacttaacgcattttgtccaagaacaaaatcgtaagggaaaggttttttggtgaccacacaattaattttgccttgccaatttcctttttccatcggcacattcagtactccaatcactggtactcttccacccgtaaaagattcgacttcaaaaggaatttctgactttcctttgtttggactaaaaccccaatcaatcaaattcactcccttttccactgcaactttatgtaaaaattccggattggcagcattaatttcggctgctgagtcagttaatgcagttgcttttaatccagcaacgttcaactctaacacaatacattctgaatttgatatttgtgtcgggtttggtgagggaaattcagttgaatgggcgattaatgaattgaaaaatttttcgtaggcgggcggttcgctgtgttcgatgtgactaattttgactgatttcttttcgcatttttcagttccttttcctttcaccttaatcatattcaactccatgttctgcgttgccattggatttgattgttgatttgaatcgaactgggttctatttgcgctgatcgcctcgattttatgatcattgacgtcttgttggtgatcggaattttggttttgaaaatggacaaaacgttgacttggccgggaatttgggttgctctcataaaaaatatcgttttgaaagccgttttgtgggtcggatacccattgatttttcgggccataagtttgataagggaccaaattttggttttgaaaatgatcaaaattcttattggggcaataatttcggttttcctgttggaaggtttggtttttgaaaccactctgtcggtttggcctgaaattattttgcgctcccatcccaaaatttggaaaatttctttcaaaacgttgtccgtaatttgggttttgaaatgggctgtacggtttttgctgtgggccggtttgctgaaactgaacaggaattccaactgattcgtttcgttctcggttttttccgtcctcaataagactcaaacggttggccatcatcaaaagctcatcaaaggtttggtttgctttggtctggcattccaaaaatctggccaaattcacatcatttatgtttgaaatgaagtgcttttttgacacctcatccaactggttttcgtccagaccaatgtatgagcaattaaccaaccgttgaattcgctcaccaaactttataatgtcttcatttggttttcttttaccattctgtgtcaattcggaaaatgcgtttgcttctttgtagtctgtctctctcaaaatggacattatttcggtttttagaatgccaaatgtcgcctcatttccaaatttgttcagcgcaatatgatacgctttcaaagctttccctttcaactttgtctgtagcaactctttttgcttttctggtctccactctccggcacacatttgaacatttaggaagaaatccttaattttgtcccgaccttccgttccgtataggttcggaatttctcggagcgtatttgcgtattggtttgacagagtaactttatgtaattccattacaatatcaggaatttgattttgttggaaattttgctgagggacaaactcgaaattttgaacgttcggaaagtgattgggttgtggtgccaaattttcaaaatttggattcggtcgctgttgataatttggttgattgatattccgaaccggatgaaaattttgaaaattgggtccatttccaaaatctcttgtattctgaattgggtgattcaccccaatttctcgaccataatttggatttggaaagttttggttttgctttgattttcgatcgataatttgatcggtcattgttccctctaaccccccccccccccaaagcccaagcctattggatgatttcgggagaaaaaagtgagagagagagatagcgagagagagagaaagagatagagagagagaagagagagatagaaagagagagaggcgagagagaaagaggagagagagtgagaagtaatagagtgaagcgagagagagagagtagtatggagaatnaaatggaaaaaagagaaagacagattgtgttagagaaatggagaaaaattagtagccataaanaataattaattatgcatatattttttggatcgatgaattataatttttaaatgatttattttacttttcaaattcattttgtataatttataaatgccaaatgaatttaaatttttagggtaataagtattaattattttttggaaaaaaagcgaagcgcaataaaagcgtattttgcncaagcggcgggggcggggacgtgtgcgttgctntacgatttatggtttgcaatatattataattaaattataattacgctaattttctttaaatcattgtcagggtgtttttttgtccacaagtcaaattttgagagaacctgctcgtcggctgttctttttttggatggttcagacttttttgaaggcaatgaatggattcattcacgaattgcttcacgtccaaggttttaaatttgttacaattggaaaaataattttgacacagggggatttttggatttgctttcacgttatgagtccagccgattttttatgagtcaaatttacattttttaaatggtcaatacctatatgcttaggattaaacgagaacttaaggtttatagaagtttttgtataacttttttacctaaatggaatagacaaaaaattattcacgaaaaagttgaatttcttgttttttattcgttatttctttttaataccagctcttttcttgcattataaaatcctgggacttttagctttaatcaccaagaatataggtattaaccaagcaggaaaaaagttatagttctaatcggttttacgcgtccaatggccttttacgcgtcctataaccgtttacacgtcctataacattttacgcgttccaaaacaatttgttttcagaaaggcaactcgtacaataaaaaatttaaaaaataaagcattgcttacgctaaagcttaagcccgggcctaagcaagcctaagtttaggcctaagctatgcttattaaacataaagcctaggcctaactaagccactgtacgacaataccgggcaaaaaaaagtttcctcttagttatttggggcggctaaaataccattgacatataaaaaaaaccataggacgcatataaagtgatgggactcttaaagtgtcatggggcgcgtaaaatgtcatgggacgtataaaaccgactagaaccaaagttatggcctaaaagctgaggatggtcattgacgggacgcaaaaaaaaaaaaaatatatatgggacatataatatgtcatggaacgcatagaaccgaacagctttttttcttgcttggtcaatccatacatctttgggatcaattgaaagcttaaagctaaaagaagttttcttgtgttgaaaaattctgggataacaagactaaaattttcttgaatataggcaaaatgattaatcagtttttttgattgcaattttcttaatacaagtatttgcagcttttctttatttttgaattcctgagacttaaagctttcaatgatgccaaagatgtatggattgaccaagtatgaaaaaaagatatgacctaagaaacggggggatagtctttgattggacgcgtaaaagtcggttggacacgtaaacttaagtagagccagcactgcttccacttttaacaattaaacgttcctttttggtttgtgctaactgtaaatgtaaacaatgctttttgaacaccacagacatcgccttccaaaccatcttatgactgagtcggttgagtcgtgttcatcgaccaatttcgtttccgaaaactcaaattgttcttcagcgacgggagaggaggacgcggagattgattcaacaatgacaaattgtgcaagaattaattgactctaccgtaagagaagcaagtcgtaattgtgcagaaaaggaacagagaaacagcactaattttaagaaaaaatttcgccaaattaataccgaaaacccaaaattaagttgtttaggtcaaatttgttgctgtaaattgccattattatcgcggacaatgcaaacggatgtacaaagtgcactcgttccacgtcattttgcacctttttccttaccaaaatggccatccgattttatacaaccaaattttatcgggttcgaacaaaagacacaagttgaacttggctgcctcgccggatgctgccttgaacacaattcggtactcacgttccttctcaaaaactgcaattcgaatttctcctggcccgtatcgttgatcaatccaatcttgtactttttggacgtcatcaattgtgtacatgtgtttgttgcggggaattgcggcacgtctcaataagttacgtgcctcaggcccgtgggtgtgctggcgatttgcgaaacttttgaatgctgtcggtccgcctccgcctggtgaccgtgaacgccaatcgtgaagacctagcaacacagctctggccaaacagagtcgatcattcggattcttaatgcggatcaacgagcgaacagtgttcaccaatcggtgctcttcctcaaggctg

SEQ ID NO: 7131 - DNA, 1107 bp, Heterodera glycines
  misc_feature (10)..(10): n is a, c, g, or t
taagaggcanttggaaagtgtcagaaggaatttggggggggggaaagaatggcacagcaaaggagcgaatgggacgggaattggggagggggggggcaattttagtgggtttgataatcgaaatttgcaaaattatagcaattttttggacccttttgctggggggtgattgagtaagtttgaatttgatctgatttgtgatttatgcttgtccctccgattgtcctcacttttccgtcccctctttttgttgtgttgttgttttgctccatgcttttccccctcctcccatttattcttcccctgccaattagcttcccctccctccgtttgctccgcgcgactccgtgccggtcattccatctttgcatgccattcccttcccttcttttcccttcatgcatctgcccatttcaacaagtgaccgaaagtaatggaaaatggacacaaaaagcgaagagaacggcacggggaaaggaaaagcaaaggaaggaagagagagagggggagagggggacgagaggaggagagagagggtggaataaagagaatggggaggagagggagaagtgacagggggaagggaagggacagatgcgttcgtcgcccttccgtccgttcatcccccccccccccctcgcgccaccccatcgtttctttcgtttcgtttactttccgccgtccatcacttttcacaatttatggtgcaggtcaacaaataagcatgacaccagtacagcagctgctggttggcacaaacactcaaaaacaggcagagaaaaaaaagtaaaattggggagaagggcgaaagactgctcggggagggaggttcttaattgctaggaaaattcgcatagacatacatttagtttatttttttggatagataacttaaattacaaattatctaaattataatggcactcgttcgcttcttcctcctcctccgcatcttctgcttctttatcacctcctcttttatcttttttcctccttctttccttctctcccttttcctcctccttttccttttcgctttctcttccttttcctcttatttctttcatacttcctttgtttctttaagctattgtccctcttaccatc

SEQ ID NO: 7132 - DNA, 2087 bp, Heterodera glycines
ggggcggggaggacagcagcagaggccattccgttccgttcctttgcttgcccaccctcccaaaaggggtattcatttgccctgtcgctcattcatcgcgcatcgtatcgccgggaactgtcgagagcaaattcccaaaatctcatcactctttcggtcactcgctttgcctttcccacaatttggtgaccctaattattttcttctttcttataaaactaattggccccattaatcagcagcgaactgagaagggccgttcccgacaattcagcagtttttagggaaacaattctcaaattttgcgattcattggttttgaaacaaagtccactcgttcgacttggatttgaccaaatattcgagattgaagggtgattgtcgaaacttctcaggtcccgtcccatcccatccgtttcgttccatcagtcccatccttccatttcttccatccaatctgtttcgtcccttcccttccgtttccgttccatcctccattctttgtgttctcctcttcttccccttcagatgttctcccactcctcctcctcccttctctcctcccttttctcttcgtcccccatttttccctctgtctcccatttcccttcaaattcttccgcttttgtcgttccttcctccgtctcctcttccgccttctccgatgcgcttcacgccctctcgcttcaacttctcctcgatcaacatcgcaattcgctgcttcgctcaattctctcactcacttccaccgtaccattctctgacaccagctacagtaacccattggatttcgcccttaaaattgagtcccttgtgaaagaggaagaagaaaataagaaaggggcagcagaagcagcagcaggtggagaagaggttacggtgaaaggtcaaacgatcatagcagcgttaatttgatttagtggagagaattggaggaaaataaaacggaaacggagagacgaagagggaaaaagaggacgcggaaagagagagcggagacggaagagaaacggaagaaagcggacgaagagaagcgaaagcgcaccgatcagacgaagcggagggttttccgactgcaaaaaggcgaaacggagacggactcaccggtcagcggaatgttcataaaggtaaagccaaccctcggcatggcacttaacaaatgccaaaaggagtcctgtgatgaggaggaactgcgccaagcgacggctgaattggacgaatcagcgctatttgtcaacgtaacggaggaaacgcgggaagcgatcaatgcaattccaaatgtgatcggggaaagcatttgcgcactttgcaaggtaaaggcaaagaaagacaaagggatgacgacagtgacagggaaaaggcaaaggcaaaagcattggttacagattcgttttggcgatgtgtttcgattggcgatgcacaaatgcccacgaattcggcacgaggagtaccggtgcgacgagtgcgagaaggtgatcaaaagggaaaagggcggacgaactgaaaagaacaaaagaaggcgaaacgaattccaaatggaaataccgtatgaatggcaatgtgggaataccgtatggatgggatatcggggaataagccaggggatatagtatgacaactgtacagggaatgccagacggtgccttccctcccccgcgagtgaccttttgctccaatccaattaaaaggatgcttttcttctttctgcacttctcttctcctctctccctccgcctctttcgttgttaatccctttcccctgcacaaacaatgccttcccttctcctctcttcttcccccccccccccccgatttctcagcatgattcactcattttctttgctcccccctccctttgcggcggcatctttcatcggttgccttccagctgggtgtcaagagggagagaagtgaagggcaatcatcgcccaatggtcgagaaagggagggaaagtaaaggattggtgccaaagccaaatgcgcttttgccataaatgtgccgaaatgaacagatatctgtcatttgcttccccccccccccctttaggtcttcggctgtccagcaaatctcgcgtcccaccgccgat

SEQ ID NO: 7133 - DNA, 813 bp, Heterodera glycines
agcaattggttggcgcagaagttgcaaatgctgattaattaatctctaagccttaagcctttgctcgtcatttcgtgccacttttttaatttattttattattttttgttttccataataatcgctgagtcttttctagtcggtccgcaattgagtctccgtttttgtgttcgatgcaaaggaatctcttgcaattcgcccatttatttgttctctctgtcgaataccgtcccttttcatatgcatactgtatctttggtcaataaatattcaaattctgttaatgattgtttttcatattttaaaattaaactctaacaaatcgaaatgaaatgtcattaatctcaacggcggaagaattcttctcatcgtaatcggcccattcctaatcaaaaaagggcttaaaaaatgcgctaaaaacttgccaattcgttgaggtcaatttcatcgaaaattgagcccgattctgtgccaacgcaaatccaaccaatcttaaaaatgcgaaagggcactcatttatcaggggaaatgcgaatttttacccgggggtcgaacgaagtcggctcaattccgcggcattcgaattttaccaatgtttggaaaagccgatttttgtcagcagaataactcgcataggaatcaatgagaatctctgaaaaagcatttacattttatggtctcccgcccaccgagtgaattgattctgccgcaaaaggaacatttggcggaaatgtgacaaatgcctttccctttggtcaaagtgtgcgtttcctacaaaaccgagtaaataatggcctaaataggccacggcat

SEQ ID NO: 7134 - DNA, 2359 bp, Heterodera glycines
gtcgtcgtaatccgacggacgaaggtcagtgacccgatcaaattggcactcatttgaagcgcaaagacaggctaagaaggacagtccaattgcatttcccacttttgtttttaaattttaattcccaatttggaagcaaattaaagaaaaggccacccaaaataaaagaaataaacaaacacaccatgaagcaaacaaagcacttttttactttaaaatcttaaataaatctaatagattagttgaaaaacggagaactaataagataaaagcagaaaagtctcccaaataaccattggcaattttcaaagaagtaaattgaatccattttatacagaatcaacaattacaaactgaaaatatatcaacaggttaaaacgcgtaaaaaaaatttaaaaatccatcccattttgtgtcaggaacatttgtctaaaggtaaaaatctgtaacgggggatgtttattgttagctattttttgtttgttgtaaatgtaaaagaatgcaaatcgccgctgtcggtcattctctgcgcacacaaatgtccccttccgcggtggcgttcactttgaatttctccccggttatccgattttcttctttccgctccaaattcatttcatcgtcgcactcaacgttcagaataaaactttgtttatttgttgaattaacaaaatcctaaaaataaacagaaatttaggcttatatcgataagagaaaagaaacttcgtgcaaagtttcgattaaatccaacgaaagagcggaataatcaaagcctttgagggagagcgcttttgggttggcggagtcatcgcaatgttcatcacaaaggctattcagccaaacactgaaaggatttaatagaatattatataaatcttcagttgtgaaaatatgtaaacaatggaattcgattcatttttcatatttttaaaaattttacaccaaaaaaggaagtgagcttttcctactcgccttatcacttcgctgtcctctgctttggctttgtacccttcgaaatcaatgacaaatgattttggagggagtcgaagaaggtcagaaataagcggacggaactcacaacgacggccgaaagaaaagacggcgccaaggcatttctaaaaaattgacacaaaaattgctgtggtcggtcacttaattcagtttcaaattttgaataaatcaaagagaaaacctgaaaagcactgatagaaaagagtgtgtcaattttatactgcgaaattaattgggaagatgaacgtccttgataatcgaaaacacagtaattgagttgaaagattcgttgccccattccttgaaggtcgcgtaagatttcactggtaaatttgaattcctgaaaatcggataactataaaaaaagaggtggggcgggggaattaaactgacgatgaactcaatacatccgacaaaacaatgccgaagccacaagtgcaaatccgaattggactcaatcgttctcccacggtaaatcaaaagcaatttcatgtcattggaacgagtcgtacgcaatttgcacctgaaaaacagcccaatgagaagtaattcctaagagaagtaccgagcaacggcacggagaggaaaaacatcgaaatatttatcaacaataagacaatgtttatttgtcacaagttgcattgtctgaagaacatcgcggtccaaaaacttcataatagccacccaacattcgttaggaattttcttagataacatctaaataatttttacatcatacatatataggtgggtatcaaaggaagttccgcagaccctcaaaaattgccgaaacgtggcttctcaaaaaccaccattcatttttgagaaaagctaattaaaaaaaaattttttttttgctcaataaattttgagcttgactgtaaatatggcttatatttatttaaaatccaaaatcttaaccaaaaagtaacaaaattaatccaaattaatattgagataaataatttttaaaatccaaaattcttgtcatttaaataaataattttgtaaatttttgagcaattcttcattttatagggggtgtattttcagaaatttttgaggtcgattcttaggggtgtatttttcctttttattgcattttttaaataatttgggcaaaacgccaaaataaataatagttttttgaatttttttaggttttaggtagggtaggccgggtccgggtacccgaccgggtcccagacccggatacccgattttttcactacccggacccggtttttggaaaatccaatacccgatacccgacccggtaggtccgggtccaaaagtacatggtaagaattggggtcaggctcaaaatgttgaccaaagtttgaggaaa

SEQ ID NO: 7135 - DNA, 4048 bp, Heterodera glycines
  misc_feature (3672)..(3673): n is a, c, g, or t
  misc_feature (3680)..(3680): n is a, c, g, or t
  misc_feature (3688)..(3688): n is a, c, g, or t
  misc_feature (3709)..(3709): n is a, c, g, or t
  misc_feature (3716)..(3716): n is a, c, g, or t
  misc_feature (3725)..(3725): n is a, c, g, or t
  misc_feature (3740)..(3740): n is a, c, g, or t
  misc_feature (3743)..(3743): n is a, c, g, or t
  misc_feature (3749)..(3749): n is a, c, g, or t
  misc_feature (3868)..(3868): n is a, c, g, or t
  misc_feature (3880)..(3880): n is a, c, g, or t
  misc_feature (3922)..(3922): n is a, c, g, or t
  misc_feature (3946)..(3946): n is a, c, g, or t
  misc_feature (3948)..(3949): n is a, c, g, or t
  misc_feature (3954)..(3954): n is a, c, g, or t
  misc_feature (3983)..(3983): n is a, c, g, or t
  misc_feature (3985)..(3985): n is a, c, g, or t
  misc_feature (3991)..(3991): n is a, c, g, or t
  misc_feature (3998)..(3998): n is a, c, g, or t
  misc_feature (4000)..(4000): n is a, c, g, or t
aaattttggattttttttgaggatttccaaaaatttccgtaaaaaacccacaaattatgtaaaaaaaatcaaaatatgtaagaaaaagtccaaaatatgtaccaaatatgtataaaatcccgaaatatgtaaaatatgtataaaaccccgaaatatgtaaataaaagtcccgatttttttttgcaaacataaaaaagaaagtgtttttcctactatttagagcatggagaatccaggaaaaaaatatgcatttgcataaaattgacatccctaaaaataaggcattaaagttcgtaaaaattgtattaaaatctcgaaaaaatgttgatattaaatttcgttgggagcaaattaactctttttccaatttttaaagatgttaaaatttaaattttagttttctgtttttttccatattaaggaaattagttgaattttggcatccactctttaatttatgtggcttctctggaaaatttaaaaaatgccaaaatataattccaaaagaaatatggatttgattttggttttgaaagcctcagaaaatttggatttattattgaaatccctgaaaatcattacaacccatccaatcaaattaaattttcaaatttacctctcatctaaattttctgatggcatttcaatgctttggtaagcgaatgcgaatgagtttaaatagatttttcaattttatttcatttttccaaaaaaaactaggtttttctttttttctaggaaaaaagaaattcattatgtttttttgaggaaaagttctaagttcaattgaaatgaaaaaaaattgtacgaaatcccattgtaaaaaataccatgacactacggtaattgggaggaattacggtaaacagcagaggtgaggggggagggggcttcatcataaaaaggataaattacggtaaagcgaacaaacattgtgatcagtgtctccaatcgggcaagcaaatgttcgaccactgagcatgccaatgccattgtttgactgcgtttgacatatttcactttttgttggtgccattttcgaagtgtgtcgaacaaaattggcacaaatttttgcacaatgtgcccatctgttgggcataagtgtgggcaactgtaatcatcaattagctcgtttaggcccctaattaggccattcagcaattccttgtcaccatttgcaatttccttgtccaaataactgcttctgctagatgagtgtgtgctttttgaagtaaaaataccaattttacagctcatcgccacttttttgaaaaattttatgctttgcttaattcagggctcgcattggaagcatttcaaaggagatttccaaggacaacaaaacgggaaaattatattcaacgtatctcttttttaactttttaaattcaaggacacttaaaaagtttgtcatatgcaatggacaatattcaaatggtttgcattttcgcctgtcaaatgaatgaatttttgaagcaatttgtgtcaatagattttgtaccaaataatgccaataattaatacaaaatatggtgtaaaattttaaaaaattgtaaaattttgagtgtttttttgaatgcttatttcaaggatattttatattcaaggatattttcaaatgagagaaccaaatttaagggcatccttgtcattcaaggacgaatgcgagccctggtttaattcacatttttttcgtaaaattgaattatttattttttagataccattttttgaaatacatacacatatttttaagttttctcattttttcgaaaatttaaatttaaatttttaggttaatatatttttcacaattaaaaattgaaaaattttgccaaaaaggggatgaaattgcccttggcacattttaccagaaaatttttgctcaaaaatctcagaccaattccaaatttgctcataattttctgtgttctccatttctttcaatgttcttatcacaaagtcgaatttgtttttcactttttgcttaaaattgtcaggattaaatgattgttggcctgagggcaattcaaattgtgcattttggcgtaattcgaccgcaacttggcgtaatgctagaatagaaataaaaaatccgccggcctgactcattgattttcaaaatttttataaaattattcgattaaaaagccagattccggatacctagttaaaaatctcgcctagcccggtctagtttctgtcactaatacatataattaaaattttaattgtgaaaaactttaattggctaattagtcgcggtaattatatttccaatcttggcatttgttggaaatgattctgattgttcgggtataattgctaattgcttcgttgaacaattgtagctcaatcggtgcacttctaataaaaaaagtaaattttttgtattttttcaaactttttcgagtgcccaaaaattgaagcaaaaattcactcgttccggtggtctctccctccgcccagcaattaatcacagtctaatgacgcatattagcggggctaatcacctgaatggcactttgccacattggtaatctcgcctttcatactgaacagttggacattcgccgttggcatttttcagttttgaaaaattttcaaatttcgtatgttccacgttggcacgtttggacaatgcgatgccaaaatggagaagcacacagccgagaacaatgccattatgaggtggtgggcttatgcttaaaccacttctactactgcttaatcgccgccgcttccaattccaaatttgctcataattttctgtgttctccatttctttcaatgttcttatcacaaagtcgaatttgtttttcactttttgcttaaaattgtcaggattaaatgattgttggcctgagggcaattcaaattgtgcattttggcgtaattcgaccgcaacttggcgtaatgctagaatagaaataaaaaatccgccggcctgactcattgattttcaaaatttttataaaattattcgattaaaaagccagattccggatacctagttaaaaatctcgcctagcccggtctagtttctgtcactaatacatataattaaaattttaattgtgaaaactttaattggctaattagtcgcggtaattatatttccagtgaatgagaaggacggaatgccaaattggcgatattttttgtaggatagactcagcaaattcaggcacagacagacaaacagagagtaatgaacatgaattgtactgatcagtgcactttttactgatcagaaagtgccgccggcgggtggcggaggaggcggcccctgctgctgattctgtccggaagtgccctgctgatgctgcccgaaaatggaattccaatcaagaaaagcgtaaaaagcctcgtactcactttgcaggactgaaattcatataattaaatttgattttaaatttaaatttcacaaataaaaattggaatgcttacctctagtcaaactaatgactctcctttggacattcaaatcgaaggtcgccaacattgccacaaattgaacttgaaactgatcgccggtcaactgatcagcaataagctcatttggttgaaagccaattcctttttgagaatcaaaagcattggccaaatctgagaaatggcttattttaaaataaataaaaacatattattattttacggtttctcaannaaatccnataatatncctccaaaacatattcaattnatatcanataatcacncactttttcaaactnatncatctnacataaatcaaaaattactatcaaaaacataaattaattttaacacattttatttaacaatccttttccttaccattttaatccaataaccatttttaacactaaaaattctaaattcnttaaaatctccnctttctattttagttcttcttctcccttttcttcttcctccncttctttcctctctttctttttcncnnccccnttccccccataaagcgttttttctccctntncttttncccatgncncactttgatgaaaaaatcatagattagatgatgtcatatgacaattat

SEQ ID NO: 7136 - DNA, 1543 bp, Heterodera glycines
caagaaaagcgtaaaaagcctcatactcactttgcaggactgaaattcatataattaaatttgattttaaatttcacaaataaaaattggaatgcttacctctagtcaaactaatgactttcccttggacattcaaatcgaaggtcgccaacattgccacaaattgaacttgaaactgatcgccggtcaactgatcagcaataagctcatttggttgaaagccaattccttttgagcaatcaaaagcattggccaaatctgagaaatggcttattttaaaataaataaaaaacatattattattttacggtttcgcaaggaaatccgataatgtggctccaaaacatatgcaagtgagatcagataatcacgggctttttgaaactgatgcatctgagataaagcaaaaattactatcaaaaacataaattaattttaacacattttgtttagcaatcctttgccgggccattttaatccaataagcatttttaagacgaaaaattcgaaattcgttaaaatgtgaactttcgatttttgttcaacttcagcgtttaggaattggtcgaaatggatgaaatatttgtgattagcgaccccgataaccccatgaaacattttttatgactataattttaaaaatgaaaaaagcttgatgaaaaatcatagattagatgatgtcatatgacaattatgatttcatattcgtgatcagcggccccgataacccccgagaagaaagaataaccgtaaataaacagcctttttattccttttttatgggaccagcagtaaaagtcagtattatccaaaactttgataattaaaaaattttttgggtattattttttccttatacaaaactttaaccttttttaaataggcaatttcccaaataagactcattttcataaattataaagaaaaacggctcccggacatttcgacaatgaccgaccgtatcgacaataaaattaaatacatattttttaaataaaattcaaatttctgctacactggtggaaaaaagtctctactcaagcaatcaaatttgaaaaaattaaaatttcgactagaaaatttaattgttattttttgtttatgtgtttttatttacccctatttatgtgctttttatgcaccacataaatcactctttcatggtgaccaggaaagtcaaaaatggcttgaaattggggaaattttagaaaattcctagggggttaggaaatttttttggaaattttgaataggtcattggatatagcacaaaattcactacagaattgccttatggatggttagaaaaaccatcaaatggaaattttcaacaaaaaactggccataacttttgacaaagtcaactaaattagacatacatggtaacatttgatagccctatgtgtcctctattagcctgcaaaatttcaaaaaatttagtcaggtttcaaaaaaagttatggccaaaaatattcgaaaacctggccacacgtgtacttttggccataactttgctcaaacttgaccaaattttttgaaatta

SEQ ID NO: 7137 - DNA, 2180 bp, Heterodera glycines
  misc_feature (40)..(41): n is a, c, g, or t
  misc_feature (66)..(66): n is a, c, g, or t
  misc_feature (73)..(73): n is a, c, g, or t
aatatctgtcccagcactaataattatttttcgcactgtnnggaaggatctgaaatcacaaaaaanaattctnttaacatgattgacgtcacaattaataaattttaactttaattggaaaaattttgtgcaattcacttgaataattcgcaatttctgatgcataccagggttattgcgaatcgaaaaaaatgcaaaatacgaaaaaacgaaattaaaacaaaatacgaaatgcgaaacacgaaaaggaaacgccataaaatcacgaatttacgaaaatatgaaatgcgaaacacgagatttgtttcatatggattctaatctgatttttttttcgaaaaatgtttaatttaatactaaaacatatttatcaatgtatttccaataaaaaaaacaaaacattgaaaaatcattatgggcacatttcataaattcgagataatgtaccaacgagaaaatcgctgatgatattgggattaacattgacattggcatgcccgtaagagtcttctcgcatcggcgatatcaccacctcgaagtccaacgaaaagtttcaggcgaaaaatcggccatctttgacaatcagttgaggcatacgtgttcaacgcttcacacttgaagtgagaaggcagtacgtaatcaaaatccaattaattcgccttaaaaaccaaaataaatatgaaagaaattaggcttttactttgcgaggacgataaatttacctcaaaaaggtggcgccgactgaaagtgccgtctgcgtacacgtttttcataatacaggtccattgtgaagtcgaagatcgagcaaacaccaaaagccttaatacagaatttagtggaattttaggattttcattttttcacctttgtggacagcgtccaaactgagttgtacagcaggtggcacatattcgtcacggcgaacacgttttataacctaaaataaatgaacaaatcaaattttggcataacaattaggaaaagttgaccttttgtcgcagctttgttcggaaaagcagctaacattggtgttgttgtgttctgcaagacttgcgcacgaattgtagccggcgctttccacgtctcaactgcacgccgttttagctgggtcacacgtcgctgacactccactgttcggcgctcatgtcgcatgtgtggcttccaataattttgaggacattagcattaatgtcaatgtgtaggctgaatttaaaaaatattctttcttttatttttgcatacacctttgcatttgttattaggtccgaaaaactcgcaacgcaaacacttctttgtaggtgaacagaaattttaaagttatagttatatgtatgtatatgctcgacaaaaaatgatattttataaaaagtaattaatttgtgggtgaaaacagctaaccagactaaaccgaccctctgactaaaacggccagactaaacctgccagactaaactgacccggtccgtcgaaacggtcattgtcgaaaaggtattggcgaaacggtcattgttgaaatgtccagccaccgaacaaattttggtcatatcataacccgataaaaaccggtcaaaaaatgccgggttccgggccggattgcattttcaaaaacgccgggttccgggcccggcctctcaaaacccggtcaacccggattttccctaaaatcgccgggcccggtaaaacgcggtagggcttggcgcggctcggtcttagaaaaaacccgtttttaggggtaaatttaaaaaaaatatatataaaatttttcggcgcccccacaaattgtccaagccacgaattgtccaagccacgaattgtccaagccacgaattgtccaagccacgaattgtccaagccacgttttgtccaagccacgaattgtccaaaagagtaaaaacccacgaattgtccaaaagtctaaaaagctcataaaaagccggaaaacgggtctgttttaggcttttcggggtcgctgaatacgaatacgacatttatatagccccttgcctaaccctagatccactcggataagaaaaaatctcatttgtataaaatatgtgctctttttttacttcagatttttcttttcattaattgaacaaatgattcgtaataaacttgaaagtctacaaaaaagtcggaagaagcgttatttgtcagacatttcatacgcaactgaggag

SEQ ID NO: 7138 - DNA, 2786 bp, Heterodera glycines
  misc_feature (2754)..(2754): n is a, c, g, or t
aatttaaaatctaaaaagcttattaattactacaatgaatgaatgaatcccacaaataagataagcgcaaatgctaaaacaagttccgtaaaattaatcttaagctaaaataaaatttactcacttcaagaaactttctcttatcaaatgggtacattttgcatttgaataaaattattatttttggaaatgcgaatttaaaaattgtttgaaacgaaattgatattatgtttatgcatttataaatagaaattataatgcatattaattctccggaagttatctttttgaacttttgttcattattcgcagttatccccccgtcctccgcttttttcccaacgaagcgccaaatccgatggattaaatgggtgtccagcggagagagcagcaaacccccgccagttacataaattataaacgataaaagttgatgaaattttggccatggccttccaaaaaggaacgaaattatctaatttattgaggaaatttttgcttacagatgcgcgttttcgcatatcttttaaacttacctttttaatgctataaacattttttattatttttaatggcaattattgttttactcaaaaaatttctacagttttatttttacataattcacaatttttcttctattatctttcttttgaatggcgttttacttttgtttcaaacggactttttcttgcattttccttcacctttgcgtgattgactttcctttttttcaatgaaacattctcaaattcacaattttcttatcttttattgtctaattttttcttagttgacaattaataaagcaacaattaaaatttacattttaaattataaaatcttttaatatattgtttaaaaagaagcttcttctctaacaaaacccatgccaaaaaaagacaccggcagtcgcataaattgggcaaaaggcaggcctaaggcacggtgactcactaatgggaaatggaaggggggggggaggaaagaatggcattgggagcgaaagagacctttgaccacgcgggggcacgggatggatgggctgggggacttgcttattccatcaccacaccatatcactaatggggaattatgattaagaaaggaagtaaatgagggtaaatgggcgtaatgggatggatgagtgagccaatggggggcaagcaaaagcggggcggacgacggcggaagtgccggagggacagtgccgtgcggtgcatgcggtggcggtgcttcctccccctccccggcccgtcgtcctttgccattgtcccaaattccctccaaaactccgcctggggctgttttgcctttggtttccgctcgcctttcccttggccaaagtttgagaaatgctcaatttcattgtcaaatgagcaaatttggttccaagagagcttcaattccctgtaaaaacaaagatttttgtataaattctactaaattttattcaaaaaatagtcggtcggcagttggcaattatcttcgaggccctcgaaggcataaatccgaatttttcttacataatattcctctttttttctaggcgaacagttttgcctgtagaaaatgacatgagaattgtgtttgaacagaaaaaaagtttcgatttctaattttaatcaaatttcttttttgtcttcgactttgtttgtgcccaatttgaacgttttatcaaattaggaaatgcttttccattttgacaaactctaaaaattaaaatatttcacttttaaattaacccttcggctttttaatttctcattttttgaattttgtttttgtttccgccccgattgcttcgttttctgttgaaattgtcttttttcaaaaagtgcatttttatgcttttgcttccgcagaaaaaaaaacaaattaaattggaacggcgttgtaaaatgagccgcaaaagcaaatagcagcagcaaatgatgtgtggcggcaccaccgaaaacggcgttccctccccccccccccccgcggggatgaaaaaagagagccgccacagtccaaaacgcattagcaaatcgccagtggcgccaaattccaaaacgtatcctcgcggcggcgccattaacaaagcgaagcgaacaaaatgccaaatttggttgaagacggtgaatgtgatgatgcacacaaagattgccgtccctattccgatacatttattgaaaaaactgatgaaattgatcccctcgtggaataaaaaattccttgaaattttgttccaaaaaaaaattttctttcggagcattttctccatggtttgtctcaattaacaaattaatttcttcgattcgttctccgttaacttttggggatttgcgtagacattttttttgccaagcgttgatccgctgatattaaaaacgcaggggcgtaagcattgaaaaggcttctgagaatgatgagattggccaatttcccttggcatttaaaatattataaaatgaattttatggaaaagaattatttcttcttcattttttgcattgcgaggtccccaaagtcctgcacaaacacaatgccaatgtctatttatttactttttttctgctcgcttcgcaacaaaaacaaaccaaaaatccattcccaagcccaatttgggtgcctttatgcattttgtcacccaaaaagtgaaaatgaaaggcttaaaaggtcattctgtgccacaacgaccaaattgaaaaaaaataaataaaaagctgcctttgttttgttagttttcgtaaaagccgatttatttctcanattttattattttatcccattgggactctaga

SEQ ID NO: 7139 - DNA, 2798 bp, Heterodera glycines
  misc_feature (48)..(48): n is a, c, g, or t
  misc_feature (60)..(60): n is a, c, g, or t
  misc_feature (2790)..(2790): n is a, c, g, or t
tttctagaaaaaaaataattaaaatttttcaaaaaaccgtagaggggnaccatagacagnattacgaaatggtcgcatctgggttcggggttcgaggctgagacaaaataaggccggattcgtgctcggtgcctaaaattagccccaaaaataattttctcaatttttattaaaaaaattttagggaccaataatctatacctttgcccccatcactttgcttttttgtgctaatgtgcctctattattatgtgccaaatggcgcacccaattcactctaatggtaccaattgagcgttgttttgctttgcttttttcatttgtaaattttaatgccaaacaagccttgacattatgtatgatgaatattcataattgcgaagagaaatttgtaaatgaagatcaatttatgcaattaatttcctgccacagggaaaataacttttgatctttttcatactctgtcaatagtttcgctaagaaatggacatttttggattttaaattattcaaaaaactacattttatttttcaataaattcattcgccgtttcatttactttcggcaaaaaaaatgttggacagttacccgccgtatggtgccgataccgccgcggcatataggcgccggccgagcagtgccaaccattgcagtccaaagatgagcgaagtggtggaggcagtgattacagaaaagtaacacaatttaaagttttaagtgaatttaattcatttaattaacccttcctttttaagagtcagcacaagtcaaagtgccaaaaatgcgcgacgaaattcggcacagccgcgccgttgcaactcacagcggatgcttctgtccactgatcaccgcaaatcattgtgcgcggtgataggaggagcagcaattgcgcaacaattgtcagcaaaaagtgacactgatgaaaatggcaacgacagcgaaaaggacagtgagccgagaaatgccacccaaattggggagccgaacaggtgacagtgccaaaattgaactcagaaatggcaaaatgccttttttaattagtgatgccattaaaaatgcccttttggtagtacctaatttttactcgaaaatggcttaaagccttttgattgttcaaaatattttcttttaaaaatcatataaattgcatttttcaaaattaacaattatcatttgtttaattttcttatcaatacatttcttatcattcagcgtaattacataataggcacaagagaaggagcttcttttaacccctaatgatcccgtgcctttctttcctaattatagcatttatcttaaactctaattttatttctgtttttattcatatggcaaatatcatttttttgtttaattattaatatgaaattttctctcaaattttcctttgttgactttgtgatgccaaattcgccacttcatcatttgaattaatttgtcgggtgggtgacgaaaggacggggggggggcggtgccgaaaaactaattgaattattagttagtgccaaaatatgctgccaaaatatgccagcaaacaggcgatgatgatgatgatgctgctgacattcttcctccccttgttatagacccacggtggaacgaagtcagtcccaactgagtcagccgagtggcacgcgcgcgttggaacaccaattgcacgaaacggcaccccatcgacggtcgaggtgagaaaaacaaatgtctaattaatgcactaatgagccacagatttttaaataaattaattaattcatcctaaaaatggctgtatttttaggcgttcttatgacgttaatgctcagcgacgttccccgccaatgaatggcgtcgcaatgggcggcacggccggcagcaccgacccaacggcacatccgcagactcagctgaccttggtgctgatgggagcacctcgggtcagtcaagttattataaaatgcaataaaattcaattaaagactggaaattctttgaaaagtgacattttggtaaagcggggacggtccaagaagcatttctgcttggaatgggtgccatccccggacgacaatttttttttgctcttcagagcagccaaaaattttttgctctattttccatcaaattttgaggaagagggggtcccgcagtgccaataggctgcagtgagagaattttttgaaaatttggtgttgcgttttgttaaaaaaattttcaaaaatcaatttttcataaaattaattaaagtgtgtcttgaaggggctaccatcatgaaaaaggcaaaattttcaatacgaatgccttttttcattaaataaatttttattttatgcggtgtctaagcaaaagaaaatgaaattttgtataacttttattatcattattttgatttacttattttcattttcttatctgatcaggttggaaagtctgcacttgtcaaccaatttctgtgggagggctttctgcacgactaccgtcctacggtggaggagttcaactgggtggagtacggtagcgacgagccgaacagtccgcaactgttacttcaactgatcgattcgtcagggagccgcgactttttggccatgcgccacctctattaccgtataggcgatgcgtttatggtaatttgttgattaaataggtatttggttaatggatttaaataatttcatttttaggtcgtttattcggtcaatgacccgaacagttttgccgaggcacagataatgcttcgcgaaattgagcaattaaattccaaaaaagtgggatcaattttgttaattaattaattatttttgcaaaanttaattat

SEQ ID NO: 7140 - DNA, 2786 bp, Heterodera glycines
  misc_feature (29)..(29): n is a, c, g, or t
  misc_feature (2688)..(2688): n is a, c, g, or t
gggggggggggggggggggagggacaacncgatatcctggtccaatggtcgccaaagtgccgatgaaaaagataagtgccaatgccaacaacggacaatttgtgtttttcccttttttttcgccgcccgtctctgtcgatgataggggtcaccagtaaaacggcaacaacagaagtgagtccactgccccacagctcacacccattcgccaatccgatccctcccaaaaataatcgtcgaatgttcggatgaatcatcgtccgacggcgggcggcgggtcaccggtccaatgaatgggttcactcactcaaatattcgccattttatacgttacattacccccattcccacaccctttctatccgagcaaatgagtggggcgggggagaggggagggaggggtctcccatatgtgaaaagaaaaaagatccccctccccggacccgcataatcattatctctttggcatgaacagtgccgggtcaatgattgctccctccattcaaatattgcacgcgaacgcctccaatttatcatttacggcaaaacgataaaactatgccgataattaaaagtgagaattgtcagtatatcaaatttctttttgatttttccagcgtattgagagaataaagtgcatagttatcaataaaatattaattaccccctcgccccttctttacaagcgacgtccgattataaaatttaaatagattttgggtgagaaaaaaacctttcatggcttaatactagcatatttttatttccatatattttcaaaaaatgaataaagaataacaaaaatttttatttttaaaatgagtgaactcataagggaattttatggctattaaaattaaccaattaaaataataattggtatttacttagggtgtaacataagtttccgcacaactttttttaaagaatttttttatgaatataaatttaaaaaaccacaatcatgatccgaaatatctgacattattattgagaatgagtttgctatttatcgggcaagggataaatcccattagaaaagtatttaaggagttagagttgataatgtaaaaatggtcattttcgaggtatgtatttttgatggctgatttaaagaaaatgaaaagagatacagaggcagagaaaacgtgagtaaatagagcaaagttaggactataaaaaattataagaaaaaaattttattacttcaaaaatgaattattggagggccgagtctaaaaatggtctccaaaaaacggcatttttcaagaccatcaaataacaaaatgttttaaaagtggttttggaaattccgaatttaccacgctgagtccgaatatggctttagatttggtctctgggttctcaacaaacctgtacagctccaacttcatgcatggagttggagcagtacaagctcagggttaaaagataggtcagatttaaggccatattcggattctactggtctaatttgtacagaaaaccttctttttttgttatatcaggttacttttttgaccataaaaaaatcgagaaaaattagtgggccaattttcaatttttgcatggtcgggaaaaaatactaaaaaattgaataagcaaataaaaaatgaaacaatggcatgaaatgaaagaagactttctgacgaacaaaattaaaaaagaattattaaaataactgcagaaattacggagttatgaatttttgaatttgtcaaaaaaaattgtgcggaaacttatgttacaccctaagtaattgaattcctttatgagattggaatttaagcccgagggcagaaatgaaagaacgaataaatttcacacacatttgctgatgaagtattttgaacagcccgcactggccataatttggtaaattaaaaaaaaatatttgactgttttcattttaaaaaaataaaaggtatttcctccatgatctttttttttgattgatcagtgcaaaggctgttcaaaagttcaaaaatgtgaaaaagtgataaaaagagacaaagttgatgatcaattattaattatgaagagatgtacaataaataatccaataattctgattagagaagtgacccgtgtttattttgacaagaaaaagaagaaaggtacggtatacttgcagcaatggtatgctgagtacggtagtacaactgcaactgcccaaagtctacaacaaaaagaggctgtccaacaattgaaagtattaagagcaaatttggaagaatgttcccaatttgggcgtatccaaatttggcagttttccaagaagtccaacacttcatctttccaagtacatattgctccgatttgtcgttctctttttattctccgagtactgctccaactcgtcgtcattcagtctctttccctttccgtcatacgtcgtgcattttggccccctctttgtgaaccatgaaattgtcccacaatttcttggccaaatcgtagcaggccaattcgcccgcgtgcgtggccaccattcgcagcagaaaaacgccgtcctgacgaagaaaatggaaaacaaagcgccgcagagactgcgagtcgaccattttgtacccttcgatgcccgtcaaatatttgccgacaaaattaagttgccttaacaaaaatggaaaatgaaaatggcataattttgatggaattttggtattaaattgaaattgtttttgattnttattcaaaattctcaactgactgaccggcttggcataacggagatgaaaatcaatagaaaagtgagcaaaccgtggcagcggcaagcaaaagtacca

SEQ ID NO: 7141 - DNA, 473 bp, Heterodera glycines
tcataactttttgtagaagcatccaaattaaacaatcttaggcagcctaagtttcctctattttcctataaaatttcaaaaaatttggttgtgtttcaaaaaagttgtggcttgtaaatttcataaattgatttggtaaacctttttgaccacaacttctttgaaactaaacgaaattttttgaaattttacaggcaaatagaggctacttaggactatcaaatgataccaagattgtttaatttggatgcttctacaaaaagttatggtgaatgaaatttatcaaaatattacatggtagtgtctttttttgtggtcgtgtaagctgaaacagaacccaatatagttattattattattagtttattattcaattataaatttaaataattaattaatcattagaataactcttccgtactgaaatgaccccatccctctgaaagtaaaacactgatatttttgtcagttcg

SEQ ID NO: 7142 - DNA, 1686 bp, Heterodera glycines
tcattcagaggcagaaaataggtgctctgaattccatttaaatagccatcttatgctattcaattatttgctacctgtacaaaacagtaattctccgtgtactgctccatcggctcggtgaaagtggcgggcacccaacattgaatggggttgcctaatgagggcaattacaaaaaatcattaaaagcgaagagtaaccaaccaaccgaggtattctttggaggagacgagaatggcgaaaactgaaaatgaacccaataataatttaacaattacaaaataggcgatgcttttaatgtcttcccattttatatttattttcctattaattaccctctaatatttcatttttttctccatttcccttttcaacgcaataaaacactttctccatttccctcagttttctgctaatgacgagttcgtgtgatcttttcagcaaaagcttttatttgtattgcccgggcgatgcttttgctcatttcctatggccaacaaataagttgcttcatccctctgcttcatccccccccaattcattagccttccgtccgtcggttgtcgccctactcaaacattctcctctccctcaccattcattcacaatgctcttttccatgcctatgatgggacacgctccttaagggcttcagttggtgtgacccacccaattccgttgggaatgaatccgaattaattagcgggggggggggaaacgatggcatgaattgggtagctgaaaatggcacatcaatgtgttatgacaaaaattatataatgtaaaataacattactgacttatagggtgtattcaccggtaaaatggtaattaagcgcttattgtgccttttggcaatttgacactttttgacaatgattttgtgctaattttcccctcaaaagtccattttacgctctttttacccctcccgcgcacaattaccaattataattgccgttgtgtaataataattcaatttgtcgattatgtcgtcgtccacatggaattggatggactttaccgcactggcgaaatagtacaacaacatgttggggctgcccttcttcgccagctttgcactgtcgatgcacgacgacggactccgacggtgcggcgaggcctaagccgtggggacaatgtgacggagggggggggaaggcacggcacaatgcaaacgaagccgaaatggaagcggaggagcaatcaaaatcaccagcggacgacgaaagggcaaacggaaattagggaaaagggggatcaattaaaggcatcttcaaattagaaattcaattattaaattaagcataatcaattggaaatatttctatttaaaacaattgtgataatttaaaaataaaaaacaaattgacataaatacaaataaataacaaaagaccaaaattgcgctaaatgaaaatggctgagctgctaaatccccacgtcccttaaaaatggaaaagcatttaatcaatttagaaatggttaaatgataagcgattactttccccacccaatgatttttaaatggcaaatgccttttgtgcggtgtctgtcgccagctgcgaccgaaatttcaaagaatttcaataaaaaagacctttgtagtttcccggaaatcacctcaaatgaatgctttgctttgtaccgttccaattcctcagcttctcttttttttgtccgtttgt

SEQ ID NO: 7143 - DNA, 800 bp, Heterodera glycines
ggaaggttgtgtagggtggggtgcggttgttttgtgatattgcgtgttaataattaattatagtgagaaaaatggcaagcttttaaatgatgtaagaattgttgggtagggaagccgaagagaacaaaaagaggcgatcgacccaaaggcaattaaaaaaggcattggcattttgaaaaaaaatatatttccacttttttagggcctaaagttcgttaggcaaacccatactaaaaaagtgatgacaatgtgtagttttgctcagatttccgcctcagttccaccggcaaaataacgtgtgttaatgtattattcggtgtatgcccccggggaaaagacaaattggcactttgtttggtttgcccgccaccttcgccggcattggcattgtgccgttgtcggcggtgggcgctgaccgtcgccttggcacacaaaatgcaaccaaagcaaaagcactttgaaggtgttgggccaagcaaattgtgaagccgtggaaaagttgcgaaattgtatttttatattttcaatggaaaaagtaaaaattaatactaatcattgggcaattaatacccaaaaaataatttaatgagtgttttcattgatttaaatttgagttcttactttttggtcgagtaagctgagatgagacttaaaagaaaggccaaaattgcaattcaacaaatgccaaaaacttaaatgagtgagtgaatgagtgactctgactttgtgttttgtgccgacggaaaaagtcggcggttcagcggatggcatccgttgcattttatttgttcggtttgtct

SEQ ID NO: 7144 - DNA, 741 bp, Heterodera glycines
acagtcgtaatattcggtatttaccttatcctccaggccttgttttctgcgctcgtcaaaaatgtcgtagtaaactttccctggaaaaaaacatttgcgtaataacacgccaaaaagttttatattaataacaattttactcttgattgatcaatcaacgctttcttaccggaacagaagacgagtcgctccacggccgccgggttgttgctggcactgccctcctcggggatggcacggcgaaacgatgtgccgggcaaaaagtcgtccaccggcgatttggccaacggatggcggagcagagactggaaattttaattaatcaatttcaaaaaagcgttagaaataacaaaaatcactcaaataaatggattttaattaaacaaaaaatgtttttttttaaatttctttttatgcacacgcactttgggcgtgaacacaatcaacggcttgcggaatggcgaatgaatttgccgacgcaacagatggaagaagttggccggtgttgtgcagttggccacaatccaattggtctcgttcagctgacgggccacaaatgcctcgtccaaagcgacactctgaatttttttttaaacttttcgttaaattccatttttcacaccttcaagtcgatgccatcgtcttcgttgcacatttgcaggaaacgctctgaaatgtttttttaattggaggaaatttgtggacaatgtttttgtattccttaaaacagtgctaattgtg

SEQ ID NO: 7145 - DNA, 2946 bp, Heterodera glycines
aggtacagaaatggactgaccaatggagttgttggttgaccacggagtagccatactcgaagcctagcacagcgtacttagtcaacggcgaattgcacaccgtgtactccgcttgggtctggcatagaaaaaagtttaatgagaaaacaatgtccggaaccaacctcggaaaggtcgttgagagggttgtacgttttttggtcaatcagctgatcatggagcgcatgatggcgatgggagaaggcgccacgctcaacatcctgaccagacaaccgcacgtgaattcctggcacaatttaagtcggaatttaccccaaaaagaacccaataaaaacacaccttccatcaacaacgacccgaacgccaacgactcgccaatggaccagtccaaattgttttcgctcagcatttcttttcggcctacaaaaaaaaatgctgaatttgagcccaccaacatacctttgagcagtcggagcagtctcgggtacaggttgaacccgtcgggcacttgcgagattttgttcacaatgtgctccagcgagtcgcgctcaatgccggtgggcaacaattgggatgggattttgccgtcgtacaacggcgtgtccgaccagttccggttgcacagctcggtcacctgcttggcactctcgtgcgctttctccagaatggcgccgtagttcttcaattctttgtccacatattcctggggcaatatgaattttttgattcaaatatatgggaaccctcacaatcaaagagttatgtaccaggattttgggttggagttttagggggagttaaaaaaaatttacgagttggccaacgggtttcaccctcccctcgtgaggagtccaagggggtataattaggaatcacaaatttttaaactaaatttataaaagacaagtatgtcaaactgggcattttcgagtgtgaaaaggccaccaaacccggaaaagtgtccaatccaatttggccctgataaaaatcgaattttccctaagaaaaattaaaaacacagtgaaatgccaataatgtgcctggtcagcgatgccttccgccaaaatcttctcctggtactggtccaacaacggctttgtctgtcgaatgcgctggtacatcaacggctgcatgaacatcggcatgtccaattcgttgtgcccgtgacgaaggtagcacaccaagtcaatgatcacgtccttcttgaactcctttgcgccactgggccgcaacatcgcacacctacggaatttttttaaggatacaaatcaactcgaaaatttaataaagcaaaaacatttgaaatagatcgcaaagaaattcagtgaaaaatttttaaaaaatttcaaaaaatgagatttgtggtttgtggagccataaaagggaggctcttaagcagttcacttctcataattgtttattagtgtaataatcccaaaaatattattttctgaaatgcttcttacacgcatcaccgcctccgggtcgtccgcattgacatggaagatcggaatgcgcatgactcggccgacatccgtgcagtagggcgaagagcgcgaggcgcgcgggtccgtggcgaagccgatttggttgttgaccacaatgtgaatggtgccgtcgatggaatagtggggcaggtctttgaggttgaacgtctccatcaccaggttctggccggagaaggaggcgtcaccgtgaagcaccagcgccttttttggggaagggaggggaaattggcgatggcgacaatgaatttaaaggatttcaatataaaaaattcaaatcaatacgaaactaaaaatgattttaaaagttaataacgatttttttaaaacttacaatttttccgaaaatgtttaagatattcaatacggtcagatttctataacctattggatttgctaatgaacagtccaaattttatcagtctaaattcataatcaaagaaaaattggcgaaaattcaaaaaattcgcatttttgttgaagaaattttctacacaaaagacaattgctaatcaaactcaccatgtgacggtcacagtgcaaatcgttgctgtaaaatgcctcagcacggactttgccctgaacaaccgggtcgacagctaaacaatttataaattttcgtcgaaaatccaaattttcaatgcctaaccctccaaatatgacgaatttgcaaccaacgcaattttgatcatgcgctgcgattggcgattcagccgttcaatgcacacgcccaaatggtatttgacatcgcgggagccctcgtccattagcttcaacgtgttgaacagggccaaaacggtgctcaacggttgctggcacacattggcgagcacattcagacgaccacgatgcggcatgccaaggctggaagggatttttgttttatatgaataatttttggaaaattatttgttttatagttaattgaatctttatagtcaattaaatcacgacaaataaatgcttgatattttataaaaaaatttttaccgaattttagacaaaatgtgttttttgttcttaatttaagggaaaaaagacagaaaagaggtggagggggggggggggggtcgccggcgaagggaaaaagagaggcaattttcttaacaaaatatccctcccaaaaaactcacacaatgttgttaacaccgagctcgtgcgagcagtcgatgacctgttcgatggccggcaccaacacttcgcaaccctcgagaccgaaacgcttttcgctgggccatttcttggccaaaaagtcctcaaactttgtggagcggatcagccgttcgaaaagcacctaaaatgggggaccaatttttaaattattccattttttcacccacttttttctgctcccgtggtaattctgtgacttcgggcgcctcaaaatggtttcggatccaatcctgctgctcgtcgtttgtcaaatgcatgtactcaacgc

SEQ ID NO: 7146 - DNA, 2509 bp, Heterodera glycines
ttgctaatgaaaaaaagagggtatattaggatgacaaatatatatatatatatgtttcagtatgttatacaattcaatacacaaatatgcatacgatcaaatattaaagttcatcggcaaatttacaatgaatatatttcatccacaatatattttcatcttccgcttggattgcgcatgacttccttctcatccctcctcattcgttttgccatcagttcggcgagcagtgcgggtcaaaaaattgttgaaaattaaaatttcaataaaaaaacgaaaaatcctcaaaaactctacccaatgtcgctgtcctggatgttgatgcacagcatagtgtccaaagtatggtttgcgtcccactcccacttcgccactgtgcgccgatccgtgccgctccgctggcgtacaaccacagcctccacgggcacacgccaacgcagcgtcagccactcgcccgttcgttcattctcccgctcaacgacctcgatgttgcgacgcgatgcccgatgacaaacgacgacgtagttgaccgcaatggcactcggcgcttcgaaatactggaaaaattgaaaaaattacaacaaaaaaaaaattggaatcggaaaaacgcaaaaaaaaaaaaaaatttccgaccgaccgttcgcaggctcgacgtgagcgtagaccaatgcgcgcgtcgccacttgcgaatagtcaaaattttcggactgccatctgggagtggtgtgtgcagccatcgtaacagttgatgcttcggcttctcattgaaagtaacttccaggtcgacgcacctgtgcgaaaaatgggggaaatttttgaaaatttgcaaaaaaatttcgccacgaccaaatgtagatggcacggaagccaatcacgccgtttggtgcagaacacttggcaagcggcagtggcttcatcaacgggtggtcgtccataacggtgacagtcgccgtgccgccccagtcccatccgcttggtgcccgatgaatacccagctcgcccagcttccatttgcgcagtttgaaatgcgtggccaccagcctgccgaagcgcgcgtcgatcagtgcaaaacttcgtgcccacctcagtgcggtcaatccaaaacagagtgtccagccaaacgtcgtttgccatgcggctactgaaaatagaaaatccgaactgttgatgcatagcagtgtccaatattcgatttgcctcccacttccacttcgccactgtgcgctgatcagtgccgttccgctggcgtacaatcacggcatgtgcagtgacttgcgcattcggcgtcagccgctcgtccgtctcttcattctcccgttccatcttctggaagttggtattgcatgcaatgtgacaaatgacgaggaagttgacagggacggcactcggagcgatgaaaaactgaaaattgattgaaattcaaaaaaaaatggaatcaaaaaatgcaaatatacggttttacgcgtcccatgaatgactatcatcctcagtttctttgggcatatcttttttcatacttggtcaatgcctatattcttggtatcaaacgaaagcttaaagtctacagaagcttttgtataactaaattctcggctaaaagcaatagacaaaaaattattcttgaaaatactcgaaaaaccttgaatttcatgttttctcattgtaatttattttctaatgcaagtaattgctgttttcttggatttataagatcccgagagttcaagcttttgattggtaccaagaatataagcattgaccaattaagaaaaaagttatggcctaagaaactgtggatggcatgggacgcgtaaaatcgattagaaaaatgaaaaaaatggaagcaaaaaatgccgtaaaatctttcggaccgtgatcaagcttggcatgaacgaagcccattgcggtttgcgccacttgcgaatggtcacaattttcggacggccatccttgcgcggtgtgtgcagccagcggaacaggttgtgcttcggcttctcatcgaactcgtccggcgggttgagcagggcattgatgtgcacagcgctgggcggcggtcggatggggaacatgtgcgtattggtgatggcacgaaggttagcacagtcgaacagcacattgggcgacacatggcgaggcaacgtgcagcgtggtgccggcgtgcgcgatcagtggccaattgcgttgggacatcagtgcccagcagcggacatccttcgaatggatggtgaactgcaaagcggtgccgaggttgatgacacgttgcaggcactgcagaaatgcgatcatttccagggcgacgtaactgtgtgaaaattgggggaaattttaaaatttgcaaatttattcgccaagaccaaaagtgtagatggcacggaagccaatcagacaagtggcaagcagaagtcgattcatcaacgggtggtcccataacggtgacagccgccgttccgcccctgtcccatccgcttggtgcacgatgaacgcccaactcgcccagcctccacttgcg

SEQ ID NO: 7147 - DNA, 2334 bp, Heterodera glycines
  misc_feature (2320)..(2320): n is a, c, g, or t
ccttcccttggatgatatggcacattatcagagccatacagctcgttaatgtgccataaaatgcgctttttttcataattgatggataaatcaggcagaacaaatgtgcgattgttcataagccatgactcagcatacaggcacacgaagtacccacaactattaccatcgtgttggaccgtcagattttcgacatcaacaatccctgtcaacactgctgacggcaaaatatccgaaatgatatttttaattttatccgtcagttgcggatccaacctgccatatgtggtaggcaaagaatcggcaaaatgagtgccaaattgcacatcatggacaatgagagtccaatgtccagggaaatgtactggcaaaagtataacttctgccggaacattagggtcgtacccaaatgtcatatttttgtaaggcatgactctgtccaggccattgctccataccattgggtcaacaacgaccacttttcgttgtgatatggttgccaagtatgccaagtatgtggcagcaaagccgtcattgagaaactgggtcatatcattccaacaggtctcaatgtatcttgggccagatcttggggcaatcggtgtttcgccatcacgttcgtaaaggccgattgctgcccatttccaaattttacaggcaaaatttcgcgatgtggcgaaattaatttgcacagagctgaaatcaattttttcaaacacaatgtgcgagggtgccggacttagagcgttttccacactttggtccatttcagagcatttgctcatagactcgttggttttgcctcttcctttaccggcatgccctcccagttgcttaactggtcgccctccacgactttgagtcgaaacaggcgttgaagcaatagcttcatttgcaaacgtgggtttgtcacactcagtgacctttcccctttttttgcacggcgaaccttggtcactttgggtgacagcagttcgaggtgtgccaattgaggacacagtttcttgcgttgccaaaattggcttcgctcctgctttcaagggtcttcccctttttttacttccaatggaagaagcaggcgtgcttatttgcaaagcacttaaacttggggtggtggtgccccggagagatgctgatgcctcaccattcccatctgcactcccgactgagacgggtgaggtatcccgactgacagatttctccgtccgccgctgataacgctcttgctcattttttcgcaaatttcgttgcttagaaggcatctgaaacaacaaatcagaaaagtttgcaaatgtggcaaaaatatgaggtaattaaccaataaatgcacacagacgttaaaactttattaacaaaaatgcacaaataaagatcaaagacatcattcttcgccgtgaagtgtagtcgtcctgtgctgaaatccatcagccagggctcacacatcccattaagaatgcagatccaaaagttggtgcgacacgttccacgaagggatgtcagcgaaccgcttaggtgcgactcatgccagtctgcgaaccacattggtgcgacaatgctccgaagggcctgtctgcgaaccacattggtgcgacaatgcccgtagggcctgtctgcgaaccacattggtgcgacaatgccccgaagggtctgtctgcgaaccacattggtgcgacaatgccccgaagggcctgtctgcgaaccacattggtgcgactatgccccgaagggcctgtctgcgaaccacattggtgcgactatggcccgaagggcctgtctgcgaaccacattggtgcgacaatgccccgaagggcctgtctgcgaaccgctttggtgcgacacatgccccgaagagccagtcagcgaaccgctttggtgcgacacatgccccgaagggccagtcagcgaaccgctttggtgcgacaaatgccccgaagggcatgtcagcgaaccgctttggtgcgacacatgccccgaagggccagtcagcgaaccgctttggtgcgacaaatgccccgaagggcatgtcagcgaaccacatatattgtcctttgtttgttccattctctgaatagccaggggcagggaactcctaacgacagacgctttgctgttgatcggaggacaatcccaccgtagccaacctcctgtttacaaaatgggaccttcgaacaattagcattgctaagtaatcaaagaacaatcctttttgcaaacattcagctgggatacaaggccagaaaaaggcgcttccattgggcagcccagccacatgcatcgcaaaggcgagtgcaagtctgagcttgatttccatacagtcttnagcagattgtatgt

SEQ ID NO: 7148 - DNA, 3368 bp, Heterodera glycines
ccttgaaaaaattcaatttttgaattttttttaatttttgttgcgagattttgtcccggcgagatttcggcggcgaattttggggtttacccatattatggaattatttcaattttctgtaatttatacgtaaaaattatgtaacagtaaaacactaaaaaacctgacactaacaaaaataaataaataaattatgaattcggaaaaaattttaattcgcgcaatttttggaatctataaaaattatgtgcatataaactccttaaaaatgagtctaatttgaacttaaaaacccatcacatgcttaatgatcaccatttttgttgttttgtccgtcactcattgtcagaagacggcccatttgtgatgctttgttccgcttcttgttcttctgttggtggtggcggagaaaatggccttaattaatcgcaatttaattatttcagtaaaaccaaatccctttttatgttttctttgctttggcaagtgtcagcttttcctttgtctattcgttcacaaatcaattggaactatttgcattgacggcgcatgtacagaaaaataattttgtaactgacgaaagaaatggtggtggcaccaaaccccccaccattagagtttttacacatttttgaaaatagttaaatttctaaacaatttaaacaaaaaaaatcagtaatttgccgaaaatatgggccacctcttgaaactgttgacccaatcagggttcctttgttcgttcaaaaacgcaattgcttgggttggccatctttgatcgatgagaattgacggtgaaatgagacgacgcaaatagtccaacgaccaccatcgacaaagcccaagtggcgaatgtttgacacaaaaattggctatatttcacgagcaaaaatgtcccaaatcggctggcgaatccacaaatgtaattcagtgcctcttttgtcgaaaatttggtgatttgaacgaagaaagccatgacagagtgatcaatgtacctaaaatggatggaatgcttttattcccatataaaagtttctttggctcttgtggagtttaggcccaatactgtaaatttagttgaaaacgaaatttgatttttaccaaatttgagtttggggttcgaaatgagtcgaaacggaaattcagagcgaattttgttggacaacggatggtcgggcaatggaaatggcacagaattgacagcgccgataatcacaaataattccgataatcacaaataattgtggtgccgttgttctgacactgaccttgcgacgaatttcgattgctctccaaattgtcaattcgctctcgtcatcaacatgtttgtccacaaacgcattgaaacgtggcgaaagcaatgccaatttgaggccgagttgaagacggtcaaaaaaggaaatgttcatcaaatgtcgttgcacaacgcgcatctgaaattgtgaaaaaataaaaaattgttgaaaaatttcaaagaaaaatgttcacgttttttggtctaaaaatgatttaaattatcgtttaattaagcactgatggatgctttcagttcgttactatgatttaaacaaaattaacaaatatgtgaaaaccgaaaaattttaatttcttttcttttttgcccataataacttttccactgacaaaaaagttgagttaatcaataacgcacaccatttcaaacatgaaaatgtgaataaacagatggagtataaaaaaaatacaaattatggacaaaaaatttatcgaaaggataaaaacatatttaaataagagtttaaacattaaaaatttattgacaattttcatatttaaatgattaatttaaaattaataagatgaaataaataatccaaaaatacatagaaaataaataatatacatcgtccggatttgaactttacaacagtgattagaataggtataaaagtgattagatgaggtataacagtgattaatttgaaatgtacatgaattatatatacatttaattgaaattaattttttgacaaattctaattaaaaaacaaatgaattctttaatttaaaaagaaataaataatcaattttaaatgtcaaacatttattcatcacaaaaaaaaaattttaattcaaaatttaaaaatttttgtattattaataaaacaaaaaactattttcaattaaataaaagcatttaactactcacttttacaaaaaaaaagtcaaaaaaacttgccgaaattggaattgtcatcaaaatgtttgtccaccagagctcattgaaacgttgcaaaagcagtgccaatttgaggccgagttgagaacattcaaaaaaggggaaaatgtccaaccaaacattgttgcgcgattgctgaaaatgttacgaaaaatcttctaattgcaaaaaacaaaaaaaaagcaaaaaaactaaaaatgggcactttacaacaaaaaaataaatttgaaaaaattttattttcaggggttttgcagtgattactgatcaaacacgtaaccaaaaaataagggtcttgaatttgccgagttttattaagtttattttagtgattaaaagaggtacaaaaatgatttgaagaggtacaatattgattagaagaggtacaataaatggtagaagaggtaaaatagtgattagaagaggtacaatttgtaaattcattaaattaaaatgaaaatattttttaacaaatttaattaaaaaatacatgaaattctatcaattaaaaaataattaatttaaacttataaaatgtattcatcaaaaaaaaaattaatttaaatataattttttatttattaactcaacaaaatattttaaattaattaaaatcattgaaaataacgtaaaaatgcacagaaaaataatgttacaccgtccggactcgaactttgcccccccccaaaaatgatgcctcagaatccccaatcacacagggattctgaggtcttgactatgtcaaaagtaaaatctgatcacgtattcgtgatcagcggcccaaataacccctaaagacatgtttttggaagatttttggtgaaaaaatttttcaactcaaaaatcctatgctcacccctttggtcccgaatctcaaactcacttttatttttataaaaattcttaaaaaagtgataaaaatgccaaataaaatttatataatagagcaaaaaactgcggatttttgtagtattttatttttccagaatatcttttcagaaccgagttatgaatttttttctgaaaattcgaatttttccagaaattctggaataacttttttccttttttagatagaaattccaaataaagtcaataaaattctcctgatttttctctatttttaaggctttattcgagtaaaattgatcaa

SEQ ID NO: 7149 - DNA, 1408 bp, Heterodera glycines
atttcgcatccctttttcaggtacattgatcactcagttatctcatttctccgctccaataaacatatttgggacgggggcattaaaatggacgtgcgcatgtgcgcggacggggcctttgggatgtttttgcccgtgaaatttggcccatttttgcgtcaaatattcgccatttgcaatttcccgatggttatcatttcgtcagattgtgtcgtcgcatttcgcctacaattttcaccggtctcaacattagtacaatcaattccggtcgcttggcactcgacatttttggtgaaaatgggccaattgcaactgctgaaaaagtgttgtccaaatggttgcacactccgaccaccgacgggcagccgaagcgattgttttgggaagattatactgctggatggagaacaaaagattgggaatcaaagttgaggaaggtcggcacatttatttttaaaaaatttctgggaatataagttgagaaaggtcggcactagggattagagctcggcattttgaaaaaagcctgacccggatttcctggacaaaaatccaggtccaggaaaaattcaggcctggagccaggtcgagctctactagggatgatattttaagctctataaaacaccaaaataggtaggctttaggctctaaaaaaccccaaaactaggctccaaagaatggaaaataggcggggtgtgtaaaatgacaaaatttattcaaaaaagttaaaaaattagggaaaacagtattgagctaaaaaaattttaaaatcaaaattcttgtcaagaaatttttgagaaaatcttaattagttcagttgattcttaggggtgtatttttcgtttttattgcattttttaacaaattttggacaaaacgccaaaataggaaaaaataggctctttcaaatttttttaggctttttacgttctaaaaaaaagcctagaaaataggcattaatacctaactagaaaagtagcaacagcccaaaaaaacatgtttttcgtgcgtttcaggccagggggagctcaggaaaaaataggcttttgcctaaaaaatatcatccctattcgtcggtacatttattttgaaaaatatttcccattgtaaatcactgcttgccaattttgcaaagatccgatggtgatcggaagagtttcggatgtccaatttgcaagagctagccatgtttagaaaacagataggcaagccaaataatacctaactcgagaaaaagttataagccgggtccgttagtcaccgcttttcaaactaatgctagcggaccaggcatatcaagcaaattgcgtttggttgacgatgaaaaaattaacgtgggggggggggggggggtggtccgaaaatttacctccttaaagctccaagagctcgactgagtttttcc

SEQ ID NO: 7150 - DNA, 1637 bp, Heterodera glycines
aattagtgaaaaggcggcgaatcaatgggaagacgaaaatttggacgatttgaatgccgtgagcattgatttgaatgatcacaatttcattgggtgagcaacgacggcatttgctgcgacttttgtcaaatccaataaaaattgtggcactcaatttaggccattatcaccaccaccagcagcagaagaagaagaagcgggtcaaagcaactgaaaggtcggcgggagacaacggccaacccgaaagatatacatacgactccttaagaattctctagtagcctgctacaaaatttcaaaaaatgtagttattaaatttcaaaaatgatgtccaaaaaggttcgaaaaatagaaaaatttacttaacgctattgaatgcaaaatttgcttctttttgagttatgtagctaatgaatatttttaattgttaaaaccgccgaaaacaaattttatatgttattaaaatatattaaaacatcaagccgcttaaactgttgattttccaaaattcccttaggtagtcaaagttacggatcgccaattgatcattggaaaagaaatgaatgaattatttgagaaatgtccgatcgatttaaatgattatttgtcgattttctcctttgatttgacggattttcattcgaaattcatcataaatttctaaaaatattcttatttgttcggataaacagaaatttgcatctgttgtatattttgacattttttgtcgatttttttcttaaatttatcgaaatttttaagcgaaatttggcataaatttcaaaacaaaaaaaaatatgcaattaaatagtaattttggtacttttccgttttgggcctacacctcaaaatttaaaaaaatgtgctgaaggacagctgaagggatactttttgtaccattctcatagcataaattagtgtagcgaacaaggattacatgacattgcgccgcggacattttgtattgttttgttgcattttttaaaatttttaggtgtaggcccaaaacggaaaattactgtaattttctcttgctcaattggcacaaaatgaattgccgatggtaataaaaatttcaaatttttcatttaccctaaattcattttcctcgcatttgagttggatttgcaacgacgtttggatggacattctcccatcttttgaccatgctcaactcggactcaaaatggcactgctttctccacgttttgatgcgttggtggacaaacatttcgatggcaaaagcgaattgacaatttggagaccaatcacaatttgcaaagatgctgttgcagcagtgccgaacttagctgtgcttatcgaccaaggcaattcagacaatttcgtgccatttccattgcccaaccattcgctgcccaacaaaattcgctttaacaacctttggattgagtaatacaaacacaaataaaaagcaattaatttgtcactcacttttcaggtacattgaccattctgtgatcgcttttcttcgtgccaatcaacaaattttcgacaaaggcactcatttgggtttatatgttcgttctgtaaacatctttaatacccagtcaatttgggatgttttggtccgacaaatttggcccatttttgcgccaaacattcgtcatttgggcttt

SEQ ID NO: 7151 - DNA, 3122 bp, Heterodera glycines
attgaggcacatacctggtttgtatccccctttttggtcaaatttttcaaaagcgtaaccagacagtcagacagtgcactatttccttcttttcttccgcatagccactggagaaaggaagaaatagtgcactcccaattagtaccaagttaagtataaaaaacatcgagtgcaactacaacaaaaacttgagcgcttacaatagtccaatttctttgcagcttcaacagcgtgcttctcagttgtcatttgtccaacagtcaattgatcaagtgctgcttcaaggccaattgcccgctcgttctgttgcgattgattacgctttgaagcggtatgaaatgaaaacaaactgattggaacagacattcttaccgatccatggaattatagggtcgaatttaatcaaattatgggtttaaatgttggtgtatatttgttcaaaaattaataatgattgaattaccaaatttcagcgccagcgaactgctgctctctttgcaggcggttgaattagtgatcatttggacaatttgcttcgtctcaatccgtgccatcacttccaccagctacgaaattcaatttcttgatcaagcatcaacattaattgtgccatttgaattgatgaacggacgaaccaacgaaaagctgacactgatcaaagcaaacgaaaataaaccggacaaccggtggataatgaaacggtgccaaattggggagacgaaggcggttcagtgggaggaagaaaattgggaccatttgaacaacatcatcattaatttgttggatgtcttctgcagtgggtgagcaacaacaaaacaaaaagcatttttgttttgtttaaaaaatcaaattgcgcttaatttaggccattgtctccgccagaacaacaacagtgatcactgatgatcagcagaggaaatgaatgaatgaattaattaattgagaaatgatcgatcataattcagcagtgctaataatgtattttataaagaaaagtcgtaaatatgtgtatgttaatgaattggagatataaaaaatggcaaaaaatgatagagataatttttttagttctaaaagttccgcgagatccgcaattttatccccgggaaaatcctcattataaaaaaaatctgcgcaaccccgatcccgctcagctctaggagaaaggtccgcctgttcccaaatcgccagataaattcggatatttcacacagaaatgtcagttattcttacaataaaatctgattttagacgaaaattatttcataacatcatttgtaagacagcaaaatgttcgactggaaaagaaaatgaataatcgaattttgaggaaaatgtaattaattattgattaaaaatttatgaatttaattgtaaaggctctcaaaatatttttcgccgaatttcagttggatttgcagcgatgttttgatggacattctgcccttttttgaccatgcccaactcggcctcaaattggcactgatttcgccacgtttcaacgttttagtggacacgcatttcaatggcaaaagcgaattgaaaattaggaaaccaatgaaaattgaaaacgagaacatagaacaatggtggagaccaacccaaattcacgagaaggacatgggaccaaagcctagactactttccaattggaaaactgttgcatttccatcgtccgaccgtccgctgccgaacaaaattagctttaagtgtcttcaagtcgagtaattaaaaataacagctttatatggcaataaacacatcatcccatccccgtttcagttacattgactagagtagagcgggaccgggaccgggccgggaattcccggtcctccgaggtcccggttcccggtcccgggttttgaaaagctcaggtcccggtcccggtagggcaaccgggaaccgggaaaaacaagcactggtaagaatgggggtctgagtgaaaaattagtgaagaaaattggagtcaaagggaaaaataaaaaataataattaatatattctttaaaagtaacactcaccaagtgtgcaaatggcctaatggctagtctccttgactttcctttcttctttcccatggttcaatccctctacagaaattagattattttcaattttttttgtatactcgtgggtttcctataaagaaaatatgattcctcatagttttttttaaattgatacatattttatcattttttaaatgaaaatcctaccaattgagcttaataatcgcaaaaaccaaccttttttttgttgaaaatctgttaacaaattgcacccaaatttttaaaattcccccccggcggcgcctatcggcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattaaataaaaaaccaaataattttgtattaatttcacttgatataaattaaaatttgaatttttttttaaatttttaaaatttttttgaatttttaaaatttcccggttggtcccggtttttcttgcggtcccggtcccggtcccgaaaaaaaatcgaggtcacggtcccggcttctcaggtcccggcaagtcccggtcccggttttggcaaaaattaccggtcccgtggcactctagggataaccaattggaaaatgcgccaaaacttgtgatttttgacaggcgttgttccaaaataaagtaaatgttgttgtttgttcgagttcagctgggccttcgtttaagcagtggtttttcaaaaaaggcaattccgattaaagtggggaagggacgaaccgggaaaagcattggaatgaatgggagtgaatccaattgttgcttccacgaaatatgtcaaaaatgccatttaaattttattatttttctcggtggctcgcctattaaaaccatcggattttccttcgcttttgaaattttaaaatgttcaaattctcttttacctgatgaatttaaggtaacaattttgtttattatagtcaatgttttatattttagttttatatgtat

SEQ ID NO: 7152 - DNA, 2886 bp, Heterodera glycines
caccaatatcaaaagcccacttaagcatcccaacgctttctcacacagcgttgcgatgaatctcctaaacggaatgccaagcccttggaaatttcacttagaagcgaaatggacgacaatgtgagggaaaataagtgggtaaagcaattgccaatgaatgctttcttttcagagaaccgtccgattgtcagctgatggacgacccaatggttgaagacaaaagagcgccctttctcgggaggattttgcagttttgcgaagtaagttaattcacaaatgaattcacgcgttttccttcccgggattaaatttttaattataggaaaataagcggaagtactgctccacgacactttgttccacactctgtgactttgtattgtcagctgccaaacaataattctttttttgttgacaaatttactttttaattattaaaaataaatgctgtgtaataatatagtaattgctaggctagatgaaaaagccgaaagtgcgaacaaagtttttttttgaaaaacaaatcgaacatagtcaactcgtatcagaaaatcacagtttttattagaaaagggcacttgcacaaatttcttaagccacggcgatttgatgattagggagggagtgagtatttgtgttggataacatcgccaattgtgtcgactgggaatgacttgcagtcgggcaatgcacggacattctcgatgtaataagcaaagtcttgaccagccattccataggcaatcgaatcgtggggtgaaatgcctcgggagttcagatgctgtctgagatacagcttgaaattctcgtggatttttagcaagatatcctgaaaatatgtcgcctcatacagtagtattctttagaagataccgtcgtcagttcggctggcataacggcggagtaactgctgtaaaatttgccaatttgcatgacaatttgttgaaatgccgccgtgggcactttgccttccaatttccactgaaacattgtaattgtttctgttttttttctcgaaaataacctcctccaatgcccctatcagttctctgtccatcagtcccaacattttgccctttatttcgccctcgtggtcttcaaaatcgcgttgtgtttggtcaaagtatcgtaggagtgtgtgtctgtcggatggcaattgattcagaaatgtttggcgaagtgctgggatgaattgggcgatgaattgcagcgaacgcaatgccaatgcttcggatgttccattttgagcgtaagaccgatttctcccaattcactcacccaaatgcttcacactgatcattttcagtccgaccaattgacgcgcacccgcgcccaaaatcaattggcaagtgcgactgttaaacgccttcaaaatttggacaatgtccatagtcagttccatggaacattgggggaacagaaaaagcaagtcgctgtactgggccaacacgcggagaagcgaagtcgcagagcttaaaagggggggggggaaagtgatggcacgagaaaatggacacaaaaaagacaacagatcgacaagggtgggattaaaacggacccgacaacgatgaagcgtttgctgccgccaaggaccaaatagtcgcggttcccttctctctcgtcatcatcgtcctcgtgctcatcctccacattttcctccacgtcactcaatgcaccgcttagtcggaatttgtcgacaattctctggtaaacgtagggaattcgattcggctgccacggctcagtgtcaattcgttcacttaacggtgcaaaaaaggttggattgattaaaaatgtgtgtgcgaagtcacttgaagaaacgccgttttgcctctgagaatttgctgatgaatttggccgtctgaatggaccgaatgcgtcgcttcgtatcattgagcctttccccgtccctcacttgttgatgaatagtcgcaaaaacgggcgatcggtgagtgccgttaccgtccgccgagaatgacccaccatctttgccttcggctgcaattttattccaacgctctacggcatcggtggccaattggcatattttgtggaaatgcttgggtcggcaatgtttcaacacggtgtcctttgaaagcggaagaataacaggaatatttgggtttattttcagcccactttgtatcgtgccgaaatgagttttgccactctttcttcgctgatctgaatggcatgactgatcagaagagggattgcgattcgcagctgggaaatgtcacggcacggcagcgccaaaccccccaaagttggacacttttgtcgtgttcgatcactttgaacgctttgctggcgatctgttgtcaaaatcagaatccgtcggtcagcccctctttaccctttgcgtcgtccgctgctctttgccctcctatctgttcggtgttgccctccttttgctcacattgcgtgatccaatgggtttcttcagtctggtcgatttggttgggtgcacttgtcgaagtacaaatggaatcacggcgacgtatgaccctctgtctgtaatgatttataaaaagcatttggggggagaggcaactaacggattcagaacttcggtggacgaccgaacacgcggcagggcttttttagcagaagcggtggaaccaccgtcatcaaattggtcagcagccaaagctaccaaattctgaattgtctaaacaaaaaaaatggtcaacggaaggtaatgggactttttgacccccccccccccccgaaattggaaatggcccacccaaaacactgtgacacaaaatggtcagagaatgaaggacagcgagcaaagtcagttcccaatgctcatctgagaggagttcaatttgctcggaaaaggacgacggaccaatgccaatgccaacggcggaattattg

SEQ ID NO: 7153 - DNA, 3093 bp, Heterodera glycines
ataaagatatttttattaattaaatttacaattcttttcattttttttaaaaatattatttattcgttttaaggagcttagcatggaatacgaaagagagggaacaacacccgtttaagaaagcgatgtgtgggaaaggaaatccgcgaatgggccttttggtttatcgtcacttttttggcatgtctcactattaaagatgtggtgaatttggtaaaagattatggcaaaataaagcattgttttcaagaaaattttagatcagagaatacggagaaaaccccaaaaaatcggatatgaatggtaaggacaaaagttgccaacccagaaaactcaatttcccgaataattggctacagaaattaatagaattagtgaatcagttgctactctccattaaaatggtaaaaagaaagaaacatttttagtgcgtttcaacgacacaatgaaagtgccaaatatgacattttgtatgagtcgtgcgcaggcgtggagccatttcaaagtgaatgcgtcagaaggcgaaaaaaagtgggacaaaaaagtgaaagtaagcaaaagaatggagtaaaatgtataaatgccaatcctggcaaggaacaactcggaaaaatgatcggacgcgaagggtttttggcattgccatgggaattggaaatgacgatggagacgtacaatttggtgatggtaaaaaagacaatgcaaattaacaacaattgtcaaagatagccattctgacgagcatggaaagagagacaacagcgaatggcattgccaattcaattcacaaatttcgaaccgaacaaaggctggatgaaatcagaaaactgtcaaaggtaacgcaaagagcaaacagtccgaaattaaataggtaactcagtcaaataactttgtcagttttggtttgccgaaattgggcagagaaacgttacattcgatgactttatgcagaaagttggaaaagagacattggttgttctttcaacaattacagctttattttctgagttttgtagcgaaattccatgcaacgcttccagaggacgagttacgacgaagaagaagtgatcaaaacccaaacaatgatcacttggctttcgcaaatgcaactttggtcagtatcaaagcaaaaaggaaaacaaacaaaaaaaaatcagattattaaacaattaatgacactgccttccaaacttcagtttccagcctgtttttgacatggataattccaaaccgataactgaccaaggtcagttcttcatgttggttttgaaacataatgctgacaaactgaatggacaacaagttgattgcatgagtggtaatgtgtaagaggatgcaatagaaataaacaaatggtttttgagtggatttccacggaaggccaagttcaacgacacggtttatgggaagtaagggaataaccaaagacgggtttacggatgaggttgttactgtcgatgggaattcaaaaagtaaatgtaaactcaaaaaagctatgcattggcatgatgcacgaaataactgtcgaagtgaaggccctttacaaaatgttgccgaacgatgaggaaggaactgcgtgccgtgaattaaccgcgagtgtggacaatcagtgggagggccggaacatcttcaaacagtttctgcaaaatctcagatacgactgtcaccttcgatgtcgaatggaatttattcgtaatttatgtcactgtacgggtccaacactgagttatctgatcaaagacgaagacgaattggccaagtggccgctttgtgattattcaaaatgcgaaactgagtaaactaagaaagcatttgcttaactaacgcattacttccgcagaatctccggacgcaattacagcgatgaagaatgcagcaaaaactgtttcagagattgcgaacagatacgcttcagcgtaacacatgaaaagaagggcaaaagcttacgaccagggaactttcttaacactcactcattacggtgtttttattgactaaacaatttcagaactgacaaccgttgtcctaaactggggctcttttgagtatctgacattggaacaggattgggtttggtctgtgaccacattcatttcggcaatcgggggaagcatcggaatgtggctcggactgtccattttgagtttgatccaggcaattttggattgtcattgctaaacacaagatgaagccgttcaggggagcacttatatgtacggctacgtaacggacaatgtcatgaataagaaacggcatttgtcaatccaacacaacacacgcaaaatgagcagccaaagcgaggagcatgagaacaaactgtcggtgaaccctttggccagtccgttcaaaaaggcatattcggataaaaaacacaataatggcacagtttccagtcaattcagaacagcgcaacagcagaatgaaatgcagacgaacgaaacattcgaaaggcattccccacctgttaattgtgaaggaagaacaccccgaagaagaagccacggaaggagtgagcaaagacatggccaataccaaacaaattgtaagaaaaccaaaaaaaaaataaaacaaataaatgcgaaaatatggaagaaagccgaaatgaaacaaaagattaaacaaaatagtttattgaaattcctttatcattgaaagctgacagaaaagcaatgccggaaatatcaacccacttatttttaactaattttaacagataaaaaaagagattcagatcaaaatcaattgttaaagttaaagtgacaatgccacacgcttttgaatggtccttttaattgtgcaattctttttcctctttgagtgccggtgaataaataatgtatcttccgttctctttgtcaccaacataatttatggccatttgtatgccaatttcgttcggatcgctaaacgcaacgcgagtccgaggcatttcggtgttgccattgagagagaaaagccgacgggacgaatccaacaaaaaattcgcaattcctttgcggcgaagccgcgaatggacccaaatgcgatcgatgccaagaaaagagcctttgaaacgctgaaaaaattcgtagaggcaaaggaaaggacagaaaa

SEQ ID NO: 7154 - DNA, 2517 bp, Heterodera glycines
ttctcccggtgggccgaaaatgcgtggtgccagcaatctcccaacggccgccgcgctggcggtcttgcacattttcggcgtgcggtggacaactgacggtgcaacaacaaatggcgacgcaaagtgaaagtgtcgctgggaaatgggtcggcttccaagaagtccaagctgcacgtgaaaagttcaaaggcgggagggaaagaatgagaaaaaacttttttttgctaaaaacatttcgtcgattttactacgcttttgtttgtattgtatttacataatgaaatgaacgtttaacaagttttgaccatttatcaaaaaggcttgtaaattgatgtttttaagcagtaaaaatttgtcaacaaaatgcaattaaaaagaattgcatacactcttaacagtatttctccccatcttcatcaactcccgtatcatcattcttggccttctttggagggggctcgttttgtccaatcggcgtttcctgttcaacaattggcgccgcgttcgatgtcccaggcgtcagttctgtccaatgactacgtccatcttcaactctttaacagttttacagcgagggattggtcttcgccacgcctgaggtagtgtcaatgattagtgattaaaaggagacaaacttaccgctccggtgcaatcaccgttcattctcagatatgtcggaacataggcaccgctcgctcgcgcaatggcggagtgagaagcttcacgcgtcgctaaatttaatgcatcataacttttatagaagcttcaaattaaaaaattggtataaatctatagctccaaagtcctctattagtgtatattggagttgacaaagccaccaaaattcaccaaattatggtcaaaatgatcagaagtgttttgaagttttctggtcacaacttttttgaaacaagttaattctttggaataaacaagtttgattcacttacacagaagcttacgatccgctggtgacatctcctttttgtactgatccactgcttttttccgggcctcatcttctcttttttcgccctcttcattctcggtgacagtttttccgatgtttgtctaaaatgaatcaaattgtttagttcagaaaatgcactattactttcgcaatttcacgcgccggttccatttttaaattcaaagatttcctaaagacaaatttattaagaaaacccgagaaaaatgttaaaaaaaattgaaccgataaaaacatttcccaaattgaatctcgttctcaagattcagtcctcaaaattttgcgcataaacattctaggtaaatatttttgatatcgaaatgaatcaaagtcgaaaacactggcgcatcttcatattttggcaaaaagtcttgtattaattcaagtttggccagttcggcacggacatttcggcaacacatacctatcttggctttttttttgcaccgtgtgccataacttttttatttttaaatcagtcatttctattttgaaatgtaaatgtaaatatagagcacacatagagctttcaaatgacgccagtgcagtgattccgacataattggaaacataaatcgtggccaaacaattatctaattttccaaaagaaaacgaaatagtaattactttcttcatctccatttttgtgggttttcctcggaatatttccagaattccttgcagtgattccgacataattggaaacataaatcgtggccaaataatgagctaattttccgaaagaaaactaaattagtaattactttcttcttctccatttttgtgggttttcctcggaatatttccagaattccttgcagtgattccgacataattggaaacataaatcgtggccaaacaattatctaaaatttataatcgctttctttatgatgccagatttgctgtttaactgacaaagaaaaacgttgtcactagggatgatatttataggtgctaaaaactgccaaaataggtaagttttaggttctaaaaaacccccaaaataggtgccaaaaagttccgaatttaggggtgtaaaagacaaaatttattcaaaaaagtaaaaaaattaggtcaaatcagtattgagctaaaaaaattttaaaataaattcttgtcaagaaataaataaataaattttggagataaatttttcatttcttaggatttgtttttccaattatgtcggaatcactgcaaggaattgggagtcataaaaacaacactttgggccaaaatataatcgaatggatccgcatggcgtgcgctttttgttgacgtttttaaatttaaatagatgtgggaaagaaccaagccttttcgcgcttaaaaatccgagttatatagtcatgatccgcggattcaatttgccgcggtgcggatcgcgcaaaaaaattgccgcgaattgcgatcgcgcattaccaaaattttccaattttttagtttttttttacttttcttacataaaaattaattaaaagcccgatgtatactaaatttgagacgggactgaagggggggggggg

SEQ ID NO: 7155 - DNA, 5024 bp, Heterodera glycines
  misc_feature (5002)..(5002): n is a, c, g, or t
aaacaaaaattatttatttaaaattatgggtcgcttaatttaaaaaaaaacaatagaatggtaggggtaatgccacctaaaaaattttggaatttctggccgatttaatgttttccccatttttagtattactatatgtgtccgctttactattcgaatttcaggcaaatactacttcattggacaaccgaacatgcacaacagtcatttacagtaatattacattgtttttccaattggggcatgtgatggacttttagctgaatacgggcattttttttcttaatttgaaaacaatttaagacagttatcggatcagttacgcacagaaaatgaacagcgcactgagtgaaagcatatgggaagcatcaaattgtcatggtaaaatttgagtttaagtgaaagaaatcttgggatttaacatttatggcccaaatcataaattagaaagtgtctcatataataaatctgatgattttaatggattcgtggccagccacccagcaaaaaccttgggttctgattactagataaaaaatgaaattcatgacctaaattctgttccattgtctacggacggatttcaatgaaaacccttaaatattactctaaatgtttatccaattttgcatttattttctttttcggattgccttcgcatcgattggaattttgaacatggtaattccacctttgagttcgacaataaaacggtctttttttgcattttctgcattcttttgcactaattggattcctttttttcagttgcaattcaaaaattacttgtggcaatggcgaaattgtgttgtccaacagaatgaaagttcgatttgtcagggctgccaaaaacaatacgacacacttttcgtattttattggaaaatattttccgatcccaacacttttttctgtattgacgtggacagcgaggtttttctttttgaaatgaaaattattttagagactaattaagccataattattgttcattcagatgaatgacacgatgaaattgtggcaaatcgttttgggctgttccgacattccgatcgaccgaacccaagacacaaccgtaactctgtcattatttcccttttgaccccccccccccccccctcttttgccaggtcctcattttctccgtcactgtgttggccatcgttttgggccttttctacgccggcagttacattcagtcggagcaaatccaagcgaatttgattcattgtgagaccaatggaattttaaaaaacgaattaaaagccctttctcgactgctgaaacttggtcagccatttccattttagattctcgaatgcgagaagcacagccaatcgccgctcggtcgcgtattctctcttcgtccacgttggactcctcaaatttgcactcgaccccaacatcatcactacatttatgagcgaaatggttgatcaatttcctttttgtacattattacttcgtttcttttaacctttttttacaattttttgtatttccctgtactacaaatttaattttttttattttttgaataaattgtttatttttctttcatatccaccaaactaatggagtattttataccaaatgagttcggtttcctttactaattcatctgttttgaaaagaatttccttttaaaatgcccgcccctttggctgttcaacaccaaatgataagcgaagacgggtcggacgcaaacattccccaggtaatccctccattcattcatttaatgcgtaataaatgcaattgggtcaccgaattccgttgcattctgctgaattgcgttctttttaataagaattcattttcctggggccttccgtctctggcatggcataatttcacggcataatcacttaaatgttcgctttctcttctttcagcaacacttttccgccaatggcaccccccagcaaccgccgtccgccactgtccctcccgccgccgcggctgcgcaccttttgaagaattcgctgtccgcccctctgctggccaatttgccgcccgtccctccccaatgcggccccccaaccgtttctttggcattgctcatcgatttcgccatccattggaactaccgacagttcgaaattttgtccgaactgaacagcaaaaagaaggagacggaccggaagatcagcgtggtcgaggcatgttaaaagaaagagaaaaataatagccaaacgcttattaggccaaaaaatacgcaaaaaagggccattggataacgaatgtgtctcgttttctttcacagttcgctcacaacactcgtctgattttcgtgcgtcttctcgccattgtccgttggctgaaaagtgccaaaaaattcgagccgctcgcctccattcgccacttgctcgacgaacaggcgacccgttacgtggagaccgccgatcggttggtggaaattgcgcggaacgaattgccaaatgcgaggtaaagcaaatcattgtcgagaaagggcttataattaatggaattaacgaacgaattcgtaaggttacccgccttccaagtggcacaagcggtcgatgtgctcacgttgggctcctacccgcggctgccacaaaatatcaaagtgagagaagacttactgttcaaatgaactttaaaatgactcacagagctactgaaagtgtgaatttagtcaaagaaaaattcttccgccaaagttctttttaagagaaaaagaatggtcaccttttccaactcttccgattttcagaaactgaatatttaagtttactcaatgctcaattggttcattggttacttaaaatgaggctttgaacatgatttgttcgactttgactatctttcccccacccaaaaaaggaccgttttattccgccacttccgttgggtgcggccgaacggcgcctgacattgcgccaactgaataagttgattgagttccatttggcacaacaagcggcgcaactgtcaccacgaattcgacacattactgtacaaaacggaatggtaatttgcattaattacaatttctgaatttcctaaaaagtgttgccttcttcaataaggcatgtctggtggtccccggagaatttgaaatggagctgactcggctgggcgatgagccgaccacccggtggacccttctgaacatccgaattctcgtggaaagtgccgaagtcggagagggacagcaaatggtccatccgctgcaagtaaagaaagcagcgagaaaataaggcaatttacaacattttaaagatcaatttcctccatcaaatggtgcaggaaaaactcgacacagcaaacgaagtaaattatgggccaatatgtaattaattagacctaattaaagtgggtgtttggatttggcaatgcattcattcattctttcccacaatcattccattcttctagcccattatggcggcttacattgttttgcattggttctgtcgctctctccatttggacattcttttttgtcaggtcgtgttttttcaaatttccataattttttccgttttaggctctccaaattgcgaaaataaaccgaagcggcaaagggagtgagggctcctcgcagcaatacatccgagtggacgagtacaatgagaaggagtgccgtttggcgatcagttattggctgaggagagaggacggcaccattcacggaaggtcggagagtgaatttggtttataaaaacgaacatttaggcattaattggggtgagttgtcgggggggggggggatgcccaaaaaagatatgggctggaaaatgccaaaggatcgaggcaaagtcaaaatgcttaactttttagttggagaggattcatccccaattaaatttctaaaaaattccaggctgtcgtctcattaccgaatgctcatttttggagacaaaaacaattcccatgtcggactgaaaattcgtcaccatccgcccagcacggaattgcccacaattgaccatgaacagaggtgttttctccctcgtttatccattcctcctccccacccttcttcaaattgtttgtttcagtccctccctccaacgattgctcaacgaaactgtccttttccggtgccgagaacgtctcctggcggtcaaacaactgcttgaagcagcttttaggttaattttaagttaataccacagaaatccgttccgttttgtttgaattttcgtttcatttttccatttttatctctcagaactctctcctcccaacccaacacaaaatgtccgtcgtccgcctcgccttcgtccaccaattcggaggacacagcccaacagtttgtccaccaatctggtcactctctgctcacattgagctgtcccctcgtgctaatcggcgactgccatcccgacgaatgtctcaccgtggcagtgaacactttcagcggtgcggtcattgcccgggtggaagtgctcggtcagttggtcacttccttgggacggcctttcctttttctatccctgcctttttcataaacttcaggtcaacgagaggagatccacaagttggagcatcagctgaacacgtgcccaactgtgctcctccactcctccgcctcgtctctgtcggccttttctgtcagttcgattggccgtctgctggcacggctccgcgttctcgtcattggcgaaagactgaacagggcgttggtcggaatgcaggcaacaaaagcactttcaactgactgaatacattcttccgtctgttaattttcaggtgaattcgttgaatgaggcgcaggcacttccgctgatggccaagttgaactctttgccgacagaacgtcgcattttccaatttatccgcgacgaccaattttatttggtgcatcatttaataaaagccatttttttccttcaacattttctcttaggttgtcacttttgcgcctgacgaccaaacgggagtccgtataaattttcaccttttctccgccaacgaaaaccgactgactttgctcgatttggatgcggaacatgttggactgctccccctnaatttgtattttgaacattcat

SEQ ID NO: 7156 - DNA, 4277 bp, Heterodera glycines
  misc_feature (4252)..(4252): n is a, c, g, or t
aaaaataaaatgtacatagaaaggaaggcacagagaaggagagagagagagagagagagagacagagtctcagttttattatgtttggtgttcatttgtcagctaaaaaatttaaaaaattaaataaaattatataaatttgatgtcgggcctcgacggataaaaggaaaacgctctctccaaaatttagggtgccattgattgagagtggatgaatatttatcccgaattcgccttgcccattttaaatatttattcgtcagctccgagactctttccaacataaataaatgtcacaacatcctcatcaaggtgatttgtggattaaaaagggtatttggaaatttgaaaatccaaaattggactcattgtcagtttatggcacaagtgccggtgccggtggttatccaccgcaacaacaacaacaacaaccacagcagcaacaggcggttgaccaacaacagcagcaatttcttggcgccgcttcagtcgctgctgcagctgcggcccaacaaatgagcaatgtgtgcgagggggggggggaattaaaattaaaattggaaatttaaaattaaattaatttaaatttggctaaagtttacgccgcaacaacagtatgaggtgtggcaacagtattattcccaaattggtgtccaacaccagcagcaacagcagcagcaaacactttcgccattcttgagccattccatccaggttttgacgagaaaagtggggacgggcaaaatggcacaaattaaatggatgttgcaaaaaaaattataatggtgccaaaattgggaggaattcgaattcccggcgagggaggaacactgtttgaaaagtttcgaaatagtcaattgtccgaaaaaaatcaaaaattgatcaaaataaattttttattttgatcctatttgattaaagggaaccagagggagtaattaatcttgtctgattgggaacaatgcaatttttaaaatcatcaaaaataaacaataaagattaaatttgtccaaaagttttattttttataatggtggaaattacctggattatggatttagggataaaatataattagccctaaattgcacattattatcttctccatttactgctagatgaacatatgtgccttgtttcctgcctaatttctttatctttgaccattaaattagaaaattaataggtcattaacaaattatttggcacaaattggtcaaaaacattcttccccatcattagtcgatggccgcccagccgtccacgtcgcttgccatgctgcagcagcaccagcagccggcgcagcaccaaatgctggcacaacagcagcagcagatggcacaacactacggcacttcgcccatggcacctgtggtggtcagcccgagcggaagcggcgcaggcagcagcggaagtgccgggttggcagccgcctcgttggtggtgcagcagcatcagcagtatctgcaacaggctgcactgcttgctcatgttagcacgagttgacttgctgtcgggtggtataagaaagactttaaaattttggaaaaaaatccacgaggggcactcgggattcggagcggtttttccgtaaacttttgggcggattcgggacaataaaaatgtcgggattagagtggaaaccctgcaccctagggaatgggtggaggcgtgggttcaatgcccatccgaggggccgcataatattatttttgcctgtttcagcagcagaatcagcagtaccaccaccaacagcagcagcaacatattcagcagccaagacaagttgcggtcgttcaaccgcaacaacagcaacaacaacaacatcagcagttgcagcaattgcatcagcggacgattggcggtgccaccggcgttggcacttcgactgttgccattggcggcagcccattcatggcatcggcggtccaacaaaatgtaaatatatatggcattttccatgtgaaactaggtcggacatcaccacaagattaagccatggtatcgcacttaacttgggaaaggctcagatttttttggggtgtcgaatcccggatatttctatctcgagaatcacaaataaaaatttttgaacatggattttattttgggcctggacttgaattttttgccaatccatgtccaggaacttcgatgttgctaattgagcaatttgataattaaataaaaggtcgtccatcaatcggcgtttggagttgcccagcaacatccacaacaacaacaacaacagccgcagcaacacgttaagcaggtgcaccagcagcagcagctgatcagccaatcgcatgttcagctgcaacagagtccacaaaagcagcatgaaaagtgggatccgctcaaggagtttggactgcacaaagacgaagttgcgttgaagtcgccgcccagcaatgtttgttctgttgtgccaattgctaattcatgaattggggaacccataaaatttgattaaattgaacgaaaaatcgtcgattaggcgtgtatttatgggctaaaaagccatggaaaatatttaagtgataaagccatttaaatcggaattacatttaagattagtccctgatgactgacaaggatagttgtgaaattaaaaaaaaacacaaaaaaatttaaataatttatgaaataaatgacgaaaaattatttaaaattttaaattgtgaattaatattttagaacaacttattttttgaattactttttgaaaagccattatatttttttaatttatctgaatatttttccatcatttttatggaaattaaaatttaataaattaaaatttttaataagcattgctatatatgatttttggcttttgaccgaatgacccggcccattaattggtttgggcacaattctcagggtttcgtgcaattgtgcgttttatttatgatcctggattctcaataattcgatttatgtcgagagtcaactttccaaatttatcgccccaattcccgcgcagaccgtcgcggagaacacgcggctgatgaagcagcgcgaggaggaggctgcagctgaacgcaaggcgtacgaggcgaacgaaagccaacgcgtgcaggaagcgttggagcagcagcgcgcgagtgccaaaagcgcggcccacgcgctgcaacagcgcctcaacgctttcccggaaccaatccatttggccgggtgccacacactgtccaaaggtcggcacggcaccgtggcgcgaaaggcttgctcaaatcgagctgatttctatcgcaagatttttcgagaattaacttatcatatttggactggcgatgcgatctcgaaactttaaagaaggaagggcgggagacatggattttctaacaaaattgctaatttttggatcaactattctgggagcaaatgcatcaaaagggacaaagtagccaccctgatagtgctgctcaagaccgaagattttccgagaccggtccaaaaaaccctagttttttcgagtctcgagtcgagactgagactttttatcagcactaatatcagggatcatggaagagagtaagacgaaaaacgcgccaatagaaattggcactgaaacagttgggggagtgcaggatgccgattttgcatttaattcgtgcctttagtcatcattttgagagtacggcacaattatttaaaaattctcactgttttggacttttgagatcggcacccttacattggctccatttgcatcatttaatgatttaattcatccaattcaatatggcctgatcagtgatttctgatcagttttttgtccccgctgttcagtgagcacttttttgcccttccccaccgaattgtcctccaattcggcccaattgccctgcttcgacatgcagcaggccaaccaagtgttggcaaacactgacgaaagtttggccgactatttgtccactttgctgtccgacaccacggacgaactgcgaaaaatgtaaaaattaattaaatttattttctaaaattttggcggcaaaaatttagattttttcataaaattttttacagtaatgttcttttttgtgcttcttctaatattaaatcttaaatatttttaggtctattttgaataagaagaaatgccgatattgaggggcccaacaataatttattaataaaattgataaatttctcacgaatttgttcaatgcccgagaaataattttgtcggcttctccaaataaggacaaatctgtagaaggacactcgaaaaccattttccaaaaantgtaattttattagagaattgaaat

SEQ ID NO: 7157 - DNA, 1955 bp, Heterodera glycines
acttttggcgatcgtctgttaatcaaggccttgcttataattcatccccagagcgaagaatttcatcttttccaactgagtggagaggtaagtagcaatttttataggttttaatggtagtaatacaataattattaatattttacttaaattattttaattatttatttgtttcctaaaatacatctacctaataatttttccatatttttgtcattcgtgtttcacaaagcactcctcagaggagaatcgcagtatagcaatcatcctaatgtcatttgtattttgatgagcccaattgtttttcatggaaaatattttctaaccccaataaatttttctttcgaactaccccgatttttcagattttttatcgacaaaaactggggatgtaatgcattttggaaaactcaactatcactgcctaaaatccaggtttctgttgtggccgtgatctctgtcctctgagtccaattgagtatcaaggtcccggttttgcccagttttgatccgggaccgggaaattcccggtttttttcccggttttcccagccaaaaagtcccggtcctggtcttgcccaaatttcccggtcccgctgcactctagtttgtacgtatgtgtgttttttttaattttagtttttttaagtttttgattttcaaaattttaaaatttacactttttcaaaataacatgtcttaataatttcgaattttttattttttatttagcttttggatagaaatgaataacgaaaatgatttgtcgattcataaccctcaaaaaggggaatgagaagtgctttatgtaaatatccgatttttgcttttttgggtggcaaacaacaacagtttctgcgaccacaaatgaatgtccaatcatacgcattaaatgaaattagcatatttagtgagtggctggtatttgtctgaaatcatttttattacccattcccaattcattgcaatgccattttaagcaataaaatcaatcccctctcaaatgggattgatccattctctgttaagctactcatcataaacaatttttgcaaagtgcattttatttcgtattattatttttttgtgattttttttgtattaaaatttaggataaataatttttaattaaatttattaaattacaaagtttcaaaatgggaacgaaagcaaaaaaatatttgaatttgactgactctcttctgcagaccgctgcaaacattgagaagagtcggaagagagcgcggacaagcgacggggacaaaacggaggcaaaagcggccaaactgaacgcaaacagaccgccaacaccgacggaagtttggctggtcccaacaaacggaccatttgctccaacaattttcgcgcattttggcgagtgtttggcgatctgtcgccgcaaaatttattaaggatgagataaacagaaggggagcacctggacatgagcaagtggtccaggaacaacacaagcccatgtaaatgatggcccgacatttcaggtggaagccattcgagcagtttaacgatggacagagtgagcggagcacgcaacagtttctgttcttcctcgtcccagtggttctgtaaaaattgtatgaattatagccacttgtgaacatttccaacccccggcttattgacgccgttccaacggtgcaaacactcgcgcagacgcggcaaaagccttccccgaacgacttccaatatccgccgcttctcctcctcctttttgtctcttgccatgtcctccgtttccttttgtgcgtccactggtgtttctgacccttctccaaattcgttaccctcgtcttcctctgttttcccttcttttttttcgtcacagtttcccttttcattcgaatgcgttccctttatttttaggtgccgcaaatcgaagtgaaaagcattcaaaacagcgccgatcactcggatggcaccttttgtgctctctt

SEQ ID NO: 7158 - DNA, 3617 bp, Heterodera glycines
  misc_feature (46)..(46): n is a, c, g, or t
gagctaaaattgttttgacaacagctttcggcacttgttctgctcncaaatcgtttattgtcaagtggtcttggtctgggtgacttctttactcctggtaaatggaagccgacaacagatttgccatcctggcttcaaacgtcacggagatgacaaaggagaggaaactttggatcaatacaaattcctcaattttggcggtccaagcgaccgtaattgacatcaaaagtaaatatctaagtctaagattctgaaaatttatatatattttaccatagaaatgtggcaatctgaacaaatcaccgagattggcacaattgtcgaaatcaatgaacgctttacaccaaccgaggtcattccaaaatatgtgatgactacttcgggatcagcgtcttgcccaacaaaggtcatacgacgtcaagcaaattttccgcttgaacacttcagaagagatcatcaagtcaatgttgttctcaaaagtgttcagctctcatctggaattaaaattcacccatcctttattttgcccggaaattcacctttccgatggcaccctgacatcattcgtcccaatggttcatttgttatttctcgcatttatatttgatattttaaaataagctctgcggagctactctacatatatattcacacaaatttgtctaagctctgcggagctgatttaattaaataaacacaaaaaacaaaaacacaacaagtgagaaatgataattaaagggaaaagttcaatacataaattttaaaaaataataataataataatattaaaataaaataaatgaatggagtattggtatatgaatcccgtgggatttaagttcttggatcagggacgatccttagatatgaaggggaggtatagtcatacagtcacaccgggctatatcaaaaatctaaattttagtcgattggaaataaaataaaataattattaaatttatataattttaaaagttaaaaatttcgtcagattttctcttggcttataatttgaaaagcaatgccaatttaattcaaatccaattgaatcagaatttcaaaaaaaaattaatttaaaaaaaaaaaaaaacgcggatttattttggtagttcattggcagagcttctgtggattggttgaaggaatgagttcattcccatcgaggctcggaattttccatttttattttgagtaattaaataaatatttaaattattttattttcagttttggcttaaaatcaaaacaaatttctcatcgtaaaacaaatgaaaagaaagaaaaagtctgaggacttcattcaaattttggaaattatttaaattttaacgaccagggacggtcttttggagggccggaggtgtaaggccgggaccggaaatggcctttacccttcccccccccccattttatctctccgatagggctcctcccatcccgaggggcgcttaaaaggcaacggataaccagccaaaggggacagtcggatcagtcgggagccatcagtggaacggccaatcgatccccacctgggaggtacccccaggcatccatcaacatcccttcccttccaagccctgcggggcctaattacggacgcgtaagagggctcctctggactatttccctcataagcactgggtatgggacttcacggctttactattagttaaaataatttgtccgtaacttcgtttttcataaaaaataataatgtatgaaaaaataagggtacaatccgaaattcctgaaattctggtttaaattatttaaaaaatttttgattttgccagacgactaattttctaattttagcattttacaaaatcgtgccaacaatttgaagatgtccggtgacaattcggcacttattgcagcggagcaagcggcgtatggccctttttttggctcgcttggcgttactgcggcgatgattttcaccgctgctgggtcggcctacggcacggcaaaatccggcaagtttgttttgttttgaggggtcttggaattttgaaaatttgggaacgtttgaagcaggccttataacctgaaaaaatctgggatttttctccgaaattttcccttcgaaaaaggggttgttttcagaggatttttgttgaacaaattgaatttatgaaatttttgttaggccgctgatttatgcgctttagcgaaaatttacccagccctctcaaaatttaaatgtatcatgaaatttaggatttacgaaatttcattccaaaatgcctaattttgagcctttcctttttttcaggtactggcattgcctgtatggctgtagcaaggcctgacctcgtgatgaaggcgatcattcctggtactctatgcaatttttttatactaataagaggccgaacgagaggatcggtcgaagggtttcggttaaaacccaaaaaaaaaaccaaacctaaaaaaatttctcggtcagtttttttcggtcaaaacccgaaaaaaaccgaccggtctgactctactaaaaatggcaatttaaattaatcttttgcctttttttaaactttctgggttttttttgtgcgttatgacaccggaagagtgaattcgttttttacattttccaagtgaaattcaaaaaaaaattgctattttgaaatttgttaaacaccaaccgaggaaccctatcgttttttcgaatccttaactcaaacaacaaaatataatttcgactttttggttcatgttttagaattagcgcttttttatcattttttaaaattaattttttccattttccaccccctccctaaaaaaaccgaaaattcagtggtcatggccggcattgtggccatctacgggctggtggtggcggtgatcatttccggccggttggaagcggctgggcccggctacaccatcgaccgcgggttcagccagttcgctgccggcctcgtgtgcggtctgtgtggactggtgccgttaggcgccgccgtgaaaattttttgcattttttaatgcgttttattaacgagttttgcccaaaaaagtgacaattttgcgcatttgagccattttttagcagattttcatcaaaaattgtcggttttttgaaaatctagcgaaattttttggaaaatttggatgagggctaggtctggggggtaccaccaaggaaaatctaaaattctcagcaaaaatacaaaaagtcatattttaatgtcatccgatagccttaaaatttcaacataacaaaaaaaaactatgtttccaccaaagttgggtccaaaaatgttcggtaaacgggttttcattttatcataatatcttttttgaaacttaacgaaatttttcaaattttgcaagcaaattaggattattagagctgtcgaaagttatctttaagtcttaaagaagtgtatttttctcactaaccgttttgtttacatagcaaaatgtcatgcgccgcggcgttcgttaattataatctgggagagatgaggataatttcgcttcctgatggcctttccttaatggcttttcaggggatgcaagacccatttagcagcttctacttttcgccatttgtttatgagggagacagtaacggctgtgtggagcaggcattgtaagaagaaagttcg

SEQ ID NO: 7159 - DNA, 923 bp, Heterodera glycines
  misc_feature (828)..(828): n is a, c, g, or t
ttcgaatccttaactcaaacaacaaaatataatttcgactttttggttcaagttttagaattagcgcttttttatcattttttaaaattaattttttccattttccaccccctccctaaaaaaaccgaaaattcagtggtcatggccggcattgtggccatctacgggctggtggtggcggtgataatttccggccggctggaggcggccgggcccggctacaccatcgaccgcgggttcagccagttcgctgccggcctcgtgtgcggtctgtgtggactgggcgccggctacgccatcggcgtggtgggcgacgcgggcgtgcgcggcctgtcgcagcagccgcgcttgtttgtcggcatgattctgatgctgatattctcggaggtgcggcgcagggacggtcccaggattttggcttggggggggggagtacctccgcccgggcgacgaccttttttgcggcagttttcccaataaactttgggaagaaggaagtccggcggtgccgttaggcgccgccgtgaaaattttttgcattttttaatgcgttttattaacgagttttgcccaaaaaagtgacaattttgcgcatttgagccattttttagcagattttcatcaaaaattgtcggttttttgaaaatctagcgaaattttttggaaaatttggatgagggctaggtctggggggtaccaccaaggaaaatctaaaattctcagcaaaaatacaaaaagtcatattttaatgtcatccgatagccttaaaatttcaacataacaaaaaaaactatgtttccaccaaagttgggtccaaaaatgttcggntaaacgggttttcattttatcataatatcttttttgaaacttaacgaaattttttaattttgcaagcaaattaggattattagagctgtcgaaag

SEQ ID NO: 7160 - DNA, 1177 bp, Heterodera glycines
gtccctgtttttcgactataacttctttcataattgtccgaattgaatgtatttgatatcatccgataggcctaaaaatctttataaaccttgctaaagtttaaattgaaaaaatttccgtttttaaaaaagttgtgttcaaaaaatgtttggaaaaacaaatcctaagtcttttggcaataacttttttgaaattaaactaaatttttcaaaaatttacaaggaaattgagaactcttagggctatcgaatgatttcaaattcattcaattcgaacaggtatgaatggggttatacccaaaaaccggctggctggcgtggcctcagtcggtcggtgctcagtcgtcccaattcgtttcgaaactgttgggtaaatttatttgaattttctttttgctctgttcaggtgctcggtctttacggaatgattgtctcactgctgctaagttcttcctgaacaatggaaggaagaaagaaggaaagaatggcacatctgctgaacattgtgccgaccgtcgtgttttgatgatcaaaatgaccagccaccgtatataatagataaataccgtattttccatccattttttactgtgtacctttttctcttttttttaacaattttatattattcaaaaaaaatgtggaaataataagtgcggtgattaggacgccattaaggcttgggttactgtacgtattttgctgaaaatctatatgtaatacttagggctgtgtttttaggcaaatgcctaaaatttttgcgcacaatgcactcagataagcacgaaaaacgcattttgaaaaaaatttaaaaaattctgagtaatggctagaaaaattagttaattataaagaattttctcacagtaagatttttgaaaaatttattggggaatcttttttaataaaaaaaattttatttacatattttcgtacacattttgggtttttatacatattgcttacatattgaagaaatttttaatctttatttccttcaataattttacagaaattctttaatgtaataaatacagcacttttttcggcacgccttgtgggttttgtgtcaacaaaaaaatttgtttgttaaatttatttgaaatttataaaaagttgtttctataggttatcggtgtcgtagaatccgaatctgatatccatttcgaaccccgaa

SEQ ID NO: 7161 - DNA, 4383 bp, Heterodera glycines
cataaaagaataggaaatcattcattcgtcgctcccccggggggggggggagagattggtgcagcgggcggctcctttatcaatggggcagcaaaaggaggaagggacagagacagaccatcgccggcgggggatgggagcatggcgcggaaaagtggtcccatatcgaccgcgaaatgtttgtattgataaaatgataattgatattagtgatattaatgataattgacaatgataatgataatggacagcaaattcggacggaggacaagtgcaggtggtggtgaaatattgtgtacaaagtccggggtttataagtaatttggcgattgaaaggtgaaaaacaaaaaacggaggggccgaaagaaagcgaaatatttacaaaaacagaaaaagcgaaacacaacgaaaagttaattacggttgcataattatcaattttaaatgtattgcaatgcattattaattatgattgggatggtgacactttaatagaaacacaacaacggtaattatgtctgattaatttgccatggtaaaaattgcaatgttaccagagccatttcaaactacaaaaaatggaatgaatacaaatgtgaacttaaaaacgattaaatcttcttaatttcaatttttgagaatttttctatggatttttgctttttctaatttcgattcttcaatttttacatattttcatcagaccaaccgttaaaaaaaattttttttttttgcttgttacttacttcataaattgaattttattttacttatttttctaaaaatggaagagtgagagatacgccgccaggaaaaaaatggaaatttttgccagttttattaacggatgaaaattatgctttaaattaaaaacgaaattattaaatgcttttgcgccgtgaaaagacaaagaccagcagcatatagatggatgatacatttgatgggtgctaagtcatttcctaaaaactgtcacaaattcatattaattttagctttcgaatcaccatcaaagagaatcaactcacattttatactttacgacggtcactacgaactaataagaaaaacattaaagaaaaataaattaatttattatattttatgataagctacgtattataaccaaggttttgcaactttaaaaggatttctattttttaaatgtaagtttgtttttagaatttgttatgcttgtcagttcatattttggagtgtttaggagacgaccatcacccacttgaagaattcatttaaatatatttaaaatataagacacttattttatgtatttatgaatctaccgattaatattttttcattattaatacataaataaaaaattttcataaattatcccaaatatccatggtgaatcatcagcagcggatatgaagttggagctggtccatcatagtttttcgttttcttcgcccgccgtttatttgctgcgcccacccaatgaatgctttttcagctgaatcaatgacacttttaagcaacccattttccgctcgctattctcatactattagtgattttaaaagcaatttttcacaaaaattttaatataatttataaaaagctgaaaaaccaaaatgaaaacatttaaattgcaaacaaatagttattttgacattttataaaggaaaattttcactgacttattccgtaatttgctgaacaaaagtgtgaatgaattaggtcaattgacaataatgccgagagcgggggagagaagaggcgagagagggctggagagagaaatagagagagagagggagaggagagagagaggaggggagagagaggaggggagagaggggaagggagggagagagggggagagggagagaggaggggagagaggggtgagagagaaaggcggagagagcggtagacagagtccgaagagtacagagagatagagaggagggggagaacgggagagaaggatggagagagaagagagagagaggggagagagagagggtggggcggagagagagggatgagagagaaagagaggagagagggggagacagagtccgctgttttgagtaaacataaacaaaaaatagattaaaaacaaaaacatagcgtctatatttgctatgagttttgtgcactcattttacccatttttgtttctcttcttcactataatttttctccaacaaaagtggacaatgggcgccgagaaattgaggtaattaattagtgatgcatcataattaatattaaatattactcttatttatagggctgcaaaaaatatggatataaaatctcaaaatatggacataaaattgtaaaaatatggacatagatttttccaaagtgggtatactttctcaaaatttcttgaaattcactaaatgtaaaataaaacttcataaatggttaaaatatggcattaaaaatcattttagaagagaaaacacatgataaagctaaaattcactcattttaacgaaaaatcaacctgaatagcgattttttcgcttttttgcttatttttgattaaccatttttcatgaaaattttgctaaaaaattattttttggaaagttttctggtctttagaggctcaaacggcaaattagctgatgggggccgttctaataggggtttttttggaaaaaagcccaaaatattgataaatatggaaatattgatatataaatccatcctagaagcttcaaaccaagctaaaaacatgtttttcgtgcgtttaggaccaccacagtccagaataaaaatactgatttccatataatttgacagaactacttatttgttagttgataattttgaataaatcaattaattttatattttccatggccgcttaagtatttcgaaggccttcgcggccgataacattgtgccggacgttgtgtcccaagcgccggaaaggctcgtgaccgtggaatacgatggcggagtgtacgcggagctcggcaacgaattggcacccaaaaagttggccaaggcgccgaacctttcatgggacgcggaggagtgcaaaaagtacacagtggccatggtcgacccggacgcgccttcgcgggagcacccgaaaaatcggtggcattttattaagggcacatcagaggcaggagcgttttcccccccccccccccccctccatccatgcaccaaaatccaaactgattggctttctccagattagtttaatttattaggattgaataagcggacggttaaaatgctgaaaacgggggcataaaaagacccataaaggggggggggggggggtggcctgctggtaataatagcgataagccgatcgctggcaccggaggtcgtgggttcgattccctcccaggtctataatttttccaaacctttattaaattgaaattcatattatgccaaataaaatttctattagaaaatgttggcttacacaattttttgccattaatgatacttttcctaattaagttttccaatacaaattaaaccgacggcggattgcccactgactgatcaaatgaattttttgttttgttttggtgactaaaagattagttaatgacaatgtcctggattcaaccaaagtattatattaaattaaaaataaaataaattatttttgatttgagagagtggctccattggttggttgtcaatgtgccgggcactgatgtcgcgcagggagagcaactcatcgattatatggggccggcaccgcccaaagggacgggttggcacaaacaatgaataatgagtgtcataatcaatttgtttgcctattgaaaaaataaaaaagaattttgaggtctccaccgctatgtgttccttgtctatgcgcagaaagaggaggcggtggttaatgccattaaaaagccaggtaatcaatcagtgttgggagactgaaaaatgcttttgaaccctatccatggaatttaaagggtgtaggggcaaggtcaatttgttaaacggtttcctaattaatatttggcgtaaccggggcataaattgccccaaggctgggccttgtccattcgaatcacaacacaaatcgcgaactcagttttgtctaaaaattgctcatttaggaatataattagataattagcaccacattttccagggcgttcgcacttcaacatcagagaatttgccaaggaaatttacgtcgggccgcctctggcagggaatttcttcaacgcgaaataccacggctgaatcagacccaatttgagtgggaatgaaagaaccatgattcctgttgcagaattatatttattttcttttttgatcatacagtaaattattttatgaattatatctaaggttgcgattttcggggcgaaaatggctaatatggacaaaaatattcacgaaaaatgt

SEQ ID NO: 7162 - DNA, 1030 bp, Heterodera glycines
tttcgttctgatttattaacagactttcaccaaaaaagaccaattttttcaattaaattaaaagtcaagcgacgacttttttgctttaaaaaaacactttttgcggcgcatttttcgaaaaattttggaggatggacggaggatccggcggtgccgataggcgccgccgggaaaaatttttgcgatttttaatcaacttgttaacagatttttgtcaaaaataactaaattttgccacaaatcttattttcttgataaaatagtgacattatgccataaaatttcaaaaatgtgagtttatttaagaaatcaagacaaattttggtcgctatctccaaatcaggacaaatctgacaaatcaggacagatcgcacccctgatggatgtcagtttgttttcgtgtatttaaaccgattttgaagaaaaactctaatttcgaaaattttgactttgactttttgttcgaattcgggttcggggttcgaaattcagaacgataattataaaattatacttcttattacaataccaatactacataacttaatattaaaatatttgtatcactaacgcattttttccactgacgcattttccggtcacgaattaattatgagttaattaagtgttaatccgttctttaccctgctgctggtcagcttgagtttccgttccgttgtcaacgtttttttgattgggaatttgatgaaatggcattttcagtttttttttgtgagaaagtgctttcaaaaattttgtattaaaaagtgattaacagaaaaattactgcaagcctaatggggacggagtgaatgacaacgacgaagcgaagcaaagcaatggaaaagcaaatgattggacgggggggggggaatatcccaatgaaaattatgctatgaatgatggaaatgaataaatgcataaacaattaaacatatcgacagattggccaaagagatagcaatggtcggagaaaggcacaaatgtggagaaattcaaagtatcctctactacttacatatgtaatttt

SEQ ID NO: 7163 - DNA, 4286 bp, Heterodera glycines
cttcatttcttaaaggcattgccaacttcgaaaggcattgaaaatggccattaatgggcaattctaaattcaaattatcaattccaatttaaacacaatcgtgtaagttttaaggttgaacatagataaaaatatggttcactaatggccgttttccattggtcggctaattaccacccaacacggccaaattaagttaaaaattcacaaagcaaagcaaatcataattataataataaaatttgtgccaatcgtggttattaaatgtcatttgaaaagtgccgggaaaagaaaaaatggcatacaaagccaaaaaaggaattacaaattaacccattttaaagttgaatctgctcagaatggaatcattcgaccaaaaagccacaacggtaagcgaaaaaaaggggaaagtgatcagtcaaaaagtgatcaaaggcaaaccaaccagccaaatgggggtgatcgggagcagggatgggcaagtcacaaagaatcactcaagcgaaactcgaaatccgattgggaagggccgtgccgtggcatcggttgtcactcacttcggtccgatcatcccaaaatccgttgtccaattgccccaatggctgttttgctaacaatgcttcttctcacttttccctgttcagttcttcttggcctataaggacatcagtccgtgttggcccatcatttgctgtgcccttttaatggcttcgatttccgtcgtcggagtgtttctcaacttttctctcattttggtcactgctctcacaaagtcatctctgaagagaggaggggatattaatgatattaattatgttaattgggcaaaatgcctttttctgctgactcgggatggattaaaatgcacgaaaatgcattttcagttttattttagtctttttgaacatattttggcatgcccttttgtaccttttgtattatttttgcaccaatttgcctgtcctacaaatgatttttccgtttcgttttcgtcccattttcattttcaatgccttttcaggtccctccacggcacttccaacattttcttggcattttgttcctttttcgaggttctgcatgagttgggccactttttctttctgtccaccgctttgtctggccactgttttgtgccttaccaaaatgcctttcgcattttggcactttctctgttcggtttgtccgcttcgactctttcgatgcttttcattggcttcgatcgcctcttttgtgtgattttccccataaagttggcaattttaccatttcaaaagccaacaacggtaagcatatgttcccctttcagatacaatcagttaaatctttggccttatgttcccattaccgtactcttttgtaccgttccaagtgtcggtttggtctttttgtattggcggcgaagcgaagaaatcccttcgatggaaatcactgggaacattggcgaattactcacaaaagtgccaaaatcacaaaaaaaaaaaattatttatgattaattcccagggtggatatgcttattctgtgtacgctgattcgaaattcgtctgtaatttggccacaatttttgtttacgtcgctgtcgcctttttgctccgctttaagcaaagtcagtccgctgatttttctgacagtgacaactttttactttatttcctttcaattaaaaattgccaagcttttcctctttttagagccggcactttttcccggcctttcctcttttgtcccggcttttcctcctcttcgtccaactttttcccggcttttttcttcttttttatcccactttttcccggcttttcctccttttggtcccactttttcccgttcccttttttagggtccgctccgtcgtccgccgccgtttcccaccaacggcacattttcttctccctccttctcatcgttttgtttaacgtcggcggatactttctgatctccgtcttttatctgtttttgccctcttctgctgatagccaaccgatcactttttggtttctccgaattcttttctctgtgcctgccaatttaagcggcgcatcaaacgccccaattcttttcgtgtcgaggcgagcgaataattaattttaattgagccaaattaatttggaaatttcagttttgaatatcgaagggcttttaaaaagcaattgaaaaacattcattcgcttttcttttcgaccaatcaaagctccgttcatccgacactttttgcgctgcaactcgcgaataatcagccgatggacgtgcaaaatgtgttgacaaaacgtcgcggcacgtttatggcggaaagtgccaataaatgaaggaaatccagccgaggatggcgaaaaagcggagacgaaacaaacgaaaagcgggcaaaaaaaaagaaacttttcgatttgacatgacatttgacagatgaaagtcaggagtcgatgaatttcacaaattaacccttttaaattcattacccaattaatttttattgtttccaaattattaaaatttgtttttgccattgccatgacaaccaatgaataaatgtgttaagcatttgccaagcctaagaatatttgggcttttcgaatagccttttttattcttttaaattttggccaatgtccaatcgccgcgaaagtgcggcggcgatgggcggcggaggggccgcggggaacgacccgcggaaagggtaccttctcaaggtttttgagttttgagggtggcaaaaagcggaagaattgggcaattgcaaaggtcgcctcgcacattctttcgctgaatctcacggaagaaagactgcccaatgggacggcactgaacgcattttgcgactcggaagtgccaattttggtcatctcacgaagggacaacgtaagcaaaaagaggggacaaaacgaacaatggcacggcacggaaagacggcaaaattaagggaaagagagagaaaattggggaaaagtgattaataattcagaaaggccatgtggacgtgagcaacgaagtaattgacaattgcggatgattaatcactactcactaattaattcacattaaaaaataacaattaattaaaatttaattttctccgtttttttcgattgacgcgaaaagggcggcacttttgcgagttgtgttttacaagcgtacaaacaatgcgttggcattggacgactacaaacagaatgtgactgtgctgagtatgcacgaaaatgcgggccaaactctgctcggcacattgaaacaggcaaaaaccaaaagaattaaaacaataaaatagaataattatttaaattaaatttaaatatttaaatttaatgattcgctttttaaggttttttcccccattttggccgacaatctatcggaaaattcgggcgaaaactcttcccaattggcatcgcttgtcaacgaattggaggaaacactgcaggaaaattttggggaaaatgaagcgacggaatcggccagaaaaggcggtaattaaacaaaactaattaagcaaatggaatgccactgcgaattcggcttttaaaggcgtacagtccgtgcgcagcgaaatcgaattgtggcacaaaaaggcacagaaagggacggagccggcacaaagttacagcgaggcattggagccattggcggacaaattggcactaatggaggcaaaattgaaattaaagaaatgaaattgaaaaataattaaggggggagggccattggacgaattgtacgaagtgtgcgaagcggcggaagagagtgtggaggcactttgggaagtgctggacgagccgtacccacaacggcgaatgcggcaactgatcatttgcatcggttggcattggcattcaaatgcttttgaattaattctttggcatttttcgacccttttgccaattccctcaaaatgttcagctgcctcactccaaaaggccatttcccatcgagcaacttcaaacatttcgccgtcagagctgtttcgatcgtcggagacacttcgcctgtcgctgaatttggccacacaatggagcgaatcggtcgcattgttaacgggacgaagttggcaacagaacgcacttcaccagtgggaaggcgaggcgatcggaatggaaacatttgaacagtttagaaaaagagtggacgaagtacggcgagggattggcggagggaagggagagaggggggaggaaagaggagggagggaggaggggatattgagggataaggaggggcggggcaaagggaagtgagaaggaggggacagaggagggggagagggagaaaggagagaagggagtagggggaga

SEQ ID NO: 7164 - DNA, 2822 bp, Heterodera glycines
  misc_feature (2729)..(2729): n is a, c, g, or t
gaggataaagagagaggcgggaggggtgggaaagggagaaacgagaggagggagtagggcaaatgccggaggggagggagtcgggaagaagcatgagactgtgatttatccccccccccctcggattttctatttttttgaggtttttgtgccatttttgtcggtttcatttcctccccatttgttctttcttttaggcccactctctatgcactttggccgaacaaattgtccaattgttaggccgtcgaggtgattctgatcagctgcgcgagagtgttttctccgccattgacgcggcgcttcgcaatgcgatgccttttggggggacgggggaacaatgggcggaacggcacggggcggccgaacgcgcgttggaccctttcattgaggagattatgccgacactgagggcgcgacttcagtttcagccgaatgtgagccgagaattggtaagcaatgatcagagatgaccagacaggaccagaagcaaagtgatctgaccaaacattggccaagattattttggatgattggagtgatcagaataagttgtaacatttgggtgccaatgtgacaatccacttcagttgctggacgaattgcaccgttaccgccactttttggcccggaagcaagtgaaggaaaagcttcaaagcgaacggtaaaaccatcaaaatttgcataaactatcgattaattggctagtgaggtgctgatcactcatttggccgaacaaattcgtgctcaaaggcgtgaaatcgaacgaatgtccgcgatggctgtgcccacggggaaatttctgacagaaattgcagcgaaaattgcatggattcgaagtaacagtactcaggtaaatggaaaatgcatttggtacggtaattagccgtttaatcgccaattgttgagattgacaaactcagcaaagcttccgcaaagtttttcgacgatttgccaatgttttcgtccttttcgcaatcattgcgcactttggccgaagaattaaaggcagctgagcaggaacaattcgacgcatggttagctaattgctaattaccaacaacggtaattagggagggaaaacggttggaaagcaaaacgaaaaccgatgaaattcgactggcttcaatcctttcttatggaatttttgcacaataatttcggtcttttttatgtgtcgtgatatgttggcccacgtggacgaccccggcggcgattccatctctctgcagacgaccggccgtctgatggttctggagagggaccggggcgtgctgaacgtcagctacagtgatcggctggcgcgactgttgcgcgaggtggcgcagctgcaggccatgggactgcgaattccgacaaaaatctctcagtgcgtccgccagggcgagaagttctatcagtacggggttctgctcaaacaggtggggacacattctgctgctgaactgaactatgagaacataggtggcccacttttacaacacaattgagcagcaaatgctgccgtgtcagcaagcgatgcttttggacgaggcgttgaccttcgaaaggctcgttttgccggcggggggccaaagggaggggcggggcgccgcggcggtgagcataacgtgggagaacccggagaagttgaagcagtacatcgacaaactgcgcgaggccgccttcaatttgacgagtcacaacagaagactcagaaaagtgggacagaacacaaagaaacaccgccccaattaattaactaattgattgattaaaggcacatgccgaaataggacaaatagtggccgaattggccgacacggatttgttgcgggaggaggaaaaatggacagccaaattaatggaagtgagacaaatatttgtggaggaggaggcatttgtggcggtgaagacgaacatgcaaccatgggcaaaccattggaacagacagctgtacaaagtgttgcaattgcaattccgatgggcaatggaaaatgtggacaatcaaatgccaacattaaatgcacaattggtaaagaaagaatgaatggggaggaaggggagagtgggagagaaaagaaagggaaagggagagaaaatgtggaaaaagagagaggagactgagagagagagtgaggtagagaagggaggaagagagagagagcgagcgagggagatagagaaaggaggaaaggaggggaaagagagaaaggagagaaagaaggggaaatgaaagaaagtgtaggaaaaagagagaggggaagaaataagaaataggaaaaacaaatgagcgaaaatgccagaattgagcggtgccctttgaggtgttccgcgaccagcgactgcaactgcgccccccgctggaggagttgcgtctccaatattaccgcgcactgcgcaaattgctgtccacgccacaacggttgcgtggggtacagaacaacgcgcgcgagacggaactgttcggacgcattgtggcgagaaatacgcgccattttcaaaaattgtacgaacggtccgaggaaatgttcgaacggctgagaacggcggacagagaatttgacgaatgggtggcattggcacaggtgaaaaatggggacaaaaatggaaaaataaaaagcaatggcacgggcattggcaaaaacggaaaattaaaaaaaagaaacaaataaatgaataaatgaatttgcaattaggtaaatttggaagatttgctggagcaaaagctgcgcaatgcttcggattgngagcatcagctgaatttgctgaaacagaaacagcgatcagtggacaaaattcccaacgaaattcgaatcgaatgcgtccgtttgtccaccgcc

SEQ ID NO: 7165 - DNA, 1845 bp, Heterodera glycines
  misc_feature (19)..(19): n is a, c, g, or t
attgtcgctcattcacatntggccaaagtccgttcaattcaatggacacacaatcagatgaacaatgcggagggtgcgggaaaagaaatttaaattttgaaaaataattaaataattaatttaagaagcagttcaacggacgcaattcttgaatacaaaaagtcattggaaccgccgagaattgaaataaacggaacaattgaaaattatgcggtgataaaacccccaaattcattattttgtttttagaaataaaatatatgggtaattaagggttcaactgacaatttttctcgtttaaatgctcaaaattcggtgataaatgaccaacgccgtggcagcagtacgtcaatcggatttagtaaagtaataaatgattttattcttaatgtgcaaatgtaaaaacatattatttaaatatttaattgcaaaattttattcttaccatattatagcataaagcacataaagtggattcgcgcaaaatcactcacaaaaaacggttggaaagagggcaggtaattaacacattaatcactttaatacttttaaaataattttgaacgatatttgatcactccaaccatacaaaaaaatctcggtacaattttcatttttcagaccacaacaacagtctctgaagacaaagcactaattgctgaacgagcgccggcattaaaattttttcagcgtgccaacgggtcaaagtttgcgcattccttggaccgatacaacacggtaaagaaaaaggggaatttgatcagtgatcaatcattaaaaaatgccatcgaacaaatattaaccaacgctataatgttgaacatttatcaatggaagtgattagaaatctcgaacattcttggacatgatttcttgaaatttgatatattttttttctaacaattttttttgaactttaaatattcaaagaatcaaatcctcttagtctaaaaatttttttaaataaaaataataaatttacaatattctaagcacaatttattttatttttttgatattcgtattaagattttagttttatttatccaaactttggaattttagtacatatttcaaatatatttgggcatttttgtaatgaaatttcatccttaatgattaatgcgttaattatttcaatttgcattttgggatttcaaaattttacaggatgtttgtgccgaaatgcgtccgctgtcattgcgcagtgccgccgcgcgttccatgtcgccgctgctgcaccagcaacggcgcctgttcagcatcggcggcggcgcgagcggtggcacacatcgctcatgcggaagtgccagcggcatggccggcattggggaagaggacgtactcagctgggaggtgatcactagggacgtgaattttaggttttaactattttttttgctcaattgatttgaagaaaggagctcaaaaaacgcatttccgcataaaaatttttcgattctgatgtcattatcggtcactagaaatcactattttgggattttgtcactaaaatagtgaaaattcactattttggagttttgtcactattttttcactatttcgacattttttggaaaattctttaacaaaaatgcaataaaaccaaaaaatacacccctaagaatcgacaaaaaaaatttcaaaaagcgctcctaagaaatgaaaaaatttttctcaaaaaggtattttcgtggcaagaattttaattttaaaaattatttttttatgtacctattttgtttttttgcccttaaaaatcccagccctactcatttgcaatgcaatcagtgaataaaaattatttttgcttaatttttggctgaaaattatgtcactatttct

SEQ ID NO: 7166 - DNA, 2890 bp, Heterodera glycines
ggattttttgaaatttattttaaaaatcaaaaatatgtttgaaaaaatttattatttgcttagaagcatctaaaaatatctaattaataataataatgtgtttttaattttatttaatctgtttttgaaaacttgaaaaaacatcggtcacttgaaaaaataaattctaaaattttgtccaggaaaatccagggtttttcctgttttgcctggacctggattttttttcacatttgacctggaccttgatttcctggacaaaaatccaggttgccgaaaaatggcctggacctggacccaggaaaaatccaggcctggatccaggtccaggtcgatctctaaacttaatgttgagagagaaaagaaaaactgttcattcattaaggggggggggggggtcgaccaaaatttttgcgaagggtcttaggtcgaattcgactctttctttttttttttgcttctcaaatagcttttttcgcggtgcgcttttttcaaaaaaatgcgagaacaaaaggggccggcggtgccgataggcgccgtcgggaaaatttgatggattttgttaacggactttcacaaaaattgacaaaaatttgcaatttttgagaattgaaaatgaagaagcccgtcctcctccacccccgagaattcttgaaaaaaattctgtttgtaaattaacaaacttagaaatttttcaaggaaaaaaaaattataaaaaattttctgatgaatacaaagattttcaaaatctgaaaaatttttcgtattttttcttccaattttcttttaaaaaaatttctaaaattttttcgaaaaattctgttagataatttttattttaacacgcctccaaaatacaagcaaaaagaattaataaacttactgaaacagaaatgcggaatgtcaccctgctcaggaaacacagacatagacgggtgttctgtgattgcgtatcgtatcaaactctcctcccaatcgcgtttgttttgcgcatccaaccgacggaaaatttcataatttgtatcaataccatcacggatctaattaaaaaacaaaaaaaaaatgaggaattttttttttttacctccgaccgaacgtaagtatgaggttctgggaaaggcggtaaaaaatttggataatatgacggaagcggaaaagggtcagaaatgcggagaacgggcgacgcttttgtcggcgattggggcagcactgaaaagacagtgttcgaattatacaactttcaccgtacacagtaaaggggggggggggggacgtaaaaggacaattgggcacctccgactgtgcaccatagggcctaaacctgggccaaaaagcgaagagggaccagtatgttttagaatttctaataattttatttaaaaagttctaaatttcaattttttctctccctggaccactccccccccccaaagcaaattatcccgactcattagttaataatgaatgaattcattgaatgccaatgtgttgcactcacatgaaaatgtgtgcggtttgctttggtgaatcgtgtccaaaaatgtgtcaaagtcggccaattccgggcgcccctcattcaccaaggccatcaaaacatcgccggcattgaccagcgaacgacccgtatgttcacacaatttcctcgaggattggcaagttttggagaaaactgaaaacattttttgatcatatttaatgagggataacaatgctaaaaagtggtggtacattggtgaaataaaaaggataaagcctccaaagagcccttctgagcagagtcaaaaccaatggaatggcaaatggaagcggcacattggcgaagaacccgtctaaatatttaaaacaaatttttcaaaaatatatgaaacaaatccaggaaaggccttgaaaagatgggtttttttttactggatttttgtccagaaaatcgtcgttacggacacggctttttcaaaaggttagtcaagctctaccgtatttaattttgaatgggaaaaaacgccccacatccagcaagcattacctgtaaaacttgataggacaaaaacagaattgaaaattcgattggcaccccgactccaccaaatttgtaggcaatggcatcactattatgaaacaaaaaatatatataatggcatttatattttacaagttagcacaaaaaataaatatttgtaacaagtgatgaaaaataaactttcaagaaaaacgaagttaaaaaataggcactattttatttacaaatccaattaaaaaaaaaacaaattttcccataaaatggatcgtctcaataaatcattgtgctgctggtccgtcgaagggtaaagcgcttgcacagcttttcatcaaaaggcaaatcgttgtgttccgcaaagtccatcagtctgtcccatgctttggcatcgcctttttttgcttaattttcaccattattattaaatctgtgccttcccccgaatgccattcacttgttatttctgcccacgatttgaccaacatttgtccaaattgtgccatgtctttggcgttcatgcgatggatttgtcggctgctgtttcgctgctttcgcatcggcggtcgccatgcgaaggcgccgttccgttgggccaaacagcgggtcacacggttgggcatccaaagccacaacagtgactgatagcgactgctggcgatcagctataaaagtgcgcggaaataattgttttaaatttggtgacgattccggtgcagaggggaaaacaccgtcagattatcatcattatttttgggacaacaaataattggtataccttgaacctattaggctgacaaaatgcacaactttacccgaacatttttatttaattagttttctaaaaaattttctgttaattttatttccggcagggac

SEQ ID NO: 7167 - DNA, 2136 bp, Heterodera glycines
  misc_feature (2116)..(2116): n is a, c, g, or t
atcaaaatagcattcctggacaatggcggaaagttgttcaatgacgcgttgggcttggctcagctgaagagcgaaaatcttaattcaaacatcgtcaatttagagaaaatttttgcaagatcgccttttagtttgaaaacaatttttggataattttttgctggctcattttggaacacgtcagttggccccccccccccccacacgtttgggccccagcatgtttttttggctataacttttttctttgtcaacaaaacccaacattgttaggtatcattagaaagctctttacatgctttattagccttattacaaaaatcgaaaaaatttttagcctattaaaaatttattaagaaaaaaattcaaaaatttcgactttttgaaatttttaaaataacttttttggtggtaatcgtataatcgcgaagcaatggcttggaaacagtttcaaaaacatgttaagctttcgaatgataccaaaaatgttgcatttggttaacatagaaaaaagttatagtccaaaaacttgctgctcatttcgattatttttttcaccagcagagtttgtgcgctattttcgtccatgttttgtcgcaaattgtccgccaaattttcactcgctgatgctcgccataccaacagacgcaaaggctgtgcgaatgaagaaccgcgaattgacaactgaaagaaagctgagaaaattttttagaatggtaaaattcatttcctgaacttttcaggattgttggacaaattaaatttttattaagtacatatatgatacacgaaaaaacattgagggatccctttgaattttagaccaaaaatttgttgtttaaaaatctatgcacataatcctggaattttcggtgtcagggcaactcgtacaatttttaatgtgtgtagtcataactttttttaaagtcaaccaaattcttcaaacttgatatcatttgaatgctctccaagtttacaagtgatcattaagcatttcacaaaaatgttataatttataaattgccaaaaagcctgcttttgtggatttttaatattcttgaaattataactttttcgtgaaatgcttaatctcttagcttctgcttaatgatcgcttgtaaacttggagagcattccaatgatatcaagtttgaagaatttggttgattttaaaaaaagttatggacacacccattaaaaattgtacgagttgccatggatccaaaccccacaatatgagatggaaaaattaaaaaaaaacatttttaaaaacatacaattttgtcccttcgctgaatgcatgcgatcagtgttgtttccaattcagtacgttccttttgacaacgtccatccctgaacaaacaaattaatcattttctgattaaatttattctctttcgacgaccttttcaatttgccaatcacagcttccatatgctcaatcagtttgcccaagtgttgaatgtcatgtccgtattgtgcctttatttgcttgtccaccaaacatttgaagcctctcaatacgtttgccatcatttcacggatcattgaatcgcccaaaatttctctgttaaaaaaggagaatattatgctgtagtatgtattgtctcgaaatttgttgtttctaataaaaaatattaatttttaaagattttacatgaaaattttaggatttatttcttttaaaaatcttgggttagaaaagctagaaaattgtcagagggatcattcatatgtatgccccctaattagccgtggtaaaattatacgaaaacaacatttattaattattattattcgtgtaaaataccgcgatgatgaggacggtttgtaggcggtcaacgcgacaaccaaatccttcaaacggccaatgttgccacatttgtaacttgccttcgcagccaaattgacaattttgcacaaatggtaggggaaggagccattccgttcaaaatcggtccgttttatttcaacaatattctgtaatgagaaaagatattgttttttgacgatttatttttagctgacatttaagggaattttcgggtaaattgtcttttacacgccggattttttttgaaatccaccgagaaaaatttttaatgaaatttttttnaagatttccatttttttttt

SEQ ID NO: 7168 - DNA, 4852 bp, Heterodera glycines
attgctgccagtttgattcagttagtcacatgtttgagttgatttaagcctcataggccttgatttctccggaaaacttggaaaattcaatacaactctacctaaaaagcagatttcggtctgcaaaacaaacaaaaatatgaacaaatatttgttgtttattatttagcttgttttatctgtttctttttgttagttgttaagattttgttcgtttttaacaagtgtctttatattaatgttacacccctttttcggaaaaaaatcgtaaattttttttcaatcgtcatttcgccttctcgcttttcgaatcttaattttcagaattgctacttacgtaaaatttcagctacgatcggttcatgggaagtggtcaaactcataaaaaatagggtgtatttatattaatgttacacagtgtatacgcgcgttttttctctttttaaaatttgaaggtgcggccgcataaccgaaaagtaccaaagagcttaaaagcttatgtttattttgaattcttttactgtttttagctgcgatttttcaaatgaattatgatcttttcactttttgtccaatgtattttatgtcttatgtaacttttgctaattgtattgatacccaatgatttacgaaaaaaacattcagttatcatccattgctgaacagaaaagccaaggcgtcattagcgatcattaaaaaatttgtgacaaattcgtccgccgtttcgccacacgaaggaatggcacaaccattggacaacgacggaaggccattcagtgaacgaattcggcaagaaaagcaggacaaagaagcgtactttaaacaattggcctcagcttggggtgacaaagcatgaaaaacaaattcgattatgtaaagaaaatccgagaaaaaaaaataccgaaaattaaacaaaaaatctcgctcgaataaaattgttttttttattcgcatcgcattcttttcctccaaattttgtttcattttttgttacccgttttggtccggtttctgtagttgcccgtaattcaaggtttttgaatttatttcgcttttcaatctcgcgcacaaaagttttggcaaaatgtctattgtatatatgtgtgtcattcatttattttttgaattttttggtggttaatttggaaaatgagaatttgatggggttttcttttcttttgacaaatttaccgtattttctctaattatatgcccgggtatattattttttaacccaatcagaaagggggagataattagagacgggcagattaatggagacatggagattatttttcaacagatttatttagtggaaaatttttgaaatttattttgaatatttatctaaaaaatcgtcataacttttgtaaacgttgaccaaatttaacattcttggtttcattcgatagcctttaatgttctctatctatttgctgaatgcaagaaaatttcattgcttttcaaaaaagttgaccaaaaatcgtaatttttttttgtcgctttattcttgttttattttatgatttattttcccttttacatattccttttatataatttagccctttttgttttataaacatttttcctcaaaagtcggtcctcaaatgtcaaatcatcaaatgtcgagtagccgttaataatcatcagggctgtaaaaatatgcacaaaaatggccaaaataataaaactaccgtacaccagtaagaaataacggaacgcattcacaaaaacgcacagtgctgtaggggcaaattggccataaactaccgaaaaaatttgcacaaatgcattcagaaatgcataaatggactgggcgataagtagggctgggatttttagttttttaactattttttctgcggcaagttggccactaaaataattttttgccactattttggcgtttcgtcattatttttgccactatttcgcgatttttcaaattttgtaaaggaaaattcactaattttcttcaaatataccaaataataccatatttttaaaggaaatatcgaaccaaaatgcccgcccaattcaatctaaatctgcatttattcgtgactggatcaaaaaaattgacggcgaagaaatttattccattaatggaaaaataatcttttgtcaagtttgcgaacagcaactaaagacaacgacgacttgaaagaaacaacagcagcaacatgataattttccacagattccatgctctttttgccactattttggcatttttggaaaacttcccaaaattgcaataaaacgaaaaatacacccctaagaatcgacctaaaaaatttttttctaaaagctcttccaagaagcatctcgtaaataactctaattgttaaggaacaaaatgacggacgggaaaatcgccaaaatccgtaatccgtaattacggggtccaataattccgtaatccttaattgcttgaagccctgcttattaccgtattattccaaaattatgttttttttattctctcctacataatataattcaaaatttggttaaatcgaataataaatgccggtatatttcaattttttcgtttttttaaatttcctatttatttggctatttccatctgaaatttcttaatcattcgtaccaaggatgttgattgtttcaagtttcgaatttcgtatgttgttggcacgaaatacgaaattattaagcactggtaagaatgtgggaaggggttgagagaaaatattttttgaaaattggtagaaaaggaaaatttttttgaaaagaaattataatttgatcagttcttttacacgtaaagaacaagaaaaatatatagcctgggcccgtaccaaaagaacgaggtaagggttaacctaccctcagaaccaggggtggggcgcggagagaaaatcacgcggtcgcggatcgcgcggaaaattggaaaattattaggcgcaaatcgaaatttaatatacaaatggaaaaaagaattaaatttaaataaaatgaatttttatgagcaaaaaaagagggaattcattaaacgatttgatgaatgtaaaagtttatatggccaactcaaacagaaagaatttgtgaaggaattgggcatttctgaatttacatttataaaatggaaaatgaattattgccaaattacaataaacgtaataatgtttttttaattaattaatattcatttaatttttatatttatttgtttaaggcaaattgaaaattcatacctatgctgagaaattgaaatatgtgaaaagaagtgaggaaatgaaactaagaaaatctaacgatgagtgataagaaaattgccgaaaatttgggtgtcaaacgaaccagcttaatcggatggaagaagaagttcggcaccaaaacgtgaaataaaagaatttttcataaaaataatttattagagcccggtagaatgattctggatcaaactgtaaattttcattgaaataatattttgaaattttacaggacccgtacgctttattctttgtaatttttagaccgtttttttattctaccaaaattgccttaataacgcaaaaattggataaagctttcacaaatgattaaagtgtttaacgcaaataaatcagaaaaataaaaaattctgaaagaaggaagtccgtcgatgctgacagagcaaatttttgccatatttattcattttttattgcaaatattcaattggaattatgttttttggaattcaattggatcctgaagaaaattaaatttcctgaacctgtaatagaatctgaactaggttcctgaacgtattttcagtaatttattgccattgatggatttttacgggataataaataaatgaccaactaactataaaaaaataaatttcttttttgccttcgtcgatacttttttcaaggttttcatttttcccatctctcagcatttaaaaaaatttcgtaattctccatatttatctgagtcggtaaacaatcttttgctcccatttgtcagctgggagaagcaccctttgctcagttactttttaatttcttttttctttttgtttgcttttgcttctcctaaagtctagaatgaatttcaaagaacactttgggctgtaggtacataagttgattgatttttcttctttttaaaatctcaaagcctttttaaatcgcagagactgcgtaatttgccatccataaatcacttaatatttggtttttacttaaaaaccataaaatggtttttacttaaaaaccataaaatggaaaaattttgacgaaaatttgcgttgctcaagagtaacaaaatttttaatgcttcttatcatatagcctaaatgttctctttaaccttcaaaatttcaaaaaatttttctgactttgaaacaagtcatggccagaagaattctaaacccagatttttcgtatgggtttcgtcgacgaatttttttggttttcgccgggactggggttaattattcaatggtggcgttaaggattgcagtcgggattagatttttgtatatactttaattaacaaatcttgaatcttgtcccttaatttatgacggcaaagaattaccacgatccaattaaatgctattgtgttttagataattcaaatggattttgcaacggggccaacgaagaaattctgcgaggtctgtcggagctggattgacttatttgaggataaaattcaagtggaaaagttgatgagtaagccggagtgttttgaattaaaataattaattaatttttttaaataaaaatgtcaactaaaagcattgtaaaaaaataaaaataagtttatgagcattggaatattattttccattttttaaaccttagatattaaatatttgtataaa

SEQ ID NO: 7169 - DNA, 971 bp, Heterodera glycines
gagcaaatatttttaaaatttcaaatatgcttttataagtcatcaaaaataatgatcaaataaaaatcgttgatcaagtggttagcaaaatgtttcttccaccttttcagagttccgtatcccactgcgcaatttcttgccaattattttatcgataatttctttgtttctttcttttactgtaaaatattgcttcatcttatctaatttgtcctcattggtataatgctcttaaataaaattacatttaacttcattagaaaacattaatcatattttcacatgcattatatttaaatcgcgcttttcctgctcaattattttcattttaggatttttttgactctaaaagataaaaattagtgttacgattattttcttcatattttttaccggaataaacgaaattgatgaatattttaaaacacattgataaaggattaatcactttaatgaaaattcgaatagataaattttataaagaattattaacagggtccaaattaattcccgctaataaataaatggtcgatacgaagatttttaattggtagcacttacgcaaaggctttggttcaaccctttgaactcatattttttctttggaaagagaataaaattaaaaaattgattaaaaaaattattcacacatttcttatctcaagaaaaaacccattttatttgaaataactaaataagtgatttgcactgattttaattaatataagcctcattaatcattttttgcgcttcaggtcattgccaaccaatatttttgtgtattttaaataagtagccaaaaaatcaattgggatttaaaaaaaaattcattattttcgcctatttaatttaaataaaatgaaaataatcaaaaaaagttttatgaaatgaaaaagaaagaattcattaaacgaattgaggaatttaaaaatgtatatggtcaaggcaaaaagaaagaatttgtgaaggaa

SEQ ID NO: 7170 - DNA, 5057 bp, Heterodera glycines
tgttatcagtctctttccgttaaagtacatagacgacaacggtggccctctcgcggacattgaaacgggcgaaatcttttctgacattcagcacaaagggattcacaattttacgattggaaaacgccttcggagggacaactgcagtgggtccatgaacgcattgttgccgcatggggacgcactttatgttgcggacattgaccctttaagtcggacggtatttttggtgagtttttcgaagccaactgaaagcctttgattcactttgtgtaatttagtgctcggggaatacccatcccaaactttttgctaaaagagtgtgtgagtgattggattgtgcttttctcatttttgccggaacacttcccccccccccttcagtagtttcgtctccgtcttggttaagtgatgaccctccagcggaacacctcgttcggaatgctctttcatgcgttttccaacgcataatatcaccaattccatgcactttacaaactcacggaaatgatgaccgttttttcgaagttcgattcggctcgccgtttcgggcgactgccacgggacaggcatttgttcgttttattcactttgacaaccctttgtttattcagttatgcgttttttacgacaacattgagtgcctgggctctgctcaaatcgaaagtgttcttgagacgttgtgaataaattttaatgcgaaattgcaaataaattattttaaatgcatttttttacgaatgtcgcatttccatagtttatctgtccaaaatacaaacaaaacatttaaagttcaatcagaaaaagaattcaatgaaatgagtgagcagaattcggctgagcaattaatccgtttgctggaagcgacgcttctccccgattcggtgaagggggcgcaggatgagcttcttaagttgaccgccttccccggtgcttttgtttgacgcatttttttttatcgttgcgccgtttaggctttgcccggacgatgcttcgtatcatttgtgactccaatttacctgctcacattcgcaacgcggcgtccatttcgttgaagaatttcgtgcgtatcaattggtttggcgagggcgaagctccgttggccgacgacgaacgagaacaaatccgaagtgccctcctggagacaatatttcaggtgggcggttgggccatttttcatcaaaattgggtctctcactttcagttgccttcgtatgttcgcccacaaatgattgaaattgtttgccaaatcagcaaagttgacttcccagatcgatggccacaagttatccagcttatcgcgcatcatcttcaagcagctaccgattttgaccagttgtccgtgtccttggccactttggacaactgatcaatcggtaccgacacgaaatgcgatcgaataaactgtggactgaaattattcttgtcgtgaatactgtaagtcgtcatgtttgtcatcgcttgactttgctctctaaggtggctgaaccgttgacgcagctttacgcgcgtatgctccagtttctgcccgacccggccaaccaaaacacgcaacttggaccttctgatcggctgtcttggctgcaaattgtgttggaactcacacgcatttatcactcactgatttcgcaagatctgcccgagtatttcgaagtaagttcgcctgagtattactccgtatttatagcattttaaggacaatcttacaccttggatggagggctttttgcaattgttggagttaaaactgcccgagcttgaggcgaagtcggtcgacttggaacctaatgagcatgacaaacttcgctgtgaaatttgcgagatcgccactcttttctcgcagcgttttgaagagtgctttattccctataccgagcgattcattgcctcggtttggaatctccttgtcatgacggacagccgaattcggtagtgcagcaaattacttcgttttctgtcgtataaaattgggaaaattaagaaaattgccccctccccattttcgtaaatctctccatttcatacttcgatttattctgtccctttttcaaagtttcgattcgttggtcagtgctgcgctcagttttctcgccgccatttgtcagcgtcctcattatgcgtcgcatttccgaagtgaaggcgttttgaaggcaatttgcgaaaatgtcgtcgtgaaaaatttgatgttgcgttctgaagatgtggaaatttacgagaacgaaccgttcgagtttctcaagcgggacattgaaggtggttacgaattcgttttactttattcggttcgtctcattaaggctccgacctcgaaacgcgccgtcgtggcgccgccgattttgtgcgggccctttgcaagcagttcgagtcggaagtgtgtgctctcctttcctcggcaattcagagctttctttcggaataccacaaaaatcccgccctgaatttcgccaaaaaggacgtcgtctattacttggtcagtgctctcgcttcgaagagcacaaccgcccgacacggaaccaccgacgccagccaactggtgagacctgtaaaaagaatgctcttactgcttttcagataaatgtcgccgatttctaccaagaacacgtccgttcggatttactcttgggtcccgtcaatgatttgcccattttgagaggcgacgcattgaaatttttggtgcttttccgtaaacaattgaagcccgaacagctgattgagtgtctccgcggccaaaatggtttattggagtgctcaatcatccgctttttgtcctctgcccatgttctgattcaccattacgttgcttacgctgtggaacgcttattcttgatgaaaaatccaactaatcctcaggtaatcgtcgtctcattttgggtaccaattttgatttctgttcaggaaactcttttcaatgcatccaatgtgccaattgaccttttaatcgatgctctttttgattgttttcaagtcccccaggcgtgtgaaacgcattatgtgatgaaggcgctgatgcgggcattttcattaattgacgtacccaattatcaattaattaatcgcaatatttattttatttcgatttctatttcttaggatcgcatggcagcaaattcccatcactatgtgaacaaacttttccagatgatcacagaagcagtccgcgtgccgaaaaatcctctttttgtgcattatatttttgagtcgctttgcgttttgatcagaagggttcgtttgagtattccccatctatttttgttttattctcctcctttaggcttattccaaagtttctggtggtttggatcagcatgttattccgatcatcgaactgattttgggaaacgacctttctgattttgtcccctatgttttgcagattatcggttgagttgcatggcaatttctctctgatttcttcgtttttagctttgatgttggaccaaagtcaatcggagaagcaacgcggcatcgaaatgtctcaagaggcttacgtccgcttcttccccactttgttacggcccgactattggttgcgttctgccaatgttcccgctttggtcctcgtcttcgagtcgtttattcgctgcgttccccaattggtcttcagtgcacaatattctgatcaaatcctcggaatttttcaacgtctgattgggtccaaagcctacgaccagcatgggttccgtttggccaacactttcatctctcatttggatttaaatgttcatttgtggcctttttggtttgactttacatcgctttaaaggcttacgaacgcccactgaacagcaatgttgttttgctaacgatgctcaacagaatgcagcaaaataaaacttccaaattttcacgacaattcacaatttttgtgtttcgctatgcggcgatcaaaggcggcgcgactttagccaatgtgagaagagagaggggagaaccaatcgaattcacttcatttcccttccgccccccgggggtcatttccccgagaaatttttaaaaaatgttcacaatgtaagatataaaaatatctgacttcgaaatattaagtcactggaggcgatccaatccgggatttacgggatgatgttggacaaaattctgcttaacgaaatgcaagcgatgccccaaacgacgacttacgaagagaaacgaatcgtcacaattggggcggcaaaactcataacggaaacgaccgcttttctcgggttgtctcttttttcgttgtgcgatttgacttttaacttgcaatttagcccccgttacgctcaaatcattgaattggcagtgaatattttggaagcattcgaacacaaaacttccgccgtggtggacactgccgttcaggaaagagaggaaaccgccgaagtgagcgaactcgaatacagcgacccgtactgcaaactgtcctatgctcaacaccccgaaccatttgcgcccgaaatcggaaacataaaaagtgggtgccaattggactattaatttcgcatttttcgtttttagtgcactttgcccaagccgttcttttcactgtccgtgaaactaaccctgaaaatttcgattgtctgaatgcgagggttcagaattgtctaagggcttattcttcaacaatctgaacaacgttatttttaatatttccatatcttgagttcaatctatttattcatcttcatattttttgtcgttcgttaacatctctcgttaaactttggcataaatttagttcaattcgtacgaattggttaaatccatctcttccctttcgctttcatacgatttgaggtcatcaaattaatggtgcgaaggctaagaaacgaaaaggaatgatttgtggggtgacccgtttctttgaggggcgttgggtttcgcgtatccctccgtctcctcggcggtcaacggatgttcgaaggcggcgccgggggatgctccgcccctttcgtcttccattgcttactcccgcattcgttcatccgagaagctccttcgctgagttgtcgcctttcgaggatcgattgatgttgttgaataatgaatttgtcgcgccattcgtcgagtggtcacac

SEQ ID NO: 7171 - DNA, 2323 bp, Heterodera glycines
tccgtcgcttatttcgtgtgcccatcgatctgagaaggtgcattcgttctgttccgatctccgtcttcgcaaatgctttcgtccgcttctgctctgagccgtcgtctgtcactaaatgcaaaatccgcccatttggggctgggcgaccgcctcggcaatctgacggccgaagcattccgtgcttatggcgcattcgttggccgaaaccccggcaaagttttggtaggcaaaaggggggcaaatgaaaaagcgaaggcattgaccgatcaatgaatggcttttgcgttgcgattgatctccgatcggtccgtttgaggtgtttatggccattttcacgttggccactcttcccggactgttcttcctcaaaatcaatttggacctttacaaagtttgccctttcctttcctttttccctttgcttccccctttttcagcttttcgtccctttggatgcgcccgttcggttcgaatttgaaagccaaaaattgtacaaccaaatcccccctggcaaattggactttcccctcgggccgcccccttcgctgatcgccaccgaccctccgcccgcttcttctcaaatgaatgaagcgccccccgccgaatcggccgccaacgaacttaaagacattccgaagaagaggaactcgcgaaacccaaccaaaaaagtgcacgaaggtaaaaaagaacagtggaaagagaaagtcgaaatttgaagggaaactgttaggcctcgggtgggcattgaacccacgccccgcccccattccgtggaaagttcgaccattgaacgaccgcggcaaatgtttacttgctttttaatgaacctttccaatcccactcttcttcttcttctttccctctctctctacagacccctccgtcccccaacacaatgatattttgcgattttacgttgtccatcgtgattatgaggtaaaaagagaaattgtgaaaatgcaatttcgaatttctaagaatttgctgcacagcgacactcttggcaaattgtttatgtacaccaacgaaatgatgaaagtggcgatggaatatgacggggaaacggtcagaggaaaagccattccaaagagcaaaaacaaaacagaaatgaccaatcaattgcttttcagtgggtttttgaggacttttgcaagcgggggccagcacaggagcagtgcagcaatgagtgagtaggggagaggggaaaaagggaaatgagggagaaggggagacggagaaagcgtaagacagagagagagagagagagagagagacatgcgttaagtgccgggccatcccaactttgataattttgcagactgaacatttggctaaaacacgcggagaatcttttccggagcaatggcacccgtcacaacccaaacttgcaactttcttaccccgtcatgtatttgttcaaccgaccaaaagtgaaacagcttttgccttctcatttcattcgctttcttaggacattggcaacataatttatggagtcaatgtgacgggtcaaaagcacgaaattgtgggggcgcgagttttgacgattcattgggtgaggggggggggggcatttggtcatgaccaaatgaattgcaatttaatttatcgctaattgacagttcgtcgcctttccgctggcaggcaacaatttggccgcctttttaaagtaccgcgaaggactcaaccgattttgggatgagaaaactgccgagtcgcagatcaatttcattcctcataagtcggtgaaagtgaacggaattggcatgcttttcctgtcaaaacggcatttgttcagtgacaaggcaatggacgacgaacttcggttgattatcgaaacggccgttcccttcgccgtgcccgccaccctccaactgatgctgtcctgtcaatctttttgcttctcccccccccccctcacttccctttttgttcagcttcgtctatctcaccaatttggccagcgacgtgcgcaagtgatttcatcccgattttataaaacgataattagtccatatcaaaaggtcaaagccaattgaggccttttttggtgtgatcagcgtttgtctgagtttggtcgctactttcgggtgagtttgacttcctcgccatatttctctgaatttgattgggtgatttctccacccgatcactttcccctttcttctgatcattccgatcactttctttcatctgttcgtccccatcctttggtcacttttctactctttcctaggatcactttctttgctggccttcatttcagccccgtgtgcagcacgatgcttttcttaattctcgccgtccggagttgacgatgcct

SEQ ID NO: 7172 - DNA, 1492 bp, Heterodera glycines
  misc_feature (14)..(14): n is a, c, g, or t
cggtagggcaaccntgggaaccgggaaaaacaagcactggcatttatggggtctgagtgaaaaattagtgaagaaaattggagtcaaagggaaaaataaaaaataataattaatatattctttaaaagtaacattgcccaagtgtgcaaatggcctaatggctagtctccttgactttcccttcttctttcccctggttcaatccctctacagaaattagattattttcaattttttgttttgtatactcgtggctttcctataaagaaaatatgattcctcatagtttttttaaattgatacatattttatcattttttaaatgaaaatcctaccaattgagcttaataatcgcaaaaaccaacctttttttgttgaaaatctgttaacaaattgcacccaaatttttaaaatttcccccggcggcgcctatcggcaccgccgtacccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattataaaaaaccaaataattttgtattattttcacttgatataaattaaaatttgaatttttttttaaatttttaaaatttttttgaatttttaaaatttcccggttggtcccggttcccggtttttcttgcggtcccggtcccgaaaaaaaatcgaggtcccggtcccggtcccggcttctcaggtcccggcaagtcccggttttggcaaaaattcccggtcccgtggcactctatttttaaaccataaacaatttgtcgctgcattggttgtttttgtccgggtgaacgacacggacaaacttccggtagttttcgttgatctcctcgggtgtggcattttcacgcacgcaaagccactcgtgaggacgcaactaaaagtgaattaattatataaacaatagaaaattaattatgtttaaataattatggattacatacatttaaatgatttccagtgcaatcataaaagtgaattttgaaaattttgaattttcgactttttgttcgaattcgggtccgggattcgaaattggtcaaaatgaatgtccgattcgtgatcagagaccttaaaaaccccataaaacgtgttttcacgactttttagaacagaaaaaattttttccaaaaaatgggggggggataaacttcagtattaccgtttaatgtatcaattttaagccaatttattcacaaaatacattttttttttgttgccaaaatgagcacggaacgctattccttctctctcaccaccttcaggttttgtttaatgttttgaaaaatgcataatcaattctattggtcagatacctgggccaacggcaacaagttggacactttcgccctggatttgctggcttataattagagaccggcgcgg

SEQ ID NO: 7173 - DNA, 3446 bp, Heterodera glycines
ataaatatgtgcacaattacttttgtttaatatttttctaagtgcattaaacaaattaaaataaatttttagttaaaattaaaatgtcatcattaaacacttggaaatggcctaaaattatttgaacacttgaaactatagcattttatagaagcaccagccaaattaacattctttgtatcatttttagctccaagagtccttttattctgtaaaatttcataaaatttgttttgttcaaaaaaagtaatggccaaaaatatttagaaaataactttttttaaatagagccaaaaattattatttttaaattttatttcataaattttattttgaggaatgaatgatgatcagttcagtctggaggaagaagaaggaaaagaacagcaagaagacaggaaaactccgacaaaagatggtaatatacaaatattagaagacattttcagatataatttggtaacttaacgacaattttaaaaaattaattgaaaattgcttcaaatttcagtttcggacggtcatttgaaagcaattttggagagaattggtgaattggagaagcagcaacaacagcagacaaaaggcgagggcaatttaacgaaaatgaaatttttgggcttttctttggtaactgcgcaattgaacatttttcgaatcatttaattattgagaacattttgactggcaacagcagaattaatacaatcagaaaaatcttaaaactcgaccgattctgcgaaaaaatgctaaaagcataggaataattattaaatttattttattttcatttaaataaataaataattaattgttttctattttaagctgctgaggaacggttcttacaatcgcaaaatgatcagaagaaaattttggaaagaatcttcagtgaattggagaagcagcaacaacagcagacaaaaggcgaggacaaattaacgaaaatgaaaaaatatttaatcgaattaaatgtttccattttaaatttaaaaattaatccgatttttaagctactgcggggcaattgtcaaagattttggaaaaaattggtgaaatggaaaaacagaacgaaaacacggacaaaggcgagggaattttagcgaagaataaattatcacttattaaaaattcttttttttgaataagtttcttatgaattaagaatttcatttaaataaattataacatttttaatttttgaaaattaattttaggaactttggagcaattttcaaagatggaaaatgatcagaagaacattttggaaaaaatcagtgaaatggagaagcagacaaagaaaaaggtgaatgaatgaatggaagagaaaaataaaataaaaatattttacggtaaaaataatttttaatttatctaataaattattatataatattattaaaaaatatcgaattatttactttcaggggtttttaaaattccaagaaaattgttgggatgccttcgcttctcacgaggacatcgaaatcagtggtgacaaaagtctcattgtctatgtctatccttcgagaaaagatcatagtatttttaaaatttacatcaaaattcaatttctactaacaagacgcgtggcatgccgtcttcgcaaaatatccgattgtgctgaacaagtctttgtctgactttttttactacgaaatttcagttattaaaaaaaaacgaatttaagtaagcgaattttggtataaaaagtgaaatattttattatttatttcttctttattcagttgggtcatcaagatcggattcgctgttaaacagcagacaaaattggatgaaacaattcaacttgaaaagggcacttttgcatatgaaagcgatggcgatatttggattaacggagaaggaaagggaacaaatgcccaatattcctacggtgttggcgataccgttggaattggcgtcaattcggccactcgacagatcattttcaccaaaaatggacttcgtttgggttagcaaataataaataatataattttacgattttaaattacaatttggttatttgtctattttatgctaatttattttatgtttaaaataatcaaaaatcccttaactttttcacagatacttctgatttggttgatccatcttttgctgatggttcattttatccattcgttactttggtcacttctggtgaccaaattgaggcgaattttgggcccaatttcaaattcgatttggcgactctctgaaggaaggattaattattcactaatgttttgatctatttgctctttttaatcatttttatgtttttcttcttcaattaaaatttggttttctgtaataatcggaaaattttgtcgtttcccgggtatttaataatactttcaaagtactcattgaaataattttttctctatcttctttatttaaaacatatttttgccattttatgtccatatttcgcgattttatatccatatttttgggaaaatatgaaaatcagaaattactttttcatttaaatcacaaaataattttatattttcctttcctcgacccattaattatgtttttacaatttctgtcaataaattgcactgaaattttcaaaaatttcccggcggcgcctatcggcaccgctggacccttttcttcccaaaaagtttttgaaaaaagcgcgccgttaaaaacgtgtaaatagtcactccttttcccaaaaattttctaaaataatgaaaaatgacataaaaaaattttaaataaaaccatcgaatacttttcaagaaaaatattcaaaaaaccaaaaacatttttgaaatcacctaattaaaaaatttagcctattaaaatatttagaaatttttttatgatattttatattttttgaaaaatttccgatttccgtcttccgatgtttttggggtcggaattccgattttcgacttccgaaaatgtttgaggcctcggaatgccatccgtgtttcccacccaccctttcgcgacggtcatttgcacttccttttttgtctttccctttttctcatcctttgctacactctctcgtttctccccgttaaatgttgccatcacctttatcttattttttcatccataatattctactattttgtttttctcatacgttttctctctcatttcatcatttcctttgcctactattttctctacaatttttctcccattcttctgcatttattcctattgtaattgcttatccccgcccattgccttcagcgatgacttcccctttcattggcctttattccttccttttcatccgtgctgacaaatgagtcgatccacaaaaaaaactcaacaataataattaaaccggaccttaaaaatccttaattttcttgaagattgcccaaaatcgctaaaaaaaatagcgcaacaaaaaggtgtaattgtcaattatttgttttaaaattaattcttaatgtttt

SEQ ID NO: 7174 - DNA, 1600 bp, Heterodera glycines
  misc_feature (1446)..(1446): n is a, c, g, or t
ccctaaaaaatcccctatttttcttgcaaaatttgctcaaatcgcaaaattttgtaattttttggacaaaatctgttaaaattttcccggcggcgcctatcggcaccgccgtacccctcctccaagttcccaaaaagtttttgaaaaaatcgcgctgtataaaacgtgtaaaaatagtcactccttttcccaaaaatgttctagaaaaatgaaaaatgacaaaaaaaaatttgataaaataattgaataattttttcaagcgaatatactaaaaacatttgtgaaataccttttacttggttaagaattaaagaatttagcctattaaaatatttagaaatttttttattatattgtatattttttgaaaaatttccgatttcttgcaccgcaaaaaagtggttttgaaaagaaaaaatagtcaaatttatgaaccgttaataatttgatttccgatcaactttttaccgtcggatccaatcgaaaaatcttagtcgacccatcagccccttttaatgcatcatcccgccagcccctaaaaatttatttttcagcattttttgatttttggaaattttttgaatttaattgaaattttttcgaattttctaaaatcccgcaatcccgcacgggatcccgcaaattttaaatgcgggatttgcgggattaatcccgcgggatcccgtcccgcaaaaaattttgagttccagtcccgcagcgggatccgcaaatttgaaatttccggtctctacttataatgtatgttaatagttaccgaaattcctttttacatccattacatccatgtttatcatttagagctattgtggtgattattattgctgtgattattgtcgtggtcattaggacaaatgtttcaacgaaaaaagcactagcaagacaatttgtagcattgcataacgaaggatttcgtgtttccaccgtcggcgataacgtaatttttctgagaatttgtgatattaactttacgcatctatttctcttttcaagctttacaaatggtcataccttttaaacggtccaacaaatattccgcaaaatccgccgaacattatctttcttgatgataatccatccaaacagtatgttaaaaaactaattaatagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattanaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttagggggtgtattttttcgttttttttt

SEQ ID NO: 7175 - DNA, 2661 bp, Heterodera glycines
aattgtcgattggatgactgactaaccatggggcaattgtaaaataatagaataatttcaaattattaattttcaaattaaaatttagtgaagtgaagtcggttctaattaaaacaaaaaaaatcaggcttctatcatgtgattcttttaaaatcgctgcatatatagacattttcattctattttacggctatggagaactttttttttttaatttgttgctctaaactaatatttaaattaaaaaatcccaaaacacaattttctttttaaatataaatattttggaagctgtcatgaatttcttaatcatttcttcttttaatttttgctggcttaatcagatagtagttactatccagtcattgtcgcggtggtgattgatggcttttggtctttgatgtttgccgcgtgattaattacctatggggggtgattaattagtgcgcgagcctaagcctatgggggggggggtgattaattagtggggagcgagcctatggggggggtacttaattaatgcctatggggcgaagtttttgcgtgaaattttcgcgcatttttttgattttaaatttcggaagggggggggggggtgaagcctaatttcggcgggaaattttcgcgcattttgatgaaacttttttaaaagttttggggtgtcaaattttgtttttttgttttttggtgatcattggtgggggggactatgcagcagcgctgtggtgttggtgatggatgagagagataaagtgagagagagagagagaagaagcaacgagagaaaagagacgggatgtgagataagagtgccggggggggggggatttgagagtatgcgatgccaaagtggcgtcctttcgttgaatgacgcgcggtgagggagggatggcgcaattgtttggcgtccgtaaaaacggagtgacctcaatggttggggggtccactcgcttttggcgaatagagtgacctaacaggggggggggattgattctggtgagtatgagttccccactttcattattttctcctttttttttgcatcatacgaacatttggcttccccttcccccattaagtttctttttttagaatgaaaaaaattgacgaaattgcaaataatttgagattacggacaaaaagggcagctttccaggtggcctgtcacagtatttctgcccaaaatgctgtaatttttttttaaatctttaagtttatcatttttttttcattttcagtctccaaagccccgttcagcagacaggaaagttcgccgtcagtcggtccgtcgcccgcccacaaatgtacggcgccagcgcgcagccaacatcagttcaaaactggtaaatttccacaaaatgatttttcataaaatttaaattttttaaattttttttgttttttcttagtttgatgcttccgacatggaagacgaaaattttaacaaaaaggtgggggtgaaaatacgggtaaattagggtcaaaaaagctacttttttcagcaacaacagaacgatccgataacaacagcaggagtcagtccgataatgattttttaataaaaaattaaagggtttttttttgggtggtatgaactgaaattttagattttaattctccctccctaatttaggaagaacgaagtgagcttgaccaattgtttttggaagtgcaacggacagttttcggcattggagcaaaatccaacttcaaagaggacgcggtggtgcgacgagccgacaacacattggtcaatgattgggaaaaacacgaggggggggggtctgaaaaagatattttttcgtgtgcttttccaaagacaaataaaagttttttgttgtttttagcaacgtcctctcccgccgcttttccacaatgatgatgaagcccaaaaggctgtggtcggcaagcgattggtcactgacaatgcggccaaaagcggcacctcggccgcgaaccccaaaagggtcaaaacgacgttggacgaccttttgatggatgtggaaatgagagcagagcaggacggaacgcaaacgacgcagcaaattgcgagcgaccaaactgaccaacagcagcaaaattacacggtaagtaattggttcgcctcaaaaaatgaggggttttaaactcaagggggagggggtcacaaaaatattatggtattataattttgcgattgttaagagaatttttttgagggagtgaatgatcttaaaattaagtgtttttttttcagttggtcaatgtgtgttcaacatcaacaacaaaactgtgtgaagtgcaggacggagtgcaaacgacgcaacaaattgtgggcgacaaaacggatcaacagcagcaacagcagcaaaataacatggtgatcgaaaagccggtgagtaatttattcacgcaaaaaaggaggggtgtctaatgaccaagagtctcaatggagggggaggggggttagaaaaaattcattataattttaaatttttgtgattgttcaggtggtgcatgcggtcattgatggcgacgacgaagattctgaaaatgtgccgagcttaatctcaattggcactcaaacctggccaaaaaaaaagataagttgcagtttttgaaaaggggtctaagggattccaaagtccgtctcatggtgagggcctgtcactcccatgcaga

SEQ ID NO: 7176 - DNA, 2200 bp, Heterodera glycines
cacgtacaatttctgcactgatatggggataaatattagaaagggtaaaaaaaaaaaataatttaaaaaaatgagaaggcaaaatcaattgtattggcggtcgagagtgcctgcactcaatcgtcccctccccccccccaaaaaaaaatttttgatcgaatggtaggggacgattgagtgcaggcactctcgactgccaatacaattgattttgccttctcatttttttaaattattttttttttttttaccttttctaatatttattcccatttcagtgcagaaatcgtacgtggcaacaaaagcgggacagtaaacaaagaaaagaggaaagattgaaagcagcacgtgcgcaaatcgatgctgatgtttataatggaaaatttttttttcgcagataacttttttgattttttcgcattattgatcaatttaaaaaataaattcattttaaattatgagttggataataaaattatttttttttcaaaaaaattaattcttttaatttaggagttggataataaatttaattaaaaaaaaataaattgctattattatcaaacagaaattattgtatatttttattatcaaacaatattagaggccaagtttaaatatgaaaaaaattcgtagaataggatcaaataaattataacaaaatgtcaggagaattaaatgaaatattatgagtataaataaattacagtactattatcaatcagaacttactgtattcttattatcaaacagtgtcagagtcaaagtttaaatatgcaaaatttgtattaaattgcaacaaaaatgtaagagacattaaatgcaaaggcaaaagagtagaaaaagcgaaaaaatgatcgtaaattcttttctttttgatccaatttctactctttcaatttttcatatattccaattcggaaatattttgaaaacaaatcaagcacttgggttcatcgcttgcaatgattgggatagagcactttggacaagaaaaaacatgtaaacactccttagccccaaatgtcaccatattttcattccctaaacaccacagacaccgttcactgacgatcagctttttccccttttgattgttttccttcccttctttttcaccattttcaagcaaattaccgatcacctcggaagcctgtgtggcgatctgttgcgtcttctcacgctccttcaacagcaaaacgctccatttttcatcaaggcgttgttcacgttccatcatttcttgtcgaaggttttgctccatttctcggcgcattttgtcgacttgcacttccatcctttcagctccaccatcctccagcttttggacacggctttgcaaaatttgacatttttctgcaatgtgattttgcagatgtgtaaaggcggccatcgccaaagaagccgcttctataaaggcaaaattatcttttactcaaaaaaatgattagtaacattaccattttgctcctccgacatcaatcttctcctttttactgatgatgatgatgatgatgtctgatcagtattcagcgatggtgtcattgctcgtttcaatgacgatagtgccacttgtacaacagcaagttcggtgttgcctttctcaaggactctgttcgccagttgttcatgttgcctggactgttgctgaataatctccagtgtttcgtgcagaactgccggcgacactggagaatgcgtatttgatggataaggcgaatattgctaaaattatagatttttaaattaaattataatgataattaaataactattatttaaattctcacttcatttcctgcccatttttccaacaattctaggcgtgcagaatagtttaatgacagatttttcaaatcgctaacatgggagcgaagaaatctgcacatttgtgcctgttgttgcactttcgaagatagctcgctgtccataattcacaagcaaaatatttaataagaatgaggaagaaaacggaaatgagcccagattggcttctcaatgccaatctccaccaccccaccgagcagtcaaatacggcgcgcccattaatcatcaatccaatgaccccccccccccccgtctcgccactgtccaatcactgtcatattcaaataggatgtgatgctatttaatcattgacacctggaaaatgactcgctaaaaggcacagagtagagggacattgtcaaaataattacaa

SEQ ID NO: 7177 - DNA, 1943 bp, Heterodera glycines
  misc_feature (18)..(20): n is a, c, g, or t
  misc_feature (34)..(34): n is a, c, g, or t
  misc_feature (1847)..(1847): n is a, c, g, or t
tggtaatagtttacatgnnnatggttggtaaccnctccccctttttttgaaaaagaaaaatttcaaaaaaatctttagaaaaacttgtttttttttcgacaaaattcaaaatatcaaacaaaaccgattcaaatgtagggagcaaaaattgtgtcagggtttgccgggtcctggtccaagatttcgaaccgggtcagggtatcgggttctgaaaaaaataattatttttttcaaatttttttcatgaaaaaattcagatttgagattttactcaaaaaatgaccaaatttattggtttgagccaatgtgattttacagattcgtaccaaaaatgttcaaatttgcaaggaatgtaatcttcaaaatttctaatggggataatgtttaaaaaaaagaaataaaaagaataccaccaatattgaagttgcatataaattacatatctttcgatccatctcgatgagacaagtcgattggtgtaagtattgagtttaattaaattggaccgaaagactttttattatttttgtggacacaataaaacaaagaacgagtaaataaataaaatccagccatcaatcaaatagtgtaaatttagaaatattatcattgatgtaacaacagatgaatgttttttgccgttcctcagctgacaatgtttgcgatcatttgactgactgtttcgtccattgatctgaacatgaaaaaatgattattttttgattacaaaataaattcccataatttatatttcctaaaaacaatttttggtaaaaatttaattgcccttccttttcaaaatgttttttcaaatttcctacatttttaacaacaacaaaaaaaattcttaaaaatcgtctggcccattagggaaggaggatatgaattatggcttaatttctacctgacaaccatgttcatggacaccgtctggtcggatgggtccatgaccaggcggacacggcacagcacatcgatgccgccacggaaaatgccgcacagcaacagctggtgggacgacttgccctccggcacccgattcgaatgctcacaagggaaaagggcggtgcatttgagcagtttggagacggcatcttgggagggggaggggattggattaaaaaatgccataatggaaaaaatgccatactaaattagaaaatagcatactagcataaatgccattaaaaatgccatactaattgaaaaactaacttaaaatgccatactaattgaaaaactaacttaaaatgccatactggattaaaaaatggcaataatttttgtttgcacaccttccaatgtgtgcacattggacagcgcgtacgactcctccgtctcgtgcccctcctccttgagcgcgtcccacgcggtggtaaatgaagcgcccttcggcgcggtggccaacagaaagtcggcaaggccaacttcgatgggctccaactgtcgaagagaaaaaaaatatagccaatttttccggattttatttatttttgtgatttttccgcaaattttgtatttttagtaaaatacgaaaattgaattttccttaacggtgggcatggttttgaagaaggtattacacaatgaatctttcggagaaagagtacgtaacgcgcaagcgtaagccacccaccccgcttttcaaaaaaaaaaaattcatgtatgacaaccggacacatctttgtataaaaaacaaagactcaaccgaccgtgtacacttcgtcgtacaaatcgttgctttcccgctcgccggttgcggggtcgacgtcgcaaatcttgaaaaaacggggagataaattaaatgaagcaataaacccagcgagatcaataaggaatgaaatggntttgtggcttcgaaaatggaaaagcataaaacaaccacacgcactttgaacttcagttgggcgccgaatgtgccggaaatgcgtccgtcctccggc

SEQ ID NO: 7178 - DNA, 1888 bp, Heterodera glycines
  misc_feature (1824)..(1824): n is a, c, g, or t
  misc_feature (1850)..(1850): n is a, c, g, or t
  misc_feature (1852)..(1852): n is a, c, g, or t
  misc_feature (1855)..(1856): n is a, c, g, or t
cagctgcgccacactccgcgccgaatttggccagcgcagtgacagcggcggcacggaccttttttatggggttaataaaataaagacgtttgaaaatttgaggaaaatttcaaaattgggactgttttcctagtgttggttggtctcagaattttttttgttgcttctcaatataatttatcgtcaaagaatcgaacaattttaaaaaaaatgctgtctttcagcggccttttaatttcatcattgaccaagaaaaaacgcgattgaacctcaaacgattaaatcccaaaaatgactatatcctgacggtacttaatttttgaattgcataaatttgaaagcattcgacaatcatttaatgttgctattagcctatagaatttcaaaggttgagtttcaaaaaatgccaaaactttacggaacctaagttttatttattttttttggatacctttttaaagatgaattttaaaaaaattgcaggcaaactcttatgatataacatcaaattccgtctctgaattaggactttttttatttgctaacaataaaacgaattgtcacgccgtatcgaatagccagatttttctaggtgttagagcctcacctgagtgctctccaaaatgacgcggttgtagatgaaccgaatgtagcgggacgggttcgccgtggtcggtccttcacggccgagcaaatgcagcacacgggtggccaatgcggcgtgttcacagtcctcaataaactcgcaactgaaagggcagaaaaagcaattacttagtaaatcaaaccggaaaataccaaaaaaaaaaaaaaaaaatcagaaattttttggctttgtcgacaaaaatataacattccaatgccaaataaaatataatttgggaaacaggtggatgaaactactcaaaaatatcagtaatattaggggaatcaatgcccatgaaaagtgctcacagatgggacaggcccaagtccttggcactggggttgtcctccacgatggtgatgatggtgtccacaatggcctttttgtagtcgaaaccgccctcgtcgcgcagcattgaggccaaaaagttcatcagtgtggcgtgtttgcgcgggtagcgatggcacagcgaacggatagcctcgatgacgacaatctgacaaagatttgggatattaaaaaaaatatataagattttaagaacagatttggcatgggttaattaatatttgaggataggtcctttcccccgcatcgttttccctcgaaaaattagaagaaaaaattggtttttcgcgatttttcaatgtttttatagggataaattatgcgaagcagggcgctccacccacgaagttttcttcgattttttagaaaattttaaaaaatgatagaaaaaatttagaaaaactctagaaaaaaattcctaatttttttcttaaaaataggaatttatagctgtttatcaccaaaaatgaataattatgctattttgagatcaagtttcaaaaatatggttaatcgggttttagaaattttaatgcttatttagaaaagtgcatattgttagaattaaaaagaattatgccctttttcttttgaaaaattttacaccttgaattcgtcgctgatctcgctgacaaaagtgccaatctgcttcatcagccgttccacgctcgcctcggcacccgtcttcaacagcgtggtgatggccaaagtggcaatggaacctgtcaaaatattttatgcaaaaatcgacaaaaaaaaagttgattgagtgcgccatacgattgctatccgtgatcaactgctccaggtccacgttgcacgaaatcacncgcctgagggtagtccatggaaattncngtnntcacgttcggacggccgcaaaacgcagcgtcg

SEQ ID NO: 7179 - DNA, 1716 bp, Heterodera glycines
  misc_feature (1634)..(1634): n is a, c, g, or t
ggaaaagcaataatttttaaaaaaatatcataaaacttcaaaaaatttccgtcggtgtattagaaaacaaaaccaaaattaaaaatttagacgaaatttgtttaaaaaattctggggagggtatcactaaaatgacagagagcaaaaaacagggatttacagccgttttaaacgacctgctaggttccccgctacccaaatttcatacatacaattagttagaccgaacacataaaaagtgccatcccctttcctcccccacctgctaatgcgcggcaaccgcacaatggcagaggcggcctcgtagacgaccatctcgtgtttgttgcgcaggcaactctcgatgaaggtgaaggcggagcgcgactcggcgctgccgccgccgtccacgcccagcgcgtgctcctccgcctcggccgcgatgaggcgggccgccacacggacaagttggcacaacgccagcggggagcgcagtccggacttgctggcaaaggacacaaaatatatatatatatataatttaaattcgaatagatcaaagatttcggggggggggctgaagccaaaattcgatttttagggatgtatttttggttttttgaatcccgaattagggggttgtgttttgcaaaatttttagccgttttcgccaaaaattactattttccccacatttgcgcctatgtccaaaatcggacccaaactacccggacacgacttttacctgaacttttggaccatcttcagaatggccagtcggtcgttggcacggatttgaacgagcaaagaaagggcgtggaattggaccatgtgattttcggcggacaccgcctcctgcacttcgttggcccaacggcggacgaccgaaaaaagggggaaaagccatgaaaaaataaagatgaaaaataaagacaaataaaatctcaaaaaaaaaaaaaaaatcaattttcacggcacttttcatggtgtaaaaaataggagcagctcgtttccccagagaattttttttttaaatttactaacttagaaacttctcaagaaaaaatcttagaaagtttttttataagaaaattctaagaatttttttttaaatatattttatggtgaattcgtaagatctttcaaaaaatttttccaaaaaatcgctgaaaatttctcgaaaagatttattaaaaaattttttattatgaaaaaaattctatgatttctttcttgaaaaatttctaagttagtaattttttttaatttcttgggggggagataatgcaaaataaaaaaatttcaataaaaaagtaagaaaatataggtagatgaaatttgcaaacataataagaaatgtttaatgaatgtgcgcaaacctcggggcttttgcgcatcaaatggagcgatgagaccaaagcggcggaggacaccgaagccgttttgtccacaatcgcctgcttcatgtagcgctcgatagcctggcacaaaatttttttgtaattgccgttttttgccatgaaaaattaaaatgacgcacgatcaaccaaaagttagttatgcatgaaaaggaaaacgatgacagtaagaaattttcaaaaattcaaagaaaatttttttgaagaattttctgcccttcccgttggtttcctganacaagtttttgatgaacacccattatatatgttaaccatggcatgcatgcacaaatccaataccaccacgagttgaacaccc

SEQ ID NO: 7180 - DNA, 2784 bp, Heterodera glycines
atacggcaaagcgcgcggattgcgggcgctcggtacacgtcctcacggccggtcatgtccagagtcagtctaaaggggaaagggggtcatcttcggctatcccccatttgcgtacgggacatttgcgcgtattttttaaatcccaaatatcctatcggcattaaaatctcgtcttatggtttatagtagcattaattttgtttgtttgaataattgacgattttttcaaaaattttattattatcaaattattggatacaatcaatttctatcatttatataatgctgtttaggcgatcaggaatagaaaaaactcagatttgaacctgatttttgacaaaagcgcaaataggtatctggacacggtcatcatcaaattcaattgtaaactttacggaaaaatgttccgttttggcataactttcacatccaataatttatgcaccaaaccgaaaaaggaggtcctttatcgctacgctaattaatgcaatagggatggtataaaaattgtcacttcagccgccctttgttaagaatttttgaaattttgaggtataggcccaaaacggaaaagtaccaagctgttgaaattttgtaaatcaaaagcccgcccggagttttgaaaaatttgtaaaaaaaatgtcaatttttcagaaagatttgttgtgtaaatgaaaagaaataaaatattgaaacaatgaacaggaaacctgctggtcacaatgatcacatcgctggacatttggcacaactctttgatggacaagtagaccaacatgcgcagcgtcatgtccttggcctgccacagtttggtgatggcaaaaaatgtgtcggtggcctccgtcttgccaatggtctccccgtgctgcagcaagtacagcaatttgcacagaatgggccgacatttgcgtgcattcaccggcgtctcgttgaaggcacgcgtctgaaaatgggggcattttctgtattgtcgtcgtcaaatgagggaatttgcatatttttttgccacacattttgcatgataattaacaagttaggaattttccgtgaaccagggactaacaaataagcaggattcggcttaaggatggagtggcgaaccataaccataaaatccagtaaaagttttaacattcagactcgttaactgataaatttggcaaaagtttgagaaattttagtccattttcaacgcccccaacaaattgtgttcaaacattcgaactccgtgcatttgcgcttgcatatgcctaaaaaaaattcgttgcaaattcacgcttttaaatcacaataggcatggcttaatcagcaaaaagagccggacttttcgtgatcggctatgccgaaaacctattaaaaaacgtgtttttgacttaaaatctaaaaaaaattcaaaaaatggggggacaaattgaactattaccaaaatatgttttccttgtaatttatgatttgagtttttgttcgaattctggtttggagctcggaattttacaaaacaaatgtcatattcgtgaccagcgccagaaataatcttagaaatgacgttttatttgaaaatttcaaggggcgtctcaaaacagaaaattaccaaagacccttggacccatttgccgatggtctccaaaaagtatgtcgtcatttacacggtcttgaccaattataagcgcaaatatttgggtaaaacaaaacctcttggacaacagtggccttgtccaagtggtcgtaagggttcccggcggccgattcatcgtcttttttgtcacgacgcatttgaagcacaaaacagcgagtttattatgtatggtatttgaggtgctaaaaatatcgaagattatacagcatatagaaaacgaattgcaatccatctttaatgacctctaattagtgaacgacaaaacgacgtttaaaaaatacaaacgatgtaacaacatcgttttgttaattttaacgatgtacataacgccaacgatgttttttttaaatatacgaattatagaatcggaaaagatgtaaatgaaatgcagttgttttttatgtagattgatgcaaagtgtgtgttgaacgaggcagggcggtgggatgggtgggtggaacgaccttttcttcacccgagcgaccagccaacgccaacgaaccaccactgattcatctcatagtagtatttgttgtccaccaatagaaccaaaaacattttgtccttttcctcggaattaaatggcttcttcatcacatttatcttcgcaactacaaaattgtggattttctggccaagactttaaatgtttaagaatattaagatatgtgatgtaattgtcaatgctgctaaagagcgccgtaaagaagaaatttaaattaacacacaacataaggaggactcgaacctgagaccccccttttggtgactaacgcacagaccactaagacgaaaaaaccaactcaattgtacaagaagtccaaaattgaatcgccgtgtagaagatcaaaatacctataactagggcttcgatttttaggtttttacatatttttttcctgagctccccgtggcctgaaacgcacgaaaaacatgtttttttgggctgttgttaagctacttttcgagttattagcacctattttctaggtttttatttttagcacctaaaaaacctaaaaaaattttaaaaaacttattttcacctattttggcattttgcccaaaatttgttaacaaaaatgcaataaaaaggaaaaacagacccctaagaatcgaccgaaatttttttcaaaaaatatacccct

SEQ ID NO: 7181 - DNA, 4253 bp, Heterodera glycines
ttgccggagccataaaaattgacgacgatccgcactttggtaaatgatggtaaacaaatttagcatttgaaatattccaattcagttctgaaacaaatttcgtcaattatcatacagaaaatgaaacaagattcggacttaaattatgcagaagtgaattgtgaaattatggtcgaatgggaattggtggagttttatctgatcaaaacggagcagggagaaaaatgggaacaaattgatcagttgcgaagcgaatggagcaaatcacattggctgggcaaaaaacaaacatcgcagaagacggtcgatgaactgatcaaagtgttgcgcggcattcgctgataaaagacggacgaattcgaattgttgcactgatttccttatccaacaatcttggtatcattcgagagctcttcagatgctttaatagcctgcaaaattccaaaaaattttgttaattttgaaccaatttatggccaaaaaagttggaaaatttggttttttgaattcttctggccataacttttttgaacctaaattttttaaaattttgcaggctaataggggacacttagagctttccaatgatatcaacaatgttggatttggttgacaaagaaaaaagttatacctaaaaacgtgccggcgcccaactgagcggttccggttttttgtttaccattttcctcatttatttttttgggataaatcgttgcatttatctcagtattcgagaaaatttaaaattaatgccaaaggacaaaaatgtaaatttagtgcaacagaaaatctataaaaaaataaaataaaattttaaaagccaatttattttttcaaagatttacaaaaaaatgtcagggcttcttggatcaaaaatttaatacattgaactaattggttggaaaattttttgcgccgcgcccgatctttagcagaaaaaactgatgttttcgaagcaaaagtttcgcacgtccctagcggcatgctgaaaacgcgaagcgattctgaacgaacgtttaacatatttgtgtaataaaaatatatttagctgttagtaattcttggcatttttctctttttttcaaaataaggaaattgattatgtgttgtggtggcgatgaacaaagtgcgaaggaatgaatgaattggatgatggaaaacacaggcacaaaagggctgattctcaacagaacaatgctgacaaaaatgaatggaaaaaggccacaattattcaattgatggggaaaaaacaataatagtaatgataatgacaggtgtcaacgttcacaaataatgaggacagagtcaacgttcacaaagaatgcgctttaacttatcgataactatatagtatatgtataaggcatatgcgaatttaagtgagcagatttacgaaaagttcggaaatcaaatgcatatttaattaacccattattattaaattaaaaaatccccttttgtgggaaagacggattgatcacttaaacactggcaaattacaacgaaaaagatgcatgcatttgtatgtagcttgtttacaatagcttatatagtgtgtgtgcttttcactgtttctgaacaatcatttttgggctaaaattgatgcgaaaatgtgacacaaaacaaatggaaacaaaggaaggaatgatgcgtcaaaataatgtgataataaaaataataaggcaataatttctgcaggaatttttttctttttttgccatcattaatccatcaaaagtgccgttgatgactgtctccgctaagggaaaactgctgatgttgcggcacggccgggggacaaatgccgccaccgccgttggacgacgacgaagtggaggtagatgaactcattgctgccgcagccgctgtcgtgccgccgtccgcgccgtagaagcgctcctgggtggccaattcgtccgcaaattttgtctcaagtgtctgaaattggcgtcaaacaaattttactagttccattttcaatcattgaatatatgatgaatgtttggtgcctggaaaaaatagctaaaaactttcaattttttcttggtattttcttattaaaaaagtgaggggggggggggtgcgcattttcgtacgatcggcctaaataaaggcaaaattggcctgtccctcaccgcttttcgtgcgggtagcgacgccttccactcggccaacaactgctggtattcctgctcatactcggccagtttggtccgctcgttctccaacagcatgttccgcttctcgttctgtacgacaaaaaggaaacattggcaattttttgtggcatttttaaatgcttttccaacatggatttcctccaactcgcgcatcacttcttggtttcgctccaccagctgtgccaatttccgcttgcacttctggtcgtactcctccattttcaggcgcatccgttgcttctcccgctcctcaaacatgcgcacttttgctgtccatgtgtcactttcgccctgaaaaatattgcattgaagtcctcgtcttgccaatcaaatgccgaattaaaattttttttcgattttttcccatttttttgtttgtttgacaaatggaggaacccggcggggaaatttattgagtttaggtgtttgcgataaaatgttaaatcccggagtaaggaaatttttaattctctcaaaaaaatatgacaccactctctgttaaaatgcactcaaaattaatatttttcgtatgtgcataaaatattaattttaaatctgaattattatgaaaaattgtgttgagatctgatggaactgtgcaccaatcacttacgggcaaatccacctccaaactcttgcggaacatcatcgtccgcgtcttcgcctcgttgcgcaacactttgggcaacgccttgcggtcggcggtgagcgcgcgcaacagctgttcctccttggactggttgatgcggcgcacgtgctcctgttccttggcatgccgggccaacatgtgcgtccgctgtaagtggaacacgtcctgcggggagaaatgatttttaaaaatgaaaagttggagaaattttttgataaaatccaaaaaaaaacataaattcatgtaaccgcatttcttgtatttataatctgctgtagttattgttattataaattttttgtttttaaaaactgaaaaattttcctagcggccggcgcctgttggcagcgccggccttaaaattcttatttctattaaaaaaaattggctcaaaatcgcaaaatttgattaatttttggtgaatctgctaaaaatagtaaaaaatttcaaatttttcccagcggcgcctgttccaaaaggaaaaaggatcttttgaaaagaagccgagtgagtacctgataaaaaacaaattgacaccattcgcataatttgacccatcgcctcttttttcatgtaagaggggactgttcccgatgcttgtctcgttgtctccttgttgaacaactcttggtatctgcttgactcaactcactcgaaactgttgggtgagcagcgcgtgtttctccgccaattgcgcctcctccaactcccacagcgccgtctccatgctgcgctccagctggtgcttctgctccaggaactgcttctccagcaggcacagcttctcccggtgccggtcccgcgcccgaagcagaaacacttcctgagagcgcatctgttgctcaacaaagtcggattcctggggaacaaagtgaaataatggacgaacggacggaaaaaaatacaaaatgttagccatgtttttcaaaaaaacaattttttaaaattcactttttcgcagtggcgcctctccaactgatccttgcgctgcctgaacacggttttgcgctgcgcctttggcaacatgtccacttcctgcttcataattttctgctcttggcgtaaccgttcgcggaaaacgcccaagtcacgctcctgggcaaaaatgcattagaaacaatggggcaaaatgcaggagaaaaaaggggacttaaattttataaaaaccataaccatatcttccctgatgagaaatttcttagaaaatattttaatgtttttagggaaatttttgtcaaaattatccaattttccctggtggtgccagcagagagcgaacggcacagggccggatcctgtacagaattttacaggaacagtacctttgtaggcttttttcactaaaaatgacaaattttgcgtcatgggtcaacttttccaaggcgatgccgttaggcgccgccggaaaattttggtattttaat

SEQ ID NO: 7182 - DNA, 1542 bp, Heterodera glycines
  misc_feature (773)..(773): n is a, c, g, or t
cgccgaacccccctgccccccaaaagtttttggaaaaaccacgccgcaaaaacgttttttaaaaaaaaaaagtcgtcgacttgcaaaaaaatcgcaaaatttggcagtttttgggccaaaatctgttaacaaactgcactcaaattttcaaaattcccgacggcgcctaccggcaccgtcggcccccccggttcaccaaaaatttttggaaaaagcgcgccgcaaaaaaagtgcttttgaaaagcaaaaaaaaaggtcgtcgatttacatggccgggaccatttcgcaaaaatgttggctgacccccccccctttataatgtatgttgtccattttgaaacattgtgttggttcatcacctgttcgacacggatgcgtttggccaatgcgcgcatctcctcctcctggtgccgttccgtctcctccattttcttcttttgcgtgcgcgacaccgcctcaatctccgcctcgtacgtgcgctggacggcctgcttctcgaacacgaacttgcgttcctggtgctcgcgcacctgctccgaacggctgtgcaaaacaaaccatggggagttaatgaaaatttcaatcaatggctcattaatttgacatgcgtttgcccaataaccacctgttcaattcctgctgctggcgcgcctcttcacgctgcatgcgtttcaagtcgcgcagctcccgcttcctgagatgaccaaaatagttatcccgtccagactcgttttcatcggcgcgctgtcatttcgtcccgcgtcgtttcgtcncgcgtcgttcgtcccgcatcgtttcgtcctgcgtcgtttcgtccccaagcctttgtaaatttaaatttaaatggctgtttttgcattttataatttacatcagttcttcaaagtcgcttttgaactcctttttcagcatggcaatcagatcagtgccgaattgttttttgaactccaaagccaatgcttgacgcttaatttatgaattttaaattaaaatgttaaatttgaaatttgaattttgtctgtcacctgttcgttgctaatggagcaaatgacttgcgtaacttcggccttaattatttcgaaatgaattttcactcaaaattcccccctcgcccaattgctcgccttgtgcttcttcgcaatggcatcatgcaaatgatgcgcagtttgtacggttttaaaatgaggattatgtttgatggttgggccaagcttggccaaggaatgaccgatcacaacactgatcagaagcagaatggtaaggccgttttggagcattttatgagtgagtgagatgaatggaaaattgggattggaatgtttgaaaaatgccgacttaaataacccaatttggataatatggcatcattaaatttggcaataaaaacataagagtgacatgaatgccaaattaacgtggacaaagtgccaaaacggcacaaaaacatttccgcccctttccttaccttatggacagaagaattgtcaaaaataggtgatatcataattggaaaatatttatgtgaaaaggaaaataaaaaaa

SEQ ID NO: 7183 - DNA, 1251 bp, Heterodera glycines
atttagcggtcaattatgcgcacttatcgattggcaaacggtccattggggtaacccttgtgaatacattggccgtctgcttgcgctgaacacgacaaatgaagtggccgaatttatgggcggaaaggcaccatttacattgtgtagttgtacattcagtattcactttgatgcagatttgttgacacattattagtatttaagccatgttttgtagttttaaaagcagtcaacagagaaaagctcaaaccgtgaaaacttccgttgacccacaatttattaacgcattgccatttacaaattaaccctgccatttcatacgcagttggtgtttggtccaatttttaagagacaaattcactgttttaatcgtcaaaactttgaataggtatgtatacgtacgaattcccaatatttattgaattatgttttagtttcgcttttgtatggttggtccctttcttttagtcttgtgttcgttttcgaaagtcccattttgtcttatgtttcgttctttaacctcccccgccccctcctccccgccggtcctcctcacttttccttctcactttcctttgtcgtcatcattcgcgtgatgtcttctcctttttgtcaccacgtgcttttttaatttattttctttacagctgcttattctaggcaacgaattgttaaaccaaacaaacggctgaaatgctaattgcttatatccccaaacgaattcatctcaatttgaatgtggtcggtgctgcacttcgtcagcgtatgccgttttctgcggctgtgcttgaccctcacgatcagctgaaagattcagacaagccgatgtcggagcagatgaacccttcattctttaaggtattcattttggctatgaccatgcttttattattcggttcctaaaaagatggtcgattactacttcgacaaaggcgctgctgtcattgagccgaaattggttgagaacttcaaagcttcgcatgggaaatcgaaagaagagagggtcagctctgtcaaagggattcttgcggcgattaaacccgttaacaaggtttaaacttgcggttgctctatattaaatttttaatttaaaggttctttacgtgaccttcccgcttcgacgcgatgacggatcttatggtctcaatttatgattaataaaagcaacaatctccttattttcagagatgattgaagcatggagggctatgcactcaggtaatatattaagtgaaagttttcaaatataag

SEQ ID NO: 7184 - DNA, 4673 bp, Heterodera glycines
  misc_feature (87)..(87): n is a, c, g, or t
gcaaatggttcaattcgcggctttcctggagccaaggctttcgagccattcaccgacttgattttcgagaagtgcgacatccttgtnccggccgcttgcgagaaagctattcacttggggaatgcacatcgtattcaagcaaaggtttgtcgatccgatttggaattttatttttaaagcccttgtctcaggtcattgctgaggcggccaacggaccgacaactccggctgctgatgcagttttgatgaacagaggcgactgtcttattgtgcccgacatgtttatcaacagcggaggtgttactgtgtcgtacttcgagtggcttaagaatctcaaccatgtctcttttgggcgtctgacttttaaatatgagcgtgactccaactaccatcttttgggttggttgctcaaaatacattttgtactagtagtttatttgttgtctgctgtttaagagtcggtgcagaagtcactcgagcgcaccttcgaccgtgccgttccggtggatcccagcgaggagttccaattgcgcattgccggtgccagcgagaaggacattgtccattctgtaggagaatgatggcttcattcgctaattcaatcaacctaaactaatttcagggccttgagtacacgatgaaccgttcggccaagcaaatcattgccaccacgaacaaatacaacttgggcttagacttgcgtactgctgcctatgccaacgccatcgaaaagatttaccaaacctatgagacgtctggctttaccttcgcttaatcgatttttcgacgcattcgtaatgtagttaattctcgggtttttgaacgcgtatcatttagtgtttgtcagatcacagttctattgtattcgattttatccgacaaacctcattcccgtaatttttttgtcttaatcatcgttaattttttcgatttgtctcccgtttttgtctgtgaaccttttccccatctacgagtacaaatagtgataaaaaattaaaaccaaaatgagagatgaaccaattggtgtagatattaataacttcgtgatcgaaaaagggggaacaaagcacagtatgccacttttaccccaaagaatccattctttaaaaaaaattcaatttttttttcgaattagggtccgggtttcagaatttggcaaacccaagttcagatccatcataatcagtatcttcgaaaacccctaaaaactgattttgagcacaaaataaaaaaaaaattaaattagaaacactcattcttcaggattgccggtttctccaaaaaaaacttactagaaaatcagcaataaaattacttattttctgtccattttattttttagacgaaatttaatatattaatgtcgtggagcgggctcgaatctcaagccctctactatcttacaaaaaccaatatgccaaagcccaaaattaagtcgatgtgtattataattgactataagggggaggtgagaagacagtgagacgcttgaaaatttatccttaattacatctgtgcaaatttcgtccgccgggattaaatagaactgtgccttctccaatatgaatcactagaaaggaaaggtcacaaataatataaaagtgcacaggtgagggaaaggctcctccactcggtttatcacaatccgtttatttctgctcttcctcggccttcttaacttctgtgtccggattaaacacctccaaaatggctcggccttcaacctcggacatgctcaattgcttcaacaccttaaaacttcatttatttagggggcgtttaatccattcagcgacttgtgatgcctggtccaccggataaacgcgataattgggggcattgagctgtccctctgaaagcaatgtgaccaggttcttcagttgctcaatggaaccacgcgtaacgcccataatggccaaacggtttttggccactaatttgattggcagctgaacgtccaaacccggaataccgccaacgaaaaggacaccacccttaagcaaacggaccaaattaaatttacgttcttaacaatcatttttgtttgccatacaaacttcagaaaggcacttgagtgaacgggcgactgtacgaggggaagtgacgaaatcgaacacaatgtgaaggccattggtagcgacgtctttggtccgcatgattaaatattcctcaaactctgaaacaatgtccaaatttgtaacgcattattttgacaaaatgaaatagcacggaccacactttagtagtaattttttaagctaattattcttaaaaagcacagaaaattattaatggggttaaagaaaccaatccggttgcattaggggaattgttgcatggaaaacccaaagttaaaagttaatggtattttgagatttaacctaagtggtaaaacggcccgaagttgacctgaatcgtcccaatgcaccacaaagtctgctccattacgttctgccaggcaaagtctctcctccttagagtcagcaacaatcagtttgattcggttctcctgacccgcggtaagaaaatgtttggccaatgtcagaatccaaagtccaagtccaccagcgccaacaattaaaatgttgcaacatccttttgtgctggcgatggcctcaacgacaggacgggcctaaaagggggaggacactgaaagaaagtcggagggaatcaaaggcacatggacaatcgcagagagtgcccaagttgcgccggccggaagaatcgacgcgacatgcattgacaaagtgtcgggaatcttgacaagaagcgacaaatttggcactgccacaaagtcagcatagccattttggcacatctgaatgagcaacgattgttgatgaataaatttgcacttgagagaagtacctcttcagtgggccatacaatgactttgtcgccgactttcaaattgtactcaaccggagttgcattgggcccaaactcatcgatcactccggaaacttcgtagcctgcatttaaagacgaataattaatatgaatgggcacaatactcaattaaattaacctggaaaaagactggtgtccttaacgccgtgagttatacgtgccttaaaattttctgattgtttaaattccctcacgacaaaaacttttctttttaatttacaactacaaatcacttgtttcgtgttactgatttctttgtcagttagacaaactccggcatagcaaacctaaaatcaagtggataaaccaataaataattcttaaaatgaaattactttgactcttgcaccatttaacggcacatcggggacttcatcttcctcaaaaaagtgcacttccttcaggtccttaggcgaaccaagtgaaatccgacggtttttgacaccaccattctgtgactgagccattgaataagacgaaaatttatttatttctgttaaaaaagaacctaaattacttttaatgtccacgccggagaataaaaattatatgtaattcattagtacagggttaccctttgtccttatttgtaagatttgtccttattttgagggtccaaatcttacaaattttaaatgtctttatttgtaagatttgtccttatttaagctctttgtccttattttcgtcttattttttggattcagggagaaatttagatttttaatgataatttttgaaagaaatgttttttgaagcgaattaatatgcaaaatcttaacaagattcagttaaatattcaaatttttcttcggcggtttcttattctctttaaaaaattggctcaaaatcgtaattttgtcatttttgaacaaaatcgttaagaaatcgcattaaaaattacaaaaatttttccggcggcgcctattagagcaggggtgtatttgttcttattttctaagaaatgttctgatttggggtagtgccttattttcatttaaaagaggaaatttctgaaaaatttggctaattcctaacaaaattcattaaaattcttaaaattttcccccagcggcgcctatcggcaccgccggccccccaaaactcctatttttttttcttaaaattagcccaagatcgcaaattttggtcattttttggacagaacttgttaaaaaattgcattaaattttcaaaaaatttccccgcggcgcctatcgacaccgccgaactctcttccctcacctatacccaaaaaatttaaaaaattaaaattgattttcggaaatgtataaatttctcatttctaagccggaattgcgcagaaaaatagttggcggtgagtaatagtattagattgctcaaatgttgggaaaccatttctggccagtggccacaattcgaaaatttgacaagcaagcggtgcagaaaaagaagcgatgaaataacaacgaacgaagtgaaaaacaaaatcagtaatatgtaaaaggaatgggggggggggggactgcaaaaaagaaatgggattattgtcggacgcgatgaatccccatacctttcaattaaacggataattattgatgaaaatttctgttctgttgaatatagttatcagttatcactttcatattaagtaaagtcatcaactgattgcactgcattaattaggtaggcggtttatttagtattagtcatttcattggaactatttttaatgacaatatgaatagcgacaataaataagaaatacatacctaatctaa

SEQ ID NO: 7185 - DNA, 3277 bp, Heterodera glycines
  misc_feature (13)..(13): n is a, c, g, or t
aaaaaattaaaanttagattttcggaaatgtataaatttctcatttctaagccggaattgcgcagaaaaatagttggcggtgagtaatagtattagattgctcaaatgttgggaaaccatttctggccagtggccacaattcgaaaatttgacaagcaagcggtgcagaaaaagaagcgatgaaataacaacgaacgaagtgaaaaacaaaatcagtaatatgtaaaaggaatggggggggctgcaaaaaagaaatgggattattgtcggacgcgatgaatccccatacctttcaattaaacggataatcattgatgaaaatttctgttctgttgaatatagttatcagttatcactttcatattaagtaaagtcatcaactgattgcactgcattaattaggtaggcggtttatttagtattagtcatttcattggaactgtttttaatgacaatatgaatagcgacaataaataagaaatacatacctaatctaaacaaatttcagcattgaccgacaatttgtaaattttttcctcgaacccactttaagagaacggcaatgagaccaccgaatgtgagttgactaaatggtaatacctagtacgatatccccccatttttagacaaataaatgaaaccgattaaattttcgactctgttcgagttcgggtctgggtttcggaatggatatctttcgtgatcaaagaccctgtggaaacatttttcatgaaacttgaaaactaaaatattttcaagaaaaggggtagcaaaccttagtattgccgataaacaaataatactttattaataaaaagttttcagtttgatcatgacctcacttctttgattagacgtgcaaaaatgaaatttgagtctcgcgcgaaagaggacttactgaatgcactgaacaatttcactgatcttcaaccggacgttgtgaattttacttttccagacggagtgcccagatggtgcctttctttttcgggcactattcccattcaatacaaggtaaagtgttccaattaattttctctcatggaatgacaccctaagggcgctcgatacaacattcccgtggcactttactttttggaaagccatccaaacgtgggcccgttctgttacgtgaagcccacttcatgtatgcgaattcggccatctaaagttgtggacgattctggtcgtatttatttgccatatcttacggaatggcgatatccaaaccatgacactaccggattgcttcaggtttcaatgtttctcaagttcaatcgtttgaattccccttttcaggttattacgattgaattccaagagaaatgtccggtatattctgtgagcaacaattctaaaaacacgggtcattcaaacaatccatatccacactcgggatccatgacgaacttgccctacccaaactcggcccttccctacccaaccgccgatccgccctcgcacataatgccacagccatcctcctacactccgatgccgcaaccgggtgttttaagagttaaccagcagatggatatctttgttttcattgtatcggtacaggaaattatcaggctccatattcaaattcatacccatcggaccccatttcttacccaactcctgccacaaatgtgacggcacaatccgatggagtgtatccctatggaaccgggactatccaaccaacccacattcatgccagtttgcttagtgcggtcgaggatcgaattcgacaacgacttcgagacaaaattggtcagttttgtctataaatttgtatttggactgtcttatcccctattttaggcactccgtttgctgagttgcaatccatcgatgtgaacctgcaagaattgcgtgtagggaaacaaaacttgcgcgatatgctcgacaacattgccagagaccaacgcgaattggagcgggttttagacatttatacggtgcatttaaattagttttttttatttgttgtcgttgtttcaggataaaaaggaagagctcgaaagtgcgttgaaagtggtcgattcaaatggcactacggacaacggagttgcatttaacgaggaacaggcgatcgatgcacaaacgcccgtccatcgacaaatactcaaatgccatgtgcaagacagtgccattgacgacaccatttaccacttgggccaggctttgcaccaaggggccgtcaatttgcagacctatctgaaatatgttcgccagctgtccaaacaacagttccaacatcgtctgttgatgtacaaatgccgggacagatcgcgtttgactatttagtggaaatacaaaaaaatgtgcacactcctcacttgaccatcattgcttaacgcaaatatgcaaattgaacgcattctttttctgtttattcggtagagggaaaataacgaaactcattttaagctgtaaatattgatgggttattcggattaatattatttgagtatgaaaatgttaaatacggtaatggttagagcccggacataaactgaactttctttcgtcctaaggttcttgtttttgcccgggcttacatttatttcttagccattattttagaggaattcgttcgtttaattaaaattttaaacccctttgatgaaacttcgtccttttcattgggtttgcttgatcaataaaatgaaatttgctatataaatgcacatttaatttgcttttatctcgcgtttatttttcgctcaattcctttattggatttgtatatttacgtctttcaaattcaatatttttaaggctaattggccatttgttgtattttggacagttttttgatttttacttcagaaaagtgctgaatcatatcacttgaagctcataccgaatttttgctcacaaatgcaggcgatcaaatgcgttgtcgttggcgatggcgcagtgggaaaaacttgtcttctcatcaggtaactaactaattgattatgtttcaaatgggaatgtcatgcaatttcttcctccagttacacaaccaatgcctttccgggtgaatacattccgacagtgttcgacaattattcggcaaatgtaagtgtcaatatgcatattttacttacgattaagcgccttcaaattctgcgtctgttttttgtagtagattaaaggtaatcctgtgttttattggtcccatattttgtgcaatacggagtagtacccgggggttttcgggggcgctgatcacgaatatgacatcaatttcgacctattccgaaccccggacccgaattcgaacaaaagtcgaaattaa

SEQ ID NO: 7186 - DNA, 5396 bp, Heterodera glycines
attttgatcgtatttttaggcacttacctaatttatcttaagggacctgagataggcataaaaaagagattcttccacaattaagaaaaaattcatccaggtttcattgcctttttatcgatcgaaatgggtcggggtcacttcggcgcggaccatttcggcgccgcaaattttgaaatgctataacttttttatttgtcagttagctttagccaatctggcatcatttgaaagctctatgtgtgctctatatttacatgtaaaaatagaaatgaatgattcaaaaataaaaaagttatgccacgcggcgccgaaaaagccaagaaaaagttaatttttgaggttttttggccataacttttttgtaaactgacgaaattttttgaaattttacaggctaatagagaatctgaagagctatcgaatgataacaaaaatttttaacttggttgatcaggaaaaaagttgttagcaacggcgccgaaaaggccggcgccgaagtgggcggttcccatcgaaatgcctggacctggattccatgatgaaataccgtaggccaatttggcatactgccaagtacacgcatatccaaaatgaaactttcgtccaacagtttgtcagcttcgtcaagaacgaacaccttcaaaaggtcgaacatgagctaaaaggaaggagtagacgaattatttcgaagaaacaagcaattttctgacatttttggactggaaaaaatcgcaagtacggcccggcgtgccgacgagaatatcgcagccatcgatggaaatgttgcgaatgttttcgtgtctcactgtttcaccgtaagccaatgaaatagatacatcgcaacctaaacagaaaaaaccgattaaaggcatcgaacggaacgacggtgcccaccattgcacaatttccgcccttgttcgtacacttggattgccagctcacgggtcggcgacaaaatgagggcgtacggacagtcccgtctcgacttgaaagtgccttcctttttcagtttcataattttgtcgatgattggcaggaaaaatgcggcacttttcccgctgctcgtctccgcgtgtgccttcacgtcgaagcctaaacaaagtttttaaaatagcgtaaaaacattggcgaaatgtgtcgcaccgtctcttatcagcggaaaagtgtacgattggatcttgcgaggtaccacgtatttgcaccgatttatgttgtcgagtagctttggctccagatcaaagtccttccaagtccttaatacagaggaaattcaacttccattatcggatgaatcgcttactcatacgctgtgaacttttcaacattgtctccactgacaactaagtcttcgtcttcgtcacggatgtccacgtagcgttcactgacgagacagtcctcttcgtaaaggcattcgatcggtcttttcttgtaaatgtgtcttggccgactcgaccttggctctaaattttgctttttagctcgtcataaatgctttcactccgttcgttaccatcccgtggaaagcgttcgtctccgccatttgttgcggatggtcctcgctgactgtgattcgacggtctttcgccaaattcgggtcgtcctcttccgcctctgccgcgcccgaaacgttctccgccgtctccttcgcttccgcgaccaccgcccctacggtcaccgtaattctctcttccgcgtccgttgttttcggcatttggccgggcattgcccaaaccaccattttgacctcgaaattaggataaataatacaaaagaacgggggaaaaaccttcggagttcatgccacgaccacggccccgtccaccaccacgcaaaatagtgccaatgctcggcggatcattcgaagaattgagttctattagaataaaaatgaccacaattactctcaaatttacgggaatgacagaccaactgcatgggcaccatgtccaaaaccgcgacggtctcctggtccgagttctgtgggatgaaattgaaaaaaatccaaataaccacacttaaataaccgaccaactgcattggcccctcttccaaaaccacgactcgtcgttcctccgcctcctctcgccctgctaccgttgaaaacggtcgtcgagtcgaaggtgaccgatttgggtggcgaaatctccgcattcactggtggacgactgatgttgttgttttgtgctggtgctaaccaccaaattatgagtgtttagcactgaaaacgaaccccctcttcccaatccgccgcgcactcctcgcgtccctcgcccagtgacggaagcgacacgcggcacagaagcgcctccaaatggcacagactgatcggcgatgggaagctgatgttcgccttcattggtggcagttccatttgctttctgcacatccgatgctgcgtcaatgccgttgcaattacgcaaaattcccctcgtcggcacgttgacaatgggcggctgctgaaatggctgagagtcggaaaaatcgatgatagttccttctaaaaaagcagaaattagaacatgtaataaactatgtataccgttcggattagcctctgaatatgctccaacaattctgtcattcggaagatgagtcgtcccattctcagtttggcttggggcaattcctctgccccctctgcctcgtcctacaaaacttgacttaacgtggcaaattgtacacacaaaacctcgagatgcagcaaatgacatcacttcgaatttatttttgacgatttttcatgcaattttaagaaaaaattggctaaaaattgcaaattttatgaaaattgaaacacctatgtaatttttttacggtacacattcggacacgaacaggaacaaaacattacgccaatttatcagaataaaataccaaatttaaaattaaaacaaagggagtcaaattcgcaagaaaatatgtatacctgtcattttaacatgtcccaaaaaggggaggggtagttgttatgaacgaatgaaggatgaatcttaatttttttaaacattcgttgaattcatacaaataaatccaatttttgtgtataattgtctatatttcgtgtcaagttaaaagaattccaaagatggatccacctccctcacacccaaaaaatcagcaaacccagtccgccaacgctttctccgcaaatgcaccggctccaccgctgacgtatgggagaggcatttttgtgtattttttgtgtgtaaaattggatttgcatccaatttcagcacatcgtccgcctctggtgtccaaccgctgcttttgccgtcctcttcagccggcgccggtgttccttatcaccagtgcgtccgccacggctttgacagttatccttcgtctacgaacgaaacggtggcaatgtacgggcagccaggggccggtgcagcggtgtattcgtcgtttcagcaacaggtcggagcccacaaaattccgctgtcgaaactccgccggacgaaactgaatcaaagtattcaaaaatttttcaaaaaaattcgttggtggaaaactgaatttttttcaaaagttttctaaggttttttcttggaaataagtgaaaattttttgtctcggtggagtttcgtcggcggagtgcgttttgggggtaccggcaacaggtgtatggagaatggtagaacgatgctgaccccttaccgaaaaatttatctgtttttttgtccacaatgtgttaggcatattgtctaccacatttttttccctaatgtgtcaattttcatcggttggttttcagcacgccgaagttgtcgatcagcagtgctaccaacaacagtccgctgcttctgtgggttacggtccgtcgatgccgggcgcctccgcgtcagtccctcttgaacaacagcagcaggcatcacaaaagggtgccgtcacttcgtcggcggcaaaaccgctgccccaacaacactttgtgcccccgccgccctccttttacacggccggcaaccgttcgtccaacgccgccgccgccgcactgcttggcgttgtgccatcgcctccgatgcttccgccgtcggtcggcggctcggcggtggttggcccaccgccgcccaccgcttacgcgacacagcagcaacagtcgatcaatgccgtcacttcgtcatcggcaaaactgctgccccagcagcccccgcagcctttttacgcggccggcaactattcgtccaaagccgccgccgcttcaatgtttggcgttatgccacgacctccgatgctttgcccgtggggcggcggctcagcggtgattggcccaccgttgcccgctgcttacgcggcacaacagcaacagccgatcgaccccatgccgtcatcgtcgtcatggaattttggccaacagcagcaataccaatttgcggcagatctatcacaccaacaccacaaagtaaaaaacttcggtttgagagaggaggtggtggatgggtagccccaatcaaagaatattttagatgtcgtccacttcatcaacggcagatttgcaccaaaagctgttcgttccgactgccgaagatctttctgacagcatgatatacccatttgatgtgacgcatttgttctgcagagaaaaaacttcggagattttggacccccaggttagcaaatacctaatcattaagagaggagggggtatatgggtagcaccactcaaggaatattaatattttagatggcgggccccacttcatcaacggcagatttgaacccaacgttgttcgttccgactgccaaagttttggaccccgaattggttagcaaataatcattaatttgaattagggaagttacttagacacaggagggcattagttttgcatattcaaaaatgaagcctcttaatttttgtgagtgaaattatggatgacttataaaactgtatcaaaattaaatggttgtggtactcatttgggtggtgcagaagatgacccatattgattttgttcaacaaaagtaatggtcattttcgatttgcatctctttatatcatggaaatgttttctctaaattcgcttttttccttcccaatctccgctcttttcggttttagaatgtattaccctaaaatgattaggcttccgtctgaacttatttccgaattggcgagtgctcttccccttgacccccgctgggccgtcatccgtgtgtcctcggcctttgattttttcgtttatacaaaacagataatttataggaaaataaatagccagaaatttaaatttgtcttacattattttaattgttcccacttttaggtggatgaagggcttaaaaaagcaaagcaacaagtttcgtccattgccaattcccaatcaagtgacgaacaacgacgaaaactgctcacaagtggaaccatcgatgttattttgtatagccataataga

SEQ ID NO: 7187 - DNA, 3794 bp, Heterodera glycines
accgtccgaaaaaacgagatgtgtaccaataaatagagagtgccagagaaaaacattatctttttttctctaatttttgtctccttttggcgtactatctaatagtttcattattaggaaaaacaacatttacttcgctacgtttcattatttttctctacgttaaatcaacaccaaattttgcatatcgatagagaaaaaaattctgcatcgatttctatgtttattatcatcgcttaaatgttgtcttaaaaagttataagaaaaaaaagttaaattattattctttttaaagatttaatggctaaaagaactttattacggaagcgacagaccaaaaatgcacgccatacgcgtgagaacaagcgggaggagagaaaagcgcagacggccaaggcgatgaaagcccggtgggctaagaaaagtgagttttttcaccaaattttattttaaaaaatatctttttttaatttcagcctctccagagccgaatcccaatgccggaacgccacagcaggacgaagcagggccgtcgacatctgctgtaccggccgaagaactaatggagccgccgccaccagcaccagtgccaacgccggagatggacaaggaaattttggaatttggcttttcgctgccatcgacatctgtcacaccaatcggtgatttggtgccgttttcgacaacaccaactgcgccaatggacaccggagagacaaccccgccaccgctggccattgacgagcgatcagagcgcatcgaacaacttgagaagcagctcaaggaccgggacgacaccatcaaatttctgcgcgagcaggtgcgcaatcgagaagcgctgatcagtgatctgcgtcggcagctggacgagcacatggtaccaccgatggcaccaccaacgaccagcaaaagtgagtgaaatttttcttttttaatttcataaaatctgatcattttttcaattttagcatcaccaaacagaggaagatcgaagaaaagactggatgaactgcagcgcagcgccaggcgcgacatcgtcgaccaaattgtgggcgtcatcgatcgtgatcgctcgcgttccgcgagccgcgcatctctggaccggatccaccgagatatccggcacaaatcgcgcactacacgccaaagaagggcaaggagcggaaggaggggatggacgctgaggatgggcttttgctgctcgcccaacttggaacacagaaggcgtacaagcggatgaaggcgattttacggctaattggccgtaatttcaacgttttgccgccgttggaaaaggtgcatttttcagtgaatttttcgtttgatcaatgttttttgggtcatcgcaataaaatgaagaatttgcgcagggttggaatatgatgaaattccaatgccaagcgggcccggatcgaattaaagctggtgagttgatggaaggggctttaaaatcttatccaactaattaagagggaggaggaacaatgggagcaagcggaggaagacaaaacgaatgaagaaagtgatcaagaagctgacgtcgatgtcgttgactgatcgaggattaatggaaattattttgtgatttaatggcaaaattaaagcgaaatataaaaagaggcggtgaaacagcggtggaaaaagaaagaggagcgaagaaccaaaatggcaaaggcgacgaaagcccgatgggccaagaagagtgagttttttcacacgcaattttgggattcaatttggaaggtgctaatttttcaggagatgaagcgttgcattccgtgtggcggcgacttgagcagctttggaagacgatgccggacgctgaacaaatgcgccaatagctggagcagcatttcgtctcaaattggttgatggacaccggcagactcgacaaattgaagctggtgagttgatggaaggggctttaaaatcttatccaactaattaagagggaggaggaacaacgggagcaagcggaggaagacaaaacgaatgaagaaagtgatcaagaagctgacgtcgatgtcgttgactgatcgaggattaatggttttttttcattacacatgacaaagaaaaatgtttaaaaatttgtaaacaattttaaaatcattttggtcacttttccttttatttattcattaaaataattgaaatacatcaatagtatgcactgggaatcgaacctgggaccccccctttggtgaccttctcacagaccacttcgccacacatacaaatcttttttggtacagcagctcagtttccggacgccgtgtataggaaataaatatttaattaccacacaaaaatgaacattggcaaaaataactcattaattgcctaagggaaaagccataaatcccattcattttgtgcgcttaataattcgctaggataatgcaaattgatttttccactgtcctcctttttcactgacccacgaaaggagtgaccattcattcactcattcattcgttacatttgcatataaaaaaccaaattaataataattctttttaatggactgtccccgaaaaatcaaactccccaacgagcttctctcggaatttatcctttgccttccgtttaattttggctacccaaccatccgagtttcggcagtctttgatttttttctcgccaaaaagcaacaaaactttcatagagtacgagtattaaaatttaaaatagtattaaatgagttgacaaaatttataatatttccagagaaatgaagattctatcacacgtcagcgggagattgttgcccaattgggtagtgtctttagaaatgccgtaaaacagttaatagagttgtgccagtttgaggtgattctcaattaaaatatttaacccacatatctactggagtttgtttagggaattttttaaaattttattaaaaatttaataatttttgttcccttttttactgcaatgggtctcacaaataaaaaatcaacaaaatttgtcaaaactgcccaatcaaaatgtgatattatttaagaatgtccaagcgattgaacatcagcaaaaaattgccattgatgcggcccatagcttcaacgaggcgaccaaacatcgtatacagctggttaagctcatggtgactttgaattcaaaaattatggttctccttatctgattgccggagtcgctcagttgggccgtcacgtttaggccggaacaaaatgggggcgaaatttttttttctggggtattttgaggtgctgagcacgaatatgatgtttgttttacgtttcagaatttttggaattttttaaaaattcgaaaatatttttaatttttttggccctcaggattttgggttaaaatttgaaaattcattgctcagtgaaggtttggtcaatttaagtgaattaaagctctaaaaatagagaaaaatcaggagaattttatgggatttaaatgaaatttatatcttcaaaataaaaaaagttattcaagaatttctggaaattttcgatttttcagaaaaaaattcataactcggttctgaaaagacattctggtaaaataaaatactacaaaaatccgcagttttttgctctattatataaattttatttggcatttttatcacttttttgcgaattgttataaaaataaaagtgattttgggattcgggaccaaaggggggtgaccaggatttttgggtggaaaattatttcaccaaaaatcttccagaaacatgtcattagggctattttatgacgctgatcacgaatacgtgatcagattttacttttgacatcgtcaagacctcaga

SEQ ID NO: 7188 - DNA, 3006 bp, Heterodera glycines
  misc_feature (2752)..(2752): n is a, c, g, or t
  misc_feature (2869)..(2869): n is a, c, g, or t
  misc_feature (2948)..(2949): n is a, c, g, or t
tcccaaaaatttcagagaaaataaacccctaaaaacttcccctcccgccccgctctagaccaaatttgagagcacggcggaaacggtgacagaaccgttggaaaactaggacggcacggggacgatggagaagcaaccattagcgaagaagggttcattcaaaattgaggatctgataaaagctgaagaaccgcaaacgaataagtaaatgtgtgagaaatggcaatttgttgcttattattgtgtctacatcatcagtggcataacgaaaatgttgttgttgcttctcattgtaaaaataaaaccgaccaaataattttaaattgcgcaaaattttgcattaaaatggcattgctgcaaatttaggcaaatttgaattccttgtaaaataaaaatttgtagattatgatatggtttttttacatacttaatctgtaaattgtccaatttcatccatttgtgtattgtctaattgacccctttctcttcaaaattggtcaccgattcctcttcaaattctcgaatattcccatgtccgcccttatccgactaatgatcagtgctcgcccctcaggggcgggatgagttcactttgtgcgccaaatctctcgcgcctcatccactccgtccgtctcttacacaatttaatcaatttacgcctctgggaagcagtgaacagttagttaattgatcgctatggcttggtccgtcgcagcgttggacttggacttgctgacctattggatgctaagtgggaagagttcaacgatgaaaacttgaaaatttaagagattttcgagattttttgtatccctccccccggcacagatgtttcttccgcctttatgcggtcggcagcgaataatgttctgttttttgtggtgagaaataaatttaaaaaatacaaattaattttaaatcaataatttcactgattaatttaatctgttttttaaatttttattctattttgcctagtaattttaaaattttgtaaatgagatttttttataacacattggacgaaaccgtaattttttcatgtccagaggggttagcgatgtaaaggggtaggtagatacataaattcagtaaaaccaaaaagaggccgctcaaaatttttttcttaatgtggcaccatccacatatctaagtcaaaatccataagaacgccccaattgttggcttttttggtcattttcaagtcacacgtttttgatcacttggactctgtccaggactcaattggccggcccctccaatggcacttgaccaatcatgatgatcagtattattaattataaatcatttttcagttggactggcgcatgccggtgctgcactttctgcacaacgcggtgcccgccctgtttctgctcgtccgacttgcgctgtcgccagaacggcgtccgctggtgccgcgactgctctgtgccattgtgcgcgcaccgctccgctcgctgctttggcgacccgtcgcggcacaactgttggtcagcgcgttgtccgctcgcgtttacgtgcacaaccgggccggggcactgtatttgtgcaggtgataatgatgacacgacattaaaactacaattggaaggaagagaagcggttctactctgtatttcaagattttttggcctcgagtccagggatttgacataattttaatttaatattatcaacaattaatggtttttaaatgtcgttacttagttggatattcgtgccaatgttgataatattaaagtaattacataattagtctcggcaaagttcgaaaatttgctgcaactctcggggccactctcagacgaagccaaaaaaggccctcttttttcaaggatattcgacttcctcggcacttttctgatcattcgatttggcgcaaactttttgaacagcgcaaacactgccgggggcaacaaagaggagacgcagcgccggaggggccgcgcggccatttgggcccttttggtaacaacaaatgcacaaatgtattggcatttaacatttaattctgctcctggggcaagcttgtgcctcgagactgagtttggtggcatggcccggccctttcagaggggcacggccaggccattaatccaagaaaattcgaaaacaaattctacaaatgaacagaattaaaaatttttatgttcatttaaaaaaaaaattaaatttctttacaattattgttcactcgcctccgagaaaacaccgaaattcgtaactttaaagctttcaatgctatgttagcaagtttttgttcaaaaaatgctcgatatgattcgttgttattttttctttcattaattcaaattaataacaaaaaagagaaaaataaattattttatcaattttctctgttaactgattttttcacatattttccttcaaaaaatcgaaaaataacccgaaatatccctttgagaatttgtttttctttcaattcttgttcttcattaaattatgcctttattcatatttacaggggccacttgcgttctccgcgtcgctttcatggtgtgatttctttaaaatttcaaaactaaaaataaaattccatttcaaaggctcgaatttggcaacatcgagtgggacccgtgggctctgtttttggccccgctgctcgcacttgcccaagctgttcacattctgttgctgaagcaggcgcagttggcatttttcgctgccctcggcatgcccaacggcaacaatgtgccaattctatgggccaataactaacttggcttanataagtccagacttatccatgtcaaggacgtccttggaaatggacccacttttctgaaaataaaatttctggccaaaaattacggcttttattcttttacatcctgggaatgcattncagaataacatgttttggtacacttgccccaaggacttttttaggcgtggtcgacctctaagggcagtccttgaaatcnngacattatcgctaatataccgcttttgtagacatacttttctgacaaaatagcgtcc

SEQ ID NO: 7189 - DNA, 1257 bp, Heterodera glycines
aagaaaacacatcagtagaatagctcataagctccctcgcaatacggcgcccacgaaatcgaaaaacggacgaataattcggacttaacagcagtcagcaaaacggtttcgaataaatcatcaatagtgtgtgaacgtatcacacgaaagaaatttaccgtcggcaagtgtactcgccagatttagaaacatcggttagaaatagttcgaatatgcaaattcatataatttttagctttcgaacctccaccaaaaggaatctactgcatcaatatttttgtactttcatgacggtcattatgaactaataagaaaaccacaaaagataaattaattatttaaattttttactgataagcttattataattaaaatttccctttgaaagttgcaaagaaatattgtagcacttattgtggcacttcattttttgactcatgctttatagcaccagtaatatggttttgcaactttaaaaaaggtttaaaaaaatttaaatttattataaatttttaaatgatatagtcgatgattgctgttattaccatgatttatgctatataaacaaatctagaaaacgctacgattgcgacaaaagcttttgcaaatgtttgtatgaaagtgctgaatgttcattaacaaaagtctgtatttattagtattttaaatagtttattttttagaatttgttatgcttgtcagttcatgtttttgatgaacattttaaagaataagaaaatttaaaaaagaaatactggaatatatatattaatttacaaactttatatcaataaaatttagataaaatatttctatatagttgttttaatttgtagtttaattctcgcccaaggtggcagtttttaagaaacgcccacttggcagtttttaagaaacgcccacttggcagtttttaagaaacgacccagcacgaaaaataccataccatattttactgttctgtgatcacttaactaattttaagaattttgattttcacacgaatcctttctgaaaaaatgacttttgaaaatcttactaagaaataataagttttgagaattaacttgtaaaaagaaagtaaattaaaggaaaacgaattttaataaagataataaaattttaaatcttaaaaagagcaaaacattccttgtacctattttcactacattttactataaaacttctctcaaccaaatgcattttgaaagaacaggaaaggccccatttgcgcatatttttttgggtctttcttta

SEQ ID NO: 7190 - DNA, 2492 bp, Heterodera glycines
ttaagatctcacttttgtgttggattcgttgccttctgatccgccgttattccctttcgtttctttgggtgattccggcgacaaaattgaggcaaactttgggccgaacttcaaattcgacctcgccacccttctctatctgacgaaggaagaaatttgttggaagatggcgtattttgtgtttttaattgacaatttataaatattcatttttctttattccctttttttaatcggatatgggttcggggttcgaatttggttgaaatggatgtcagattcatgaccagcaactccgaaaacgccctagaaattttttaaatgattaaaaaacaattttattttttatggtctgtaaagtgcataccgtaaaccctctatttgaaggcccgggccttctattgttcaacccctcaaatctcggaaatttttttctgggtcaaaaaggggtgaaattttcgaaaattaaaatactcaaaaaattttagggtgttgtaacaaatctgtaattcgctttcggcatagttaaagccccagaaataacgagataacaagaaaaaaaagttataattacaatcataaaattaaaactgttgtcaatttccattggcaattttaaagccaaaaccgtttgagttttcgatttgatttaaagatttagacttcatttcatccttttcatttaattgcctttttcccctttttgcgcattatattatttttgcttgaatttgcatttcccctcaataacaatcatcattttccctttttgccctttccctttcgttcctgtttcttttcccaccaacgatcggccaaagttgccatttctcatccgttacaatatgctcatttctcactcactttctcacacgtggtgcgacttttgggggatccgacacttagggaacccgacatttggggattttaataaaacaaaaaatataaaaaaatttaatttttgtccaaaactagacaaatttagtctgctttagtcagagttaattccattgcattgcaagaaaaacaaaataatattttttaaaataactctgtttccggactgagatttgctttgcaagtgagtcaaaaaaaaataatttgttaaaaaatgaatttaaagcaccgcacaaagtcacgcgaaagataagaaacagaaaagatagtctcggcattaaacagcaaagccatctgaaatgtccttgacgagtgtctgttaccattggcccttgggaaaggcgttttaaaaaaaatttgtccaattttggacataaaattaaattttttaatattttttgttttattaaaatccccaaatgtcgggttccctaagtgtcggatccccaaatgacgttcgatccgcaaatgtcgggtccctaaaagtcgggtccccaaatgtcgggatccccaaagtcgggtccccaaatgtcgggttcccaagttgcaaatccccaaaagtcgggtagccgacaagtctcacaatccattagccattttatgtgagtgtaatatttatcccgcccccatcgcacctttaggctgatcgcgcatcaggatttggatccaaattaacacattaaataaagactgttcattccggcataattacgcgcaaaaatttcaaatttaacaactttttaatttactaaatatacaaacaaaatataagtgtgcaattaaaaaataataatttcacagtttttaaatcacaatgtcaatcgaaacaattattggcagacttcaaactgctgaacatgttatttctgaatatttgaatgatgttttgcccgaaaaacctgaggcaccaaaaatgcaaaagaaaaacgtgctttgatacttttggtaaaaaatataaaagagtcttctgacgaattattagcgcaattagaagaaattcgaggggcacgttcagctcaagtcgatctgatcagagttttaacagctcaagagcgattagatgctgaaagaagaaataaatttgacagatttaaattctctcacaaggaaaggaaatacactacttaagaaattaagggaattgaaacaacaaatcgaacagtttttagactgtactaatggcaatgggaatgcaagatcaaactttgttttaccaaaatcacaattaaaaaactttgatggtaaagggtggctcgaaatctggacacttttcgaatcatcagtacatttggatggttcttataccggaattcaaaaaatgagttatttagatagtcttttagtgggcgaagccaaaagggttattgaaaagattacttccattttcagatgacaattatgatttagcaatagatcttttgaaagaaaaatatgggaaagaagaaggtcttatcagagacttacataatcaattagccaatttaaaggtatcaaaaacggtggaagaagactgatcttcaaattgaggttgaacggctttgtcgtcaattggaacattttaaccaagatttatcaagtccacaaatttacttaag

SEQ ID NO: 7191 - DNA, 2015 bp, Heterodera glycines
ggaaaatgcatataagctatataccatgggatagagcagggtcgacttctattgtgatttttaattttagcggtgcattttgcctgctaaaaaagttacagggcctcaaaaatcgagattttggctgtgttttcactaaaaattggtggctcagttggttaaattcccaaattttgggggtccgggttcgaatccaacgtaaaaataaattaattaattaaatttttaacaaattaaagattaaaaaaatacatttttaattatgattgaattgtgtccaagattcgttgcctatctttgtgatctattttaactcggcaatcgcttttaattccgctgcgccaattttaaaaggagtgtcctttttcaaaagattaaacagtggagaagcaatcgaaccgaaagaataaatgaattttcggtaataggtcataaaacctaaggaagaatgaagctcttttttggtttttggaaccggaaactctaaaattggctttgttttatcggcgtccaacttaattccttttctcgtgaggacatggcccaaaaattggagttcttctgtaccaaaatggcatttggaaatttttaatttgagtcctgactcgcggatttgttcaaaaactaatttcaaatgcttcaaatgctgctcaaacgactctgaggccaccagcacatcatcaatgtagacaaacacaaaatcattcatcatttgtccaaataactgagacataaaccgttggaaagtcgcaactgcgttgcataagccaaatggcattacggtaaattcatggagcccaaattcggtgacaaaagcagttttttcgaccgattcctccggcatttttatttgccatagcctgagagaaaatccaaagttgagaaatattttcgtccacccaacatgagaagggttctttcaatgttcggcaatggaaagcagtcctttctggttaccgaatttaagcctcggtaatcgacacaaaacctcaaagttccatcctttttcggtacaataacaattgggctagcccatggtgataaagatggacgaataataccacggcccaaataatcttggatcatggccgcaaccttttctcggtatgcatatggcacaggtcgcatacgatttttgatggggaatgaacggtcagtgtcaatatggtgtttgacaacttcgatttgggttagatcgctgtcattaaaagcggaaatatttgcaaaaacatgcaaaagtgatccgagtttattatgtttgtcctcatccaattggccaatttcggctttgaactcatcctcaaaaagacacttttccatctccaccgaatgataaagccatgcatcttcaagacaatcatcagctttggcaatttccttcacctcttcaactgcagcaatttcttcattttgttttaaaattactgctttatgtgaaaaatttgtgattgcggtgatgaaattgaaagttcaacaaattttgttgaatatggttcaaccaaagtactgtaaatcacacgcacagaatcagacttgttgtccacacactcaaattccactaattcgccgttgggagcatcaaaaattttgaacccaaggagcccaagtgcatttgttccaaacaaaattggatgtccaacaggcgcatccgtaatgtggaacataatttcaactgcttcacaacctcttcttacaactggcaacacaataattccataacactctacacgctttccattaatgtcaacgacattccgggttttcggccaaattttgagatttgtgccttccaatttctgactttccaaaatatttttaagaaactccgccttaataagtgaaacttgtgcaccgccatccatcattgaaatagcgggctgatcaaaaattttaacattcgttgtcattatttttccaattgggcacagttccttattgtcagcagcttcaaaattgttttcgtactcctcccagaaaatggttgaaaaattccttcatttcgggttcatgttcag

SEQ ID NO: 7192 - DNA, 5388 bp, Heterodera glycines
  misc_feature (5273)..(5273): n is a, c, g, or t
tttttttagcaaaattaaaaataatttatttaaatttttaaaatttataaaacattttacagttctcgaattttttttagcaaaattaaaaatgttcaaaacattttataagaattctcaaaaatcatttgtctgggaattgaagcaaatccttttcaagctattgaatatccccctaattttaatgtattttgccactaattctttttccaaatccaaaatattctttcacaaatgccaattccttcacaatttaattttttcctttgccataaaatattgtattcataaaccgtttaatgaatgcgtaatttttctgctcataaataaattaatttcatgtttgattttcttttcatttatttgattaatattgaattaatgattaataataacaaattaatatttggagaatgataatttgaattgagaaaaagatagatggtaaatagtataattttgtaaagaaaatataaattatattgaaggtttttattacaattcctttcccccacccccggttttctgcccatgaattcggcataatcttgccatttacttcaataatcaattaattactcccaaccaaagaattattaacaattttttgttcgtccttcatcagcagcaaagctagctattcatccagcagctctctttctgcacagcgcagcgcgcagagattaatcaatctctgtcttcttgccgcgcaaaactgctcgattatatgtcaattggttcattatagttaaatatcgctcgcaactataacatggaattaataattttacttttacataattttcgctcaaatttggtcagcaatactacagaggaattgtcatccttaattctaatcattgctgataacaattttaatagttgataagaaaggtaccatttaaatttgatcataaatattaaatgatcatgactagggctgggaatttatgtcaatacatatttttttcctggcttctctatgctctgaatagtaggaaaacactttcttttttgcgtttgcgaacaaaagttgggacttttatttacatatttttacatagagggtttttgagaatttatagaattttttgtgaaaaaaaaatttttttttgaaaagtacccaaaaaatcgtttttttcaaaagtgagatactaaaaattaacttttaaaatagtaaatgtgtttttaaacctttaggtcatttttatggcattttatgcctatttcaccctttatgagaatttatttccaaaaaataaccatttacaaaattttatttacatattttggtacatattttagcattttttgttacatgttttatttacctatttcgggatttttcttacataaaattcccatccataatcatgatcatacagtcttgccctaaagacattattggcttaaaagttaatattattttttaaaataaccaatcccacattcttttttcccttatttctcaagataacaagctggtgtagctcccgatttttcgacagcaacgggcttttcgatagtgaaggacttttcgacaataaacaaaaaataatggacttttcgacagtaaacataaaaataaattatggtttgtcagttttattaaatttcttttaaattagcattaatttgtatttctaaataaatattaggaatacgtttttttggttttaccttttttcctgagctttaagtggcccgaaagtacgcttgttaagctactcttcgattatagcaactattttctagttttttataaagtttaaaaatacatattttgatcaaatttatttatatattttcttaaaaatttttgtttgaaatatttgtatctcaatactaatttggcttaattttgtttctttttgtataaaactttacattaaccccctaaattgaaacatgattgcttttacttttgaaaaatctattgtcgaaaagtcacctcataaaatttataatatttctggaaaatgtcctttgttgtaaaaattccttctgtcgaaaagtccggcgcccgctggtgttcgaactttttaaataaagtaccggttttaaataaaaatactctaattttataataaatcaataaaattatcggctttaagaaattgcaaatatgcttgtattttttattttttattttgttgcatttgcttatccttttcggcacaatttcgtttctgatcgcactgacgaatctaatgagggattaaaaggaagcggaccagctttgcgacttcgttgcggcgaaaaaatgccagataatagggtaaaacttggtccaacatagaattaatttttgtctaacgaatattaggtaattttttttattttaataatttttctgaaaaggtaatacattattaaattttaataattccaggtcgaatttggacaactttcgccgccttcggactggccatgggcaatttcggtccgttccgaatgtttgaataagcgttcaaaccgcaccgaagtactctcgacttgttccggagttctaattggttcaaaacatgtgctaacagctgctcattgtcttttaacgacaattaattcctatttgcgatgcaaaggaaatgaagtagccggggaatttgaattccctgggaccacgtgagttttacaaatttattttgcatattaatattttgctaaaacttagaaaatttaatccaaattaaatcgaatctataatcacttttgcgccgtgctttttaaaaaaattgaggaacagatgggggtacagttctagtgttaataaggtggaggctactccagcggtctaaaggcactgacgggaaaattttcacaaatttcgattaattttgataagaattggtttaaatttaattaaacttattgtatgttattagaaaatatttgacatcctgtctttaaaattttcaaaaatgcaatgcggatcccacggattcccgcacaaaaaaatctgcggatcgcgctggggatgggaatcaaaaattttttgtgggaggcggattccgcggaagtaatcacgcaaatcccatattaccataaatgcgagtttaacgctgggattgcaaaattcgcgcgtaatcccgccccgtgcaggtctttcatttattacaccgaataaaaactaaaaatggttctaaatgtggctcatcatcacaggattctttttgccaaatagggattaaattcattcagcaaattgcctattaaattaatttttcccattagggtgtatgtggctgcaaaattcataaaactgacaattggagggaaaaattggaaccaaacgagttcgttgagcatcaaaaaatacaccaaatttgacagattcatgtcacaacactacgacaatgacattgcaatacttgaggcaattattaatttaatatgcatctttttatgattcctatttttatattgtttggcattttctttttgaccaaaattgaagttgcatggaacttggaattttaggcaaaaaccgtgacagtgaattgacgggaccaaaaaattagaaccgggactatgttttaaaccggaaaccggatccaacttgtgaattgcaagaaaaaatcaaaagttttatttcttgcgtaaatttattcagctcactcatcctgttgtttatgacatgaaaataaatagaatttgtctcccttctatttatactgcaagaaatgggcatttggcgtattttttggggtatggactgaccaaaggcggtatgtcatttaaatatttatttggaaaaattttcgagcaaatataatcatttttaatttcgccgttaattataaacgggaattcaaatatgtgcttattcgacatataattttttgttcttaagctctcgagcttgctgggacaaaccgaacaaagtcaaccaaattacgcgaagactttgtacaattgagggttggcccgccatgcccagttaactttttatgtaccaattcccaaacacacccaacacgtcacacgacacccgtattatcttaatgattgtcaataatacatttttatggcaattaagggggactccggaggaccgcttatgcgcgaataccgaggaaaatggtacgtcattggtttggttattggcaaacccgacgtgtgtgaccataaatgtaagacattaaaaaataaaagcaacttaattggattaatttgttaatagcgtgtttcttgcgcccaacctcttattgtacttggattaaccgagcgaccagagggcgcgtcatctgccaacgaattatttattaataacgaagacgaatggttggaaattttggattattttatgcaattatattaattaattattatttttaatttaaagaatttttgccttaaaatatagattgaaaaatttggacttgtgtttgaaaatgttatttattgtgatggctatttcaatgttttttaaattttttattaataaatatttgtgtacaaaaaatttaaattcattgagagttcccatatttattttattttcgaaagtattaatagtaaaatagttattgctatttgcgagttttactttaaattaattgatttgatatttttttaatattagtttaatgttttgtaattttctttcataaaacataatatctaataaaatgggaacaatttaaagattgtataatttaattaataaaaaaatatattaaaacattaaaaattcatttttacgattcggaacatttatgattaggtaattgacctcaaaaaaactaattataagaagatttatcattatacaaaaaaaatgtggaaatgttatacaaaacaccggcggaataacaacagagagagagataaaatatgaaaatggcgtgaaattggaacatttaaatattgcacaaattaattaattaattaaaaacaatgtgaaattgggtatatctgccgatttgtttttatttgttgtgataaattgcgtaaattcgttaacaattagaaattctcaaaaattgttttttaacgagagaatgaagtgaatgcaaaatgcttatgtgccttcaaattattatttttatttaaatttcaaatctttttagaaattcgagaattataattttaatttttaatttaaccaaaagaagtcattaaaatgataattaaattttagcacataaatgtttcttttaagtgagagacaattatagaattaaagctcattaatgaaacttataaataataaatgaaatgtaaaaaacaattttagtaaaaagtcatttaaaaatataaaattaacttgngcacataagtgttgtttaagtgatagacaattataaaaataaagctcattaatgacacataaataatgaacgaaatgtaaaaaaccattcttttcataaataacatttatttttg

SEQ ID NO: 7193 - DNA, 1556 bp, Heterodera glycines
atagtcatagttggctataaaaattttagaatttattctttaaatttctttaaaatatattttatttttttattatattgaataattttaatatatttgctaaataatattcgaatgaaaatttttaataattatattaaagctaattataaataatttatttcaattagtcatataattaccgttttcaggtgatgtttgttcattgtttttcggattggttgatgacgcaccgctgttcatccgtttgtgttcatggtaaagttggagcagtgcagctggcggtggcggtggttgattctgttggccaagcaacgcggtatcaccagaggaagaagccttgaaaatgcacaaatttatttaaattaacatatttcaaatatttagtgttctacgaaacccaaaattccataataataaattaaatttcttttagtcaaaactaattaataaacctttttcgaaaaaaaaacatagtctaaaaataaaaataaaatagtattttcagagtgtagcatcctcaagctaacaaaatttaaaattttttcttgggctttaatttatctgaaaaaaaatatttttccattttgtgcattcatcaaaattttttaaaaaatctgtcaacaaaaaaggctaataacaaaatgcagcaaaatgaaaaatacactctctaagaattgaattttcaaaaatcggttgaatttattcaatattgttactttaaatttctcacttttggtcatattttcataaaatattttgtaattttacgtaaatatttatttaaatattttggaaatttttcataaatataaatcccagccttaattataattatttatattaaaaaaacgctaacaggcaattcggtggttgaaacttctgaacaagcagaagttgtgccaccatttcggccacttgatgaggacgaatttgcggacgaatttggcccacaaccgttcacattttccaacagaacagcaccggaaggtgaaaaggcaaatttgagttgaggaaactcggcaccaatgccattctgagaattctttttgagaatgaatgtgccacagcagcaaattttgtcaatgattgccgtgaaaaacgcggaaattgggccaaagccagcgccatcaaggcgccaacggcgataatgtgcgcgagtcttaacaaaaaatttgaaaagcttttaattttagtgtgacggtatgccaaagtatggatttttgctggtttcgaatcttcaacaaaaattataatgatggtggttttgctgaataagatgtctagttagtgttgtaattctaaatttaatgtaaaatttattaaaattcatccactctatcgtatgtaatttgtctaaatacatccgagtgatcaccacataaattatgttactgtaattcatctttatccatactcttcctgtaatatcccgttcgaaaaaaacccacgcactattttatccacaacaatttcggctaacagctgcacgcccagtgccatgttcagcaacgacactgcaagtgccgaattcagcacaaatgccgaagtcgcgg

SEQ ID NO: 7194 - DNA, 1182 bp, Heterodera glycines
gtacgcgttgccgtagatgacacggtgacggcgctgctcacgtgtttgtgctgcatttgatcccatttgttgtgttgcggcataaggataggcatcggatgagcacgatttctgtggtttttggatatcaaaaatgaatccaccaatctaattttttgtataaattagggaatgttattgttatattgggtgttaattgtctctcatagtagcgtcagagaagttgttgaaattaagaggacagacaattaaagggtgaccgaaaatttggttaacaccccatgccaattactgagcttaccaataaatttaattcacggaatattaaaaattgcaaacaaaattaataataatacagaggacaatgtgacaatgtttacagtaagcggtgcaataaatcatttaatagtcctaccgtattccgtgacgaattcattgcaaaaaatgtgtgtgccaagcaaaaaatggtggccgacaaaagcaacgaaacagggccaacaaaagtgtaaatgccgaagaggtccaaattgagccagcaaaaatccgacaaaggctggggctgggatggcacaattttatgcaaattttgcataaaaatggtaacgacaataagcagcagagggaaccctgtgggaattttaaaaaaattaatttaatttaaattaatttaaaaaatctattaatgtccttgcttaaggacttttaaaaattaaaaaggaatattatttgtttaaatttatttcataaagtttgtagcgacagcattaaaaaaatatatttaaattaataaaaatttaaagttttattttctaaataattataaattaaaaatatatttgtgtatgtttaaaatgattgttttaaattcattatgaataacataaaattaataatttacaaatttatgccagaataaaaatattaaagcagaattataatattgtataattaccgtatccaaagaggtacagactgatgtgtttgagcaatgagtttgatgagatcgtatcaattgtgttatcatgcaagtgaagtgccgtattacgtaattgccaagcgtccaatagagtccagcaaagtgaggacagcacaaaatattggagcaacaaagcaatggaagtgcagaagaactaaaattgcaatgagaattaaattttaaaaaaattattaaaattttactgt

SEQ ID NO: 7195 - DNA, 2412 bp, Heterodera glycines
tgactttggcgaaataaaggacatttgtgtttttcctcagttcattttctttaaaatatgcataggccatattttgatcacacataggagaataagacaatttaaaaagcgaatggggaggaaaaacggagcaaattcaaatcgaaatgggcaataaaatatcaatgattgcacaaaacgccgaataaaatgccgaaaagaatgatcccttttggttaccccccctcccctttcattttatctgtcacatggacacccaaagggggtccactgcgttttccgatccgatcacttccaccccccccccccgccatccctcgtcattcttccgtcgtccatccctcccctccttcggattttgtatttttagtgttgaatagcttaatcaatgtactatcagattcgaaataatttttttgttcgaattcggaaccggggttcggaattgggtaaatccgagttaagattcgtaatcagcaccctcgaaaaccccataaaattgatttcgagcccaaataaaaaataaattaaggaccacaattctttaccagtgctgcttttttggcaaccaaatttatcagtgagcacagatttaaaatctctgtacttgaaaaaagtacacatttatttaattattgtattttatgccaattcaaaaatttatttttttgatttcactacaagcactttttcttttcttttcgttatttcttagattggtttgcttcgttttgaaatcacattaagccatactttgtaattgttcattttcgtgtttatagagagaaaccgaccatacatacaataattaataaccattgtaccccgatgaatgcaggcagcatcgacaatgatcatgatcattaccataattccatcaaaaattcttccccgaaattatcatatgactccgtgaattgttggagtatggaaagcgaagggagctctgtcaacaacgatgagaatgtgagattcatcttactttaagtttaaaaaagaacaggaattacaattgtccttttcaaaatcactcgaattcaaggactgataaggacaaaaacaataattgtctaatttgatgatccattggacaaaaaaccaatgcattttcttaattgcacttaatttagccgaatccggaaatggatgatgaaatgatggaagaagaggcagcgcatcatgaggacgatcaggttgcgaatattttggatctcaaaacgactataatttcctttaatcccatcgcagctggtgttaggcagtgatgaggacgaacaggaggtacggatttgttgacactttaccaatgtaatatttcctattaaggaccccaaggactacagaaaaggtggctaccaccctgtgcagatcggcgatgtgttcaaaaatggccgataccacgtcatccgcaaattgggatggggtcatttctccaccgtttggcttaggtttgttttgcttgggttttataatttttgatatttttctaatctgattttatgtaattgagaatctagaaccctaccattttatttcagtgtgtaaaaacaagtcgctaatttgctagcgttccttcaaacattttcttatattttagttgggacatcgaaataaagcgattcgtggcaatgaaaatagtcaaatcggctgagcattacacagaagcggcattggacgaaataaaagtgctctaatttgatctttcatttttttattcattttcagctgctcgaatgtgtgcgggactcggacccaaccgacgaatcacttcaggtttcgacttgcaaataataaaatggcattccatacacttaccagagagtggtccaacttctcgacagttttaccatcagtggggtcaatggagtccatgtatgtatggtttttgaggtaattatttatttgcatttcgcgacttgcattcgtttctttaggttctcggatgtaatctgttgaagcttatcattcgaagcagttacgctggtttgccgataatgctggtcaaaaggatcgtaaaacaggtcactcttatccatctgttttaacccatcataaattggttttaggttctcgaaggccttcgttatttgcacgataaatgccatataattcacacagacattaagccgtattttcttttctgttaacaattttcattttgaaattttagcgaaaatgttttgattacgatgagccacgaagaaatcaaaaaattggccgaagatgcaattttagcagggaagacgggacgggacatgtccggctcagcggtgtgcagttcaaaaaaggcgttgaagaaggcaaatacattcgtaaataaaatggcaattaattcccattaattacagatggacgaaacgctcacaaagaacaaaaagaagaagttaaagaagaaacggaaacgccatcgcg

SEQ ID NO: 7196 - DNA, 2076 bp, Heterodera glycines
aggctacatgacatttcgccaactgacatttcgccaactcagccaaaaacattcatttcgccaactcagccaaaatcagacattttgccaactgacatctcaccaactttacatctcgccaactgacatctcgccaacctgacgtttcgccaactcagccaaaatctgacgtttcgccaactaatttcgccaactagtcgaaaattgaattttaactatataatgatattaaatttattataaaagtgcttcaaagcaaagaaatcttcataaaatatataaaatatcaaaaaaaacaataaaatatgaaaatgtttaaaatcaattttcatcggcctcagtttcttcaccactctctgaatttccacggacgtgaagtccctccgcaaagccttgcatcacgagcccgagcaggtgcaaagaatttgtcaatccttcttccgattcaaagtcggcctcgtcaaggattcgcaccacattttgttctttgataatgtaccgttgcggtcgttttctacttttctggagctgttctgcgcgtccgatgtccagttgtttgtcgatgtccttgatgaatgctgctatgaaatcactcagtgacggatgatgattgagttcacgctaaattaacaaaaaataagtgtcttccaacggacaaatttttactgcaaattgtccatgcgcggcttccatgccgttgttcgttcgctcaattgccatttgagctctggtgtacacattccaaaacgagattgggaagcgtggaggacagacgatgtcttgttcccagcgtggaataagctgcaagctgctttcttctgacaatggaatggttggagttgaaggttgtggcgaatgcagtccgaattgtattggtccactgcctgtcattatggatgcctgggaaatactgaacgctaaaattgaaaaatttcataaatttcatgacagaataggtgcatttacgagttgtgcttcgagtgcgacgcagaagaaagtgtccgacatcagcatgcggttcaaatgcctccgccccgcgatcaatctcgaattgagtggtgccaatgtaggttttggcaaaatacgccagccatccttgaactccaagcggtgccgcgctgacaatagttgaaaaagcgcgccgaacgtaaagtggcggaatgagtgccaaagagagaacagatctgattttgaaaaaacaaataaatacacataagctaatgaaagacacctgaatgttttgtgaacggatttcctttgaaccggtgcttcgttgtcatcttcgttcaacaaattaaaaatgcccatgcttctggcttttcggaacaccgcttgcgccatgtggaagctgcagcccgagcgttcgcatgacgggaagacatgacgcatcgctttcagcattccaatctcgaagtcgctcatcacttaaaataattattaatgaagataatctgctgtttttttttgcctttatgggaaggatgggttcaacggcacgcttcaactgttgaaggacttctgtgtaatacttcgaggctttaccaggtagcaaggcttgcgctgtgacgaccatccgattgtttacgtaacagccgatgacgaacacttgcgtccaaggctttggtgcactgcggaaagtgccgtcaaggctccaccgacgattttgtttgagcattgataacagctgaaattaaaaagatttaaaaaataaaataagtaagtcacgccttgctatggctgaaaatcagtacgacatccgactgtcctaccctcacttcgcggctgtcataaatgaggacggattcatcgtcttttttcagaagaccagccggaatttggatttgcagtgggtcgccgcagttaactttgccaacaaatttgttcttggccctagtaaatgttgtatcattattcgactgaattgttttctacctgttcgtcatttggtcgagtgcttcattggtgccaagcagctcaaagacttcgtcgttgacgttggtccgaatctgtgcgcgcagttgagatggttgttgctttgggttctccgtgatcagttgcttcatctgatttcgtttt

SEQ ID NO: 7197 - DNA, 1446 bp, Heterodera glycines
gatccgcaccacattttgttctttgatgacgtgccgttgtcgtcgtttagtgcttttctggagctgttctgcgcgtccgatgtccaactgtttgttgatgtccttcgtgaatgcagcaatgaaatcactcaatgatggatgatggttgagctcacgctgaaaataccaaaaaataatgttttccgatgaatttttttactgcaaattgcggcttccatgccgttgttcgttcgctcaattgccatttgagccctggtgtatacattccaaaacgatatggggaagcggggaggacggacaatgacgtgttcccaacgtcgaataagctgcaagctgctttcttcggacaatgggattgtcggagttgatggttgtggcgaatgcagtccgaattgtattggtccactgcctgctattgtggacgtctgtgatacactgaacgctaaatcatttaaaattatgttaattatcatgaaacagtatatgcatttacgagttttgctttgagtgcgacgtagaaagaagcgtccgacatcagcattgggttcaaatgcctccgctccacggtcaatctcgaattgagtggtgccaatgtaggttttgccaaaagacgccagccatccttgaactccaagcggtgccgcgctgacaatagttgaaaaagctcgccgaacgtaaagtggcggaatgagtgccaaagagagaactgatctgatttggaaaaacaaataaatacacatgagctaatgaaagacacctgaatgttttgtgaacagccttcctttgaaccggtgcttcgtcgtcatctccgtccaataaattaaaaatgcccatgcttctggcttttcggaacaccgcttgcgccatgtggaagctgcagcccgagcgttcgcatgacgggaagacatgccgcattgctttcagcattccaatctcgaagtcgctcatcacttaaaataattattaatgaagataatctgctgtttttttgccttttatgggaaggatgggttcaacagcacgcttcaactgttgaaggacttctgtgtaatacttcgaggctttgccaggtagcaaggcttgcgctgcaaccaccattcggttgttaacatagcagcccatgacgaacacctgcatccacggctttggcgcacttcggaatgtgccgtcgtggctccaccgacgattctgtttgagcactgacaacagctgaaattaagctgatttaaaaaaaagatataggtagacttgccttgctatggctgaaaatcaggacgacatcagattgtccagtcctcacattacggctgtcataaatgaggacggactcatcattcttcattaaaagacctgacggaatttgtatgttcagtgggtcggcacagttgacaccaccaacgaatttgttctttgttctaaatattgtatcattattttctctgaatt

SEQ ID NO: 7198 - DNA, 4574 bp, Heterodera glycines
agtctcaattttaaagcgcagataagttttgatgctgatcaaaaggtcttacattaaccagatttgttgtccacatcctcacttaattgacgatcaccacaaatttttaaaataaaatttcgaaattaagctcatttggattcgtaatttaaatatttattttcaaaatacaaatcagttaatataaatttattaataaaaattaacaattaaaatgtgaaagaaagaaaaaatttcaaatataaaactaattagcaccgcactggtttggcacccccccaaaccccaaaatttacataacaatgtgagaggaagagagaaagagaggaaaatcaggaatttaaaacagaaaattaattgacattatttgaggcattatttgaaagactgatgatttgttcaataagagtggtaaggtcaccagtgtcaaaacaattataataagcagtacggtaacgctcatggaggaggacggtgttccagccttttctttttaaaacgatgttcaggaggagacggcaagtgcgtccgtttccatccaaaaatgggtgaattttggcttaaatacttttcttgcatgttatttaagcgagaattatctttattaaagtaaaataaacgaaatattacaaaaaactggctaaaaacgaatattattaaagtggatcgttttatgaaagctaccccgacatcacattggcatggagagttttgattgtctcaaaaattacaccgattagaacaatgacgagaagcggaattaataattttttacggacaaattcatacatatacaaacatcaaaatgcgtaagagatctgtgcattgaataatttcttaatcattttcatttttgaaatgttcaaaaaataaaaatttaccaaattaaaaaaatttgaaaatttccaaaatccattaaaaacgaatataatataattggattattgtaagtttatgaccattcacaatcagcttaaatttaaagtcagcaataatccattttccgtccgttttactcaactattcacagcatacaaccatcaaaacaatttaattctttgaaagttttatccccttttcttttgcagcagaaatattctacctgctcagaaattatctttggattcatcccttcggtttccaaggagtacaagaagttcttgtcgtcatcaaacgacgctaatttaataaatttcaaaaatccataaaatcaaacaatgtatttggaaacgaatttatttctcttgcaaagttttaccgcacccccccccctttcttttacagcaaaaagattctacctgctcagaaattcgttttgggttcatcctttcagtgtccaagatgtacaagaaattcgagtcgtcttcaaacgacacggacacatcgcgccgcatgtctctggcagtgtccccgtcccgctgctctcgcccttcgcatggccattgcttcttggtgctcctcagggctatcaaaatagtcctctggtggcgttggtgcatcttcgctgctctcctcttgtggcatgtttagcatttttagcacataaacccgggccaagtttatggagagaaagacatggaagaaaataagaaaattgatacttcatgtcaagatctcaaccgatttcatccaaaatatagttacaaaaagtcgaaaattcaaaattttcagaattcacttttgttcctaaattgactaaaaaagctaattagtcaaaaaccattgcaacatcaaaaaatggttattctgtacaagtacgaacataaaagtgaattttgagaattttaaactttcggcttttttcgaattcgggtccgggattcgaaatgggccgaaatgaatgtcagattcgtgatcagagaccctgaaaactcccccacccacccataatctgtttccacgactttttagaacaaaaaaaaaatttttccaaaaagggggggacaccatcgatagtagtaccattttaatcgtttcccgcaaaaaggattaatttttgcctttttggggtcaaattttaaaaaaataaaggtccatcggtgtctttaggcgttaaaaatgctcaaatttttttctgacgaccttatttttttgcctttcaacccacttttttgatggttcaaattcaaattcaaatttattcaaataaaagaatccaaatgaaggacaaaagccgcttacacatatggaaatgtcctagatctccaacagttttttaagtttggtcctgtaactttgaattgagtttattgatgaaaggtcgattgttttgcttaattcttgtaaattttttgtggtacgattggtaaaagaatgttcagttttagtaattttagatttagtgattaatctgggaaaaggtgaatttcttctttgagatatgttatataattttagagggtttaggtgagtttcttgtttaataattttgaaggctgtgatcagatctaaatattttctcctattttcaagactggaaatataaaggtattttaatcggtctgaatatggtaaaaccggtaaatggcactttaagaacacttttctggtgaaaaatttttgaaatttttcaaggcgaataatttcttttttaatgtgggggttccaattttcggatgaatattcaagtaagggtctaatatagcttttatagattttaatccatgtcttagatgattttgatttcattttttgaaaaagcgttctgcttctaaggtaggctttttgaagaatagcagaaatatgggatttaaaggtcagtttgttgtcaattaagattccaagatctcgaattgtttgggtctctttaatagtctttccattaaatttgtatggaattttgaaattatctttgccgaggtatagagaagctgatttttctggtgaaaattgtagaccccaaattttggcccattggctgacgcaatgtaaggcttcgtctagttttttacgttgagattcggtgtcatagcaaaaataaattttagtatcgtcggcaaaaagttttagcgaaattccgtcagggattactggggatagatcatttataaaaattaaaaatagaattggccccaagacagatccctggggaacacctgatttgatgggaaattctttggaaaactgctgattaattctgaccttgaatgtcctgttagttagaaaatctttaagccaatttagaaggttgcccttaattccaattttctctattttataaattagcaattcatgagggactttgtcaaaggctttaattatgtccaaataaatacagtcgatttttttattgagaagtatggcattataccaatcctcaagagtcgaaattaattggagggtggtagagcgctttctgaggaaaccgaattgttgatcagaaattaagttattttccagtaaaaattctgttattcttttggctaatattctttcgaaaattctacagcaagaacaggtaatggaaatgggacggaagtttgatgctagattcttatctccgtttttaaatagtggtagaataattgaggttttccaaatttttggtagtttaccggattttagagacagtttgaataaatctgttagaggtctggttaaaattagatgaaaacgtttcagaaaattaaaacttaaatcgtcaggagatgtattatttttgtttggaaggtgggttaaaatttcgagaacatctaaaacattgaaatgaacgtcagaaattgaaggttgattaacagaaattattggaggaggtttggggtattctgataaattttggaaggattcagaaaaatggtttgcaaaaatgtcagctttagttttgtcatcagttatgatttgttggttatgagagatgggtggtatttcccaacgctgaaaatcttttccaatatatttatatatatttccggggttttggtctaagaattttttttcctgtttttcctggaatttcctagtttgaattttgatgtggagtgctatggatttatataggggaagatatttttcaggttcttttttgagtttcttccaaagagctgccttttctttaagctttttgtcgctaacattaacgcagcatttattttttgattattttttgtatttaattttaaatttgttttttaattttctctttttttgtgtgtttttattccttccattttttccttatgcttcagccaagacggctgatgatgttcatttggctgttgttgctgccttcctttttgtttctcctccgcttaagtcatgccaatttgcttatccctggcattatgacggaacgcgtcgaattggcaccaaaatcggtaatttactcctttttaatattttttttatacatattaatccttaattttttttcaattaagcaagaatacatcggctttcttcagtcggctttgaatggcactgaggtggaaattcgggtcaaatgtgaggaggacgttgaaatcgaattcgatgtcgaatttgccattcgaagttcgccttgcgccaaggaatttattgtggacaaaatgcgctaaaagacaagtcaaccaatttgctggtaagctttgcgtctttcg

SEQ ID NO: 7199 - DNA, 2005 bp, Heterodera glycines
cttgttggtgtttggcagtgcaaagataattcatttttaataaagaattcgacaaagtaatgtccaattttgttaaaaggggctggtgtattattgtgccatttaacgcttttactatttagattaaaatcttccaatattagtgtttgtcctttaattttttcttcaatatagttaaagaattttttgagttagaaagggaagtgctagggggccggtagacaccgataatggaaaaatttttgagatttttaagcctcaatgtaacaatttcgcatccaaaaactgattccgcaaaggctgaataaacggaaaattttttttctattaagattgaaactccgccacctcgtttgttttcacgaagggctgaaaagatttgatagttttcaggaattgctgcatgtaaaatatcaaaattttgaggtgttaaccatgtttcgactaatactataaaattatatttttcaatgttaagtgtggttatgagggggtcaattttgttcataattgatcgaacatttgataaaattcctataaatttttgttctggaattgatctattgaaattttggttattgtctgaaattgttggagatctgtgaagttcaggattatattttgaaataacagaagtggcttttgtcctagaaaaagtaaatgatggtgtatgagatcgaattgaaaaatgatcaaatgaatcaacaaaaaaagaaagattgggatttgtgtgtgttgaaaatttttgtaaatttttttgaaattgggtttcgttacacacaaaacccggaaaccttgaaatcatcgaaaattttgctgcattttttgtccaagttcgtgcagttggtttgaaatggcgctagcattgttggcacgtggcggatggttggccattccgttgcgtttggcctgtctttgttcgtattccgcctggagttgttcacggctgagagacgggcgaatcagcaaacggccccagtttggcagagaacggaggcgagtgcgctcctttttccaaccgccgagtgcaatgtgctgatggacggaggccggcagcaccactttgaccaagcgtggcgaggcacggtgaacatcaggacggcccattcggtaggtcgtcgttggcaccgcctcaacacccaattcgtccaaaatccccgagacaaccttttgatcctctcgaacacgctccgaaggacgggctgaagggttctccggcattccaatgatgaccaaggaacggcgccgttcctgttcctcggcactgttgttgtttgcgttgttgttcagaccatcgatgacgtgttggcatgtgtggagggtagtcagcagaacgccgaactgaagtttgacggcctgggaaatgtcgtcttgaacaagaagagcgttgactgcagcagaaagtgagtcgatttggccagccaaagcgtccgcggaaatacgtgtggttttggtggaaggtggagttgctgttgagtccattggtcgtttcatggtttgacgtagaacaaaaaataagaagaaatgaagatttttaatttacgaaaaaatttcgacttttatttttttaattcacctaaattttaagaaaacaatcatttatcaaatatatatgaacttttcaaaaatttatttttaatttataatttaaaccttcaattggtactctgggggtttgctgctctaaatcagaatcatattttagagtaataatttatttttaaatttgtttttcctcataacagacaataaattccttcttgttagaattaaaaatatattaattttgtattcttagaacaaaaaattgagttttactaattcattgttaaatgagttattttaatttacaaatggattgaattattaattatgaaatttatttaatttgaaattcgttagataatctgtgatttaggtcatatgttttaatttttgtcttttttttttattaatttaatttacattaccgtaatgttatttaaaaataagttgaaatatctat

SEQ ID NO: 7200 - DNA, 2024 bp, Heterodera glycines
cttttcgtatggcttttgccggcaccacacagatcaacattgatgtccgattcggcagattgagtgccgagaagaaaggagccggaaatgagcaggcgcgcgcgattggcagactgaattaaaacaattaaaaagacaactaaattgactaacgatggatcgtttaatttaattcgtgttaatgacacaattagcattatcaaatgatatcaaaaactcatcaacgcttttcctctgcctcaaacacaaatgaaaattggcaatttatttttactatttttggccaattgcattttctcacccattcctcaaccattgaatggattttgatcagtgcattttttatttgctcctcattttcttctcggtcatttgcgtttccaaaattgcgtaaatatttttccaacttaattaaataattaattaatttttattttattttcaatgaaactttttttgtcgctgttaattcgttcattttataggcctccgttgttatttgttgtgacaattttgcgaacattggcataatttgtctgttgtgccaatctttcgtgaccaaattttgtgcgtataattcgctgtctaaatttattttcaaattaaataaataattaattatttttaccaatttttatttgttgctccatttttgcccactccctttttaagtgctcaaaatgaattgggtcgaattttgtgccgataattttaaacagttttttcgccttctgttcgtttcccaattcgtcccatttcgtccgatatttctcatcttcgataattaaaaatgcgtattttctgacgacaatttgctgcattaattgcaatttttcaatttcgaaagtgtcacttttggacattccgtcaaaaaaatcgaatccctccaaatgagccaaaaggttcaacaaagtgtagaaaagtttgttgagaaatgcccacagattttcaatgctgtcaatgtttagggtgaatgccacttctttgatcactgtccacaattgggccgaatttttggctttttttccatcgaaaaaatatttttgggggtccaatcgaaacaattgctgaaccgttttaatccgctgctcaatttcatgcacaagtgttcctatcaaaagcaccatttgtttttctgttgaacttttttcgccggttcctttgaacttttcgtacagaaaagtgtcgtcacagaatgctaatgaataattaattaatgattaaatattataattggcataattaaaaaaaattggctttgctccgcttaaattttaattagcccattttcaccttttaatggaacgatcgcctcgtaaactgtgcgactgtccaattcctttgcctttaattctgccaaaaaacttcgcaatctttccatggctttttgtcgccgcttttcctttgagtcaatcgctttttccgacctttctttgtttgggctcgttgctgctgaatttccctcactttcgccttcactttctccaaaaactgatcaaaatttgcaatttatcattaaataaaaaacattttattattttttttgtattttaatttatttaattattttgcttttttgactgacttttgtcctctgtcaatgatttgtccgtttcgtttgcgttctttggactttccgtcgtttcgcctttcgtaatttcctcatcctccgcttcaatttgtaaattgtttttttctatttttgaattttgttttaaatttttatccatttgaatttccgatgaaaattccattttattgtaataaatgccagcggcgcggaagaatttttccaatttttcggagtccaaaaattccaaaaaatttcttcgtttttccacgtccgcattcattgctaaatttagaggaaaattaattttaattgaatttaataaaatatttttttgccaataaaaaatacttctgattaattggccaaatgatgggacttctttttcactttttgttaataaattttccaattttgtaaagtgcattttctgaatttctttatgtgtcggcac

SEQ ID NO: 7201 - DNA, 1825 bp, Heterodera glycines
ggggacctctagagcggaattggcaattatcgcacttaaagcaaattaattatttatcgaattcatttttttaattcgtttcactttttccaattcccacaaattatccaccatttcgctgcttgtcaattgcttcgtttcgttttcatttgccaacgcttcgttctgcgcagcccataaggtaaagctttccaaatagcacactttggccaattttccgtcttttccgctcaattttgaaagaatttgcttcaatttggcattttcgacctcaacttcaattgccattcgctttaatttcgcattttccttcgcttttaatgggcggagtttcgccaaaagattttccagtaaaatttcgaagtaaaaacagaaaacagaaagtgtcaaattgtctttggtttcgccattgtcctcatcccccagtattagcttctcatataattgcattatgttgaatgattcggcattttctaaattcgtttttcaatttttaaattgtcaattgttggcattttgtaaaactcaccgtaatccgtcaagttttttgtcccttttttcgccatgctttcaataatgagttgttcaaacatttgcgaatcttttggaatcattctctccaaccgttctctatcaatgtaaattgctaaaaattggcaaaattaaattttccgctaattttactgctttttcgccccaatttgttcatacttttcagttttgcccgaaattcgtcattttgaacaagaagctctttcagagtttcgttgtgagtcgaagccaaaaatgggattacggcgtgccaccaatcatctggttgtccaattccgcctaatttgcccttaattgctcccaatgtgaacagatgttgcattgaagtattaatggcatggacactgttcaagtcgggcacagaatccatcccattttcggttattgtaaatgcttcgtccaaaatttcttgttcgtcactttttggcaaaatttttgctttatgaattgtaaacctaagaaaatttgtttattttttactttcaaatttaaagaaatcaaaaaataaaattaagcgcaaaatggtggcacacaacgatcaatgttctcgtttcctttgagtaaatacgaaaaaaaatttgttttggaatcattgaaaagtccattccgatttccggactaaaaaccgcgaaattttcttttcgagactcttgagcctaatcttaaacagaatcaaacccttaaacacatgccatttataataggcaagcatgttaagcaacagttcggccttcagccagacaatctcttcattttggtaatccaaaaagcgaatgtaatttcgcacttctatttttgtgatttggccaactgacaattctaaaacattgtccaaaatgcccgattggttaattaatgcgttaatattaccgtttcggcacatcctttgaagttccgcgtatttgtggaatatatttaaggacaattcctgtccagtgtttctgtccttgtccatgtaaaatctgttcagtctgtacacagccgccttctcttcggccactgaatttttcagaaattcggaaaatgcattttccgatcggttcagtctgatcattctgagcgtgtgctgctccaacagctcatctcgcattgtgcccaggttttttgccaacaaatgaacaatgccaattttgtcgggtcgttttttctgagttctttttttgttgtacagttgagccaacgaatgccaaaatgaatacactttcatcgccgagttttttgaatgttttgcaaattttcacaaattactgtcccataattctcaaaatctttc

SEQ ID NO: 7202 - DNA, 2967 bp, Heterodera glycines
  misc_feature (39)..(39): n is a, c, g, or t
ttttgcctttttgggggtcgaattttttaactgttaaancttgggcaaatatttcaaaaatgcgagcaaaaaatatgcaaattgcgagccgaaactcagcagtttccgactgttttttgtcataagaaagcatttcgacataattttgtgacaatttttgatcattaattacatctaaaatattttaatggacatattaattaaattgcctttttatttttaattaatttattcctttgataattaattttcgcttaagcttttattaccaattgacattattattggatgttggaattcaagctcttctaccaaattttctccaattaattttgcaatttcatttttaattgaaagaattttttcgttatttttcatcaaatttttagagcgcaatgttcgcattttataagcaaattctgtttcaacattaaatttgctctcatcaaaatactcagacattttcctaaattattttttaaattattttaattaaaatatagattttaaattaccatttataggctgtgccttttgcattatttctcccaatttttatttcgcctttttcttcctttgaattggtcaataataaaaatgaaattgcgctgtaatgcaacatttttcggtcatcaacgaatttttcgatatgcttttttgatgttttgtccattttgtcaccattttccaattgttttcccattttggcacaatcaatcgcagcataatttgtgtctttgctctctcttcgaaattgttttttgtctatcaaaatgcatttattaatttaccgtatttcctaaaatacagccccccccccattaattagagcctcaccctaaaataaaacccaccttttgagggggtaaaacacgagacaggagattttttgctgaagaactattcaaattttttttggcacttttttttacgaaaaagtgatcgaggccggaactttatttcaattttttccaaaagaaaaaaatcaaataatttaatttaattatttttaaggtgaaaagaaagaaaacccaaattgtttgtaaaaagcaaaaaagaataaaaatccatcaattaaaaataatcaatttttatcataaattaaattggaatttcatttactttaaattttaaagtttttctcccttattttttgttttcaaacataatttttctgtcacatgttttttcaaaattttctagtggttggaggaagccgcggtgccgataagcatttgttaacagaatatgtccaaaaaataaccctttttgtggatttatggaccaaattttaaaaatttggcagattttggagagatttgaggaatttaggctaaatttgttaaacaattttgcgcctaaaaagaacaataaaattatttttctttaaaacttatttttctctcagacccctttctcccccccccccattcttactagagaccggacaactgctggggtcggagggatcccgagtcgggatcccgactcaatcccggtcccgatcaatcccgaacattttggaaaaacgatcgggacggatcccgatcgaatcccgatcccgctcaatcccgaagatttttttcgggatcccgcgggattatcgggattgctaaaactcaattttttcttttacattttgtgtcatgttttgttcaaatgcttatctaatatttataattggtcaattcgattgataaaaatagggattggaattatatcaggtttttatagaaatttttcaaaatatgtcatgtcaaaaaaatcagtttttaggtcaaaaattagaacatttaacaacatagctttaaatagtttttttacaatttaatcaattaatattaatttttgtattttcgcctcctatgatcatttttaacaattttgaggaaaattagcagtcctaaagtgcatcggaatcaaaaagttcgatttttaagaattttttttgcagtgaatttagtgagttcgattcccaccgaggcccctaacattttgcccatttcttattttattaattcgaaaaaaacatattttaatgatttaaaattaaattatatttaaaacatgccaaaaacactgcgaatattgaggaaaaatttccaatattcacagcttttcacgatttgcgttgaattttgatacaaattctcaatgttcaaaaattgttccaatgttttttccgacaattttttgtgttccgcgtccaaattttcttttgtttttaccgcttttaataattcattcatttcattaaaataaataatctcttcaatttttgttagcgaaatttcttcaaaatttttgtcacattttttttcagtttcaaatgatagcccaaaaaaatttgcataaaaacagtcaatttgatcaatgccaaatgcttaaaaagttttaaaatattttaaaattaaaaatttcattactttttttagcgccttttaaagaacagacggataaaaaaattgtcaaaaataataaacaaaatgaattctccaaaagtaccatcataattgagtttcctaaacatttaaaaatatatttttttattattaatattacctatgaatataaaccttgtttaatacttaatgataataatattataataaaaatgtaaatattgcatgaaaagtatcgatggaatgaaaccaattgtaaaaaatgtatggtttttgaagctttgctgagagagaatacaatttgcattttgtgaaatatgtcatggttttttggccctttgcataaatctgcaaaaatattcataaattatttttaatttattcaaaaaggcgacactatgaaataaatttaaaaaattgaaaaattaaaaaatgttttctttaaacgaaagattaattaggtgttttgttttgagtcactttttatactaaaaaacaagaacaaatgtgcacaataattttcaaaatgttttcgatgaaatttaaaaattccaccgatttatcc

SEQ ID NO: 7203 - DNA, 1411 bp, Heterodera glycines
ttggaaaaaattctcgtaaagggtgaaaaaggcacaaaatgtcataaaaatgccctaaatagtcttagaatcatatttttaatattttaaaaattgatttttggtatctctttttttttgaaaaaaatggtttttaggggtacattttcaaaaaaaaaaatttttttttaatttttcacaagaaattttgattaattttaaaaattctcaaaaatttatggagaaattgctaaaaagtccaaaatatgtacaaaaagcccgaaatgtgtaaatatgctaaaaagctcgaaatatgtaaaaatatataaataaaagtcccgatttttgttcgcaaacacaaaaaagaatgtgttttttttctactattcagagcatttggggaatccaggaaaaatatgtgttacataaaatttccatccctaataattatatttaaaaaatgttaaatttatttttttaatttataacgcctattgctattttcttacaaagtcgtgcaaaacggcatttcaattcaacagttggaacatttactgttcgttcaattacttccagtgctataccttgctcaaacatttggtcaattttttccaactaaattaaaaatttaatttaattaaatttaaaaaaaaaagattcactgatttttcaggaaattattcgaaaaaaatttcccggaacacgggccttttcatataactttgtttaaaaggaaccaaatttttaaatttttatatcattcgatagctctaggtgccatcaattagcctgcaaaatttcaaaaagtttagtaaagtttcaaaaaaattattaactcttcaaaaaaaaacttggtttttttgatttctcagcaggtcataactttttttaaacttgacgaatttctttgaaattttcaaggcaaatagagaacacaatttgtgaaaaaaaaaataaaaatgtatagggcctcaaaaatcaaaattttggctgtgttttcacttaaaattggtggctcagttggttaaattcgcatttttggagctcgggttcaaatccaacatgaaaataaataaattttaattaataaatgataaatgtaaagattggaaattaatagaaagtgaaaaaagatggaaaagggctctttggcctaaaattcgattttttaggccctgtaacgtttgaactagacgccagacaccgctaaaattaaaaattcacaatagaagtcggccctgctctatcgaatggcatataacacatatggattttccgagttacagctcggaatgttcccttttaacattttattgtataattatgtcgaattcattcaacaactatccaaagcacataataaaactccgttttttattcgctttattatgaggagtattattttcggttaattaacatttgcacttttaca

SEQ ID NO: 7204 - DNA, 2228 bp, Heterodera glycines
ctggctcagtcagggatcaaagctgttcaagggcacacaaacggactccagttctaattcaaattttgctacaaaatctatctaaaagcggttaccccacatttgcgtcaatgtctaaaatcgggttcaaacctaagttttctcaatccctggtggactaaatagcattatataagtggtcgaaagtgattgtgtcggataatttgatagttaattaccttttgaaaaattatcaattattcaaacagcagaattaatgctcctaataaactaaaagactgtgttttcttaattaatgctgtttagactatcatggcttgaaaaaaaatagttttgaatcagattttgggcatgagcgcaaatgtcttaaaaaactgcttattttttggcaatttttttgatgaaatttttcacattttccatattggtagattctaaggatttaaaaatacgatctactttaaaacattaatgttatatttctatttttggtaaccgtatgcaatttaaacccgtacaaaaattcgttggcccgtgaaatgactactgttggagatacggtagacaggataaatcattgaaatctgaatttaaatttgaagttgtccgcctatgatatcgccatggatttggcttcatccgtttcaaatgctcgtcatttgcgtcgtcgtcgcggtgccgacaaaaatggctatttatacgagccgacgacacgacgacgtctttacacaaaatacgaagtgaaataataataataataataataattgtttttttattttaactaataaaatgccatattccaaatatttagactgattagtctcattatcagtcgtaattaaatttttaccagggacttcttgcggagttctcattctgcgattgcagtgcaagcaagcttggatgtcaagcattgaaagtgcaaataaaatccatttaaatgaacttttatattaaaaaacatttaaaaaattttttgattaaatatttttattgtaaataaatgtaaattattccattatctaattatctaattaatttaatttaaatagtttaggaagaaaatgggcaagatggactgaataaaacacgacctctttgtctatgcttttacaatcaacaaaatgaacaggtctttggtaaaatgccaaatttggcataattttcaaaaatcctttaaggtttggccctgctttgagccggcaaaatggcaggaaaagcgttgcgggggatgcaccgctttgggcaactgcgattttgaccagggccaaccgggcgaaacgtcggatgatgccgagaaacaacagccgcagaaggccatcaacaacaacacttccgccgacagcaacagaaacggggcatcggcttggtggccatgcctttgtgcacccgcaatacggtaagttggacagacactgtatgtacaatatttcaatcgactgctgtttggtgagtatgactaatcacttggaattgtttgggcgatcatattttacataaaatttaattttaacttttttttaattctcagaatttgcgttcgtgttgatgacaatttgccagaaactgttggctctccgccgttggcagccgacaactcatccgacccttctccttcttctgctgatccgccattgcttgaacgcgtgcccaaaatttgggagttgaaaaaggcggaagtgaagcgaatggaaacgccggaacagaaggaggcgagggaagaagcatatggactgagggtaatgagaaaacgaacggacaattaaagcgtttaattttaaattaattacctaaatggcattttcatttccttttattatttaaatttgggttactccccgaccctcggcggagattaaagtcggatatcatggagaaaattcctcaacaagatttttccgggatacctggacaaatttagaagattacggagagaacaccttctttggtgaggaaattgaaaaaaaaatagaatttttttttaataaaattcttataaactcatttaaaactcaattctctcatcctatttgctcccaattccccgaataccgtatttgctctttttatccccccggggggattatttttcaacctcctcagaaaggggggggggataattagacacggggggataaatggagaagggggtattatttttcgacagatttatttagtgtaaaatttttgaaatttatttgaacacgtcgccaaaaaatgtcatc

SEQ ID NO: 7205 - DNA, 3804 bp, Heterodera glycines
  misc_feature (10)..(10): n is a, c, g, or t
atttaaattntgggttactccccgaccctcggcggccctccaggcggatatcatggagaaaattcctcaacaagatttctccgggatacctggacaaatttagaagattacggagagaacaccttctttgtgaggaaattgaaaaaaatagaatttttttttaaataaaattcttataaactcatttaaaactcaattctctcatcctatttgctcccaattccccgaataccgtatttgctctttttatccccccggggggattatttttcaaacacctcagaaaggggggggggggataattggggacggcgggattaatggggacggggggataaaaagagcaaatacgttagattcagggaacaactctaatttaaattttcaattttttttgccctttattgaaaatgcaaacttaaaaataaataatccaacctccctcctccctctacgagtttttttccttttacaatttattttcacttcactgctttgaatgattaattttaattaaattttaaagggtgtgtatgatccgatcgcaattcgttcaaaagctgtcgagaatctcgtgtttgctgtctcacaaatgagtgaatacgaacagagtcagatgggctacagtaagcgcgagttcatcaccaagtaaacaatgcacgaacaatcaaatggttatttgtgattatatgacggaaatttaacactaataataatcactgaccctttatgtacttttgatagttaatttttattaaatataattaaaatatttttatttaatatttatttttaagatgcagtttcaatgggagggaatgttcggtggaggaagacttctcattgtatgtggacccgacttatggcaactgtttcacattcaatgcccacccggacaaaaatgtgttgagtgaacgagccgggccaaattatggtaaaaatgcgtttcaattaaaaaacaaaatgaaaaatgccatttaagaaatttgaaatctttgcaaatatttaggcctccgtttccaagtttttgtcaatgtcagcgactatttgcccacgacagaagctgccggtgttcgcattactgtgcataagtcaatgcgtggcgtactgtactttttgatttcaattcttgtttttagtcctgaagaacagccctttccggacacacatggccataggaatgaatttgcttattttcaaaaaaatttaaaataaattctttttagtgctccaactggcttcgttagctcatttggcatccgtttgaagtgagaataaaaaaacatttaattattttgaaaagaaaacattagcttaatgatttaaaaattaaataaaaatatataataattttgaagatgtgttaatcggttgccaagtccatacggcgaatgtgttgagcaaggcaaaactgatgaatatatttatcgggacaaggaatattccactgaggtaaaatcttgcaaaatcctgtaataatcaaaagttatccaaatgtgacaaatccataacctaaattagcgaatttaattattgaaaatccccttctgctgaaggggtgccaacgctcgtgcatccaacggatgctggtcagaaagtgcgggtaagaagaacagttgggaaacagattataataaatgaaatataataattaataaatattaattactaggaataaaatttataataataaattaataataataaggataattaatctgcaaatattctatttttggcaaatcaacagatgtggcgacccgcgttttcctcgctatttgaacttcagcaattgtcccgtgggcgacccgcggctgagttagtgttaatcttcaagaaattatttaaatgataacacaaaaatggaattcatacgcaaattgtaaatgagaattgcttgaaataatgaaaaatcagctgaaaaagattccgttttaaagaaacaattatcaattataggaccagcaataaagtttttttagcaaaaataattaattagttactaacaatgcatttaaattcaaatttgcaggagagtgtctccgacgtgaaatgcacagcgctgcgcggtctgccactcagcccgactgcgtgtgccgacagccgtgtcggtgcgatcaaataaaacaattaattttgattgcatttaattagaaaattaatccataataaaaaaagttctaacttttcttcagtgagcaggtgttcagcattacgtacagttgtgccaggtaaatattgtaaaattcgaaatgtttagctttcaaattccgggagggggtgggggggggtaccgttttgttaaagtatttctggtcgtttcccctctgtcataatgagaggccatttttatgaaaaaatattctgggaatgcgataccgacaattcatctgatcattttttcttctcggtctcaagtctatctcagtccatttgagctgttaaatccctttctcatttacttaatttaatattgaatttgctattatttttataatttggcgttttttcattattttctcatgctttattaaatttattcaataaattaattcaacagatggccctccagcgatttggcattgcacggcgaatgcgacccgtcgctgagcggtgcgcaatgtctgcagttccatcgagaacagtccgccattgtcgaggtgtactttgaacaattgaactacgagagtttgcaggagagcgaagcatacggagtaaaaacgaaaatttatttaaaattaaagaagggagggggaggaggggctaatgcttaatggggaaatatgtccagcggaaggcaaagcggaccaactgcgtttaggaaaagttagaaaccatcaacaaagttggtatcattaaaatgctctaaaaagctttacagctaaccaaaactcataatgatttgcaaagaagtaaacaattaaaattaagaatatacaaaaattctgacttttctgcagtttcaggtcttaatttttatctggttgttaatctcatagaaataccttacaaatacagtctaaatatagatgaacaaagaacaaatgttagctacaaaaagccattaaataccacaaatttggctttctgtctcttaaagtcacaatcaaaaatctcgagtaattgttgcgagaagttgttactttttttcttgtaacaatatcaaaaatattttgctgttttcccatagatgccaaatttgctgtctgactttggcggacagcttggcctatggatgggtgtttcagtgatcacaatcatggaagttggcattctaatcagtgagctgctggttttgttttttgtgccaaaaatggtcacttggctgagtcgattgttgaacattgtcgttggcactgatcgggtgccgtcgggcgatggcccaatgttgccttctggcgacacggacccaatgtttgcatttaatttttaataaataaataaatatgttgaaaaatggttatttaataataataaatatgatttgattcctaaaatattttaatatatttaattgagaagttttatttcatttttaaaaattaatatttgatttaattaatttctctatttttaacacaaaagaaataaattttaacctttagttttcctataagaaaattgtaaatattttcaagtgtttaagggctaagaaaaggcgtgttttggtccacaaaggctctgttatccgttgggcagccgaatcagaatgttgcaatgcgggaaaattaggacctggcacaaccaactcaaatggcgagggcaacaaatattactcgactattgatgattaaggccaccgga

SEQ ID NO: 7206 - DNA, 1396 bp, Heterodera glycines
  misc_feature (1380)..(1380): n is a, c, g, or t
aattttttttcaaaatacgcattatgtcgatttattttggcgtaagatgcatattttctatgaaattaatagctaagcattattttggatcaaaataaatagttgttaaatgaattcaaagctttttcccagaaaaatttacctttggaaaaaaaattcgaaattttttgttcgaattcgggtccggggtttggaattgagaaattcgacttcagtttagtgatcagcacccccgaaaacccccaaatactcattttgagctcaaataaaaaataataattttatatttgggacccccattctttacgattgccgtttatggcattgcccaatttataacaccaattttggtttattaaataggtgggacagacttttggatgaagtgcagcaagtgggcgcttacccgatggaccgcgtggtgcccgtgtccgccttcggaaatccggcacttggcgaattttacaaagtgatgccgtcgagcggacttcgagttcggttttttctttattttgtcattttctcccatttttgggtgcaaaaatgtcatagaattacaaattccatacatttgaattgccatggattatttaaattttttctagcgaggcttgtatcacatctttttaatatttttttctgggaaaaatcacaatttgaccaattctgaaaccggactcgaattggaacaaaagttcacatttttcaacaagttcacatttacgcaacaaaatccattcaatgcaaagaagtggacagaatgagttttcgactttttgttcgagttcgaatcatgtattcaaacatgttttcagaaaaattttcttttaaaattctcaaaattttcccagcgtttgcatcgccaggtcacaaatttgaaagcccccgcccctaattgacaaactacgaattattggctctaatttcctcctttttttacagttggaaatccgtcacgaggactacaagcagcagttgggggacatcaaacaaacttattggattgctgaagtgaaagaggcaaaccctatatttgattacttttatgacagtttttatgtccaaccttcgaattttgctgggcaacaaaataagggacgatcgaaggaacaacaaaaaaaaaactgtgccaaattggcatttcgttgtcttcaattagcatcgaataatcttgataatgctgtgtccctttctctttagctcgtcggcttttaccttttgctgcgttacgaaggcatggacgaggagggggacgaaagggacgacttttgggccaacatcggctcggacgatgtcaaaaacgtcggctattggtaagtttaggcattgttctttatgttccatttttttaaatgtcgctcgaggcaatttttattccanatataaaaattgccaa

SEQ ID NO: 7207 - DNA, 2480 bp, Heterodera glycines
  misc_feature (2432)..(2432): n is a, c, g, or t
cccaattgcctctactctgaccacccagcgcgtgctttgaactaataaataccactcccccattaaaaattgtttatttgaatattgtgttaacctcgtcttcgcccgtctctccgactccctcttcctcctcttcatcatcaatttcttcctcattctctccgatgttttgcttcttactgtcaattctgcttgtttctgatgcatcttggctagccgccgccactcgaacctaaaacaaaaataacgaacgtttaagaaggttccgttttaacgtgcagttgctcaatagacctgcacatcggggaagtcctcctcgtcgttttgtccctcctcctcctcctcgttgctttcttgctcactgtcattctctcttctgtttgacatttcctcctcttcccctttctccacttcatcttcccctctcaattcgtcccttatactgctgtctccatctagacttccaaattcattttccgcttctttccgtcgttgctgatggcgtgcagccgattcatcatccaatttaaacatcagccctaaaggaaagaccgagtttcaagttgattgtactcacaactgaatgtaacagaaagaaacgaaccaaatccgagttgaagttgacacggaggcagaaagttgcgctttcctctgatcataaacgcaccagcaggaatgtattcgcccgttggagcagttcgggacacctttgaagaaatgaaatttgatgaaaggttaattggcaaattcacagccgtacctgctcccgacggacccaccatgagctcaccgacactcccgcgtcccaagccgaagaaaagcacacggccattgtcccctggaggaaaattcagtcaaaattatttagctgtgaattactgcttcgttcagcgtccgtggcggaggttcagcgccggaacggtcgcggtttcgaattacaaccgaagcagctcctcttaaataagaatagaattaaaatacagttcgaagtccgaactgactgaatctctgcgtgtacgtaaatgtcacaagaacgcatgtaacgcttaaccaaaagctcattctggtgggcatctctcccggcgagcaccaaaaaacggtccgaactaataaactgagaatggaagggaaaggacctaagtaacgccaaaagaaatacaaattggcaaagctcacccagtggaatttctcgaaccaatagcttttgcgtgctcggatcgtactcattttcttcgtcttcatctgaaagtgccaattgttcatcataacaagactcgtctgtttaattttgcctggttaagtttatttttggcctggctttgagccgatttcagcgctgtcttcgaagctgcgaaggttttttgttcttttgcgcttgccattttccgttcagagtaaaagcgtcgtgcgttttggtctgcattaagcccaatgtcgatgtcaatattaaaagtagatccatcagtttcttccgggtcgctgagacgcatcgtaaagctttaaagattgggctgcaaacaaaccaatgctaaaagataaccggttcgagttcaattgcaacttggaaatgctgcgtacgacggggtgttgttccgctatcgttttgagccacggctcaatgtctgcccaactcatattggcaatggcaattctgaacaatacgaatgcaattcgtcacgaggtccacgacaaaaaaggcaaaaatcgcttgcctcataaggtacaatgccttctccaccaattctttgtttagcaaaaccaactccgctcggcgttcctggacttgttgcacttcgctcaatgcttggatacgattttcgtggtcgcgtcgcacattcttcaaacagctcacagcatttatcgttacgcttattttgccattacctgcacttttttttctgcctctttttctgctcccaaaatgcgttgttccgctttttgtgtttcgatcgacgagtaaaatttgtccactgcttcgctgaatgtatcaaactcgagcactttcaattgctgctcattgtcagtgctccgaaattggacaaagtcgtacggatagtattcctgaattaagtaatttatgtttcgtttttctgactaattgtaagtaaactttatagctttgaattgccggccgtccctccgcttttgcgtctccatttgtcaccgcccttttcacttcctcataagcgatgaatccgccgaatggccgccttttaatttcttcagaaatgcgcgatgcttcgaccagtgcacgctccacgagttgcgcgcccgcttcagaaggcggcaaatgctctccaatctaacaaattgtaagtcaaatgagcaaaagcagaaatgaaatagaggcgtatattatatccaaaagaagattctgtctcattttcatgaagggactgactggcaaaaggatatacgttttttaaatccgngtattttaaaaacctgttcctgtgtcagtactctcccaatagacttct

SEQ ID NO: 7208 - DNA, 4717 bp, Heterodera glycines
gatcaacaccaacctgaagcaccgtaaaacgggactgattgtcagtcccaaatccaacctgagaaacagcgggtgagacgccgcgtattaatgtgttttcggaatttcatgctgaacccggaaggaatggtcgacttcggccaatcataagtggtgctgtggattcttatgccggactcaaaaagaatgaacgctttttcgttgggcctgacaaatttcaaaaaaagataagaattaaagtagaccaacctttgtaattttatcaaatatgtcttcgagtttatgtcgtagacattaacaactctcatcccaacaaaagcgcgcaaatcgtgcaaagctgcacaaagatcaaatgtcgcgaatttagttttcatttaagaagaaaacgaaacaggcttaattaagtttttgatgctatttcatatgagttcataagctattggaatttgacaattcttctatgttgtattgtaccacaccttgtcaattttggggccctagcagttcaaaaaagatttagatgtttggcgaagtggtttttgtaatatagcaaagttaaaaattttgttttccaactgtgtttggctctcgaattttgtgtcattttgtagcattttttgtcggcttaccaatgataccttacttcactataagagcccaagtttttctagtatgtttttgcataattaagaaagttgtggatgttattcaaacaaaaatgtcgtcagctaattcctcttctgcgacagcctcaacatcgggaccaaccaacaaacgtcaaagaatgcggtcggaatgcaatgtttccaatgcatcggttcaaaaacagaatttaggcaataatcggtattcaatgactttccaacttattatggtaactcatcgattttctttaggcattttgccaatcatcgaccacgttatcgccaaccaaaaagggataatcggcggcttttagtcccgggtttggtttccaattgtcctgtcagaattcgttctgctgaactcagtgatttacccgggtttgttttttcttttgccattttctgagccctttttagtttctcatatgacccaattacgaagaaatactaccgaattttggagaatggtcccggacgtgtaagtcaaaattcgaactacacacatttatgttatgttcttaagcccccagggtcaactctccaacatttacgcaatttagccgtacgagccggaaacacagagacatcatcgaattctgcaacttcctgctttaagccaaacaggaaccagtcagcggatatttccaatttgccaaattatctacaacaactccaactcggtcctggcggtagttcgaccacgagaagaaccgggcgtttcgtggaggaaaggcggcttcgtcatgttaagcaacagcccagctatagctttgaggtgagttctgttattttattggatcgggtgggttactcccgttgtatcttttttatgctttatttttaagtaatcgcttttaaacaggtttccggcacttggggtcagcgcttctcgagttgccaatttctggacgtgtcggaggatggacgaactttgattggatgctggtgatactttttcagaaatcactagcacctttttttttgtaggacttcagagcaaaacaatcttttcgaggggcactgttctcgtgtgctatccttcggcgtcactgttgacccaaacacagccaaaaaagacactcagcgaatggcactcgccgaagatgttggggacatggcatcactgttggactccaatgggaaataccgctgcaacacctatgggtttttggatgcgaatgcttatccattttttatgctattctctttcagattgtgctttgagccaatagacaatgagatttgcttgggctcttccaaccgaattctcattgacatggtcacttttttttaaaattaattcaaaatttcatttcgttttcggtggtgtaatagcacttagaagtctctaaaattaattcaaaatcacaaaattcttttttgaggtgcttgccccggctgaccgtgacgtcacttgccttctctttgccactgctcgttctttttaccaggaacaacaacattccgtcggatcttgtccaaaaattgtaaccaaatgcacggttaacttgcgtcccattgaattcaatctttcggaggaggtaaatgttctatcagactaattgaaaaatgttatatttttccgatatattaaaaaaacatgacttttaatatacatttcaacaaaaaatttttttatcaaatttagggccgtgaatcgatgtcatctcccatttataatgcccattggacttcgactgaaccgatttggtctttgtgcttcaattcgcaccacatgaaaatttgcgttggcatggaaaaatgtgccaaaatactgaacgtactcagtggacaaaatttttatgtcggaagcggcggaaaaaatgtcatttcgtgtattttttccaaggttactttgttatgtttttttgatgatacctaatgatttctccaaggacggaaataccctttttctgggccggaaaaatgccgatgtttccatgttggacatgcgcatgacatcgaaccataaagttggcgaattggcccagtcgccctctaccggatacatgcatttgctacagacgcgtcctcacactttagtcactgagaattttgaaggaaaggtccgccattttttgtttttgtctaaaaatgataactgaacagatcaaactttgggatgtgcgtggccgttgtcaacccttggccgaattggagattgggcaccgcaattcctcacataaattaccttgcttcgttgatgcttcagaacgctttgtattcgccgttggtgaagacgcgacagtccggggatggtcacttcacacgggcgaagttcgctaatgaaaaactatcataagactagggcgtatttttcttgagccgaaatacccatcctgaagattctctggctccgaatccgaccctcgaaaaattattgtttttttctttttgtaaagctgctgtgttcggtcacaagtccaaagatgcatcagcgtaaccctctgtcctatgcgcagcaactttccatgtcaacaaatgaccatccagcaatttccggcgtggacttcccacgagtggtattttataattgaattcataatttttttttttgattttcaggcattcagttcttcatggggtggaaggacgggaaattcggctttaattctcgcggtcgatggagatttgctcgttcatgagcttttgctatgagatggcggctatgtctaacaaaaaacgtttatttatttaagcatccagcaaaatttttatgtatttcaacttttattttctaatgcctttattgattgcatttttacatgtaaaataatctcatttgataaatgattgattaaaaattcagttacaaatctatgctcattaagattacaactataaaagatagggtcaatggcacttcaacaatttcagggattatatacaaagatgtttttgtagtgcatttttattaaggaattcccccaaaatagattcaaataagaccagaaaaaagcaccgtttttttgttgtaaaatttagcctaaggagagttcaggaataaatgataagtcatagaatcttgttccttgtattttcggtcgccagttgcagaggtattctggaaattattaaatgttggttgtgagttcggcaatttgaaaagccctggacttggattctaagttggatctggacaaaaacccaggcccgggaaaacccaagggcttgtaatggccagggacctgtgctacgaaattccatttgagctgaatcgcttcgttattcgaaccagtggtcccattggcaattgtcgttccacagttttaggcacacaaaacaccattcggactgaaaatgatttccaaaagtattttgggtggtttctttcacctgacattgcgtgcatcggatgtgtgcacacccaccattacgctctgtgggcgcttcacaatgtgggcattgtttggtcgtgcgacggataagcgacgcactttccgcgtcggtagggcagcgaagacaattctgattgttgtcgacgcatttgcatcggtctgtccctcctgcttttgtgctgctacaacgacgacaaatcactcgacagcactccggacacagaaacaccttcgaaatgtgccacaaaggttaggcaaattgttttttcctgaaaagacttcgtccgccgttcgttcgacacttttttcgtcagttccctccacaagaaaagcagcgccacaatttggccatggacagtgctgtcgtcgttccgcagtttgagcagaaaaaaacagttgcgctgccaattggtggtagtgctggtaggaaggcttgcccagcaaatacaaagtgtgaacatcggtgacgacagctgaagtgcgttggaattgtgaaacaaaaagggcaatggaaaaatgccaatttaaaaagcgaaaaattaagcgcttttaccggtgcacccgtaaaaggggcatccgacggtgtaaccgacttgggggtgccattttagactcatccgggacaaaagttcttcagcatatgcgacgaaacattgaacgcagctgagatgggtgcagtcgcgcaatcgaacgcccaagggaaacgaattggagccgcaaatgacacattcggag

SEQ ID NO: 7209 - DNA, 1582 bp, Heterodera glycines
agatttgtattgtatattaaagatttacgtgcttaattgtaaaattaatccatctctgcatataattcgtcgatatatttcgtcattaaatgatcatttattcaagtacgagaatggagttggaaaataatgaaaaataattttggaatttattcgcttaactgaaaatattgcgtgaaaatttgcttataattcttcggatgagtgttgtcatatgcaatatcaaaaagagtgcttttcattaaaaagataaaatgtagatcatttaaatattgttattcgttttttggcacatcaattgccatgaaagaaatttctttcagaatttgttcagaatttcctgctttaagactaattacttgacaaagcttttgtgaaaattaaagatttaatataaaaataagcttgagtaaacttaataagtggttgtttttaccagcacttttcacttctagttaatcgcttttcaatattcgttattaaacagtcatccatttaggttcgagaattgcgtaggaacattatgaaaaaagacatttttaatttactttctgacctgaaaaaatcgtgtataagcactccacataatttgcctaatgaaagttgtcatatgcaaaacgaaagagatttgtattgtatattaataaattaattaactgtcagctgttaatatgtttttttaatatctaaaatattaaatttacattttaaaatgtttttgaaatgtgagatgaacgaagaacgtctcccccccccccccctccgttcacgcgcatttatcgtattgatcttattttgggcagcaaacgtttggccatataatctgtgatcaatcgattttggaatggaaaaaagaacaccgatcagtgatcgccacccggggcgattttaaaattcttattgttatgctttcatcactcaattattcgatacttccaacttattctctgttccctttttgcattacccccccccccccccccgccattccgtcgctttcatttgcttttccgttggctgtcgtttaaaatgttagtccccccccccactgaacattgacagccattcattctgagatccgattccatccaacttcattttaatagcatctgcacattctcaataaataataattgttcaattaattctcatttacacataaaaaatccatttaaattaattaattccaccgtttggtccaaaacatttcagtgaattgatcagatgaacttttgatcgatgatgcgccgcctttcctccttttcttttcgctttttaattgttaaattaattgcctttcccttcgtctccgcttacaccgaaaaaaaattgcaaaatgaacttcaaaatggatcatcgatctcttcctccaatttgtcctccttttcgtcgtcgctttcgtctcccaatgtgccgttcttccaaattttacacttcgccagcaacggcactttcccttcatcctccaatacttcgtccgccaattcatctcatttcgtcttttttccgttctctgtcccagtttttggtgtgccggtagcaactgcttacattgactgcaggagcactgatcagatgatca

SEQ ID NO: 7210 - DNA, 4270 bp, Heterodera glycines
  misc_feature (31)..(31): n is a, c, g, or t
  misc_feature (1671)..(1671): n is a, c, g, or t
cacattaaaaatccatttaaattaattaatntctccaccgctttggtccaaaagatctcaatgaattgatcagacgaacttttgatcgacgatgcgccgcctttcctccttttcacttcgctttttaattgttaaactaattgcctttctctactcaattctcttcgtctccgcttacaccgaaacaaaattgcaaaatgaacttcgaaatgggtcactgatcttttcctcctcctcctccaatttgtcctccttttcgtcttcgctttcttctcccaatgtgccgttcttcgccagcaacgacactttcccttcatccttcaatacttctgccaattcatctcatttcatcttttttccgttttctgtgccaatttttggtgtgccgggggcaactgtttctattgactgcagcagcactgatcagtcgatcagcagaagcacacaatcaatccgttgggagtgcggcattaaggaggaaaaggctgaaaggaatgaaaggggggaaaattgggaagacgcgggaggagaagggcacagcaaaagtgccggtcggggacaatttgcaccgcaacagcaacggcaattccgaagcggaccaattgaattgtatcactcccacaaagtcagtcggttctttacaatgtctgatcacacaatatttcgaaatgatcaacattgcctttatgtcctcctcaaggtgaaccaatcggatggcaaattgttcatttcggcattggtccgctggcacttcctctcattgatctccaaatatttttaccgaattcatttttggattcggcaaaacgcttcctcaatttcggatgacggcgttcaaaaggaaattcggcatttcgttgttcatttggcggcgagcgattcgaaccgttcattagaggacaaaacaaatgagcacggaataatgacaaaggcagaaggcaagcaaaacactcggagaacacttttgcctttaggctgcgctttttcttcacgtcgacgcttttttcgaattcggaaattcttacgaagtgagtggcgatggcatttcaatgccaattattaaaatatccttcagattcactgctcagccgaaaaaatcaatcgctttcaaaaggaaaatgacacgatggagagaagcattttgttgggaaatgcttataaatcaattgcctttctaaaaatatgtaagtcgacaaaaaacggagggaaatgggggggggggggaagagaatgccatcggatgagtggggcagaagagaggaaacaatttgaaaacaccgatcggcagatgatgaaatggacatggacgggtgcccggatggtcgtggaattatgctaaacccaaaaacatcagcggaagcattggccaaacggaaggaaatggcgagtcgatggttagcgtccctggccattaattgctcaaatggcaaacaaatgagcgtccctttttctgctgaaggacgggtgcgctacgctcgatccgcttcttcccttggcattccgccgtcaatgtgagttttttcgccgcgccgccctcccattgcattggcacttatcgcgtccaactttggctaatgaacgcacttcacaacgaaacgagcgtaacatcggtgaagcatttgcattaagcggtaaatgatttccttttgcagcaacagttgagccgaatgngagcaaacgtttacattggcagtgccgaattcagagaattgccaacggatgagcgaatgaaataccaattaaaggtggggaaatgccgattctgatcatgggaagcaaaaacagcaaacaaaaggtggtgccggaggagcagtcaaatggcatttgcatatgcgaaatgaatcggaagtgcggctgtgttcaggcaaacgatcggctcaaaggggctcttagtctgatcaaacaatttcccggggcattccgccgtttaggtcgaaagtctcggccttaattagtgtcccattaaaggcttattggtggactcattaaaaggttgctctttgctttaggtccattcagaaccgttttccctgctgctgccaaattcgtcgtcctccgatcagtccgatttcgtctcccttttgcgtccctccgtgccctttttctctgtgccctccccctcctcccactctttcgccctccccccgcttcttctcgcctgtctctttctctctctcactctcattctgctggccatcattcttctccttttggtccttcgccgttctgctgatcaatcggcggaacgcaaacggcgcattttattcattttcaccgggtaaataaaagcaaaaataataaattgggcaaaatttgtcgattgcacttcagaaaacaaaaaaatgtggaagaatttggactgatgagaagaaaagaattcggcgtgaacatttcgttgcacggatcgcaaaagaaattggagtcaattttattggtaattacctaattaacaaagcaaatgccgtcgaaggaagggaaggaaggctcgtcgcttcaccttctcttcccaaggtgaacgcccagccaaaccgccgcaatgaattggaacgcgtcgcgagggttttggtgaagaatggcatccgcgtgttctacgaccgatgggacagggaaagcattgagcgaaatttgcttggatgggttcaaaacgcggtgacaaaggcgactaaggtcggtcgacggacaaaggcaaaggcggggaattcgtaggaaattcgaaagattcgaccaataaatctaatttatccgtccttttgcagattgttttgttctacgacagtcgtgctgaacaactgctgctggttccctgcgcaggacaaaacggggatttgttcgatcgcgtgttctgtgcacttcaccaacatttggacctcaaaaaaacggttcgaatttcgaacaaagcgcaatatgaccaattcgtcagattttcatcaaatgggacgagtccaaattggcggatggacggccgttgtctgcttttctgttggcggagaatgtttttctgtttcggcgcgatttgaaacaaatttttgccgctcttaacgtgacgatcagtgacactgaacagagagacattgaggtgaagtgataaaacaattttttttggtgattaattgttcagcgtgaatatgaaaaaatgaaagtgattggaaatccgaaggaaatgagagaggaaaagcccaatgaacggacccatttgctgagcgaatttgaagacgaacacatggcgaagaacaacggcggggggcaatttggcacaaaagaaacagtgacggcaccgacagcggaagggggaaaaggggaagagggaacggaggcgagcagtaactgcaacacaacaacaacacaatgggggacgacagggatgagcagtgactgcaacacaacaacagcagcagcagcgcaattggagtggcataatgaagcggaggaacaaaggacaaagaatcagctggcaaaaggaaaagaagaaggtgattctggagtgattgtgccatgaaattcaaaacaacaatttattttttatgttggttaaaaaatacaatcaaaaagaaataaagccccccccctctccccctctctttcccccagtcgccatctcccgactcgccgccctttcagttcctcattttattttcaactatttcctgcgcatttgccccaattttgctgattgccctccgtccatcgtttttgttgtcccctgccgtttcacctttaccgcgccttattttcatcctactaattaaccggttaagttgttttcctctttcctgctggtgactgatcagttaaggcatttgctcgagctgaaatatttgtacaatttgtcacaattagccgtttatttcctatataaagaggacgcaaaaacattcccatcatctacaatacctaatttgtgataataaataaaaaacaatgaattcttttgtaccatttttatttttgatgggtttaatttgcctatcagtgatagaaaacgtcgactcggtgctgaatttgccccttttctcctttttcactgtatattcaggttcgagtgcggcgatatattcgcttggcatgtcacaacgaatgtgccaaagaatgtgcgagacatcccggcttcgaaagtacgtcaattgttgaaaatggctttcattgggtttgtgtgcgaagtgtcgccctccccccccccctccatttccccgcttctgtcctaaatcgaatgttgggcaggtcaatgctggccccactgcacgaagtactgcttggactacgcggcaacaca

SEQ ID NO: 7211 - DNA, 3449 bp, Heterodera glycines
cagtcgtgcctcttctcgtggctttatcttccccagagcctttgtattggtcgactggttctctcttgccatatccgatttcacgcgtatttgtgaacgtgggtcgagtgaaacattatctgcgctttaccatcaggcgttatttgactgatctcgaacagtgtgttcttcgagaagttcacagttatcatcggatttgttgtcattggcactggtgctgccactttgtctgttgtccatttgctcaatttaaaatcagacagatttgaacaaaaaggttttggacgagtactcaccaataattcataccgctttatgtcatggtaaacctcctggagacgctcatatccatgcgtaatcaattgatcaaattcgtgaggaattttaatctaaaatcaaaaaatatcaatccacagaatgccgatgcaatttgattacctgatttcgagtggaaaagggcattttactggaagattcaactttatcggctaactgttgtaagctttggtcaggatcagcggcaaataaagtcaaatcattggcattgtctaacaaacaggaaaagagctttgagtcagccacatcagcattctcttcaatcagacgaagatcttaattaagttgcaattttaaattaaccaggcaaagattcggacaaacctttctcaatctcatgcagttgctgctcctcaacatcataacccatttcactaatgacttctctaatgacatcagaaaaatcttcgaaaacattgtcatcacgaaacaatgaatccataaatgttgaaatgaattgtaaatttttgacgcgttctaaatgattaatacaagacttggttatgaatttacttgagatcggcgggagtgggactcctacgggatttttacgagaataccgctcccgtttgcaaaaaggcacttatcagtgtattttttgaattagcgccaaaattattctcttaacgccaaatagcataatagcgtaattttgcgcgctaattcaaaatttacactggtaaatgccttttgtattttttattttgatctgccataactcgcttcatttcaaactaaactgaacaaatttgatatctaaaaaaatttgtaatggaaaatctactaagtaaaaactaagcaaatttgagttctaagaaatgtgtgactttcaaattttcacaaagcaaaaaaggcaattaggtaattacctattagggtattttttgaattagcgcgcaaaaaattacgccaattacggctatttggcgtttcgcactggtagcctaaaattgactcgctgtgtattgtccgatttacagaaacgggattgtgagaatcccgcgcgtatcaatgttttctccagatccaagttattattgttcgagaatgtattttatctaatttaggtaatggaaggtcacggattcctctattcgctggaaatcgaaaattttaaatccttcaaaggcaagcattacatcgggccttttaaacgattttccgctattatcggaccgaatgggtcgggtatgtccaatgcataacatttaaaatcgctacatacataataatggattaaggaaaatcaaatttgatggatgccatttcttttgtgcttggtgaaagaacgaatcatctgcgagtgagaaaacttggggtgagtcaactgttttcacattcccctttttaaacaactaattatcgcttaggatttggtccatggcgcgtccatttcgatgccggcgagtaagacttgttgtgttcggatgatttatcgaaaccctgatgggactgaacggacttttcaacgaacgacttcggaattacgtgttgatgataatgtggtgaatctttcacaatatcacaaagcattggaagaaatcaacattttcagcaaggttttgcactctttgtcaacattatttcttaattgccactgtaatttcaggccagaaatttcctcgtttatcaaggcgctgtcgaacaaatcgcaatgcaaaaccccaaagaaatgacacagctttttgaagaattatcgaagttaggaaattttttaataagaaaaattaatctttgactttgacaacatcacatgttgtaagatctgcagaattcaaggacgaatatgaaaaactgaaggaggaaatgcaccaagcagaagcacgtgctcaaaaaaacctaaataaaaagagagacattacgaaagagttgcgcgaggttatgatggagaagaacgaggcacggcgtttccaaacactaaaggaggaattggtcacacaaatggatggggtggcaaattaaaacaattttaaaaatgattcaggtcatccaaaatcggacgctctttttggttcaattattctttgcggagaaaagcaaacaatttgttgaggagggactcgagcagttgcgcttggatttggaaaagaaaaagagcgaccgaagcgaatttgaaagtgatttgcatgagaagcaacgggcagcgaaggacgtgcaccgggagaagcagcgaattgaaattcgattgcagagagaagtggacacttttgatggtttaatcggtcaaaaatgaattaacaacactcaaaggaacgaaaagtgctgaacagacgaccgaatgttaccaaaagcaaacaacagttggaccactgctgcctcaaattggactcagtgcgaaaagcgtacgaaacggcgaagagagcgatggattctcaggagaagacggtgaaagaggccgaagaacggattaagtcggtcatgggatggactttatcagtaaacacagcctcatttcatcaaggaaaacgcaaaaggaaaaggccgttttggaggaagaactcaacaaggagtcgcaggcactgcaacttaacctaagcaaggaacaagtgagccgatttttgccgcaacgaattcacacggccaatgctttttggtggtcgccggaggtgttgccgccaacgaacactttcggacgcgcgtcaaagaaatcgctgcccaacgaaattttgccgaagtgattgtgttgccgcgggaattgtgcccggacaacggagtgatggtggcatggacaggcgcagaaatattggcaccccgaagggaaaagggagaagaaatcgactttttgagttgggcccccccccccccgaaacgaaggtcctggctacgcccttggggtggaatgttctcgaagggtgaaaatggacccgtactctcacgtccctaaatgccactgaagacgtacctcgtctttcgttgcagcgtcgttctgctcactgcccattccctccgcctccccttcttcgataaattcgatattttccggatcgaattcgtcctcctcgtcaaaaaccttgaaagaaatgctgtattatttacaaattttccattaccattgctggcacattcggctccccatcttcgtccgggaattcaaaaaagatggaatttggctc

SEQ ID NO: 7212 - DNA, 1958 bp, Heterodera glycines
ctctagtagtcatattagaagatatttatatttaattgtttaggaaaattttccttgaaattgccagggtgtgtagtccttggaaatcacgtgcctctaggcacgaaaatgatattttcgtccttatttacacgtgatcgtgcttttcgtgtggcgtcactttttcgacaaatttccaacatatcgcaaaaaacgcatcacaccgtttctcgcggtgccaaacgcgcgaacggcgccgctcgaggggaggagaagcgacgtcgttttgccgtggttggcgccccgccagggggtggcaccgcgccggcgccaccagcgccggcaccgccgcccccggcgccgttaaggtttgtacaaacaccgccgaccgcaatttgaccggctaaacatttaaaaataattaaaaaataaatttttaaaatgaaaacatgtatagaaaaattaattaattagaaattgtttagcaaattcttcaaatctttaaacatcaatagggctagcaaaaatatgcacacataaaattgcaaaattgtgaataatataatttttataaatttcttcaaacctctcaaaaaaatagcaaaatcgatcatttataagacaaaaaaaattatgataaaaataaagttttattaaatttgaaaaataccaaaaaatgaaaataaattattttttgcgtgtttttgaaataatttactaattttaaaaaaaatagattttttaaattaatattcttgagaaaatatccggtatgaattagtctacttaagctaattggtgctaggtcgatccacaaaaaactcaatgattaaattaaaaagaataatataaaaattcgccatttttgttctaatttttttgcacaaatatcttttgtcatctatgggcggaaatgcaacaaaaaaaaggtaaacaaaaatgaacggcatgaaatactaaaattaaaaaaacaaaaaccaaaaatggaatggcttgaaattctaggagcaaaatggcttaatctattaaaaaaaaaatggaaaacccttcaaatttttgatttaaaaacttaataaaatagtagtaattttaaatattataataatttaccaacacttttgttcattgtagtggtaaaaatttaaatacttccatataattgatgagtaaaatgtttatttgtgtttaaataccgtatttgctctaattatcccccaatctccattaatcccccaatctccattaatcccccagtctaggaggcgtttgaaaaataatccctctatcataatcccccagtctccaattatcccccagtatacgagggggttgaaaaataatcccccatgggggataattagagcaaatacggtagcttaaatttatacaaataaaaaaaaatatttagcctatctaattatataaacaaatttcgatttactttatttctgaaaatgttttaaaaatccataaaaaaatataaattaaataattaaattaaatattaaatattaatattcattgatacttttgtaagttcggctcagcacgaaacaaaataaatatatttgttttaataaatctcatttatttgactcattttagaaacgcgaaaacatttttcatctgaggaaaaaagtgaaataattgtgaattttggcagaataaaagaagaaattaggaaaaaatttggagtgaaaacaaacacgaaaattgatggaaaaattgcaaaaaaattgggtgttagtatgagaacaatttactattggaagaagaaggaatattacgataataattagacttttccacgattttcggattaatccctgggaattttttcaacaattttcttcgtcaaataaccaatttgaattaaactctccatcccttcctatgaattataacatctctaaaatttgtaaaaattctttcctgataatgaagaaatagactgtttctttgcctaagacaccaatttt

SEQ ID NO: 7213 - DNA, 3367 bp, Heterodera glycines
  misc_feature (3304)..(3304): n is a, c, g, or t
ggtcccctttccatgtatggtggggtctgatcagtcacaaataaccaatcccggtaaatgatcatagtaattggacaaaatcaggtcattgatccctagttggaggaaggaaagcattggatcaacaaaatcctgtgatcagtccccaaccccaaaaaaatcgatatgatgagacgcaagcaattacagcagctaaatacgctctgatctaaatgcatgctgttgagaggaccaaataaaactgattgaggatggcactgtaagttacaaataatcaacgtcacgaacactgtgctgattaccggataccaaatttattggatcattagcatccccaaatgccatggcattgattccaaaatcttttcgacaaattaattcgcaaattcagacacaaaaactcaccggatgggcattgacacatgccggcaacgcaattggaaccgcccaagcacacctcaccacttgggcacgggtcaccgggcaaaactaattaattatgcgcaattaatttatgttaattaataccatttttgcctctaccgtacccgtgtgcacattccgacatacgccggccatgtttacggtgggcgcaatgcaggagcaaattcgttccgagttacagtaggcattcggcgggcacgcctcacccattgctacagtaatacaaattaaattattaaaatacaaaaaaaaatatttattttttaaaggattttcattattttaccgcaagaagcgcctgccaaaacagtttcaggccgctaaaatataatattttatgtttagattaagagagaaaaaaaaataataaaatgaaaccaaaaaatgtttggcataatgccatacaacaggggtgtgccaaacttctgtcgttttcatttcccccccccattttcggcattttttgagtttgattttcattttttcgttaaaaaaactcacaatgcattgcccattttgtgccacaaatggggacggacacgtgcacacgccttggacacagacggcaaaattggtgcacacattcgtggccgagcatggctggccggccccaacttgggtgaccaccgcgcaccggacaccgtccggcacggtgccaagcgggcacttgcactgaccctgttggcagctggcaccgcccaggcatcgctcgcgacctgtcgggcacggtccatccggtggcactggcaattaattttaaatttttgtaaagtaaatgaatttttaatgatttgaataagcaattttttaagtattgcgtcaatcatagattagaccgcattccggcattttttggcgccattaattcgcattatcgcaggaaaagtgccggtatttcgtattttggcattttttagtcgccggtcttcgtattttggcatttttttttggcaccgctatttcgcattacggcaccaagtgtgttatttcgtatttcggcactttttttggcaccgctatttcgcagctttcaacctcattaatattaatcttttattaaaattagaaaatttttaatgtttttggaatcaattgggaataatttttttaaatttaataattagaaataaaatattttaaatgaaaaaataaaattaaatatgcagaaaaaaatcatcattccatgaatgctttaatgtgcgttttacatattgccaattttaaatgtcattgctaccggttggcggatattggcacgtcccaccgatggccaacagtggtggcacactttaaaaaaatattttacaaagatttttaatggcactgtactctcaccaaatgcacatgccctgctcgcatttggagcctccaccgcattcaacggccggggaacaggccgagtttggtggtactgtaacaacaatacaagggaatacagtatcacgaacagtgagtgacggtgtcagcaaaataatgcttgccattttttaaattaacaaatgattttttcgccgtgtttgttggtaaaaatcttagaaatttataggaaaaaatttttttgaaaaaatatttgaaaaatttatcagagatttttttgaaaacacttacgaattcatcagaaaattttgaaaaattgaaaattttttcttaagcttacttataaaaatttttttttaggtgcttcttgaaaaatttctgtttgaagccaaaaatgaaaaatggcaccatataaatatggaaatttcttcggtagccttcctctccccatttccacaaattggaagtgattggactgatcacctttcctgatcacccccaagcaatcgattctaattataataatcctcatgccgtgccgtgcccacctgtcattttggtgacacaaacatcgttgagcgcactggtcccggtcgggcacacgcacgtgccgtccatgcaggtggagccgccaacacagcgctcaccgcgcacgcacgagccaagcggcgcggcacgcactacagtagaacaaatgattaattacagtaaattagagtcgttatggtacagtaaccgcgacggttttagcgagcgtcaaaacttaaaaatcatatataccaattacattaatgttataaagttaattttaaggatatgggagctattacataactgattttaaagttaaaggttgtattgcataaattacagaaaatttgttacagtattttgtttaccatatgagtgactacaaaattatagtaacccgaattataaaaaattattatgattaaatgatgctttttcccttctcggaacacagaagagacgccactgtttccattacagtaaattagactagagtatgttacagtaatcggtcagattacaaattacagtagaaaccaatctttttaataaaaaattattatgattaaatgctttttttactcggaacgcagacgccactgttgttgaccatgcttgtagggcatgtgcactgatcattcacacattgggaaccgccggcacactgacgattcaccaaacagggctaaaattgtaaaaataattaattaattattattaattttataattttatcattaaatgatgtgacataatatctctgccccctcccaactttttatttttcaataaaaatcttaaaaattttttagaagaaaatttcaagaaaaaaatttgaaaaaatattcagaattttttgaaaattaattaaaaaaaaaaattaggtaattcatcataaaattttatattcaaaattttttccctgaaaattttctctacaattaaaatttattgaaaagcaataaactagactaattaatattgtttttttttccaaagatattggcctatncaatgtgataataaattaatttattttttgcaaatcggtcagatcaaaaacaaaaccaattta

SEQ ID NO: 7214 - DNA, 1961 bp, Heterodera glycines
ggcaaaaggaattagggaattctttaaagctcagaattagagcactgcctgcgccggggcctatgtctaggtttttcctgggtcaggtccaggccgtttttttgaaaacttggacttttcctggacctggattttgttccaggatttccaggtcacatatatcaaatatgaaaataactcattcctcagtttcgattctcgagtcgagtaatttctcggcattttagggtctcgccctcgtttttcgggaatgatttctcggtctcgattctcgctaaatacttcatttctcgtacatcctttacgaaatccatatgctttttaaaacaatggcaccatttaaaggcaattaattgttgcaaaaaagggtgcctgattattcgggcaccggcaacggctcagactgcacagcattcccgggtaaacggcatggcattggcttgagtaaaggcattcgccgccgggctgaacagctgaaaatttaaatatttaatttaaattaaaaaattcaaaataaccctaaacgatggaacccaatatagcagaataaaaatgaattaaaacatcaattttcgtattcaaatttaaatatttaaaagcacactctacctggtaagcagcttccggtcacgccagagaacatttgtccttgagggcattgcgtgccacttaatgggagagaaaggcaattaattaattatcgaattaagtcatttatcacactaatgaaatacaacaacccgtcactggccacaggcaaagattaattaattatttgcccaattaaggctcattgattaataactaattaattaattgctccaattaagagtccttgattaattaccacgtcccgtcagtggccatgggcaataattaattaattatttacccaattaagagtcattgattaattattaattgcccaattaagagtcattgattcattaccacgtcccgtcagtggccataggcaaatcctttgggcacacgcactgttccagcaaacattgggcgccctcaaaaggcataaataataattatgtaaaataaaattgaaaatttacaacattaattacttggacaacagccgaacattgcattgaatgtgaacatgggccagccccgggcaaaattgctaaaaatttcaaaaaaaaaaaaaatgatattggcataattttaaaattaaaaaaaaatcaatcaaaaattattaaaaccacaaacatttttgcaaaattgtaatttttttaaatctaaaaaattttctttggaaaatttcttgaaaaatgcaaaaatttaaaatttttttttaatccagaaaattaaaaaatccaacaagagaaaatctcctatttttttcggttttcttgttcaaaatttttgaaaaagcaaattttaaattcaattatttttaaatttttactaggggcaggtgaacaggaaagaatggttacttttgccctgaaacgaaaaactaccgaccctggcgacattggccaatttcggccacccaaatttcgccacgcctggtacagttacggtcggagaaaatgcaactgtgcccgtcctgcgacacgcgcatgccgtacacacattggcacgtcagttgccggcaaaatgccttcaaggccgcaatttttagattaatatatatatattatattttcggcacgagactcttgaggacgataaatgtgccaatttcgttccgattttttcagaattatttaatttaaaaagtaattaaacgaaaaatattttttcgaaattaacgcaatctttcaacaaaaaaaaaacatgttttcataccccgggctcctcggcagaacattgctgtgagtattggcatggtgccccaggaactggaaacattaaataataaagcaaaattgtcacatggggttttgatatctaaaataaatttaaaattaaatgaattaatagttgagcgccgataaatt

SEQ ID NO: 7215 - DNA, 3222 bp, Heterodera glycines
  misc_feature (17)..(17): n is a, c, g, or t
  misc_feature (59)..(59): n is a, c, g, or t
ccgtccttttttggatntacggaggcggtaaaaccttaaaccaaaaaatcataattatntaaatgcaatattaaatttgttaggcttttggtccggcaccgcctctttggatgtttacgatggcaaaattttgtcgaggtacataacaaatccgctggtgtttttggccgtacgtacttaaatccccttttgtccagtgaagaggatgtccattgtggttacggtaaattaccgggttacggtgttcggctttttgtatctcggccagagaggtcgttcgagattttttgtgtttaaccattcgagaattaaagctcattttggccaggaggcgccggggaatatgggcttatgggaccaattgcttgcgctcaaatgggtgcaccaaaacatcgaatgtttgcctttgatttccataattgagacaatttatgcctttgttcagctttcggcggtgaaccggcacttgtcactctcttcggcgaaagtgccggcgccgcttccattaacatgcacatgtctgttccgttgttcaattttagtaaagtctccatcaattcacttttaaaggctttcgccccgttcgcagccctttttcgcgcgtgccattatccaaagcggaagtgccacggcaccctgggcagtggaaaacaaacaggtggggggggggggggaagtcaatcggaagtccaaaacgagtgatcactactgctgatcagcaaagtgctttatgaatctgggccaatttgatttattattttacttatttattcaaagtgcaattgtttcttaaggtggcattgcatcgggcggtcattttatacggtaattctaattaatgataatttgctattaaatattttaatcaccaaaatggcacagattatatgaaatgcggcggtgccaaagagaaaatgtcccaattggcgcccgaggcgtggaatttggatgccgttttggagtgtttgctgaaggcatcctcagaaaggcttcgtgacgcggaatggagccccgttatggaatttgccgactttccatgggtacaaataatatttttaattattgcctaaattgtttggtggttttcctgccccttttcgcccatttaggtgccggtcatcgacggcgatttactcgagcaaagtgtgagtagttcactcaaacagggcaattttaaggtaaaatttaaaggatggaccatttttaccattttgggctaattataataattaatggatgtattattattttctgcaattaaatgcttttcgaatattcgttctgttcagcgcactcaacttctcgtcggcagcaacaaagacgaggccatttatttcattgtttaccaattggccgacatttttcccccgtcggaatttttcagcaaaaagttgggagacaattaacaaaaaaaactattaaatttgtttaatttctccagggaattcatcacaacacgtgagctgtggctgaagagcatttccaaccttttgccccgccaaattctcaaatcgtcgctgagtcttcaggccatcgtgcagcaatacgagccggacggggaattgccagtcgaatggtggcaatgggtggacaggtgggaaagggggataaaggggtaattaagagcatttgacgatggggaaatctttaattaatcagaccaattaagggcattaggggggggggatgttccttcaaaatgaccattcctttttcagtttggacaaaatgctcggcgatttgctgttcacttgcaatgtcaacgaatttgcgcttgcccacgctgagcatggcgcgcccactttttattatgtgttttcccaccgcgcttctcaacagacgtggcccgaatggatgggcaagcgaacttcgaaattcaaatttggatttgaagtcattgggatttgtccacaggtgttttacatgggtacgagatcaacttcatttttggcgagccgtacaatcgcaagcagttcaattacacgcgggaggagagggagctcagctcgcgctttatgcggtcagaaattcaaataaattcttaacaaaattacatttaatacatttttctcgaactatttgattttctactcctaattggaattatttccttttttgaaggtcggccctaaaagtgttatccaatagatatctccgcttttggactaaatcactttttaaagatattgggccaactttgcccgaactggcgacccgaatcgcaacgcggacggctcatacactggtgggcatttggcaattagggctaattaggaagaatgactgtggttaaaaagcccttaaatctggaaaaataattcagctgacacttggcccacttacaacacgaaaggcatggaatatatgaacctaacagtcgagtcggactactcactgcgaggggcacgacggattggcacgggcccacggaggaaacagtgcaaattttggaagcagttgatgccgaaactgttgctcctctccggtatttcaactgttacattatcccatggattaatttaacaatttggcacttaatttgttctcatttgtcagccgatcttggtgagtcgttcatccgatggaagcagcacatggagcgttgggagcaggagtacatggcggactgggaagcggccatgaaccgatggtcgcgtttccaatcgtaccgcgacagagacatcgccgaaagcatcgatcagcaggggacatgcgttggaggaggaggaggaggaagctgatcagtgatcggagaatagaaaagcagaggaggacaactaacaatctgtgatcggactgcggcggagtgctgagttttattgcttggtttacgcaatggcacttggtcatattcccatttattattcgggtatttttattttcattttttttattttgtgtcatttaatacattcgaagaaaatttttcatatataaaattggcgtcttgttattacgattattattacttagtcaaatttacaatttttcccatttaatgaaagtcgacagtgtccccaaatacccccccccccctcccaaattttcgccgttgcgttgcttaatccaatttgtcgtaaattgaggaaaagcattgacaaacaacgagcagggcatatgaatgggtaaggagttggcacgtgggcacattgctaatggatggcttcttctctccgtgccctttcccctcggctgcttttcccccttctcggcttttcgttc

SEQ ID NO: 7216 - DNA, 758 bp, Heterodera glycines
cattttgcacccctaaaaatggggttttttagtgcctattttccattttttagagcttattttgggggttttttagagcctaaaaatctgagccctactttgaacaattgccaaattcgtcagtgaattttaatttttaggtcaaatttaatcacaaaatttccaaaaggtcaatttattttacagtgaaacagcgacattctttcttaatcttttcgcctttttattttgcgttttttccttttttttaaagtttttgttttgctttttcgccttttctcaggggaatttgtgccgggcgaaggtcacgcgccctttcgctgcaaaacattcgcccaaaatgcaaaagttccccaatttccaatccctcccctttctctcccccgcccattgtttcgcttctgtcccattctatgctttttaatcatcaaatgcttttcctccttttattagggcgaactctgctctcgaaagtgccactttctgttccagaattcgtcttccgttcggtgtccgtcggcactttcgccgccttttctcctctttcataataaaatataatctttagttgttgcgctccccaagaaaaaagaaatgaaacggagttccatttaccattcattcgttccatttttggcatttcccttccaattgctttccattcattcattttgcgctgtcatgccaaaaaccgcattttttcatttcaaatttaattaaaggaaagaaatggtaattaattaatcatcgctctgtta

SEQ ID NO: 7217 - DNA, 2042 bp, Heterodera glycines
ccagtgcccaacctgtacttcctgcatttgctgtacatccgccacgacttgcacaataatttgcgctttctcctcggctctttgtccgtttgccaaataacggtaacttttttttgccaatttcttcacctccattgtgcccattttggcattttgttgcacaattttcagattgccatcactcgcattcccacccaaatttgctacgctttcacgggcattttttacattgatcacttccgttggctcgtctttggccacgaaatcgccgttatggttgaagaaataatttaaatttgattcactttttctacagtattttcgcaccattatcgtaccaatgactgtcgaaaggggtaaaatacggtaccgaaccattctccgcgcattaatttttctgttacagttttggccacggtattgtccaagcattatgagcagagggaatctccggtcattggcatttgcgcagtttttgttacggtactggcataatgtgtgctgggacgtttcgtaaaatccgccattttagcgaatttttcgacaaaacatgtcataactttgcttaaaatcaaccaaattttacattcttagtatcattcgatagcccagctttttctctattagcctgccaaattaaaaaaattggtcatctttagaaaaagttgtatgaaaataagtactatttctaccataacttagtttaaatttgataattttgtttgaaattttgcaaacaaaatagagaaaaagcttagctatcgaatggtaccaagaatgtaaaatttggttgcttttaagcaaagttataccatgtttagtgaaaaaaattgctggcggattttacgaacgcgccccctaacccgcataatgtgctaatgggtggcgttatgaaaaattatcactgatcagctggtgatgtccacactgatcgggctgtacattggcagtgagctgaacaactcgctgatcaacaacggcgtgatcactttccgaggcgacttctacggcctgtaccatatcatcgatgttacagtacgcctgttcatttgggtcgtttgttttacggtatctttttttaattttaattctttcatttttccgttttccaatttgccaaaggttttcgtcactttgctgttgtacaaccaacgctgctacgcttttacgcggctgcccaacaaacattcgctcgtccagcgctaccaattcgccgaaaatgtccgttcgagtcgccaactgttggccattggcaccatcgttttcgtttggtaattgcaaaagggcctttttaattacccaatccattttttcgcttcagcaatttgctgttcgattttgttatgctgcgaattgcctacaacaaagaccatttcaacgtcgaatattcacaggcatttgactttgtgctcgccgttggccttaaccttattccgatggcggccatttggtgacattaattaataattagtttacaaattgatgtaatttatttaattattcccagtttccacgactcaatgcgtcgcgctgcgagtgcgcactttcggcgttttttgcgcttcgtcgggccaaaaaatggcctcggcagtcgcactgcgacatccccgcggtcgccggtgtcccattgcgaaagtccgactttcattttggacgcaaaacgcgcaaaacagcggaaaaaggcaccaaaggcattgctaagtgggagaaagctgattttcaacagagcggaggagcaaaatgtgagcaataaataaaacaattaaagcaattaataaataataattaattattgatttaatgagtgggcctttaattgaagaaaatttagttgaacaatttaaatgcttaagcaaaaaccgattaaataatttgaccacccaaaactgaagatgaaaacaatggaatttcaacagaaacccaaacaacatattgacaatgagtttaggtttattttgacgaactgcgcaagagttggtcaacgcgtgggcagaaacagcgacgaaacaccgccgaagggaatgccttccgcggaacggacg

SEQ ID NO: 7218 - DNA, 997 bp, Heterodera glycines
cctccctttggacctccgctggtgttttgcattccctgttcttcgatttgctgcttcagctgctcaatttcctcgttcagtgcgttcagtgtttccgtctgactgttaatggtcccactgctctctctgggaataatttttaattttttttttgaaaggccaaattaaacaattaaacagcgaaaaagcgtgcctgtactgctcggtgatggcggccaattcgttttgccgattgcggtacaacagaagtaaattgccgaactgttcctgtcaaatttggacatttatagaaaatgaaaaaaccaatacaaagggggctttagatcggatcattattaatcataatttgtttaaaccaaccatttagccattaattaccccccccccccctccaaaagaataaatatgccaaaagcacagacattcaaatggctttcgcgcgtcctaatgcgttccatcgcctggccaatctcttcgcccgtccgtgccatgaacggcttcagctgcgcgtactgctcgcgcagttcgcactccatccgctgcatttgctcagtgtgcatgcgccaatccctcagattggcgcgcaccgttactttgagctgcggcgtcacccgcttcaattcgtcctccattttggccgagtcggcgacggaagtgcgcaacacatccattagaggaacagtctaaacaaaagggcaacaattaaaaatgatctttcgaattacccaccccaatctgcgcctctccagaagaagtgccgtcggcagagactccaaatggcatttggttttcgtcaatttcttcggccggctcgtcaatgtcctcagccatatccacttcgtccaaaaactaaaaattcaattttgattttgtgaaattgaccggctggctaattaatttttgttttttgctactattttccccacttgttcggctgtcaattccgcctcgtccgcttagtcttggccttcattttgttccgccagatcgtcttctc

SEQ ID NO: 7219 - DNA, 991 bp, Heterodera glycines
aaataattacctaattcattaatcgaaactgtgcaccatatacccattgccagacagattgattgatcaatcggcatcttttctaaccaaataacccatggtagtctgccaatgaagaaggtttcgttactccatccgcatttgtcattaacgacgttttaaattgtctaaatttaagcaaacaaaacgagctggtttcagttacgctgttgacactactttttaataatttgatatgaaacttagttattctaattaaaaagtaaaattattattaattgtataaaggataaaagcattgatcgtaaatgaccaccatcattgtgctgtaaaattcagatttaatgagtggtgagatagacaggaaatttaaaacggcaaaatgctgaccccaaattggataaaaacagacgaaataaaataatttatagatttatataatcaaaaaattataggcatgaaatttaaaacggcaaaatgctgaccccaaattggataaaaacagacgaaataaaataatttatagatttatataatcaaaaaattaatttggtaagatgtccggtcgatttttcagtagaagaattgaaaaactgaatgaaaaaaacagaagaagaaaaaccgaaaattttctcagtcggtattggattaaagaaccgaaaaaattaggcctaaaatcacgaccaaaaaagtcgatttcggatacaattaaatttgattttattatttgcaattaaacttattaggacgcggatttatataccttgtagagaaaaaaaaattctcaaaagttggtttaatttttcgaaaatcttaaaataattaaattgattaacctcccgctaaaacaatcaaaaatgaaaatctcgcatgttgggtagtggtgtcaaaagacgcagaatttaagaatataaggaaatccttagttttttttttgtattttaagaactattcgaactatattcaaaaactgacaaaaatcgcactttct

SEQ ID NO: 7220 - DNA, 3455 bp, Heterodera glycines
  misc_feature (21)..(21): n is a, c, g, or t
tggcgcccagttggcggtgcncagttaagctgccgcctagttggcgtcacccagtcggcgtcgctcagttggcggcgcccagtcgggcccccaccgcgaattgtcggccggaagtgccctaaaagggaggcttgttcttctgcagttctgctggactctttgttttctttcagttgtgcctttgcttaagttccaggcgtggagcgcggccgcgactgcgacaaatgaagcagcgatggacgatcgcaggatttttgcgcaatctgcgaccgtgatctgcggctttttggaaagctttttttaatttaaatgaatattaatttatataaaggtctcgtaaatactttttttttaaaagcaacgagattttaattaattttttaattgaatgtagtgaaaaagggggtacttttcggttttggggcctagatttgaattagaaaaacaccaaaggacgcacagatttatatatataatagggttgcacccccgaccccgccccgaccccgaaccccgacatttttggccatttttcggggttaaccccgacccgaaccccgacgcttccaaccccgacaaccccgaaccccgacccttaaccccgacttggggtcggggttaaatatacacccctaagaatggcatttttgtgagagaaagtcaagaaaatttaaacaagttttgaattttgaaccattttgccaaatttttattaaataaagaaaatttgctttcaattatgacatatattgtggtgtattggttagtgcatcacactgacattactgtctttcataagttcgataaccattgacgttctcattttaaatttatttttttgtgattaatactagagttctggtacggaccggatccgtatacggatttttacggatccgtagtccgtattttttgggccgatacggatttttacggactacggatttttagtccgtaatccgtatgggtgcctagtccgtactcttggtccttatccgtattttctcaaaataccgatctctaattaatacattttttaaacaaaattatcaataaataaaaatagaccattcttggcataattgttaacagattaaacccaaattttcaaaaaatttttactttcgttgaaatttaaaattcaattttcatgactaaataaatcatgaaaacaatatatttcaaaatattgacaaaatatcgaaacaattaaatttcaaaattcgcttggccgagtccaaaaattcgtaaatcttattaaaaaaattggctcaaaatcgaaaatattcagcactttttgggcaaaatctgttaacagacccatgtaaattttcaaaaattttcccggcggcgcctatcggcaccgccggacccctttctcctgaaaagcctttagaaaaagcgcgccgagaaaaaaagatggtttgaaaacgaaaaaagtaatcagaaatttttgatcattttttgaataagattcacttttttcaaattgccggatccgaaaccggtttccggattgggaaaaatttaaattttcacatgttaatatttgtaaaaaccggcaaaatttcatttattaatatagaaattcgatgcaccagaaatgtcgccgccaaaaagacataatgttgccgacaaaataaaaaattttaaaattttcaagatattaaagcatacaaaaatatttatgataaaaaataaataaataaatataaacaaataaaactttattatggaaattataaaaaattttgactatatggcataaggtaaaaatttaaaaaccccgaaccccgaccccgacccgaacaatttggtcgaccccgaccccgaacgattttgttaaccccgaccccgaccccgaacttgctgaccccgacaaccccgaaccccgacttttctaaccccgacgttcgggggtgcaaccctagttttttaaatggggattttgaaaattaccgtgaatataaaagtcaatgagtataatttttagaaaatggcgaaacgtcatagaaccgaaaagaaagagggagaagaaacagaagaaagggaagagaaagagaacaaagaaaaggggaaagagaaagagacagaaaatgaacaggaaatgagggaacttggccaaatggaggtcataaattaattaataaagaaaagtcaggaatttgaaaattcaggatcagatttcgggtgggagccagaccgggtcggattttactaataaaaccttgtttttcaagatcctgatccaggtcccaaacttttgaccctgaccacgatcagtttctaaaaatgcctaaaaaatttaattcgaaaaaacaaaattattgaggcgtcattattagtgctcgactttttgaaaaaagactgggcctgggtttgttgggcctgagcctggcttgcgtggacaaaatttcggaaaaacaaggtccaggagaaacccaggttgccgaaaaaggcccggaccttgcttgacctggatctaggaaaatccagacttggacccaattccaggtcgagctctatcaactttattatagttaaactaagtgtacttgtcaaaaatatcttgagactcccggtaaaattatcaaatagcctcagcactttagcttaattattttctttagcatccgttgccgaattatttgttgccagaagacaaaatcccggagtataagctgcacaaatgcacacagtgtttatgttcattttattgggccaaatcacttcaaaaacactcatgcaaaggccaacagacggagaaagggacagaagaagaaaaggaagcggtgatcagtgattgattgaaaatgaatttataataatttaaatggattaattaaatccgaaatttcagaaacaaactgttactgatgctaataacccgggagagcagaaggaggcaagtcaatccgatgcaaaagcattgggtgaaaaacagcagaactgttatgatgaggtaaatgggttttccagatctgggattttccttatctgctaaaagtctgtaagaatttgcataaaattagggtttgctgatttttttgctttttgaaaaactttacctgacgctgtctttttttatgaccaactgaaacatgatcagcgtcagacacatggacaagctataaaatatgtaaatagaaggggaaaaatcgaaacccgacccggacttctttcttcgacccaacccgatttttttctccacccgctacaatccaggaagacattatttttaataaaacgttaaattaattgttactttttatttcaaatttaacagaaaaccaaagccaatgctgagaagcaatatgaggtgggtatttaattgaatgagaattaattaactactaattacttccattcatttacaatactcaaatgattattgtaatatttgcataattaattttttaaatttttaatatttctaaattctgttacatggaaaa

SEQ ID NO: 7221 - DNA, 2625 bp, Heterodera glycines
tttaccgcaacattttacacgctttcaattgcatgctcgtttaagatttttcttttttgtatttgcgaataaaatgagggatttttatttacatatttttacatatttcgggatttttctacagatcacataccttcatactttcaaattattttgcgcttttttggtacaacttttcatttttgattattgtgaatgcttttctaagaatttttataaaaaaatcacaataacatttatattttatagtttgttactggctaaaatagcgattttaaaataacttttttttttaaattttgagcaccgatatcgtaactgaaacccctttgtttttagagaatttcaaatgtctttaaagccaaaaaccattagccagcgcatcgagatgatttttgacgacggcgagggcgcggacattcactttttagtaggcgaaggctcagaaaaagaggcaaatgccataaaattgtttccttcaagactatgcttaatttttaagcttattgcagcgcataaagcgcttctcatcccggcgtcggaagtgtttagggcaatgtttcgatttgatcagcaaaattcgaattttggaggcggtgaaaaaagaaaattaatgcaaatataatttaattgtttttatttgaagtggacaacccagtggaagtgcccgacgttgaagcagcagcattcaaagtgatgttgcgcttcatttacacggacggattgagcgcattgaacggagacaatgcaatggcagtgctttacgcaggtaaattttagttgaaaaatattatttaaaaaatatatttaatttgcacattgtttcccggccatttttaggaaataacggatttttcagaatgaaaatgaaataaatcagcgattcgaatatcgatttgaacattacatcattttagagatcgacattttgaaaaaagcctggacctggacctggatttcctggacaaaaatccaggcctggatccaggtccaggtcgatctctaatcattttattttaattcttgtttagcaagaaagtattgcatcgatgcgttggtcgaaccatgtctgcaatttccaattccaactttgcgcaatgtttttctggcttacgccctgaccagtcttcttcaattggaggtgggaaaggcgtaaaataacaattttaattaatttaattggaaagattgtcccgacttcagcttttaataaaattacagtatcttttgaacaatttccctaaattttggatatttatgtccaccttttttgtaatatttcagaatttttggtccactctttcccaaattcgatttcaacctacataaaatttgtatattctctgaactgtttgttcagttaattatttttaggacttcgcccgccgctgcttggcttacatcgataaaaatgcggactctttgatcagatctgatgattttttgcaagttgaccaaaaaacattgtgcgaaattttggagcgtgatcaattgcaaatctgtggagaaatttcaatttggaaagcggtaaatttatacaaatatttatttaaaaaagcaattaaaatatttccattgttttaattaggctctccgttgggctgattgtcagtgcttgcaaaatggccatgaatgttcagcggagaatcgtcgtgccgcccttggccctgcgctcttccaaattcgttttccactctttcagccaacaaaattttccgaacttattggtaaaagttaaattgttaattactcttttgttttgtattggcatttttgttgatttttactgaattattacccaattaatgccaatttgaattttgagcagcacaattaattgccccatattactatttattcattgaattccaccttttttacagttccttccggcattttgacaacggaagaatttgtcggcgtctaccaattctattgccatccgaattttcagtggttacacccgttgaaatttccgcgccatggccgaatttctgatcggcaccacgcgacccttgtgttggacattgagaaattttcggaatttgcacaagaaattgtcgggagtgaacggagcagtgaagcggcgtttgtcagcggaatgccgtggaaaattcgtgcaacgataaaaatggcgaaacaaagcactggaaaatgtttggacatttacctttggtgctgtgccgcttcagtagaagaagaaggaggaggtgagtataatcatcaagggtgtggtccatgtggcccaaaacaatttggaatgtgggatttatctttacctaattttttaaaatccagagggataggcgccgccgagaatttttccagatttatgtgtaatttgtcaatagattttatttttaaaaagaataatgtacatttgtatataatatttatataaaaaaatctttgttatgttttatgtaaatttttgtttccagcggaatcgatctcaaaaattatcgggccgggaattcctcattttttaggtaccggtatatttctcagtcccatatcgtcgggaccaggggtgtgcgaaatttcgtgtcgtttttgtttcgccccttttttcgtcattttttggaatttcgttttcgtccattaaaatttttcgtttcgttttcg

SEQ ID NO: 7222 - DNA, 3688 bp, Heterodera glycines
tcaggcctttgatctgatcaaaaattttttgctggcaaagttgtaggccatagttggggcatttcgcttttggggtccgctaagctctgaaagcaaaagcaaaaaatttcgtaacactgagactggcggcaaagtcggtttttgagccgctggtactcagttggcccttggaccggaaaacctatatttttcccggatgcgcctcaaaaagttgtaagacccttccactactttcagggcgctcccggcctctctgccgggagattttgttcctgcagacgaaactccttttcaatataacatatatagtaaatgggtaaccttcttcaaccgtagtaacattaattttgattgaaatgcagattgctcagccatctcattgtttgtcattatgtttgcatatgtatttacgtctatcctgcctttttgattgtttttggtgcacttcataaataaagagaatcagagcctaccattcactttgacgggcaaaacagaatatcgaattttctaaagaaatcatccaaaactttgagtattgtcaaggggtagtgtttatcttccgggtatttaactcgacttattcattcagcacatgtacattggtttaccaatcgagtagtgtgtagtaaaattaacgaaggagtagagagaaatgaagtcacatagaaattttttcattccgtcttcaaatccactcatttatttgttgctcattaacattttagcgatctcgtagcctaatacacttacaactggatggacaacttgacttcgtataaattcataacgttttacattcctctcccgcactttagcatttatttttttcaattagacattaatatacatcttctaggtagcgctaattgcaggcatgctaaacatatccgcttacttctattgcagttctctctgtttccaactattcatccacagaataatgatcaatttgccaagtgttcagttgaaaagttattgatctagaaatatcgcaaacaggccttatactagtcatacattcctttagtacatcaatgggtactaaaagacgctgccttccttaataatgccttagttcctttgagacatcaaataattccctcctaaacgataccagcgctgtcattaaaattttcaatgtcattacattttttctcattaattgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttaggtataatttacttaattttaatcaatactattgtatttattatttttattatattttaatacaactttaatttaattttaatttaattttttaatttagttttatttatttttatttttatttaacatttattttcttttaattttaatcttatttttatttttattttactttttatttgaattaatttgaattttattttactttatttattattcagttaatttaaaggagttgttcagaacctctatccaataaaggctatttcgccgctcagcacggcataaaaggtactttaaccgtgcaccgtttagcattgtatgatatcctcactattttcaatatttttacttgtttttattgtttatttctttgaaatttctattaatattttacttttgtagtgtttaatgcaatcaaagaacattttaacttgaaatttttaacaaaatgaacttaataaaatattagtagttaattattgtaaaatataatttattaataaataagattaattcatttattaaaatctaaaaataatgataagaatatatgtatacttcatattatatatcattttattaattaatttttcaatataaaatttctttcttccatcattaaaatgtttttgcttagcaataagtaaaaaattccatatatgcacgctacccctctccgcctcccatctgatatgaaattcttaacgcttttttcttaattattattattttttcatttatttccttatttttagctatcatcaccattattattattttactaaatttattttaatatttattttttctacaactcttcatctcttcattaggcttgggttatgacacaagtaccatttgccacccctccagtcgccacatgtcaccacactcctcaaataagttttgggttatacgaccaccatttggcaggttgccaactaaattgttcatgctatgccacactacactaaaatgagtcgccgtatgaccaacattttatgccatccacggtcagtcattagcgcttaaatgaccaccagcgggcgctcagatagcccatgcgggcgcttaggtgacacgtgtgagcgctcaggtggcctggcatcccttccctccccaaaggccacgacagctgatgtccgtccctccaatacgatttgactttaataattatttaattaattaattttatattttttcatttatttttaaatttttatctattattttaattttattttaatttatttaatttacctaattttaatttattttattttatttttaatttaatttgaatttatttaatttaattttttaattaatttattattattattatttatatttttgtgtggtattagagagagcaagagaaaagagagatataagagagagaaaaagaaaaaagaaagagagtgagagagagagtgagataagagagaatgagagagagagagaaaagagagatataagagagaaagaaaaaagagagagagtgagagagagagagataagagagagagtgagagagagaaagaaaaaagagagagagagaaaagagagatataagagagagagaaagaaaaaagaaagagagtgagagagagagtgagataagagagaatgagagagagagagagaaaatagagatataagagagagaaagaaaaaagagagagagtgagagagagagagataagagagagagtgagagagagaaagaaaaaagagagagagaaaagagagatataagagagagagaaagaaaaaagaaagagagtgagagagagagagataagagagagagtgagagagagaaagaaaagaaagatagtgagagagacagaagagatagagagagaatgaatgttagcttttttattcaattattttttaaattataaaaaattttttttaatttatttattttaatttataatttattttattttaatttaatttattttttattaatcaacaaaaaacccttcaataggtttaggttcactcccgcacccatccaataggttttggtttaaaccaataggttttagttttgggattgtttatttatttttattttttattatttatttatttttaatttaatttaattatttaaatttattattaatcaataaaaacccttcaataggtttaggttcactcccgcacccatccaatatgctttggtttaaactaataggctttggtttggaacggtggttttccaagggccaaaaagggggctagtaactactaagtgatcgatcaatttgaattatggaattgttgacgtgctcatagaaattgttatttttagcatggaatt

SEQ ID NO: 7223 - DNA, 1010 bp, Heterodera glycines
  misc_feature (212)..(212): n is a, c, g, or t
  misc_feature (886)..(886): n is a, c, g, or t
  misc_feature (890)..(890): n is a, c, g, or t
  misc_feature (895)..(895): n is a, c, g, or t
  misc_feature (901)..(901): n is a, c, g, or t
  misc_feature (903)..(903): n is a, c, g, or t
  misc_feature (914)..(915): n is a, c, g, or t
  misc_feature (918)..(920): n is a, c, g, or t
  misc_feature (944)..(946): n is a, c, g, or t
  misc_feature (951)..(951): n is a, c, g, or t
  misc_feature (958)..(958): n is a, c, g, or t
cactgggactgaaatggcggggctgaaaaaataactctggggctcaaatggctgcgctgtaaaaataactctggggctcaaatggttgcactgtaaaaaataactctggggctcaaatggcatacgcgagcgtttaaatggcacacacgcgggcgctcaggtggcatgcgtcccttcccttccctataaggcatgacagctgacgcccatcnttctgcctccctttccttctctaataggatttagccttgggttttatccttcagatgttttttcaattatttacctcttctgggattggatatatttattataggtgttttttaaggcttaaatctggtactgaaatgtccctttcaactgggactgaaatggcggggctgaaaattaagggccaaaatcttggtgagtaactacttaggtgcgaaaattggaacccaataattattcaaaataagtacaaaacatttcgtcaattattattactgccccaaaaagagttttcccagtgacattgtcccggttaattgccattttcaattcattgtcttggatttacaatatttagcccaatttatactccctttccatttactcactttgacttgcgccggcctcagtttttccattataataaaatcgttccgttcaaaatttgtcattttttccaattcttcaattattttattaccaaagaaaatttttttgccgtacttggacgatccacattcgttccatttcatcacatatttttccgggttcattttcactttctaatttaattgtttaagttaattaattttctaaaaattcactcacttttattatttcctccgcttcttcgtccccttctccgatgctccaactttttgtgagcacttctctnatanctttnaccatntnaacttcttcannacnnngaaataagaggtcaacaactccgnnncaatntgaaaanctttaccctatgtagagaaataggcctcccagttccaaaaagatttgcatgt

SEQ ID NO: 7224 - DNA, 1343 bp, Heterodera glycines
ttcgatagccctaacctttctctattagctcatctaaatttcaaaaaattttggtcaagattgagcaaagttatgccaaaagtacacaagcaatcagctttcgaaactgttggacaaatgaaaaaagtgcaaatgtttacgagatatgtatatccctgatgattgatatccgattttggtcaatcggcagtcaggataaaaaaaattactcaccagtcagttcattttaattcgtaaaaagtcaatttttagagtccatctgcagtaagagcaaaatttattgttttcacttcataattggacacggatgagaaaggctttttgacagccaatgattttgaacagttttttcgcatgcaaacagaagccaatgatttttgtcagttgactaaaaatcaactgacaaattggagcaaattttgacaaaaccattttaaatgatttattctaaaattctatggataaatccggtttcaagaattcactaaatgtatcctcaagacatacataacacaaatatacatatgttgtgatcaatgaccattctatgataaaaaagacaattatgagcacgtcaataattccatctttcaatttggttgatcacttctaaacaattgattcattcacttctgctgctgatcacttgggccgggatttacgtcgagaagcctaaaaacacaaacgcaatgacttttaactgtttgcttaagcattcactgacctgtcaccgatttcgtcctcgttgtcaatttggataaaaatttgattccattgattcaagggccgaaaaattcgcaatccaatcgcttcttcttcccattttgtccatttgctcgcatttcgcacaattggacaacggatcagcaaaaaatgttcgttgtggtcatcacttcttttcaatgccaattgttcacgggtcaattcgttggtcagattgaagagcacgacggaatcagcaaaaaaagtgttccaaataaaaataacgacaatgaaattgacgggagatgaagcatcggcaaatgcctaaaatgaggaaaaattggttaataagcgaaacccaaacagggtaaagtgccaaataaatcaatagtaagcaccgctttgatggcttcaatccgcgacatccaattctcaccatccgtgttcatccagcattcgagcatctttggcacattgctttgaagtggagtgaaaagccatttggtcaccgcttgtccatccgatgccgtggcactgtcatcgcatggaaattcgccgaagagattgacggtatatgaactgacaaagcgaagcgatggaaattcgttgagaattgacgggtcgacgaatgacgcaaacgg

SEQ ID NO: 7225 - DNA, 944 bp, Heterodera glycines
gattggtcctcccaagccatcccctcaaatcatttattcggagaagcaaaagcggacagtgttcaatttttaacatttgtgaaatgtgcggcagaaattgcccatttccgagtgatcaacaaaaaacaaaatcaaaagatgcttatgtggatttcaatgttgatcctgggaccaaatttgttggcttttcgcattttgaccaatcgcttggccataaaataaacgaaaatttcaaaaacgaatttttttgccggaaagaaaaattggcaaaagtgtggtgcatcaaattatgcaattaaccttctcatttgccgtgcgcatcatcctttgcataatgtaaccttcgctgaaaattactattttttaatattttggaatcaaattcccaaaaaatacgaatcagaatcggaaacgtgcttttgggcaaaatctttcataaatcccaacgaaatttcaaaattttctccgcctgcacgctcctcaaaaaatttttttcccattcttctgccgtatcaggaagaagagttgagacgtattcaagcagctcaagtagcagcaattcaccttttttgattagtaattttacataaataaataaaattaataaaaacaaataataaattttactttcagtccataaaaggaaatgcagcggaacggatcagctcaataaatttttgctctcttttttaaatgttttgctgataaataagtctaaacaaattctcaactaataagaaaaacctttgaaaaaccgattctgtcatctattttggcccaatcgaaccccgaactccgattcgaacaaaaagtagaagatccatttttgaacaaaattcacattttatacacaaaatcgcttcaattctttttaacaccagatctcgggtttgattgatcgaaatggatgtcaggatggtttttcaacccttaaaccccaaaaa

SEQ ID NO: 7226 - DNA, 2909 bp, Heterodera glycines
gggtttggattcattgaaatggatgtcaggatcctttttccaacccttaaaaccctaaaaagtgattttgtgcaataaacgtgaattttagtgaaaaatgaatttttgagtttttgttcgaatcaggttccgggttcggattgggacaaaataaatgtcagaatcggatttaccgacactgaaaactagagaccggacaagagggtcggtcgaacggtttcggttaaaaaaacgaaaaaaaccgaaatcgaaaaaaccgaagaaaaattttcggtataccgtttcgctttcggtttttttgaatttttttatcttttcccaaaaaaaaacaataaaccatttttatcaatagaaaaagtgatcacctctgagtaaaattgtagagctatttaagctctatcaatggtgtactaaaggcttggaaaatgatagaaaaggcagccaaaaaacatgtgtttgctccttgattcaaaaaaaaacacaacgattagttttagcgatttggtgccttttttggcgttttttcccgaaaaattccattaaaaattcaaaaaaatcggaataatacacccctaagaaatgatctaaaaaaattcagagaatatacctttatgaattgaaaaattttcacaaaaattgttcgccaaaattcattttttttcttgataaaaaattttaggtttaaaaatttccttattgaaaaacattataaaatattgaattatcaataaatcagcaaaatttagtttttggttagtttttacgtgttttgctccctaaaaatcattaattaaaaaatttaaatgccttttttcatgcctttttcgggatttttgtgccttttttcagtgcgattttgcgctttttggtgccttaattgtgagctcaagccataactttagggccggcggtgctgataagagccgccgggaaatctttttgtaattttaatgctatttgttagcagattttgtctaaaaataccaaattttgagattttgggctaattttttaagaaatgatagcttttgggggggggggcgggggggccgataggcgccgccggaggaaaattttaaaaatttttaatgaattttgttaacaaaatggccaactgatttgtccaaaaagtcggtcgattggttcggtttttaaattatttcggtcgaacgggttcgggttaaaaaaccgaaaaaccgaaaatccaaaaatacccgaaaaaaaccgaaaaaaaaaacgacccgggccgatctctactgaaaactcctgaaacaatattacaaaaaaaaaatttcattttttttaaatctccgcataaataaatcaccagtacccaaatttttaaaatttgaaaaaaaataagcaaaaaaatggtttttgggacaaaaaatttattgggtgttgacaatttttgccagcatcagtcccttccttccctaaaatttctttggaaaaattaacttaactagcattcaaaatgtaatgaaaaagttatgcaaataatctaatgaaattccacccaagcaatggaaaatcaaatatggaaaataaatgaatatacgaattgcgaaagagttgggccaggggcacgcggaaagaacattgttcttcaaaatcaaaaaaacgaaatcgaaaaaaatacaacgaatttcttgaaaattttaggtaattcattttgaaacttttttgcaaaatttgttaatttttcatttttcactttctttttcgtttttttgaaagaatttttctttacaggagtaatgatgagaaaatatcgaaaatatctacataaaattttttgaaaggaccaccgacccattcggatccgtaccgaattcagaggaataatggtaagccacccctgtctagagaaaggcaaatcaacctttaaattgataccccgcaaaaagcaataaaaaggttgatttgccattctgtacccctgtcccactctctctccattctctggtctgatcagtgattactcattggaccttctacaaaatgggttttcacttgacaaagtcccattcaatggagtgccattccgccatcgatcaccaaaatttcgccagttatgaaagaagcgtcgtcgctgcacagaaatttcattgcgttgctaatgtcgcgaacagtgcccaaacggcgcaaaacggtcatagaagccaactaaaaaccgtttttcggaaaatttagctgccacccctccctaaattcgaaaccactccctaacataaagctccacttaagcgatgggtgattgaaaaaaagccacgaagccaatatttagaaataacaaaaatttagaaaatgtaaaaacaaaattacaaaaaggcaaaacggacaatgacacaaattttctcggttatttaataagtctttcaatcataattaccaaaatttaacgtaattttactttgctagtaaattttatctagaattaaccaaaatttagaaaatccaaaagattaaaaaactgtcaataaattggttttagattcgtacattaagaatttaacactttattttgccttggattctaaacataatatctgataaattttgatcaaaaaagatttacctgttcatctgatggttgtccaaccttcaggtcgcggtcgagtaaagttttttcaattgggccgggactcaaataaaaaattcttaattttcatattccactttacttggtactgacttgatcgagttgactcgcactttttgtgccccataaatcagtgccaatgtgcgggtccattggtccaaagcggcttttgttgccgaataaaacggtgccaatgcgacagggcgaattgaagccaacgaactgacattcaaaatgacgcctttctgttctatcagtttgggaagacacaacgacgtcagatgaacaatgctgagaatggact

SEQ ID NO: 7227 - DNA, 2182 bp, Heterodera glycines
ttttttgctcgattgatttgaagaaaggagctcaaaaaacgcatttctgcattaaacttttttcatttggacgtcatttttcggcactagaaatcactattttggcatctcgtcacttaaaatagtaaaattaacttttttggcgttttgtcactatttcgacattttttggaaaattccttaacaaaaatgcaataaaaccaaaaaatacacccctaagaatcgatcccaaaaaaatttcaaaaaaatacacccctacgaatcgagctaaaatttttcaaatctactcctatgaaatgaaaaaaatttcctcaaaaatttactttcttggcgccgccgagaaattttttgagagtagcttcccaatttccctatgcgggcaataggcggaggaggtcgacctgaccgaactccgccccattttacatttaaaattaatcaattaaatgttaatttgggattttgttcgcggcacaaaacactaaaaacactgaccttctcaatccgacattgtaaaggtaatccaaattgttcaaatcaaattgttctttagtgccttttagcattacagtcccggcattgtttacctaaacataaggacaatattcaaaaacaaaaattttgaagctcaccaaaatatcaatttgtttgaactttttaatcgttttatcgaaaattgccgttgtcgtttcaaccttttcgatgtctccgtaaacttttagcactttttcgttggacacattggcctctttaatgatcagtgcctcagtttcctttaaaaatgtattaaacattattttcagtcaaattttacacactttcaatcgttctttgtccctcccgtggatcacaacattcgctccttcttttgcaaattcaattgccgcatctcggccaatgcccgaagatgagcctaattaattgggggaagggcagggagaggggcatttggttgagaaatcggtgccaggaaagggattctagtgttgagtgcattttttgttaaatcaaaaattattattcgttaaaatattttgtcaaaaactcctccccaaagttgactatttttaatgaaatttgtttttcccacatgaatgtcaaatgaatttttaatggattacggaaactgattcataatgactttgtttaaaatacccctggtttattgagaaattaggttcggatttaatgagacaattaccagtgattatcacaactttgccaacaaagcggagagcttttaaatggaataagattaaaatttattttaaacatttaattataaaacatacgatcttcagactgagcaaacaaaaagctatttaaaagcataagaagcactaatttgatgttgcccattttaataataatatgaaattaaataaaaattaaataaattattaaaaatttatgcagaaaatgctttaaataataataatacggaattttatatgtaatgaaatactccaaaatttcgcaagcttatgaagcttacagatcattgctaaaattgccctttttcatatgacaaaataaaatcgaatatgatcacactttggcaaaaaatcacaagggaaagggcaatttatgttaataatatttattataattgtccttttaaatgactatttcaaatcaattaaatgctcccacgggaaagacttacgaataaaacctattaatacaaacaaaaataataatatggaatttttcaataatttgtaattttcagacgacagtgttaaacttcgaatgccaaaaaatattaaataaaaaggaaaagtttccgttcgtagttctctcttaaaactttcttccgcactctttccttcttcagactaatttttctcttcctctttctcctccttttttttattttccatttttccttaaaattactttttttcaagtcctccaatttatttttcaaattttccataacattttcaattatgaaattttgattctcaaatgactcttcgtatttttttgccatctcttcaaagttttaatttctttccattttttgttttcccaattttacatagtgccattttcagcattttccactcaatcatctttacctgaatttttaaggtcatgtcctttgattttgacgaatttttatgattttaaaacccaaatgatcgaattttgttgtaagccaaaagaaggcgcgaga

SEQ ID NO: 7228 - DNA, 5489 bp, Heterodera glycines
  misc_feature (3367)..(3367): n is a, c, g, or t
  misc_feature (3413)..(3413): n is a, c, g, or t
atgttggactgacgcaatttgcgcattgtttttggccaaacaatggaacaaaaaagagaaataatgacaacaaattgaaccatttcatttgtgaaaaagcaatcgaagaagaatcactcaatggcacgtcgatcggaagaagaggtggtcgtaaatgaattgaatgcgagaatgaaaaaaggacgaagggtgcgaaatgcgaactttgggtgggacgaagcgaagcgaaggaggaaggaaattgggtgtgaaccggtatttctcgggttcattatttttcttctgacccaactattaattacataataattatggtttaccctttgttttttatttgaaaaatattattaaaaagagtgtaacttttgcatttttttaacaaatcaggcaaaaatcctccaaattccctctcccccctctcccccccccctctctctctctctctccctctctctccgtctctctcacacaaacactttcctctttctctctctctctcttgcttcattgcctctctcactttctctctcgttctttttctctccccctctttttgaaagcattttgtgcgaaaaactcccgctaattcaaatcatttacaaggccggacagataacagtcatcaattaatatatagaatagattgataagcaactactcattctaaattctttattcacacataattcaatgttggaagttgttctggaatatttgccatcgtggattcgcactcttaattcggtgcattacaattgagctcgcttatctgtattcttttttttcagttcatcgattatgagggtcagcgtaagtctgaacgttttttccaggtgttcttatctgttgttctcattgtagacatttacaacttttaggttattttgattgtccacggtgtgcttgggttttttgctggttatctcactcaacagctgtcggtgactatgtacagcgtcggagttggatttctgatctcttgtctgattgtgcttcccccttggccgttttaccgtcagaaccctttgaatgtgtgtcttttgctacagtttacagtaataaattcttttagtggcaaccaaatagtccggtagaggaagacaaagctgcgaatccgtcatcatcatccggcaataagaattcaaaaaagactcgttgagtgtgatcataattcgatacggtttccttgtacactttcttattgttgataaaccgcttctgttgctacggactttttttcatcctaaaagtgctttattgttcatgacatgtctgcttatttatttgattttcttgcttatatttcttattcatagcagacaatgtctaatgttctgttttcgtcagctctaaaatgcttcaaaacttggcaaactcttccttttaaacacttcagttttcctcaaattggctgtttcgggggccgtttattcagctcaaatacgtaggttgaaaaaaaaaatcataaagataaaacttatttttcgcagagaaagttctgatgacgagcctttagacgcagataaaagtggcctcaccatatacaatggagccggagccatggaattttttattcatcacaattcgtagatatgccacttttttagttgtcgtctcctcgaattccgaaggaatggtcaaaagtgccgatcatagcaattaacagacggcctctttttcctggttttatgaaaaaaatcgacgtgatatttcgatttgagactgactattcaacgattacacaaaaatatttagttggtccaaaatgaccagttgatggactccattaaaatggtgtgcgatctcaaaaatccttacgttggaattttcgtgaaaagggacgatgcgtaagtcccatttaaaaatatggagtttgagtttgttttagcaatacatcggatgcagtcaattcgatcgacgagctttaccctgtcggcacattcggcaatgtcgttgaactaaaccgagtccatccgaagaggttggaaatgttcgtcagcgcccatcggcgcattcgactgttggaaaagttggacacactcgacaatgaacaagtcggcagaacacagcggagaaaaaagagggtacaaccgcaacagctgactccaaacagagaagagggcgctaacgggaccgaagaaccgcaaggcgagaagccgcttctctatgcgcgtattgagaatgttgttgagccggtattcaagccggacgattggatgaaagtaaatgcatttatttaagtgacaaaatcatttctcccgtctaggcgaccattgacaccatcataatgaccattcgtgaaattgccagttatagtccgctctttcaacaacaaataatcaatttgctcattccaaaacaaaatgtgacggaagatcccatcgccttatgtgacttagtcggcactattgttgaaacatcgaccgcaacaacccaagacttacaggatttgatggagaaaacggatgtgagagtttcgatatattttagtttaaaacaattttatgttaggtaatggaacgactacggaaagctttggaattgctggagaaggagaagaccattttaagaatgcggaaccaaataaaggaggacgtagagcgaaaagtgaacgaacagcacagaaaagcaatgctttacgaacatgtgaaaatgcgaaatcttttaattaattaaaattaaaatttagctgaaagcaataaaacgggaacttggtatcgaaaaagaggacaaacaagctgttcttgagaagatggaagaacgattagccaacctcaaagttcccgagtacgcaatgaaagtaatcaaagaggagcaagccaaactgtcatttctggaccctcacagcagtgagttcagcatttcaaggtagaaacggttctttcccattaatataattaacattttaaaggaattacttggattggctgaccagtgtgccctgggggaaaacttctgaggaaaacatggacgttcacaaagcacgtcaaattttggaggaagaccattatgggatgaaagatgttaaagagcgcattcttgagtttattgcagtcgggatactcaaacagcagacaaacgggaaaattctctgcttccacgggcctcccggagtgggaaagacgagtattgcaaaatcaatcgcacgtgcacttaacagagaggtgagtcacaattaaaacggaaatggtaaccgttattttatcaatctctgttaatcttctatttaatcatctctatgttgtcttgtcccgacattataatgcgaaaaaggcgtcccgtgtttatcgcaggaaccagggtttcgactggggaggggtaccgcctcaggcaacgactttttttgttgttgcttttcataccattntgaggtaaaccttgaaaaaggtgcaccaaaaaggaaatttttaatntcatcaaacaaatattaatttttaaaaaaaattcgtgtatggggggtcttggaagatacataccccgtgtaccctcctcccctttgggccgtttctggtttatcggaacacaaatatacgggttagctgatgcctcaaaagtttggacacaatttatcctattttctgctaaatccgcagtttacaaaaataccacagattctttcagtactaccgcttttcggttggaggcatgacagacgtcgctgagataaaaggccatcgacgcacttatgttggagcaatgccgggcaaattgattcaatgcctaaagaaagttcaaactgagaatccactggttctcattgatgaagtggacaaaattggcagagaaggtgcaattgttattcaatttttgaacaacttcgtttttagggtaccatggcgatccctcttcagcgttgctcgaagttttggaccccgaacaaaacgcaaattttttggatgtgagttgaaattaatttaacaaatataattttacattcagcatttcttggatgttcctgtagacctttcaaaggttctgtttatatgcaccgctaatgtaactgacacaataccgggtccattaaaagaccgaatggagatgattgaagttgcgggttatgtggctgaagaaaagctggagattgctcgcaaatatttggtcccaaaatgccgtgagaaatggtaagagcttacaccaatatttattttaatctatttcccatttaaattcattttaaagtgctttgcccgacgaaaaattggttataaaagacgatgcaatcgattcgttgataaaatcttattgccgtgaatcgggagtacgaaatttggaaaagcacattgaaaaagtaatttaatatggcgaacatagaagccctttaaaaattgttttagattttcagaaagagcgcttatcaattagtaagcggagaaggcgcccaaacacaaatactgccaattgtggtggagaacagcaacctcaagaaatatgttgggcgagaaaagttcacttctgaccggttgtacccgacaacgccggtcggtgtagtaatgggattggcgtggacagcgatgggtatgtcgaattgatttctgaataagtaatattgcaagctctttctcgtttataggaggctcggcgctttatgtcgaggcgactcttgcaagacgtttgggcacaccttcaacagatgttcagcaagtcactgatgagaaatcccatcagaaaacagtgaccggcaatttggaagtgaccggacacctcggcgatgtgatgaaggtacttggaacatttaggaacccccggtctattattttaaaggaatcaatgcgtactgcttacactgttgcgaaaaatgtactactgagaaaggacccgcaaaacgaatttcttgaaaaagcgtatatccatcttcacctgcccgaggttgacctgtcgtctcctttcgttgacccattcaaatgttttcccttagggcgctgtgccgaaggatggcccttctgccggctgcactgttgtcagtgcccttatgtcgctggcacttgaccgtcccgtggcccagcagacagcgatgaccggggaagtttcgctgacggggaagattttgccggttggcggcataaaagagaaaataatcgcagcaaaacgggcaggagtgggacggattatactgcccagcgaaaacaggaaggacttcgaagatttggctgactttatcaagaaagatgtagatgcccatttcgtttctcattacgatgagatatatgaacttgttttccaatgacagctttcttttcggttgttgttttgttttattttgaattttcttatttctttcaaatttttaattgaataaactcgattgatttatttcttgtttccttttacatttaacttttgttgcttactgattgattatctttgttaaatcctttcttttgtcttcgcttagttttcgaatatgaatttccattacgttgaaccgtccatggatgacttagaaaatgatgaggaactacttgctgaactacgggccctggagagtgatg

SEQ ID NO: 7229 - DNA, 2452 bp, Heterodera glycines
tgttcgttcgattaggtatttaatttcttaagagtgcacttatctctgtattgccatggctcacaacggttgacttcccctgcatttccgttcgtccgttctttacgtcaaaaatcattaattttttttttcgttgcatgtgcctggtggtgtctgagtgggtgtttttgttaacataacgttcattttgtacttcctcgttctaaaagataaagatggacaaattttggcgctatttgcaaatagaccgattttgaattttattaaaaccaaaggggaggcctttttgttttgcaaaatttttttgataatttgtgaaaaactttcccgcgggttttggtggtccctgatcacgaatctgacatctattttgactaatttctcatgattatggccccgagaacctaccgggactatgtatttgcaaatagcgccgaaattttaatgccttttttattgataaaataatggttaaaaatactcaatttgtaaataaaatataatttttaccctcttttattcatccaatttactttgaccttgggctccatttttccacgacttatcgcttcgatttcgttctcggtattgtacagtcattccttccgttagtcataagccaagaccaatcagcagatttctcatatgtttgggtggcgaatatcgaagataaaatctctcctccccttcccaattacagcgaaaatgtcgctgctgagtgttctcccgacgcgtcacttaagggcagttctgagtaacaacaaacaatttcttctttctcgatatttttccgtctcaaatttggcaatgcaaaaaattcgagtcgccaatccggtggtggatttggatggagacgaaatgacgaggataatttgggctggcatcaaagagaaggttaccgagagaatgaaacattccttaaattacatattttgaatttcctttttctttgactttctccatttagctgatcctgccctatctcgacatcgacatcaaatattacgacttgagcatcgaaaatcgagacgccactgacgatgaagtgacagtggacgcagcggaagccatcaaaaaatacaatgtgggcataaaatgtgcgacaattacggcggacgaggcgcgcgtgaaagaatttggccttaaaaaaatgtggttgagtccgaacggaacaatccgaaacattctcggggggacaggtgaggaaaagctttggaaatataataaagcattttaaatgctaattggaaacaacgaataaaaaatacgctcaaatgtttcagtgttccgtgagccgatcatttgcaagaacattccccgagttgtgcccgggtggaagaaggaaattgtgatcggacgccacgcatttggtgaccaatacaaagcgacggatattgtggtgccgaaggggtccaaatttgaaataaacatcattaaaagtgacggacaagttgagaggcactcggtgttcaactttgccgatacgggcggtattataatgggcatgtgagtggggggaaaatggagaaaatttattttagcgattaggggcagaagcttgcgtttattttctttaaaaatttacaaattaaggtataacacggacgactccatccgtggctttgcccattcctgcttccaatacgccctcaaaaagcaatttcctcttttcttgagcaccaaaaacacaattttgaagcgctacgatggccgcttcaaagacattttccaggaaattttcgacaggtattcctatcaactgtaaaatgcttctttaatttgtagtagcattaaaaaatttccagggaatacaaatccaaattcgaagcgctgggaatttactacgaacaccgactcatcgacgatatggtcgcgcaaatgttgaaaagtgagggtggctttgtttgggcctgcaaaaactacgacggtgacgtccaaagtgacgtggtggcccaggggtacgggtcattgggccttatgacatgtgagcgaattggcaaaaaataaattacattgttttactaagcaaaattttttagctgttttaatgtgtccggacggaaaaactatcgaagccgaggctgcacatggaactgttacgcgtcacttccgcgaacaccaaaaggtgaggaaaatgcttttctggcaacaaattgtattttcaatattcacatttttagggtaatccaacgtccacaaatccagtggcttcaattttcgcttggacccgcgggttggagcatcgcggtgttttggacggaaacgacgcccttgtgaagtgggttttgttgtttcaaattttcaaacaaaaatttgaactttcgcgtgttatctataaatttgatgactgaccaaaaaaaaaacacaaagatacgctcgtactttggagaacgcttgtgggccactatagggtagacaaaatgaccaaagacctggccatttgcatctacgg

SEQ ID NO: 7230 - DNA, 3295 bp, Heterodera glycines
  misc_feature (3246)..(3247): n is a, c, g, or t
  misc_feature (3255)..(3255): n is a, c, g, or t
ctatgaaaatcatcatcatttttggcccgcttaattactccattaaattctttttcgtaagaaagaagaaattttcgtttcgatgacatttatttttttgtataaaattatctaaaggaaattaattaaaatttattgcaaaatgagaatttttcgaaaaaatgttaaagatttgaagaaaaagttcgaacactttgccaaatatacctaaatttttcaaaaaatcatgagtttttgttagagcccggagcaggacgggatcatgcgcaagattttgcaggatcccagtccgcaatcctgcattttttggaaaatgcaggattgcaggatttgcaggattaatccggccggatccggtcgtgcaaaaatttttgaattacaatcctgtaacaggattcgcaaatttgaaatttccgggctctagtttttgtcacttttttatcaaaaggccacaaaaatcctcaaatttctcaaaagaccataaaaatccacaaatcctcattttcaaaaaaatcctctttgaccctctaaaagaacacaaaatgaggaaaaatcctcagatatcgaaacctgcgctaatcacgaatctgagctaatatttgcaatatcaatggttttgaccatgtttttatcataaagcatcgtaaaaaataatccgcagccaagcggattcgaactccaggtccccgtctcatatgacgtctaaataaaattttttaatttatttttcgtcgggaccgcaattctgcagtatttcccttttttttgtccttccaagatttcgatgattttaaaaattaaatggcaatttggccaagactcttaaatccaaccctcgggttggaggttcgaactctagagaatggaccgctttaaataatgctaacatgcccacttaacagattccatttataaaccaaaatgcgagacacttcaaaggaaatttttgtgcgccaccaatccgagctgaagtatgtcttaaatattggatgaatggtttatccccctgccattaaaagtctcttcgccgtcacacatttcgccgtacaaaatggactgatgctaatagtgcaaaatgggcaacagttgagccacattcggttgcagaacggacggcggacaagtgggacaaaagaaaacaatgcgaccaaaaacattgcatggaataatgacccttttcagacttaaaattgcccatcgattcgatggaccgcgtcgctttccttcacatggaccccggcggacagcacgcgttggtcagcaccggagctggcgacaatttctacgttcacatgcgcagtgcgtctgtaaaatcactccgacgattgaaagtgggcacggggggtaaaggagtaattggcactttggcttaaattaaaaaaagacagggccatgtgataagcgcaattggatggaactccgaattctgcaaagacaatgagacgggtttcattgttctgggcacagccaaaggtggtggtattgttagtggtagatactgttttttattgttatcggtagatactgtttttatgtatttcgggtattttttgattttttccccgtttgggcaccgtctcattttgtccaataatacatggtaatgcctccgtccggatcgttacttttaccatcccatctggactaaatatgattgttttcgaacttctccaatttgacattgttttccatttcccctaatttagggaatttgtatgagacaaatatcaccgcagcctccaccaccacccttcccgtgccttatctgaatttgctgtccagctcattagtcgacgacaaagaattggccatctccggcctttgcctacgccaatttcccgagggggacgacgaacagtgagttttctggaacaatttttaatttcaaattcggcttctacaaacagtccaagagctttatttctgccgatcatatttctattacttctcagttttcttctgttggtctgcgtgcccaatcgtctgtactgcttggccggcccgccaaatatggctgctgctgctcaaccgttggcaccgctcccaggccaacaaatggtgagcacagtgtggagcagtgcgttggtggaacagtcaatgcccgagcgggaggccgtccttcaagcgttgttcaattggaacggtacggaaatttgttcgtgaattacggcctttttgttccctttgaagctgaccaccggcctcgttacctttgcatggaggctggggttgaggaacgtttgcccagcacattggccattcagccgatgaactgttcggatgacagcgacgggtgccggttcaggtaattgttatttataattttccagataatagattttaatggcacctttttttcttgcattaggtttggttggcttagttccagcggaatttgcattggcaacgtgggcacgggaagagcgcggaagcgcgcgttgcccgacgcgtacgacatgattgacattggcaccaaaactttaaagtgagcgatgaacgctgggaaagaaatatacaatgccatatcgagaattgatttgttaaggcatcggctttcggaaggccgagtcgattatccgctggacattgtgctcaccgaacaccatttcttgcgtcttttttccagtcgattgaacgcgatttcgctgttggatgaaacaaccacgttcgaagatatttttatggtatgattaaatgtatcaaaattggcacaatttctatccctccagggcattccaaaagtgatcggaatgtgccgtgacgcctcctcccatttggtttgggttggcaccgagtcgtccatgttttcatatcggcccaatgacgagacgaggcattcttggagaaactaaagaagttaacaaattgctttagatatgtttggcggcactatttggccaaaggcgaattttccaaggcgaaaaaagtggccaatcaaatggaagacaaacagccatttcagctgatcattaaaagggaggcggagaaatttttgactgacaaaaagtaaaagaaaataatgtaaaatttaaattttaagtttttttgcgcagttttgttgctgcggctgagtcgttggcccaatccgacaaacccttcgaaagggtggtgctccatttgcttaccgctggcaccagtgcaaggaatggactgaagcgttttttggaactgaaacttggccaaattccaatgccggcacgtgccaatgaggtggccaatttgctgctatttcaccttttaatattnngcagatanaccgttttttacatttgaggataaatgcgtcgcgatttgt

SEQ ID NO: 7231 - DNA, 1525 bp, Heterodera glycines
  misc_feature (1487)..(1487): n is a, c, g, or t
agccaatggtgtcaaaggtgttgctgatgcgtggcgcctaccgcgaggcgctcgacattctgacgcgtgagactcgcttcgccgaactgttgtacgcacacgcggcacagcttgcgttggccgagccgcgtgcgctcgttgacgctttgttggcactacagcagcaacatgcgtcgttggacgtgttgcaattgttgcccgccttccaacaatgcctggacaaacgcctgccggaccggcaagcgttggtgtgtttgttgagacggcgtttctcagcttccacgctttttaggcggatgcgattttcgtttttttggattatttccctctccaaaatgcgtctccaccatttgtcaacttcaccattcatttgtacgccgtttttcggccccaaaaactgctcgtccatctgcaaaagtgcgccggcgagtcttcttcccaaccaccgtccgctttgactgcgagacgcactcacaatcattgtcatttcgatgttgcccaagcacttcgtatttgcacagaaaatggcaggcatatggcgtttccatcctattttaccattttgggcattacagcattgcacgagtgttctgtgtttttgctttgcctcgagcgtctttacgaggaagcgacgcgtttggcgttgcgtcacgttggcctcgcgtgtgccaaagagtgcgcgcgacgtttggacgccgactcagccgcagcagacgcattcgccccaatcgggcatttggcgtcctttcatgggccggtggatgaggaggattttggagaaagtggcgatgctggtgtacaaaaaatggaacaacagcagcagcaagtgcaggagatgcgcaagcgagtttggatggaaattggtgagcaaatgtcggaaaaaatatattgaccaatatgctttgcaattccattcaaatttgagttccttttttttgttagcaaagagtgtaattgcgagcggtgcgcctgtcgagcaatgtttggcactgctgaaagagtcgcggggtgccgtgcgcgtgcaagacgttttggcacattttccagaatttcacaccatcgaacacttacgggagcccatctgcgaatgcctcaagcaatacaccaaccaaattgaggttgtgttttactggaccgaatgctgctggataaattggatttataacaaaattccagcaccttcaaagtgaaattagggatgtcactgcgatggcggaggaattgcgcaccgaaactgcgaaagcgcatgccaagtgaaaactcgcttatatgaaaattcctaaatgacaatatatttattgtttttttagctttatggtcgtcagaaccagcgattgttgtgcgatgtgccgtggcattctgttgacaaaaccctttattgcttttgtgtgtcgtcatttcttccacagaaactgtttggaggacaaagtgaaggtgagtcgcgaagcattttaaaatttgttgcgaaaattgtaattccttcccanagtcttcttccactgagtttggccgattggagcgcgag

SEQ ID NO: 7232 - DNA, 3369 bp, Heterodera glycines
cttcataattttttaattataacttttattttttgattaaggcccaattctttaatctattcataaaatcaattttgttttcgcaaataattaagaaatcaaattaaatttatgggaggacaatgcccaaaaatcagaaaatttaaattttactattattttttaaatatcatttaaaattttgattaggtgtgatggggacaacgattgtggcgacaattcggatgagaccaatgatcagtgcaaagttgcggtttgtgagccaccgttgcgcttccgatgtgcacactcccgtctctgtctgaacattttgcagctctgcaacgggtaaaaaacaaattaatttaattgcaatttaaattgttaaatgttacttaattattatattaatgtatggactacttaattaatgtgtgtttaaccattattaagtgattggttaatgttaattaccattgacaagtggctaattaacagacaatatttccctactaccactctgttaagtaccctaattaacaataactactatgcttaattacctttgattagtactaaattggtgataaatttcagctttaatgactgtggtgaacacgacttctccgatgaacatctatgtaagtttccaaaatttaatcgacttttcaagaaaaaagaatttcatttgtatatttaaaaaaaattaatttaaattaattttttccctaatttagcaatgtgttcatccttttctgagtatggcgattgctctacggacgaattcaaatgctccaatggcaaatgcatcaatgccacacttgcttgtgatcggaaagatggtgagatgagcggtgatcagaatttttgatttttgaaatttcggagaaaattttgtccatcaaaaccaattctttctaaattcactcatactctcccctcttccgtgccaaaaagcaatttttttttaaatttccgtttaaatgaaatttttttttttttttttttgatttcctcattcaaactcgtgagtcaaattttctgatcacagattgcggcgatgccaccgatgagattggctgcgcgaaaaacaacggcaaaagttgccattccaagggggacaacggcgggtgcaagcacttgtgcactgatgtgcaggacggctactattgccattgtcgggacgggttcagaccagacccggccaacccgttcgactgtgtggtaaaaaaaaaattggaaaatttgattactgctcaagaccgaaatttcccgtgattcgagatcaagaaaaaaagagacttttctcggctcagggctcgagaaaatcaaaaaaaaaaacacaaaatcaattcaaaaaataattattttttattaaatttccaaaactggtctctgtttattgaaatatatgttcatttttgaatacatacgtcgtaccaaaataaaaatcaatttttgcgaaaaacggacaattattgattgagctaataatagccgattcctaaggacgtcctttgtgaacccaaggacggacgaatggaaatttggataaaaattcacaaaatatttttttcaaggacattgatgagtgccaaggcaacaacacatgcacacagcaatgcctgaacaccaagggctcatatctgtgcaaatgtgtggacgactacacatcaggtacagttgcgccttttctttgttcaataatttatttttgtcggtaaaattcaataatttatttttgtcggtaaaaataacgaaattttatcggcattttttttacccctaattttttgttaataaaatgtcgacaattttttcttttcaaaatccgaataatttttatttaaaaataacttcctagaatgaaaattcaagaaatgaatataaaattcttgaaaaacctggaacgagaaaaatgttggcattcgggtcaataggccaagaatgttcaggtcgggatccgggacgcggaccgagaaaaatgccgggattcagatcaacctggcaaagctcttgattggatgtctaaagacaaatcgctaaatctctccctgattttgattcaattctgatcaggcgtcgtgatcggtgcaatggcgggcaaagattgtcgcgcaaatggcgagccggcattggtgatggtggccgccaacaacaaggtgatgcagttgaatttggtcggcgcccggggccgcgtcaacgccgctgcggagtccgcggacgtacaggcggacattgccgctgtggagttcgacccgcgtcgggaacagatgttttgggtatggttttcttgagcattaattaatttgtttatttaacggtcattgaatgatttatttgccggtaatcagtagggaatagaattacatggaaatccatatttttttcctggactgtgggaggcctgaaacgcacgaaaaacatgtttttagcttggtttgaagcttctaggaaggatttctatatccatattttccatatttttccatatttcgcgatttatgtccatatttccatatttttccatattttggcattttggtccatattttatgtccatattttggcatttttcaaaaaaacctctattagaacggcccccagcagctaaattagcctttttgagcccaaaacccgaaaaatttttcaaaaaatcattttttcgccaaaatttctcgagaatattgaataaatttaaattttcttaaaaattaataaattatgtcaaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaattttgcactcaattttgaaaaatttatgtccatattttgacatttttgccatttatgtccatatttcgcgatttttgccattttatgtccatattttgcgatttttggtccatattttatggccatatttcgcgattttatatccatataattacactccctagtaatcagtttaattgactattagttggttaggtcgctattaattgccagtttaattgatgttatgtttttagattgatgcctaccaaaagaaggtgttccgttcggcattgccaaagggcaatcagtcggtaagggcataacgggcaaaatttggcattttaatttgtgccaaattttaaatactcatcttttttttttgccagcacgaaggccagaaactgcaaattcatttgatgacaatgtga

SEQ ID NO: 7233 - DNA, 2295 bp, Heterodera glycines
ctatttttacaagttttttgccttaaaacggccaaaatttggtcatttttagtgaaaaagtaagtgcagttgttacccagcagtggaaaaaaagttattggttaaatagcaaaaaaaaaaaaaaaaggttttcaggttcgggtcccccccccccccgaaaaaattgttttagatacgcccctgcggtcaaccaatggcacttcgtacaattttttgttttaaattttagaagaatgttttgctttttttttaaatcacattttgattaattaaaaatttttctacggacttccataacatcacaattcgaatgccatacataaaattgcctataatattccatggccattaattttaaaaattgtttaaaaatttttaaaaaattaaacccaaaaattatttgaattgttgtattaattcacaagaaaaaaaagtccgcgttacttagaggtaatcaattctttctctaactgtcagttctcttcttttcccacactctttcaccctctcactatactcttctgtaggaggggcaaaaaataaccaaaacatttggctatttccatcactgattttttttttttgttgcttttgtttttaaaaaagaatttccatccaaaacctttgggttggaattttaaaatattttcttctggcgtaattgctaaaaatgccaaatttccaattaggtattttatgtaaaaatttaaaaattaaatttgaattccaaatactcccataattgtttttttccccaaaaggtatgcccgtgacatgttgcaggccgaaagtgcatgtgcccgcgcacaatgcacccatttgtgtgctgaattgccggccagcggtttccgttgcatgtgcccggacaatgtgacacaatttgatgacggctcatgtggcaccgttcgaattgaggagttgccggtgaaaaattggaatttttttttaggattttccaaatttttgtttgggtttgcgtccggggttcgaacctggcccgaaacggaaatccatgttctttgatttacgacccagaaaacggcacagattttgacgatttttaggggtcggggtcacttcggcgcggaccatttcggcgccgcaaattttgaaatgctataacttttttatttgtcagttagctttagccaatctggcatcatttgaaagctctatgtgtgctctatatttacatgtaaaaatagaaatgaatgattcaaaaataaaaaagttatgccacgcggcgccgaaaaagccaagaaaaagttaatttttgaggttttttggccataacttttttgtaaactgacgaaattttttgaaattttacaggctaatagagaatctgaagagctatcgaatgataacaaaaattttttaatttggttgatcaggaaaaaagttgttagcaacggcgccgaaaaggccggcgccagatagaacagaaaaataaccctgtcacattttgcagcaaaacgccaaaatttctctattttcaaattttatttgtgtttatgcagtcagtttatgtttaacaaaaaaatcgtaagactcaaaaaattacccaaaaatttttgtctaattaaataaccgtgtcttaattgcattaacaaatacctattttcttccagccacccaagcaatgttcgtgccaaaatggtggcatttgcaccgccgccggcacatgcaaatgcggtgactttgagggcgaattttgccaaaaggtgattgattggttgtggttggtggcagttttaaatcatttggaatcatctcatcattcatgcaattgtttcttttttttttttctttcagcaatcgtcagtgactcgtcaacttattggacgacttggtaattaattaaaattataaaattttggtagtcttggtaaacaattttcaaaataaaaaatatttaaataaaaatcagagggaaataattaatttttaagtataaatttaacctcaaattctttacaatttaccccaaaacgactattttcaaaaacttttagcctaattcaagaaatttcgtttttgaagtcagaattccttggcgcctaaaagtttcggaagaagaaatttctgtgttcgaatttctgggccaataaaactttcgggagtcggaatttcgcgccatccttgggtgcctacctatttcgcattcattattattttttcaccaatttttcaccgttttttaaggcaacggtgcctactacgcgttgctgttgatgttctccatgctggtgtgcctgggcatgctcaccgtcattgtgctgttgatgtacaaaa

SEQ ID NO: 7234 - DNA, 1355 bp, Heterodera glycines
  misc_feature (1278)..(1278): n is a, c, g, or t
tttttgaaaatttttgcaaagaatttgataataatatatttgtactgtatgagctaaatggttggtatgggcagatggggctaaaggaacattgcgagaaatgctccccctaattagcagaaaaatctcaaaaaatatctctttttaaatttagaaatttcggaagtgacattttactctgaaaaatttgttattttttttaaatttccgaatacatttttaaaaaaaaaatcaattttatttgttttttttttttggtcaaacgaccgggcgggtgattaactatatacagtactagagtagcagtcaccggtaaataatgttcactttaaaatggtaccagaatacaaaaaccaagttaatgccgttttatactgttgtacatactatttgctatatgagaattaatgattctcgactcataaatcaataaaaatatttctcccttttttctcgggtctcgactcccttggtcctccccattcctcactctccttgcattgttaatttaaaatgccaaaattgcagtcctccggtgggtcaggcgagttgcatcagcaacagcatgatgggccaccgtccaacgagctgctgcacggcctgaacatgaccaccactacgtttgcgaacccggtctatgaccatggggacacgctcagctacgaggaggacaccaccacagttggcgaccggggcagcagcagtggcaccaaatttgagaccattgaaacgggcaaaatgtgagggagatcatacacacaatacagttatacttgatcaaaaatcatagacaaaattgaagaaggttcatgcataatcaatcagcagagctcagatttggaccagagtatttttaacccccaaattcatttctacttttttaaaaataatttaaaaaatcgaaaaaatcaagtagttgatgaaaagaagtcatagataaaatcaatgatttttaaaatccgaattcaggttcgtgatcagcgcattttttaaagcctataaaaaatacctacgaaatttttaacatttttttttcgttgggacaccaattcttgaccattgtctcagaagcatcaattaattttttcataaatcgcgaaaaattggctggtgcattttttgaattccgcccaatggtctgaaattcgaagaaataatttcacattttactttattttcatgaattcttccgatattcaaaatgttctataatatccatttttcagcaacccattgtttgaggagcataacagataaataaatgagtgaagaaggaanttgtgccgtgcgtttcttatgattgtctctctttttttttttgccaaaaattatcatttttattttccaatgtgatc

SEQ ID NO: 7235 - DNA, 1569 bp, Heterodera glycines
  misc_feature (35)..(35): n is a, c, g, or t
acaagacaaattctaccttcggattaggccatttntggctcccctcgatccaaaccccaaagttcgaacacccgcgacatcattggaaagtccaccttttggacggtcaaattgaagtgctgctcaaagtgatttctcacctgaacaattctcaattcgttttcattcattttcacacattgataccgatccaccaatcacgaaactttctcgactcgatgccgagactctcgagcagcgttagcctttcccctcccattccgcggcccttccccactcacttttctcactgcttctctctgctcgttttgcaagtgttgtccgatcagcacattcaaatcctccatgtaaaaaaggcgcaattgatacgtaaaatccacttcgatggcaaatcccgccacacttttcctcgccaaaacggccattgccaacgccaatcgtccgcgtaacggcacatcggtcagttttcgctgcgaatcttaacacgtccatcagctcgccaagatcagtgctccctcggcgaatcatttcggccgctttgttcgccggaatgaatagcaacggatcagccgatgcccagccgatctgatcaatcggttgaaaagcgttgtataaggcgaagagggcgtccgccagcaaaaaataggcatcggcaaagaatcggaggatggggtaaaaggagcgaatgaaagcgtagcgacgcattgcgaaggacggacaaaagtcggagttgggagaggacggagaggggcagggggacttggcctgaatttggagaccgatcaaacgcattaaaaccaatttacaatttccaatcacttcataaaagccgcttctgtcgccgcacattcctttttcatttttatagcagaaattgtcattttcgccaagaattgaggacgaaagtgaaaatgaaagggcgagtaaagtcacaaaaaacagcggaaagttgcagcgaattaccattttatgtaaggttgccagatctgaggatttatcctcattttgtggctttttgagaaattttgaggattttggggaaaatcctcaaaatcttttaaattttgataaattggcataatgtttggcaatttaaagaatttttttaatgaaaatatgctaaaaatatggtcaaaattcttaatttttcccccggcggcgcctatcggcaccgccggaccgtaaaaatcctttatttacatgcaaaaatttgctcaaaatcgcaaaatttgttcatttttcggacaaaatctgttaacaaatcgcattgaaaattacaaaatttttcccggcggcgcctatcggcaccgccggccccccttgcgccccaaaatttttttgggaaaagcgccgcaaaaaaatcaacttcgtttttcatgttcagaatcccaaaaaatgcttatttctaacaaaaaaaaatgctcaaattgatcatggacaatcaaaaatataacatttgaacattttaaacgtgttttgaatatttgtgaaaatgaggctttttggcccaaaatgaggcttttttgcttgccaaatgaggcttttgaaaattttcatctggcaaccctg

SEQ ID NO: 7236 - DNA, 2427 bp, Heterodera glycines
  misc_feature (55)..(55): n is a, c, g, or t
  misc_feature (81)..(81): n is a, c, g, or t
  misc_feature (87)..(87): n is a, c, g, or t
  misc_feature (106)..(106): n is a, c, g, or t
atgcatatttcgcgatttgtatgcatattttcgtgcatatgtgttacattttctntaaaaaatcctctattcaaaatgccncctctntaaatatgtcatttgaccncaaaataccgaaaatttcaaaaaactctataactttctaaaaaattggaaatttatgtcaaaaacaagttaaaatagaaaaattttaggcttttttactcagttttctttaaaataataaattttttagttttgtttgtattcttcttttcttctaaattgatttttaaaccatatttatgtagttattttagagatttttggcttaaatttacgaattttatgaaatttttaaaattttatactcgatttgaaaaaatttatattcatattttgcactttttggtgcatattttagatttttattttttgtttttttgtcttacactattttttaaatttctctaatcatccgccaaatttttttcggggaatttcctcccccgaaagtcaccaaattaaaacaaacgaatttttggaattaatctcaaaacaaaataataaaatcggctaaattagtcaacaattaagagtacgagttgtctatgcttttcttattaattgttgtcatcaattattggtataaatgtacaattatatatatttatttttagtattcggtcattgggatttcttaggcaaattcgcgacgatcgtcgccaaatgccagcaatggcacataaggcaacacatttcccgatttggcatttcgttcattttggcattttgtggtaatacattccctccgcgcaatcattgcctgaatgtacgaagtcagaagatctaaaaaattcggtttaagccaatgcgagagggttaagcattcgaaccgtccattttgtggccaagtgttgtctcaaaaagcaatcggttgcccttttccattgtgatgtgaaaatagctgaaaatttggcaaacatttgaaccaaaggcaattttcataacaaaaaaaaagtttagtgccatccccgataaagtgccattctcgaatctgccttcgatgtttgttagtttttttttaattttacgtattcgccggttgccattgacaaatctgctcgaatacgtaagtgcaaatgtgctgcttggactccgaaccgtagagagatattccgtcactatgaattccaataaaccaagggatatttattttttgattaccgattgattgccaccaataattttgagcccattttcgagtcggccgattgtttcaccaaaaaattaaaaattattttcggaaaaaatgaatgaatgcctcgaaaaaggcggagccaaaagtcggctcagaagaaagtcgtcgaagaaacgccattttggcatcgtcggaacattttggcatttgcaaattggcaccaaattcggcacaaattaacttaacaattttttgatgagtttaaatcgtcgccttcgctttttcttacccttttccactcggccgaattttgcattttcaaaaagtccctaaaaagagaaatttaaatttattttataattttttccatttccattttcatttcgcatttgcttctttcattccctcactttggtattaattgctgcaaaatgtgctgaatgtgcgccagcggcggctctttcccatctttcgtttgtgccctcaaaatcagtgccccaatttgtgccgcctcccttttgccaatgttgtgatagcctcgcaaatacttcgggagttcctgggaatattgttttgctgaattatttggccaattacaattggcctttgcctggtagtaatggaaaatcaagtcttgacgcatgtcttgacccggcacgacatccaaccaaaccttgcgcataaaatgcacctgccaaatgaatgaatgcttttaaaatataaaatccttaaattaaatgctcatcaattaatgcctaatgagtaattattgactaatgatcattaatgccccgccaatatttttatttccatgttttgccttatacgcaaattgcactgcttgttcagctgctcctccgttttgtttcgcccaactctttcgtgcccaacgctgcaatttgtggatgaaatcgaaaaagtgatcgtccggcggaatgcaaacgactgaaaatgcgcaattagcccaagggaatcaattaaaaaaagtaattaagggtaattaaaatttttatttttggtcttgtttattttttgtttgtttttgatgtcctttttttgttccaaaagcacacctttctccccgattttaacaaataggaaaagtccgatcgccgaacggaggccaatcgtttgggcaatgttttcgctcagttccttcgccaccgaccaactctcgacctgaacagaaataaagtcaagaattaatttgaatattgaaaattgcctccacattcacatggcttccg

SEQ ID NO: 7237 - DNA, 2016 bp, Heterodera glycines
tgtctgcctattttcccagcgtcgttggtatgagcaaaaaaaaaaaaaaaggtcgttcgggcgaaagtttttcaaaaatacacccctaagaatcgggcgaagaattttcaaaaatacacccctaagaatcgggcgaagaattttcaaaaatacacccctaagaattgacttttcggatcggtaccccccccccccccccaagcccaaatcctggatacgtccctgggcgccatgttatcagaaattggaagagcgaattgagccctcgtaaaaaactaagacaaatcatagccccgtcccaaggcctattttacgggaaaaagccggaattttagttttttctgcatttatttagggtatgtttcacaatgttgatttgcatctctctcctcaataaattttctaataaattttagtatgttgaagtgcccggcatggctggtcgatttgaagcggaatatatttacgactcgtactgtttttgtttttatccccatttcattttaatttttttcattttcagctctcacttatccgacacggtcaaactgatgggcaaggaatacaaccggaaaaagctgaagcggaaatgatcaattgaacaatttatttttgaatctcttatatggatcttcataatgttgttttttgtctagatttatctcgattttattttttaaattattttattttgatttttaatcgcatttttacaagtttcccccatttgtcatagtattcatttgatattccaatcattttaacttttttttccatgccgtcatttttaacaaatttatcgaataacgatggctaataataatcattgtccaccaaatgtttctgtagaaaatgatggcggttggacattggcagttcgtacgaagcacgggtgccgtcggcgtcgcgtgttcagtgccaaaacgacgacaaaatgcggggccaatttggacgggccaagcacaaatgcattcaacgaggacggcactgaaggaggagaagttcaagcagcagtggaagagttgacacttcagatggaacgcctcgtgtgcagaatgccacacacatttttgtgagtcataagttgtgatcagggtcgctgatcgtgaattcagcacccatattggtgtttattttattcgtgtatatttggtagagcccggcggaatcgggactcccgcgggatttccgactcccgcttttcggtgaacgggatttttacgggattcccgttcaggactcccatcccggtaaattttgaactcccgctcccagaaattttttttaccggattctaatatttggcaggttttgatgcggaattcaaaaagttgtattgtccacctttttgtttgcttccagagtcagacagtgcactatttcttcctttctctcgtggctatgcggaagaaaagaaggaaatagtgcactgtctgactgtctgcctattttcccagcgtcgctggtatgagcaaaaaaaaaaaaaaaaggtcgttcgggcgaaagtttttcaaaaatacacccctaagaatcgggcgaagaattttcaaaaatacacccctaagaattgacttttcggatcggtaccccccccccaagcccaaatcctggatacgtccctgacacatggaacaaaaactttggaaaaagattgttcaggtgcccttgccaatttttggcttgtgttcctccaatcattttcatttaaaaaattcatcagaaaatcaaagagtcacttttttatgaataattaaatgctccaagtcatttcacatttcatcgctttttctagtcatgcaaattcagcagtttttttgcgagttttggtttaagggagtattgagaatttttttaaaaatttttggatgaaattgcaaattctgtcccttttcctattgccttctaccaccacctgcacgagctgttcattctccacgtcgtggatttgcttctgtgtcttaatcactcgctccaagtgttcggcgtgtgcaatcgccgcccgtttcagttgcgcgt

SEQ ID NO: 7238 - DNA, 4147 bp, Heterodera glycines
  misc_feature (4136)..(4136): n is a, c, g, or t
aaaagacgagagcgagagtttggcgataggcgagagtccccaaaaacacgagagttggcgagtggcgagaggacgagaggcgagagtttttcaattttttgtagccttattttttatttcaaaaaaacaaaatcatatattaaattagagttacgggtccgtgtattgccgggtccagaaaagccgggtcagggtcctagttaataaagcgggtccgcgtcaaaccgggtcatgaaaatcaaaaaaaaatcttcgaaatttttcatgaaaataaaagcttatattttaaaaatataatataaatattttcatgaaataaatttattttacaaacaaagtttattatttgtccattttttgccattaaaaccacctttttttcagcgcttctttcaaacttcggggacagttggggtccggcggtgccggtaggcgcagccgggagaaattttgaaaatttatttcggatctgttaacagattttattcaaaaaatgactaaacttgtgcttttagtcaatgcgatttacagaatttgtatcaaaaatgctcaaattattgttataaataaaataagttaaataaattacgacgcatataaagaatataaataataatacttctaaaaatttaaaaattatcatacttccagagttaataattaaaaatatgatatagagaaagttaataaatactgcaaaagttaaataaatttaaatatcttctcatatgaagaaaatataaataaaataaaaaataatttgggagttcattaacgtcaaacccatcaacctcaagcttttcaatacgaaaatgaactctaatgacgtgaggttcgagcattatacataaagcattaatcaaagctgctgaaatataaactaaaaacattcatttaagtttataaaataaaaagaaaattatttattcagcatttgaaatagaaaaaataaaaagttataatgtcactttggagaatttgaaaatataaacaaattttaattcatcaaaagaaacgattgataaatatcaattcaaattattatctattttattatacaccaagaaaaaaacaaaaaatgtatttgaaaataaaaatttctgacattgctaaaatgaaaatatgatgcaaaaattctttattctcatctacttgaaaatgatttttacgcagttatttattttatactttttaattaattaaataaaagcaaatatttttgttgaaatgattaaccctaatattaaaggaataggaggacaccagaggagcgagatatttaacaaaattaatgaatataatttaaggaatatgacgctaattaaaatacaattacgcactaattattaataaatatcaaaaagaacaaataagaaacatattataacaaaaagctatgaaaaagaaaataatatgctgtgtttttagaatattgatactgcctatagacataatggagttaaaaaataaataatattttttctgataaataactaataatttatctaaacaaatttcattatcaatttgaataggagttttcaaaatttatccaaaaaatatctattattaggtcttatttaataaagatttactatatattaaaatataatataaaaatgaaatgaataataaatattttaaaaattaatttaaaaatatacttaaaagttgacgatctaaaggcttttcactttattgccatgtgaaaatgttttgaattataaatgacttgaatgatgaaataaatgattaacaataaataaaaaaacccatcaaatagacattttggtaaaaaattttacgaaaaaatatacttaataattgaaaaattgataatttaatagaaatattagtagttatgagtacatttgtgtttggggttcacgccttcgaacgtcccccatgcgcaccttcgctgagagggacgagcccagctcggacatggtggtaatgcataataaacccagttgaggaccagtacaagacaagggggttccactatttttctatttttctctattatttcattttgtataagatttttgttaaagttaaagaaattaatagtagtatagagtaacgcaaactatttgtgtgaacaaaagtgagtgataaggcataaatttaatattttattaacaaaaaaataaattccaaaatatacgcataaaattattaaaaccaacaaacgacaaccaattatccaaattagcagtttataatatcacaaagtaaatactcagtctcgaaagttcccttgataaataaattggttaatataactcagttttataataagtatatacccgatacgccttggcactcgctcttacacgtaatatgtagattatccatgttgaggatttcgattttgtttagcttaaagataaatacattttttgtttaagatactatactcactatttcccgttcatcctcaaagttaaattctttcgccccatagcactgaaagagtttcctcataatattttcaaaacaatttattataatttttttccgtaaaatgatgaatctcaattttaaagaagaaaatgtcctgcgtgaacccccctcacatgaacaccctctttttacgcttttcccacattcattacatcccttaattattcattgaatattttttcttttgttatatttggcatctaaaaattatattaaaaaatagaaaaataaaaaaaactaaaaaaaaaaaaaatgaaaaaagtcactttttatggttaaaaaaaagaggttttttttatttttctttttttttgtgtctttaataatattggtttattaatttgtaaaggattaattattctttttctttaaatgaaaatttttcatcattatcatttttttatctacaaattattttttattaaaattcctttttgcagatattatattactttttaccagattttattttctatttttatttgtataagctttttgctacatttggcattactatttttaatctttattattgttatcttttaaaaaaataaaaatttcttaatctttttgttatttgtaaaaagaattaaactttcatttaatcaattctttggtctcccgttttcccctttttctcattaaacattttttgctttcccttaaaatatttctcaattttttacaaaatggaaccatcaaacaaatcatttatcaccaccgcccgatgcggccaccgaatatcttccagctgcaactgcgagctcaccattcccaacgtaggtccgcagagtctttttaactcgggaattgacctaaacaaattaaataatatttaaataaaatatataaaaaattgtcattattacatgctttttcgaattcagtttgtaggtctccaatatttttttaaccagtttgtgcttttgaagcggcccagtatcatgaagaatcgattttatcatctaaatttagaaattacccctaaaaattaaatggttaataaacagaaacgcacaaatatatatggtgcaggttcgagacgggccattgattttaaacaatttaaaagacaaaatacctgaaatttacgataatttttattgaaaaagaaattaaatttgcacatttgtaaaaaaggtatttgtaaaaaacgatatgaaaaataagtcaaaaatttaaaaggtcaaataaaaacatattctaagtataaacaaggggtacaaatttttaaattaaatttgaattttatgaaaaatattaatactggtaaaataatgatagagccgtgcaggaataagaaagacaactcaaattaacgattttaaaataacacgaaaaaagaaatgtgcgaaccaatcgaagcgatctaatcgtagataaagaatggacgaacaacgaattttataaacataaacgacaaaaaataattgatcaaagatattttaaataatactttcaatttccgaagaaattctatttaaaatacgatataaggataaaaaaaattacgtatccgaatgaaaatatattattacagtaatttaatcccaaataaaaacctaaacattctggtcagggttatgaaactggattcgaatggaacgaactatttgaccattgttaaaaaggacaaaactaaccggtttatgattaatgaacggattatntatctgctaaa

SEQ ID NO: 7239 - DNA, 2670 bp, Heterodera glycines
aatttacccattttcgtgggatattttataaagtgtaatattcaagaataaaccggaagaatgttatgtgggagtcccacgacacgaaacttgacgattttagtcttatttctaacacatattaggcagatttaaatagtaattaacattttttaaaacgattgtaatttttttcaggaccgaatttttgatatttaattatttatccaaggaaaccgtgcggaccaagggtatcggaatgagccttttcgtggcagacgggtgcgcaataacaggaactggcgcggtcgctttaaccgccagaacaatcgatactcaggtggatagagtaaactataattttcccaaaattttcaataaatcatgcaactttgccaactgtagaattttgatcaatactatcaatatatgttaaattttcacggatttaaatttcagaaaatttctagtcgttctttatgatttcttaattgaactaagtcgttttgtgggacgtttttgaaatctagttcgattatgcgggtccgtttttgttgcaataaaaacatccacctaaaatcgtttaattttaatttaacttattcctagcattaataaatcagctctatttcatttattattttttatttagcaaattttgaacgcatccggccaattccactaaaccaaggtagaaaattctccactccttcaccatacacatatttaaaaacttttagttcgcccacatttatatgggagtaagtaacattttttcaattataaatcaaatgactaatcatataccgaaccagatgggtgagacaactgttcaacccggctcccccacctccggtgttttatgtgtttagagggcccgcccacctactgaatgaccctcgcctgtttgagcgcgttaacgggggtagtgttatttttatgccgcctcaaaacatcgccctaaaaacatgatttagcgagtcctcaaatgccgatgggtctccaatatgaccaaaacggagttgcgattttcaacccagccgttccaccccccggatacgagaaccttcgccccccgggaacataaatgccaatcaaataattggacgattttagcaccgatttttggctaactgttaatcgatccataaactgttgatctctcataaaagttgatctgttttgtggtgtctctttcattttaaagggaaaagttaatgaaaatagtgtgacgggtgaagatactatgaagatggtgaaaataggtgataggcaattaattaagtgtttgtacatattgcttagaatgcattttcagtgcctggtgatatagagtgcgcggtataatcaattgtctgagttttgactaggtgggctgagtttttggctaggtgccaattcactattgattcgtgcgctaaccattttcatcatcaccaaatgctacaattttctcgtccaccaattatcgtgccttatgatgtctgtccgtaccttatacacgccaaacaatagtgaaaggggcgtgactcagtcagccatgcgcatactttgttcgctaaactcggtaccagccgctaccgtttatcacggacagtggccggcgtctctttttgtgtatttaaggaagggatttgtagcacattactcactttattaaagcagcaaaaattaaaattgattatttttaattaaatatgtccgaaaaaattccttaaaacaggaaaagaagtaagagcaaaaagaaatgtaattaatttttttaaaacggtcccaaaaaaaaatgacgaaacaaattatttcgaggaaattgagagttatataacggaaaacaaaaaattcggcattacggggcatgttacaaaattctattttaaaaatgcctatacagagtcggctgaagaaaactttaaaaaaacaattaacaaacttattgagaaagcttgtaataaagaggaaaatggacgtaaaatttgcaaaatgtctgtgaatttatattgtaaaggaattacagacccggtagtaatacctatcagaccgaaggagcaaatatctgcggatacgattcttaatgagtttattaaattacaacaatcgtattcggaaatcaatttactcgatcaagaaatatctgtaattttcaccacttattcaacacctgctggaagcggtaaaaaaatataattaattcatatgctcatcatttttaggcagaaaatcaaataaattaatggaaaaaaatgatcttagtcgtattcgtatttctaacgctgacagtttcggtaagtggttaatcaaaaagaggatttaaattggtttttcaggtttattttatgccttagagctcacccgtcattaccagctcattaacaatgggataacatataaaaaatatttatgtattataaataatccaaaaaaacaaaaaactattgtgcgagatttgatgaatgaggcggacattaatcaaaaagaaaaatcctacgggctcgatcatatcaaattaattcaaaatttttgggatcaaaaatattcaaaaatatatagaattgttgcctttgacgatgtaagaatattctcgaaaaaactttctttatttgtgttttagagatgtggtttgaagcctatatttaaagcagaaggtgggaggcggtttgaagttgttgttttattgcaaaatggacactggtg

SEQ ID NO: 7240 - DNA, 2115 bp, Heterodera glycines
gcttttaagtccccccgggaggggggaccgtttccaaaaattttgtcccccattttctgcggagagtccaagtcccttaaaggaccaatttcttgtcacggacgacagtcgcctttggccccttatggaacagaaaaggtggaatattcagatggggtgcgtcccttcctaaaaagttctcttttcgtctacccctcccatccttgtgcactatttcttttcaaaattggtccaaatttttttgctttttttgaaatttaattgtaaaaattcgaaacaatttcttttcgatttaaaattgtgcttcacaatgcttttaagtcccaccgtgaggcgggacagttccaaaattttgtaccacatttttctgtggaaagtccaagtaccttaaatggacaatttcttgtcaacgacgacagtcgcctttggccccttatggaacagaaaaggtggaatatcagatggggtgcgtcccttcctaaaaagttctcttttcgtctacccctcccatccttgtgcactatttcttttcaaaattggtccaaatttttttgctttttttgaaatttaattgtaaaaattcgaaacaatttcttttcgatttaaaattgtgcttcacaatgcttttaagtcccaccgtgaggcgggacagttccaaaattttgtaccacattttactgcggagagtccaagtaccttaaatggacaatttcttgtcaacgacgacagtcgcctttggccccttatggaacagaaaaggtggaatatcagatggggtgcgtcccttcctaaaaagttctcttttcgtctacccctcccatccttgtgcactatttcttttcaaaattggtccaaatttttttgctttttttgaaatttaattgtaaaatatatacgaaattctttcttttcgatttaaaattgtgcttcacaatgcttttaagtcccaccgtgaggcgggacagttccaaaattttgtaccacattttactgcggagagtccaagtacctttaggactacagaagagccaatgaagcagcacatttaggacagttatgaaaaataaagaaggaaatattcgatggggtgcgatcctttcaaaaaattactctcttcgtctaccctccctcgctttttgtgtactaattcgtttctaaaattggttctgaattttttggcattttgaaattaattgcaaaaattcgaaacaaaatactctgaagatttgtaatttcacttcaccatgcttttaagtcccaccgtgaggcgggacagttccaaaatttgtaccacatttttctgtggaaagtccaagtaccttaaatggacaatttcttgtcaacgacgacagtcgcctttggccccttatggaacagaaaaggtggaatatcagatggggtgcgtcccttcctaaaaagttctcttttcgtctacccctcccatccttgtgcactatttcttttcaaaattggtccaaatttttttgctttttttgaaatttaattgtaaaaattcgaaacaatttcttttcgatttaaaattgtgcttcacaatgcttttaagtcccaccgtgaggcgggacagttccaaaattttgtaccacatttttctgtggaaagtccaagtaccttaaatggacaatttcttgtcaacgacgacagtcgcctttggccccttatggaacagaaaaggtggaatatcagatggggtgcgtcccttcctaaaaagttctcttttcgtctacccctcccatccttgtgcactatttcttttcaaaattggtccaaatttttttgctttttttgaaatttaattgtaaaatatatacgaaattctttcttttcgatttaaaattgtgcttctcaatgcttttaagtcccaccgtgaggcgggacagttccaaaattttgtaccacattttactgcggagagtccaagtacctttaggactacagaattgccaatgaagcagcacattttgggcccttatggaaaaaaaaagggggaaatcagatgggggggcgtccctccctaaaaagtctcttttcgccaaccccccccatctttggggactatttctttttaaaattggtcaaatttttttttgttttttt

SEQ ID NO: 7241 - DNA, 1375 bp, Heterodera glycines
  misc_feature (1292)..(1292): n is a, c, g, or t
caaaaattcgaaacaaatactctgaagatttgtaatttcacttcaccatgcttttaagtcccaccgtgaggcgggacagttccaaaattttgtaccacatttttctgtggaaagtccaagtaccttaaatggacaatttcttgtcaacgacgacagtcgcctttggccccttatggaacagaaaaggtggaatatcagatggggtgcgtcccttcctaaaaagttctcttttcgtctacccctcccatccttgtgcactatttcttttcaaaattggtccaaatttttttgctttttttgaaatttaattgtaaaaattcgaaacaatttcttttcgatttaaaattgtgcttcacaatgcttttaagtcccaccgtgaggcgggacagttccaaaattttgtaccacattttactgcggagagtccaagtacctttaggactacagaagagccaatgaagcagcacatttaggacagttatgaaaaataaagaaggaaatattcgatggggtgcgatcctttcaaaaaattactctcttcgtctaccctccctcgctttttgtgtactaattcgtttctaaaattggttctgaattttttggcattttgaaattaattgcaaaaattcgaaacaaaatactctgaagatttgtaatttcacttcaccatgcttttaagtcccaccgtgaggcgggacagttccaaaattttgtaccacatttttctgtggaaagtccaagtaccttaaatggacaatttcttgtcaacgacgacagtcgcctttggccccttatggaacagaaaaggtggaatatcagatggggtgcgtcccttcctaaaaagttctcttttcgtctacccctcccatccttgtgcactatttcttttcaaaattggtccaaatttttttgctttttttgaaatttaattgtaaaaattcgaaacaatttcttttcgatttaaaattgtgcttcacaatgcttttaagtcccaccgtgaggcgggacagttccaaaattttgtaccacattttactgcggagagtccaagtaccttaaatggacaatttcttgtcaacgacgacagtcgcctttggcctcttatggaacagaaaaggtggaatatcagatggggtgcgtcctttcctaaaaagttctcttttcgtctacccctcccatccttgtgcactatttcttttcaaaattggttccgaattttttggcattttgaaattaattgtaaaaattcgaaacaaaatactctgaagatttgtaatttcacttcaccaggncttttaagtcccaccgtgaggcgggacagttccaaaattttgtaccacattttactgcggaaagtccaagtaccttaaatgga

SEQ ID NO: 7242 - DNA, 4418 bp, Heterodera glycines
  misc_feature (696)..(696): n is a, c, g, or t
  misc_feature (961)..(961): n is a, c, g, or t
  misc_feature (979)..(979): n is a, c, g, or t
  misc_feature (987)..(987): n is a, c, g, or t
  misc_feature (997)..(999): n is a, c, g, or t
  misc_feature (1044)..(1045): n is a, c, g, or t
  misc_feature (1063)..(1064): n is a, c, g, or t
  misc_feature (1130)..(1131): n is a, c, g, or t
  misc_feature (1152)..(1152): n is a, c, g, or t
cttctcaatgtcctttttttggtctgccccacccctcattttgccaaatttcgtcgttcgtttcatttcgccgtttctttaggcctcctttttgtgtttgtattcggacattgccttggacacaaaatacactcgcccaatcgcaaattccaacgaagaagtaaggaccaatgaatgggctgctgcttttgacgatcatttaaccaaatttctgctgtttaggctgaggaagactcagccgacgcatcggccgaagacgaagacacaacgacgccgcaacttttcatagccgaaatactgcaaatccatctgtacaagccgtccgaattcctcaagaatctgatccaggaaacgcttctttcgttggctcagaatggctcactgctcggactcaccaatttgcttgtgcttgttttggtggtcatcaatcggtcggtcgattggtcaaaaacagtcaagtgatcaatccgatcaccgcccaatcgcagttcgatgagtggcaaaggcattcgcatttcacgtgccaaagtgattgctgtgttcgccggcgtttggctgttcctcgtcgtcagtcacgtgcttttctccgcacttcagtacttcgctgtctcgcagctgcacgaactgttggagttgaccagcagcaaccccagccaatttgcatgtcgacggtactctcagccaataagaaatggnggggggggggtcgaacccacggcccacctatttcatgggactgatttcttgatcactgggcctgatttgccgataattcactcctcccactccccccccccccccgctcttttagaagtgccactttcatggtgtacaatgaaatcggagagcgctgcgatcggttggccgtttaccaagagttgggccactttctgctcagaggtcacactctgttcaccgttgtgctgctgtccatttctttggtcattttcgtaatcactgntgtattagccatcgccgncgtccaanagagcaacannncattttctagaatagaaaatagcgacaaatcaggcaaaaatagcnncggcggaagagaagcganncggggggaaacggacagtagagagcgggcggaagcactagtgaggagaagagcggtagagtaggcnngggcgggggcagggagggggnggggggggggtctcgaactgatgaatgcttttcgtttttcagtgactcgagcccattccgccggcgtgaaacgctcttccaaactctcgtcctttcgctgttcgtttgtccttccgtttgttttgctttcattccgtcccttcttttccagcattgctttcttcctgtcgctgttctcccaaagcttcatcgaaatgtatgtgatggtggtcaacgatcgtcgcgagatcgcctggtgggcctccgtctatcagctgagtcgcattgcggcgttcatcgacccgttgtttaaccccgtgctggtggccgtccgcactccgatcattcgcagacgcgtaaattatcactgatcagtccgatcagttgcccgatcaatcatctctctgtcccttgtccgatgctttccatttgctttagctccgtttctgtgtctattctctgctcggctctctctgctcccttttctgtccgtggtgtcgtcgtgtgtccctttctctccgcaaccgaatgcgtcaccatgattccgttgctattaccatgaaaacatggacggaaaggaagcgctccagcggctcccgaagggcttcttcggcttcgtatttaagtgccgactcggcgaaagtgccggactggcgaagcatttgttcacgaaaggcaatcataaaaagaatgctggcatttaatcactttttattttgcagtttttccgttcgataagacgcgccgaaaatggcggaacaaatgccaattcacttgcataagacaaaatgttgacgaatgtttgacatggacttttgaagttcatttaattatgtccaaaatttaaattttaaaataaaaataagggtgtattaacagttgaatttttaataacaatgataactcatagataaggtaattgtcctccaaacccatttgttttgccctaattaaatgcaaattgctgcacttaattggtgtttttttggccatcaaattgcagcttaatcattttcggttgttggaaaggacaaaatcgacaacaaatggattcatcagtcaattgagcgaaacgtttagcccttccgttaaaacagctgctgatcactccgttatttccattgaaattaaattggctgccaaatgggccgccattttcacttcttttccctctcaaagattactttttgagtcttttttcaccataattaaaataattgaaagtaaaatttaacggatgttttgtgtcaaatttgttgcaaatttttgttgttttattcacagaaaatgagtgaaaataattcgaccattgccaacgaaaacgaaccgatgctaaaaattcggggtaaaattcattcacccattgttggcattgtgaagaaaaagcaaaaatatttttagacgttccggaaaatgaacgcttcgaattggcaattcgaaaatttgacttttgtcgtcgttggccccgcaatttgcacaacgaattcgctgctcagtcagcggccagcaaaaattcgcacaaaataaacaaatttctgcccatttgcgtggattttttgggcgaaatcgtcgaatattttggctcggcaaaagaaagcatttgcgaacagatttatccatctctttttgaaattgtcagcaacaaaatttatgatgatttttatccgccgttggacgacgaagaaaaccaatggccggcggaaaaaggggaaacattggcaaaagagggccaaggagagcaactgcacggagatgcaaccgaaacattagcaaaagagggtgaaggagggcacgtcaatgctctttctgctgatgaatggcattcggttgagtggagccattcaaaggtcgaaaattagggacagaagccatgctaacaaataagcactaaatattaattaaataataaaattgattttctgctgttgttcgtttatgagccgtcccaaattgaatttgactttagttggtttatgagctgttccttttggtgctccgatcggacaaattccgtgtgactcgtgccaaagagtttgtcgatcagaaatttgtacggcgtttgatcacaaatgtggcaatttgtccgcatagcgaagtgagacgctgtttggcacagatactccgaagcatttacctgaagttcgtccgcttccgtccccacattcgcaaacacctcttttactccctcggcgaagccgtttttgacgagcggtgccaattggcaacaacaaaaacatttcacggagttgcggagacattggacattttggagaagtgaattggttgaatgaaagtgttttaccaaatgcttttaagtgtgatcggtggctttaaagtgcccctcaaaagcgaagagaagcaaatgttttccaaagttttgcttccccttcacaaaagcgactctcttgaaagcttttacaaaatggtaaattgattatgctttctgattaaatgattctcgcttcggctcatcgaccgggtcattcaattcatcgaattggacgcgcaattggcggcggcggcgattgacaaaatgttaaaatggtggccgaaaacgaatggacagaaagaagcaagcgattagcaaatcgcatttttaaatttatgttgttgtttagtgtatttttctggatgaattggaagtgatcctttcaaaggtcgaagaccaaagcattttgaggccaatggtcggccgactgttcggccaaatcgccaaaagcatctccagccaaaacttccaagtaaaatttaaattctctaattactttggagtttagataatttttattttgacctaaagttcaaatttgagaattaccaaaacttaaaaattccaaaaagctaaaaattctaattaatttaaaaatattttatgaataatttaaaataattttctttttttgtttttaaaaattgttaaggtcattctcgaaatttttgcactaaaaagtgttgatgttttctggtctgatagataaataaatgactcatctccttaatatttttaatcatttgcctttcggtgtccatcaaagcactccatttgtggaagaatgaacgaattcttcaactgatcacaaaacatttcgcactttttacgcaaataatcgctgaaccattggcagaaacggtcaaaacccattggagcacaaaaacccaatcggaggcgaagaattttgaaaacattctaatggaaatgaattgggcggcaaaaaataaaaagaaaaattataaaaaatcagaggaagaataaaataaaataataaaaatttgttgtcattagagcc

SEQ ID NO: 7243 - DNA, 1767 bp, Heterodera glycines
aaaaggtttatgtgattttttatttaatggaaggatgactttcagtttatttccaggtatttaagctgtttttgaaccatgcatagaaattgccgtcaaactgatatttggatatatttgtggccattcgggtccggatttaggaattggtcaaattttcgtcgtgtcatttcgggtatcatcctttcctgataatttttccccctgacaaaggaggggtcggcaagtgaccgtgggatttccaaatgaaatttggtgggtggatagatgacgcccaggttctattgtgaaattttgactatttttgccaaatgagcatgagtgccgagatatgacgtgccaaacttttttaatgaacaaacaaattaaataattatttgcaaccattcgcattgtcaaatggtgtagaggtaatgcgttagtaacagtcgcaccaggttcgaatccgctatatgcaattttttttttttaattttttttttgctttttatgaaaagtcaattctcaaaagattagttttataaaaagactttatttttaattttactttttattttggtacatatgataataaaaaatatttttaattttactttcattttgatatgtacataagataataaaatatttaaaaaatacgacaggatatttattgcacctttatgtttaatgtagtaattttttgatttctaatggaaaaaaatttaaaataaaaaatatgtttttactaaaaatttttagatagttaactttgcatgaaaatcaaaaataaaaattataaaataatatatacatgcatgggattcgaacctgtgacataaaaaagatttgactaacctactacctctacaccaatggcttctttcttggccaacaagaattatatcttttctaattaaaaaagcgtaaaaactttggcacgtcatatctcggcactcatgctcatttggcaaaaatggttaaaatttcacaatagaaactaggggtgatttacccacccaccaaatttcatttggaaatcccacggtcacttgccgacccctcctttgtgagtgcaactcagaatcgtaaaaaacgcctttttgtttacttttttatgggaccagtaaaagttagtattactcctatttttagcttaggtattcgaagtttctaggacgccttttcaatttccatattgtaaataaatctggaattctctggcgatatttttgaaattaatagccttttctaattgtgcgtttactaatgaatagaaaaaagaattccaataacatcacttctaacatcaacatacattataattatatccgggatgtgaccgaaaaatcttagaaatcagaacttcaggctcaaaaaattgaatttttgggtcttaaatccgaacatttctaataaatcagaactgatcacttccacgaattatatttaacattttttgatgacatatcgtgtttaattgtggaaaataattaattgaatgattttgtttgccttttttattattgattaattaacagtacttgcattaagaacaaatcattaagaagatagaagctgagtaaaatgagaaatattcataagacaagaagataaattggtaaaatgagaaatgatcgatcagtgaccagtgaaacacacccgacaataattctaaatattagaatgggtgggcattattcattcattcccaaggaatgcttgaaaacatttctaatcctttaagttgtcgggtttcttgttcattcccgtcaataatttcgcaat

SEQ ID NO: 7244 - DNA, 1509 bp, Heterodera glycines
tttgatcaatgtacagcacgaatggacaaattttttaagacgcttatcatacagcgccaatatccactcataacttctgatctgaatgaacaacgcaattccgtcactcatcggcagattttccgtggcactgcgaattgactcgctgctgctgatcgacgactcgccaatgctcgcgtccaaactctcttcgacgcaactcttctcctcccttttcagttctgcttccacccgcttcttctccgtctttttccatcctcccccaaatcctccgtcgattacgtcgaactcatcgtcaggttcgcctccaatttcagtttcgttttctttgttttggttgtcttcgctcattaagtcgtaagcatgactttgttcgtcaccaacatccgcttcttcttcttttacatattcctcttctttctcttcgcaaatcacattgacaataaaccaaagtggcgattgtcgttcagggaccaaacagagccgagcctgggcaatgataagctgaccaacccgcacaagtgacaaatgattgccgagttttccatcagggtcaagcagtacaccgaaattatcgacatggattgaacctctgactgtgaatgtcggggaaagcatcgaattggttacaggaaaacaaagttcaaactgaatgtgccattgaaatgcttatttcttcgatgtaataaatattttaccagtttgtccccttccaaagatttcaatgagaaatttgacgataatccaactggtaaacttggctctttattcaatgataaatcaactacaaaaagcttcgaagagcttattgaaggaaggacgggacggtcgacttctcttaataagaatttgttggaaataccaaacgaacaaggaatattcaatgaaaaatcctgattcattttttcgtattagtaaataccatgggtttttggcaatcctggtaaaaaataatgatttataatttaacccgggtacaatgaactagaaacccggcttttgcactttaaaatattacctgcaacaaaaatgtacgatatcgccgacggatatattgtttgtgagcttatttgtagcaattgctaattgcccatctcgtaaacagaggatcaatacgaagcagtaatcgtcaaacaatttcaaaacaaatccctgctctttttgggtaattaaatgcgagaaatgaaaggtcgacacatgcttaaattatgttttaagccaaaaagggatcaatggcactcgtacaaaggcaacacgtacaatgggcaaatatctagtattttttaaatcaaaaatagaatgcttttttttgctctataaaaaagtgtaaaaattgcgcattataaaagttaccatttgtacgagttgtcgacaccaaaaaattatattcaaagaaaaacctttgaaacagcactaagttttttgctctccatcacaatgtctttgagagactgcaatttccaacgaggaataccaatttcccatcctcttctaaaatttgctaattgg

SEQ ID NO: 7245 - DNA, 2180 bp, Heterodera glycines
  misc_feature (2160)..(2160): n is a, c, g, or t
agttggttacaacccaagaactttactaaatgatatactatagtgttattgttttattaaattctacctttttattaaattttttttgaaatttgagtgtcttcttttttgtttaagtttttttaatatatcagatttaaaaacagatttttaattttaaaggttcactttcaaaaaaatttctctgaaaaaataatttttaattattatagtcaattttatcccttgtagcctccatatagcttgtcgtaggccttttctaaaaaaaccaaaaatattggtaaaaatgtaataaattgaattaaaaatagctttatcttttattcattttaagattttttttaaaatagtatcttttgattcttttggttttacttaaattgaaagaatatttataatttcactgctgccatttgtgccggcaaaaaagcggaaatttacatatattgagaataattgtttgcagaattcaaaaagttaattttgtatcgaaattgacaatttataaaaaataatgtttaattcataaataactaactgttaacatctattattttttaatattaaaatatttaaaattaatgcataaataaataatatatattttatcttcgtatataatttatttattttttatttgtggtttttatcaaaattttgcaaactaacatttgaaaaatataaattcgagcagaaaaatcattctttttataccattgccttttaaaaatttatttattagctatttttgtttttctgaaaattctttttaatattttttacatcgtgttttgttgaacgcaacaaatatttatatatttttatccataagtaaagttagaaataaattggtttcgcaattcattaacaatagccattgcgtccataaaattttcataaaaacatacaactttgtcaaatcgcataaagaaatcgggtttccgatttgtcacttattagtttttaaatatttatgttattattcactatagttttctaatttaaaatagtttagcttttaacgattttatataacaaattgtgagatttaatgcatatttgttttttattttgataacagaaatcgaagaaaaatatgaagtaatttttgttttttattacataactattttatgtttaattcgtttatttttgtttatgttacaataaatgatgaaaacaagttagtcagtaatattaagagtttgaaatttcgtttcgaaacattgatttagtatgtataaataaattatggaacttttatatttcgttcgtttattatcatatttagtgatttctcatgcaatttttcaaaatattcaactattttggtttcttttgtgaaatagttttatgattaatcaacatcatgcgcaatttaaaattaaatcatagatagtaataaaaaaagcttaaatatttataaagttgtgcttataattgaatatttgacaattagcaataaagtttaagcaaaacccccaaaattcttccggcttttagtcgtgactcatgacataaaaaagtttcagggggtgggggtcacaaacggataacaatcttttattcattcatttcttatttaattgtttttcaaatttagttgaaattaattaatgaagaaaagggtcggaaaaaaaagataaaagaaaaagttccagaacaaaaaaaaatcttaaaaactcatttaaatagacttcatctcatttcaagtgtaatttacgagtttcataagaccccgaaaatctcggttcggggttcggggttgtcggggttggaagtgtcggggttcggggtcggggttgccaaatcgttcggggttcggggtcggggtttttcaatttttgccttataccatatagtcaaatttttttattattttagcttacaattttttattattcataataatacttttatatgcttttttatttctttttatctaaatatttttgaatataattaattaaaaacgataaggaatttttaaaatgaacaattgtgaaaatctgtaaaaatagtcaaaatttcaaatttttgctccgacgcctggcccccaaataaaaatagtggattttattcaaaaaaaaatgcccaaaaatttctgatccccttttttgtttttcaaattatctttttttcgcggcgctctttttctanagacttttaggaaaaagggg

SEQ ID NO: 7246 - DNA, 704 bp, Heterodera glycines
ccacagcttctgcatagttggacggcggtttctgacaaactgatgtcttaatacgcagtacgaaattatgcctcttgagaaatttctgcagcccaactgatgcctggagaaaattttcatttagtagtataggtagcagtttctaggcgatccattcggccaatttcaaatttttcatgtaaaatacagaaattctgtaacaaaaatgcattataaatagggatgcgatttttaggcacaaaaaatcgcaaaataggcacctaaaaaggcagaaaaaaatcgcaaaataggcacaaaaaagcccaaataggcacaaaaataggcaaataaattttttttattaacgctttttaggtaacaaaacacgtaaaaacttaaatatttcaattgtaaatgaaattattaaatgttttaaagttttttttcgaatatgaaaaaatttttaaaccaaaaaatttttattaagaaaaaaatattaaatttagggataatttttttgaaaaattttacatttcttaggggcgtattttttgtttttattgcatttttgttaaggattttttcaaaaaccctaaaataggcactttgggcacaaaaaccccgaaataggcaaagttaggcattataaaagtcatcgtagacaccccaaaccatgcggaaagggcttttttcgtgcttatctgtgcgtattcagtgcgcaaaat

SEQ ID NO: 7247 - DNA, 3766 bp, Heterodera glycines
ctgcgaagggcacaatgtgggggtaaaatttaccacacatttgtggccttatactactaactcatgttattttttactgaagttacaatgtaatagaatatataatcactatatttgttaagcttgttcagccatgttctagttactgcattccaagccattgcaacttaagttttttgtttataataaaagagaaattttttcatttgattatttttaatatatttcaaattatagcatatcttatgattgttcttttgtttaaaatcaaaaaggcattattccaagcgtctaacccaattttttacctgttaaaaaactcaaaaatggtcaaaatttcatattattgcactcactcacttgtgaaacatttgccccttttgatctatccactgagaattgattaagccgctctaggttatgggaaacgcaagtgagatcgggggggggggggggacaagaatgtattccgtatactactaacgttaaagccaaagttatcgcgttacttaagatcataacgaaattttatttataaccttgctcaataataatcaaatgtttagtcttgatatcattcattttctctattagaatgcaaaatcaaaaaaattcatgtacttaaaactctgcacttttttatcatttgtttttttctttttttttgttattttaatgctttttcaattatttttaggtcttatgcttaatgttttttaccttatatgaacaaaaattatttatattttttagtgttatatgataagaaatatcttattcctatttaatcttataaataatgttgattaatttattgttttttttgatttgttttacattgtaaaggttttttgtaatgtgaaccaaatataaatgtcttgtgctggtcaaaatttaattatgtagatgaatgaatatcaaattaatgaactactcaagaaaaaatcattattaagtatttatttatctcttttaaaaagtgttaatttatttttttatgaattcttttaaatttttactttaatagattgcttagtagtatatgtccacaaatgtggccccaaatgtggtcccttttcaccgaccccattattacccagattgattaatgcgaaagtggaaaatgcatattgcaaatgcgaaagtgcaatttgcaatatgcatgcgagtgcatgcacatgtttgtgcatgtgtgaatgagcgagtgagtgtgagtgatagtgagagtgagagtgagtgatagtgtgaatgaaagtgagagtgagagtgagtgagcgtgaatgagagtgagagtgagtgagagtgtgagtgagagtgagagtgagtgagtgagagcgagagtgagtgagtgtgagtgtgaatgagagtgagagtgagtgtgtgaacgagcgtttgatcgagcgtgcgttaagcgtatgagtgcgcgcgttatgcatgtgcgcgtgtgcattaaacgcatgcgcctgtatggccgtgtatccgcgtttgaacttgtatgtgcgaaaatgagctgtccaaataaatcccccgccgcaataaaataattttttataatttttctgccaatcaatattcttcgtgacagccgaaaaaatccgtgccagcctaaaaaatcggtgccacccaaaaaaatcaacaccaacagttaagaaaattaagagactcccatctctctaaattccaacacctaataccctcaaaaactgttgtaaacagcgaaccatttttattttatcgatcaatatgtaaatagtaatagaaaatgagacacatttgttttttaatattgtgatttgtgatcattatattatagatatgtacttagacatctcttctgtttaatgtccctattcttccctagaaatccccttttttttgttttcaacacatttttacacatattttcatattaaacggtaataccaacaaattatatggtcgaaatgtcaacattaaatccgcgtccaaaattaccaatttttaaattttcttatcctcctggcattcttttacccgctgtcaccccttcccctgcttcccttagtacatcaataaaaattgtcgttcgcccagcggaaaatataggttggcgtcagccgttcatttaggatattgattatatcaacacaacgagaaattaactttttttttcaccaaagatattttattatttaatagaaaagaataaacagaacatcggcaactaaattgcaagaaaaatcaaacaaaaaaaatttaaaatagtacataatatggtaaattaatcaaggatcgattaggttcaaaattatgctcaaccggctgatgggtgggattagtatttgtaaacaataaagtggaaagatcataagttgaagaggccctacaattataattaatacatcgatatctaatgccacgccgaattcccgtttctttctcgattaatccttcacttctaaaccaaatcccggacagtagtacatactttctcggtatgatgtcatcagattaggtgatagtcgggcgacagtttgggtagataggatcgaacccatgcccatagttcaatatgtttttatacttggtgttccataattctgctgctcgagcggtgtcaccatcttcacatttaagcacataaagttttgctagctcaaatgcctctataaatgcatatttatagacgccagagcatggtttagaatcaattccatatggaatccaagacggtggaccaacattgtacgcaacagcacaatttaatccctaatatatatcaaaaaattttggctcaaagttttttttctcaccgttgaaaacccaaaatgcacagaacccgggagagttattataccctcaccagcacgctgaacataataaaatataaacgttttttattataataaaattagggataatattttatatattaaactgatatggttataaaatttcttttaaaaaaataatttccaatcactatgataatgtttttgctagtcacaagcttcgaaaaaatattcaaaaaaaaatgttttagataccaaaaattactaaacactatgtgaaaatatatttttcttaaaatcttatctttattgataactcacagttcggatacatcggatcctattttcacggatgatattagggttcaccaaaattgacttattccgcaaatattccggatcatttgtgaattctttaacaaaaaaggttgagagcagatttttaaatttcaaaaaatctgccgccggaatcgaatacctgaaaatacattgtcataaaaagaccccccccccactaaaagtaccatatagttatgccaacattgtcagttccgcttgaagggcacaataaattcacactataaaggtcagaattctcagtgtgggcggtaaaatatgagccggcttttcgtaaataaaaatagggcgacgtaattccctcaattggaacaccaagaccaccattatttgtcgataaaaactgtagttctaagatggagcccaaagatggctgccagtctttgtcacccttttgcataggcaattctttggcatattcaaatattctttgttcttctgttacgccattccaaaaaacgctaaaattttacttctgtaaacattttctatatattttaagagttatgtcagtaaaaatgcagggtgccccaaaggttctgagagcctattaaaattgttaaaactttatactcatctgtctgtcagccaaaatttccggttgcaaactatctttttaactttttattatcctgttt

SEQ ID NO: 7248 - DNA, 1296 bp, Heterodera glycines
gtcagggttgaatcccgttagcagcgaatgatttcactccatttaattgaggcggtaaagcggccgaggagatcgtgagagtagccggaggccgcctccggaggacccgagcggccgagggcgttagggggaaggagccgaagacccttcgggaacctatcggttttggattcctttaacaacaaataatttttaaacacatattttacatattttttaattataacaacatccaagcagtttccaaggcccacggaaatctaggtagcgaagctctcgaagcgcgaagcgctttaaatcactaaagcacgcgcaagcacgcacccgctagttatacgtatttaatttaatttcttaattgtacatttacataattttataattttacatacattttatatttttttagatttaatcaagaatgtgtcttatatttagagccttaaatttgctatgatattcgtaagaaaaattgtgcaatttaatgagagagcgtcagcgctctctgcaattccactgagagcgtcagtgctctcagtggagaatagcctattttttaatacaaaaaattgtaattaaaagctgtaaaagccaaattatccttttataccatatatcgaataattcacgtacatattttagtttattacttaagccattttttacatactcctttcatatctctttaaataaaaaagatattttttttatttttgtaagcaacaataatctttaaacttttttttagaatttatttgtatgaaataactttatgaccaaagattttcaattataaatactatccttcatggaatatcgaagcatttattggataaaaaatgtagcaacaccggattcatttaacaaaaaaatacatatgatgaaattattccaggggtgtcttttattcaaaaatttttaaaaaaacatcccgtaattcatttccaaagtcctcccggcatttgacccaattcagaatcgacccggaattccacacgatcgcctgggtgccgtagtgttacggcaggccacagcccacttgaatccgcgatgaattgtttattttggccttaaaataaatattacaatcacaaaaaaaattatctaacacgcacctagcaaatcaccgttcaaaaaatatgaaaggcaattctctcttttgttgtggaaaactcctattttatctccctttgaaaatggtgctacatattcaggattcctttccattgttacaaatttggcctgttgaggcaactccatatgtgttgtcggcccatcccaccagtttggtccttt

SEQ ID NO: 7249 - DNA, 3216 bp, Heterodera glycines
  misc_feature (14)..(14): n is a, c, g, or t
agggtttacccccntttcctcacccattttttcgaaaaaataatccctagaaaacattacttttggaagcagaaattttttttcgataaatgaggtgggaaacataaattttactattaccaaaaaatttctaacaaaaaatttaaaatttttttttatataagaaaattacaacggaaaataataaaaatttcagcgactttttgcgttgagtgatgcctctcctaatcagaacattttgatttaggccgcgatgcgcatgcagaaccctgctggcctcatggggacaatgtatgcgcctgccagcggtggatttttcctgccacaggccatccagaaccaacgtgctgcgccgttcatgcaaacaccgaatctgtccggggcacaaatgcgtggcgctgtccctcgctggaacaatatgggcggtttcagtgaggagtgccaaatggtgtctttgtttggcatttccattttttttgtagatcatccaatgcaaggctacatgatgggtccagctggtggcggtcagttcggcggcgctaaccaaattgctcgtggaggacctcgctccggtggtggcggaggaatgcgtcagtacgggggacaaccgcgccagcaacagaaccgcatgcctggtatgggcggaggccatcagcagcaaggaatgcgttaccaggtgaaaacatgcataaaaaccgacacgcaaaaaaaggggtacatggggcgagactgatccaggggggggactgatataaattccaacaaatttcaaaaaaatccgccaaacaaaaattagaacaaaaagattttattaaatattaaaaatgaggatggtgttcgtatattggacaaaaaacttgtgcaccgccccaatgtttttttttcaattgcagggacagccgagaggaatgcaacaacaacagcaggctcaacaaccacaaattgcctattcgtcgtatccgcagcagcagagccgtggcggcatggcaccacagatgggtggcggaggcggtggaggagtcaaagctgaccatgcgatcactgctacacaccaggaaccgttgaatacacatgatgcttaccgaggctgccatcactgtatgtattgctgtctgtcatcaattaaattcacctataattttttattttttcctaaatagggacaaaagcaaatgtatggtgagcgtctgtacgcgatggttgccagttgcttccgggacggtgatgtcgagaaagttggcaagatcacgggaattcttctcgagatggagaatgccgagattttggtcggtttttttcatcactcacaagcatagctgtgcgggggggcggttgtgacgccgaacgcaaggggtcggcgggtgtcgaacgcacgaggcggggggagggttgagaaaaaggaaaagaaaaaaagagaaaaagggagcggcaacatcaaggaaatggtcgcgaaattgcgttcgactaaccctgaggggtttctcgtcgaacgcaaaaaaatgaagacttgaaaattgattagtttctttaagaaatttcgctaaaattttccaatttttctgcgactgacaccattttcctcctgcgttcgacgaattttgctgaagaaaattcgtcaaacacaagaagaggggctgaaaattttctcaaataaaatttgtctttcatgtcagattttcccaaaatggcatgtcattatttttttgttatttagttgttgcttggagacgaggaaatgttgcgtttgcgcgtggacgaagcagcaacagtgctttaccaggccacgggtcagaaggaggcgcagtaggataaatgaagtggatggattggatgaataaattgatgagtaaaaggaaaaatcaaaaaaattgatatgttatttggcttctttgtctgagtaaatgcttatctgttaaatgtgttgaaaaatgtttccatgggttttctgctcgcaaatcacgaatcgggcacacatttccgactcccggacccgaattcgaacaaaaactcgagaattcaaattttcgaatttcatatttttgcttcaaaccttatttaaatacatgaaaacgaagttaaagtcatagtgcttcaatataaaattatttaagccatttttagactaaaaacggaaattcgaattttgggcttgtgttcgaattcgtgtcagggattcgagattggtcgaaatgggggtaatataccgatggtaggatcactttttttgaaaaaaatatttaactgtcggaaccgctgaaccaaacaagaaattcaaaattcttttgttcctaaattgattaaaatggttggaaatttagtcaaaaactattgcaaaagcaaataaataatggtcattcagtacagagagatcatgttaagtatgttgaaatttttttttgcagtttgaataagtacatacaaatcggagcagttgagcttgaaaaacacacaaatatgttacacatggagaatacaatacatgtaagagaacggatttctcttctcctcagaactccgccattgcgttggtcccgccaaaggtgcgcaacagagtcatcatttcggcattgccgcctccttcttcggccaagtccattgcgcgtctgccttaaggggggggggatatataatataaaacagtgaaattttgtgttaaacccaccatctgcgccaatttgttctttgtccgcgcccttttccagaaggagtctcgccacttcagtgtgcccattttcaactgcgtacatcaaagggttgtagccaccgccgtccgtcttgttaactgcagtgcccatgtccaccagaaaagccactgaaaaggaaggttgaaaaattatgtttgaatttgatgtcaattttctacccaccaacatccagacgtcccgcaccgcttgcgcaaatcaacggggtcttcccaaagaattcttgctggtcaagagccgctcctttctcgacgagcactcgacagacgtccaggtgtccagcttctgcggtgagcaacagcggaaaaaattgtcctgaaatgggagattgattaaactgcgcgtatttgaattgaaacaaaaatggaaggagtgaagggaaataactgttgtaccagctgctggtagccgaataatagagagtgattaaaaaaggcatttttcactccttttatacacattttctcccccaaaaaagacgagttaggcaatttattttcgatttataggtaag

SEQ ID NO: 7250 - DNA, 3983 bp, Heterodera glycines
ccccccccccttaaggcagacgcgcaatggacttggccgaagaaggaggcggcaatgccgaaatgatgactctgttgcacccctttggcgggcccaccgcaatggcggagttttgggagaagaaggaaaccgaatcggatcggaggaggacgaagaatccgttgctgttcaccaccaccatttccattttcctcctcttccaaaaccgtacgctttcggggcacctcgtgccgcggcatcgctcgtccaatggcatcccgcgtttgcatggcattttcaatgacgacagcgtcgtcgtcatccgattccaattcgagaagcggtggacgtggacgcttattgttgttaccattggtgctgcgcagctttgccggcgtggaggagactttgttgttgcttccaccactaccaccaccaccaggtgctgtggaaaaaaagtagtcaccaaagggatcgtcactatccacaggtcccccccccccagaaaaaaaaaaattattttttaaaaactgaagtaattttcatcacaaaattttgaaaaatctctaaaaaaaatttcaattttttctttctttctttaaattcattcaaaaaatttactacttgtaagaatttttcttgaaaattccaaacaaaaacatcactaggacattcgacgcaaaaaaataatgaaaattttaagaaaaaattcaaaaaacgattaaaacccaaaaaaaaattcttcatgaagcaacacgatcggtgcttttttttaatcttccgaataaaaattgtttggaatagtcatttttgctaatgttttattacactttttttgtaaatttttcttacggtttgggggaggcggtgcatgacgaagcgcgtgccgatgctgcgcctcggagggcggcggcccgtcaacgagagtttgtccgacctgttcccgttcgtcctcctgcagatgacgtttcaactccatgtcaccgccctcacaatcgatgtaagtgcgatactttcggcaccaaaacttccactgaggtaaaaatttttttttttgaatttcagaaattttttgtaatgaatgatgcactccgctttttaggtaaaaataaaaaatatttctcgtaggattttttcctttaagaatttttttaattttcgggagggcgggggggtggggctgattattacacacagcggcatcatttcctccaaaaattctaccgcccttggccccgacaacatctccgctgctcaaattcgccacctcggccccattgccattgaatatatggccaatctcttcaatctgtccatctcttccggcattataccacaaatgtggaaaaacgctaaagtcattcccatcccaaaaccgggcaaagaccataccaaccctgccaacttccgtccgatctctcttctctctccaatcgccaaaatccttgaacgcctactactcccctctctcaatacacacctcccacccgcaccacaccaacacggcttccgccatggcttctccactgtcaccgccctacattctatttaccgcttcatcacagacggtctcaaccgaaaacaaccagttgagcgcaccgttgcagtagccctcgacctctcaaaagcatttgacaccgttgaccaccgattactaatatctaatatcgaacatctcaacaacaacactccctgctcatcacaaaagatggctagccaactacctcggcggtcgccaagcccaagtcaccttccgcgacactacctcccccctccacactatccgtatgggagtcccccaaggcagcgttctctcgccaacccttttcaacttttacaccgccaacttcccctcacctcctcccggcattcaaatcgtcacatatgccgatgacatcaccattttggcccgtgccacccaaatcaattctgccagcgaccaaattaactcctttcttccacgtgtcatttcctggctcaacgatagaaagctgatcctctcaacctctaaatcctcatcgaccatcttcacgaccagttcacatgagcaccgcatcgacccccatatccacgccaacgactgtcctatcccagtccttcgtaatcccaaaatactcggcatcacatttgacccacaggtcacctttaatgctcatgtgtccactctccgcaccaaacttcaaaaacgcaacaatatcctccgtgccctcgcaggaacaacctggggccaatgcaaagaagtcctctccaccacttacaaagccattggacgctcattactaaattatgcagctccaatttggtctccccagctggctgactcccactggtcaaccctccaacgctgccaaaactccgccctccggacaaccactggctgtgttactatgacatcctctgaacatctccattcagaaacatccatcctgcccgccaaagatcacaatttccttctctcacaacaattccttcttgcctgccgtgctcccacccatccctccttcgatgttcctcgccctcgtccatctcgccaaatgaaatggaccctcgagcaccgtttcggccatataatagactctaccctatcagatacacgtggagaaatcctaccggcacaaaaactccttcacactcgtatggttgctacaacaattcgttcctccaccaaccgcatccttggcaagccacccccacctatcgacaacagcgaaacttccctcccgcgtgtagcacgctcacgccttgcccaactacgagccggcttctccccgctgatcaacagctacaacgccaaaattaaccctcacataaccaactcatgcccagcgtgcaatgccaccccccacgacacaattcatcttttcaactgcaccgccaaccccactaacctcacaacccaaacgctgtggacccacccccgtctggccgcgactttcttgaaactcatgccagttatccctttcacccagcaaggagtcggctaacaacaacaacaaccgccggaccccttctttcccaaaagttttttgaaaaagcgcttcgaaaaaagtgatgtgaaaatcaaatctgaatttctattaatattcgatgatttagtccaaaaatgattaattgtttgaaataattgaagaaaatttgtttgaaaattttcattaatttaatttattaaataaaaaaccaaataattttgtattattttcacttgatataaattaaaatttgaatttttttttaaatttttaaaatttttttgaatttttaaaatttcccggttggtcccggttcccggtttttcttgcggtcccggtcccgaaaaaaaatcgaggtcccggtcccggcttctcaggtcccggcaagtcccggtcccggttttggcaaaaaatcccggtcccgtggcactctagtaaaaacatctatgcaatttaacacaaatccggcacatcgccctcggcgtcaacccaattgcatgaacttggacgacagatgaaccaaaattttcactgatttcaaggttttcggggtttgtgtgtaagcaaccccaaattcaaaaaaaaaatacaaaatttttcaacacatacaaaccccaatcattctttttttgttgactcatttgactatttttcaattcgatctcatacaccatcatttatttattctaggacaaaagccgctcctgttatttcaaaaaataatcctgatcttcaaagatctccaacaatttctgacactaatcaaactatcaatagaccaattccagaattaaaatttataggaattttatcaaatgttcgatcaattatgaacaaaattaactccctcataatcacacttaacactgaaaaatgtaatttcatagtattagttgaaacatggttgaccccccaaaattctgagattttaaatgcagcaattcctgaaaattaccaaattttttcagcccttagtaaaaacaaacgaggtgacggagtttcaatcataatagaaaaaaaatttctgtttattca

SEQ ID NO: 7251 - DNA, 1436 bp, Heterodera glycines
aaaatgatatacttacacttctgctcttggccgagtagtaaaattcggtttttgggtcatggtaaaagccggttgccggatcgtagaaatagcccgagctatgctcatattgaaattttgctggatcgggctcagctaaacaaaaagcaattaaaccaaaaaaaacaaaaatttcatacaacaaattggcaaaattccaaacggagtgttcactgaatttgcggtggaagacgaagaactctgattatgagttgtttggtcaatgatttggacatctgaaaatggaaaaaatttgttaaattttgtgtaaattatgaaaaaaaaatccaataaatatgcaaaaccttcttgcgtttctggcaacaatttaacgcgcccttcgctcaaaactttggccaacgaatgacgagaaaatgagacaaacactaaagtaaatagtaatattaaaaacaaaatgatttattgatggctttcaatttttcatatttttagtgtgcattgaagcaaaatcaaaaaaaaataatttttttgaattttcgactctttgttcgagaccggggttcggagttggtcgaaaatggacgccaaattgtgatcagcgacaaggaaaaccgcctaattgtgagaaattttcagggcatttaaaaaaaagtttttttttttgcaaaatggcgaggcaaagagtaaatcttaatattataggtattacccgttttctaagctacaattagacttttgattaggtgcaattactagaaatttgattttttgaaaaagaggacagaattttcggggaaaaggaaacttttttacaaaggcaacggcatttcgacaaattatagccaattaaaaaaggaataattttttggttttcggtaccggcacaattgtcgatgtataaacatgttcgttgcagcttatggtgggccatttctgcgtcaaacagtgaccccatttgaatgaatgcgaacagtcgcgaggcggccaaacggacgttcaatggctcaacatcagtaaaacggacaaccgcatgacggacagacaaatcatcggcactcgcgggcagttcacggattaacaaagctaaaaaaagtaatttttttagttaaaaaattttccaatagtcacctaaatcgttaaatggcagcctttttaagagttttagaaacgaaaactcaaaaccgctgaagatccaaaaacaacaacaaaattaccaaagaaaaaaaaatttcaaaaaatgcccaccccctaagctttttattaccatacttttttgtcacaataaatatcattcaaaaaattactgtcgcatggaagggtgccaaccatcgtcaaacccttggcgtccaatgcaaatgcttcgcccttggcccgtagtgtgccgcatttgaagcagttggcacggccattgaaattgttgataaagcactaaaagg

SEQ ID NO: 7252 - DNA, 3341 bp, Heterodera glycines
  misc_feature (3285)..(3285): n is a, c, g, or t
  misc_feature (3294)..(3294): n is a, c, g, or t
  misc_feature (3317)..(3317): n is a, c, g, or t
aaaaaatcctcattttttaaaccataaaaaatgcaataaaatcaattaagagtcatatttttcgtttgaaacaatcaatgtcatcaatttcttgtcatttataagcattttatggaagtctgagcacgaaaaatcgaagttgcacttcacttgggccaatgctttcactgtgcatctgttaaattttttgcttttagattgctctttttgtagcgcgattttccaaaaaactttttggaaacattgggggagggggtccggcagtgcctataggcgctgccggaaaaaaatttggattttgagtgcgatttgttaacaaattttgtcaaaaaatgatttttactgaggatttttcgaaaaaatgtttaagatttgaagaaaaagttcgaacattttgccaaatatacctaattttaaaaaaatcatgcgtttttgtcacttttttaacaaaagacgacaaaaatcctcaaatttctcaaaagcttcacaaaaatacgcaaatcctcatttttcaaaaaaatcctctttgaccctctaaaagaccacaaaatgcgctgtccaaatggcacattgctaaccgcgctttttcctccccgtcatcattggaagaagaagcggaaacgggaggagaagcaaccgcagcattttgttgatcggcacttttgcttccattctgatccgcttgctcttcgctcggttccaacgcttaacaaatttataaatttacacatttgagtcttttaatccccccattttgtgccattctttcccatttgatgccatttcaccctcttttgttccattcttcccccatttaaccattgatgccattgtcccctattcccactacatttgtcccattctcccccaattgatgccattgcccctgccattttcccattgtttcccattttgtctcattcttcccaattttgtgccattgtcccccaaattttcttccccattttgtgtcattcttccccacttttttccatgttgccaattccttcctcctttttgtctccccatggcttttcctcctcctcctccgtcccctcatgctcttttccgccgttctgttcgcttctttttcttcgcctctttttgtactgctccccaatgtttcgctgcatcgctccgccaaccgaaggcggcggcgtttgcggtgaatcgatgtgcgcctcgtgcgaattctgcgagtcctcatctgattttgttgaatcattttcatagaattctaactgtattatttttttagaatcaatttaaacgccgcctatcccaattttttaaaaatcaaatttaattatggtaattaattatccgatttaaacaaaaacaaatccccattttaattatgtaattaatcagtgattaaatttttaaaaatattaatcccactcccaagcaccctttaaaaaatcattagtaagttaattgccctttaaacatttccaaactcattaattaattaactaattacccccccccccccctctcccaccgtccgttatgccaagctgaagccgtcgctgtgcggaggagcagcgtgagctggcacgtgagctgcgctgggagcgcaacgaagtcggccccttacgatcgaatgccttggaaaaatcataagttcggcggccaaaaatccaaaacttttggtcgagaattggtctcgagaggaactgacaaatgggacggagacaaacaaaaaaggaaaaatgacaaataaaaacttgaaaaatcattttcccgtggatctttttaaaaattatttattttataatttaatttattttgttaattttcacattcattgatggcaattcaatgcgcggaagaagctgttgtgccgcgatttgctgctgctgctgttgcagtgttttctgttctttttggatgccatccgacgcattctcaaaaaataaaataaatatttatttatttttattattttgcattttgtatttttatttttgccatttgcctccaattccttttccaattcggcaatttttcgtgtcgcttctgccaatgcgtcggtcgcttctctttgctgcctaattataatatttaattgttttatcattttaaatcaaattttaactttttacgaaaataaaactttcaaaaatttgatcgaaaaataaagcatttctactctttcactctctttttttcttttctctagcattttttcagtaggcaaaaattcgtaggcgaaatgtcaaatgttggcttagtaggcgaaacgtccgatcttggcttagtaggcgaaatgtccagtaggcgaagtgtcagtaggcgagatgtctagtaggcgaaatgtcaaatgttggcttagtaggcgaaacgtccgatcttggcttagtaggcgaaatgtccagtaggcgaaatgtcgtcgtgccgaatatccctgtttttgaggactcaaaaatgtttttgttggtaagtttttgatttggaactgttggttgatggaatgaatttgttttttggaaggttgacctttttcgccaaattttttgcctcttcatttttgtcggcacatcttaaaattttctgaaatttgttagaaaattttttgaatcctttcctcttcaaaaatcttccagaaaaaatagactccagcatgaatttgagctgatctctttcggcggatatgtccttcaaatcattttccaattgatggattttctcttgaaattcacattttggcactttttccacttttttgaaatttaaaaatttcttgaaatatggttctccagcaaaatttggtgtccaaaattattcacttttattgggatttgcttttcgttgtaaggaaaaaatttgcttcccatgggggggtaccatctaaactattaccctccttttaaatagcgcctttaaatagttgtttattacacacaaatacaacataatatacaatatagacatatacatacatataatatatacatagggctgacaacgcggaataatgaatataggtccgaacaacacggaataatgaatgaaacacgcggggcacgacaatcaatcaatcaggttgcactccttcttcgtcggttcgcttgtttctcccagtcgtaagggaactcgcggatgccattcgtgttgaggtagtcgcgcagaaccccgtctatccattcgtatttgggccgctggtaaaactccaggtcgtcctgtgggaagaggggggggggggggtaattaggaataataaaagcggcacaaaatgacgcataaaacgcacaatgtgtaaacagatgtcgtagaatattnggcggcatntctttcacagtgcatgcaggggncccgttgtgcacttccttcggctt

SEQ ID NO: 7253 - DNA, 3275 bp, Heterodera glycines
  misc_feature (6)..(7): n is a, c, g, or t
  misc_feature (28)..(28): n is a, c, g, or t
  misc_feature (32)..(33): n is a, c, g, or t
  misc_feature (305)..(305): n is a, c, g, or t
ctgcannggtcttgagaaaaaattaaantttnntatttcatttagtcatggggattacacacatgcacatgtggtgtagtggttaaactttctacctttcataatttttcgcctgggttcaattccccacttggatagaatattcctcacattttctttaccattattttaattaaaattttaattttaaaaaatattccaacttttttctttcattttaagcatcctaaaaacccaaaacttaatcaattggtcattttttttacaaattctgttaacaaatcgcattaaaaattacaaaattntttcccggcggcgcctatcggcaccgccggccctccttgtcccccaaaagtcttggaaaaaacgtgccgcgtaaaaagcggtgttgaaagcaaaaaaggtcattgatttacattaatttacatggccggagacccttcgcaaaattggaaaattggccgctgatcccttgttttgcaataatctgaattttgaggtctacatctgaattttagtgttctttatcctgaatttgaaaaaaaaacttggtcaccctcaatatacatatacttctgaacaattctaatgctaaaaaacaggcactcgcgcgaaaactgaataaaaattttgtatttggaaaattttgtccaaaaatttttatgttctaaaattaccggtttttaccggtaccggtaccggtaccggtggaaaaagttggtaccggtaccggtaccggtttttgcagtaccggtcagtaccggtaccggtttttttgcaattaccgattaccgctcaactctaatttaaaatcattaatggtctaacccatctcaaaaaagatatttttcctttaatttccgatcactttccatacaatttaagacgtaaagttgtgttaaaatcacaatgcactaaaacatcccattcttttattaatagaactgctctaatttggtccaaacttaacaaagtgttaacagatgccccgtctgttgactgcttcaaaaagcgaatacagacgtggctggaggctaacaaaatttaactctaaaagtacccattcttccataatactactactattttataattcaacgtgtaagtggtcaccccttcgttggattttattttatttgaataaatactattaaataaattttttcgagtctcaagccattttactggcggaattatttgccaactacatttttccatgaattgtttattatacacaaatacatagtataggtcgaacaagtacacataatatacaatatagaatatacatacatataatatatacatagggctgacaacacggaataatgaatataggtccgaacaacacggaattatgaatgaaacacgcggggcacgacaatcaatcaatcaggttgcactccttgttcgtcgattcgcttctttctcccagtcgtaagggaactcgtggatgccattcgtgttgaggtagtcgcgcagaaccctgtctatccattcgtatttgggccgctggtaaaactccaggtcgtcctgtgggaagagggggggggggtaattagtataattaaagcggcacaaaatgtcgcataaaacgcacaatgtgtaacaagatgtcgtagaatattggcgggcatttcttcaacagtgcatgcagggcccgttgttgcacttccttaggcttgtggcttagacggagtcgtttcattttgcctgtctgaaaatgaagggggaaatggatatttgaaatcccgcgccaaatcccctccgacccacaaaactcacgcggcgttcgctcgtcacatgggtccatggcagcttgccggtgtacatgtccaccagtgtgtagaaccaagactcgatgtcgtccgctcggcagtagtcggctcgcgcgtgtgctgagatcgatgcgtacattggcgttccgcggaagtgcgtctttgatctttgttttcgtgctcgaccctgtgaaaaattggaaaaaattaattatgcgagaggaatgggcggataatctctgctcacggattggctgatgtaacggcgcgcaagtccaaagtcgatcaaaaaaatgcgtcggctctcattggtctccgcgcgtccgatcgcggcattctccagtttgacatccagatgaaggtagtcaattttgtgaagagcctctagcgcatcgagcagttgaagcgaaacgccaattgccgtcccagggctgaacacgtcgcccgccgcgctcagcagatcaaacaggccacgtccgatcagcgacatactgaaagttggggaaaaaattagaatttggcataatttgcgattcgggcgagagggattgaaaacaaatggcaggagtcatcaaaatgtgagccttttatacgcaaattctgctgggcactgcagcagccaaaatttcgccggatgatttttttggattgggatgtataaaaggaaaggaaaatgtcggttggtcactcattcccttcacagcgcgacaacaacaacaacaaacaatcagcaacgacgacaattgcgcaacgcttcaacacagcacatccatcacccgtgcacacgttgactccgatcacttctgctgctgctctccaatcaacacaatgggcttcctcttctacatgttcctggctgcggtgcgtacggagttggagcggtgggtttgggggtgggtggaattcgcgttgtgaatttggcttactttcagtgggctctagtaccgtttatgcgtccaatggacttttatgcgtccaatcaatttttatgcgtccattcaattttttatgcgtccaatcaatttttatgcgtccaatcagatatttatgcgcccaatggatttttatgcgtccaatcaatttttatgcgtccattcaattttttatgcgtccaatcaatttttatgcgtccattcaattttttatgcgtccaatcaatttttatgcgtccattcaattttttatgcgtccaatcaatttttatgtgtccattcaattttttatgcgtccaatcaatttttatgcgtccattcaattttttatgcgtccaatcaatttttatgcgtccaatcaatttttatgtgtccattcaattttttatgcgtccaatcaatttttatgcgtccattcaattttttatgcgtccaatcaatttttatgcgtccaatggatttttatgcgtccaatcaatttttatgcgtccaatcaatttttatgcgtccattcaattttttatgcgtccgaatcaatttttatgcgtccattcaattttttatg

SEQ ID NO: 7254 - DNA, 4553 bp, Heterodera glycines
ttcattataaacgcatttatcttttaacttatcttttaattttagccaagtactataccatttttaatttttgtcttgttctcccggaggagatacgagccggaacgcgccaccctttcatcacacattctcggcccctcactgcctcccgaacaaaaaaatgagggacagcgcgtccaggcatcgttctcccggaggagatacgagccggaacgcgccaccctttcatcacacagtctcgtcccctcactgcctcccgaacaaaaaaatgagggacagcgcgtccaggcatcgttctccaggaggagatacgagccggaactcgccaccctttcatcacacattctcggcccctcactgcctcccgaacaaaaaaatgagggacagcgcgtccaggcatcgttctcccggaggagatacgagccggaacgcgccaccctttcatcacacagtctcgtcccctcactgcctcccgaacaaaaaaatgagggacagcgcgtccaggcatcgttctccaggaggagatacgagccggaactcgccaccctttcatcacacagtctcgtcccctcactgcctcccgaacaaaaaaatgaaggacagcgcgtccaggcatcgttctcccggaggagatacgagccggaacgcgccaccctttttataaagtcacacataaaataaaaaacgctaaaactaacccgggggagatacgagccgaaatgcgtcaccctttcatcacacaacacataatccgttcatcattgatcttcattgccaaagaactgtccttcaacatgcgcacaatcacgttgaagtggaaggcacttcttcaaataattagattataaaaattcgttgttcgatttataaattaaccattttcactctgaatgatgctgccaagaaattgttgcatccaatcatcagttttaactgaaacgtaaaacaatttcttgaatctaaattgtatcagatttttaaataccaaatttgttctccggcgtctcaagagtatagactttgatgcagcttacgtacttgtcttcatctaccggtttgaacaagatgggcttatgctaaaaaggataaacatttggaaatacagtttttaactatttagtaaatttcaagtttaacattagttcaacagaaaaagaccaaacaaaaaccatggacgttttttacgcataattataaaatagactatttactagaatttagtcttatcatctataaaataaaattataaataatgaagcattctctttaaaatataaaataaaatattaccccttttttaaacaataaaacattcagcagaagtctggaagtccttccatttccatcatcaaaaggatgaattttgagctgcaaaaggagtttttaattaattattttaaaacatagttaaagatttatttaaacaaaacattttttgattttaaattatctcacgagttctagatgagcgcttatggccattttaatattttccagcgggtcctttggctgattgattgtttcaaccagttctttcatcgcacttggcactgcagcagcgtcaattgctgtgtagtcgccaacacccacaagtccagtgcggtaaattccacccccatatattcgtcgtctggcgattgcattaagttctttgatatgctgaaaagcaataaaacaaaatatgaatgctatcaaaaaaagcaatgaatcttgcgcattttgtaaagttttttgctatcactagggtcgcatcttatagacgaaaaatcttgaaatagttaaaaatagaaaggaaaaggcaacatagactgaagaagaatccgaaataatgaacgaacattaatcccattaagaattcatgcaacttaccccttcagttacacttggagcattaataatctcatagttgttcaacacctctttcagcagatcatcgtcatccataaacatagttttgccactatacttttcatcgttcgtccacgtcataaacattttttttggcggcctcatctagaaaaaatccgggatccatatttaaataaaaattatagtacttggctaaaattaaaagataagttaaaagataaatgcgtttataatgaaagcataatgggaaaaatgaaatgattagtaaaggaatgtcgattatcggaaaagtataaaggcatggccaaagtagatggcaaagaggaattatctttgtgcgtccccacaaattggcctaatttcggtgtaaaatgtctgatcaacaagtctttaccccaacttgatctgatgatcactcatttttttctagggctcgggtattctgattttacaaaaattttctgattttaaggctcctaatttggctcccgacttttggtcagcggacttttcggcataaggacttatcgacagcggatttcaaaggatatttcgacaataaaggatttttacagaaaataaaatatgatggaatttcgacagtaaacatgaaaataaatcttatattaaaataaattaaattttttccagtttctaaatttcttataaatttacatataaatgtgcattgctgtattgctaatcattattactagtgagaattttttaaaaactttattttgaccttttgcccaaatttgtgaatatttactctatactgtcgaaaattcctctatcgaaaagtcctcttaaaattttaaatatttctctcgaatattctttgctgtgaaaaatccggcgctcccaaattttacttaattaaatgttctgatttatcttcaaaattgccctcaaaatggccaatttttttccattttcacagcccaaaaaacacaccgcttttcagttttaaaacgggaattaaaaaatcacactttcgcatgtttaataaattctatatttaaagtgaatttgataaattaaataagagtgctaaattactattagggctgggatttttatgttttaacatatttttctgcgatttaattatgtcgagagaagcccaaaatagcattttctccgaacaatttttgatttagataaaagcacatattttggtgttttggcacataaaaatgtatcacacatattcggggtttgggacatattttggtatttagagaaaaatgtgtaaaaaaattaagaaaattgcaaaatatactcctaaaatcaattttttaaaatttatttcgaataccgaaagatttatatttcaggatttttagcaaataaaaatcccgccttaattattataaaaccagcggcagcacccccctaaaaaatgaaaaattttctcaaaaattcatctccaaaaatttattttttaaattaattaaaagcaaatttcaatttttgctgctttaaatcttcatttttgataaatattttcttaaatattttgaaaaatcacgaaataagggcaaaaatagggggcgaaatgtccaatagggataaaacattttaggggcaaagtcaaaatagggatttctagggtcggataggggcgttaaaaccaaaaattcccgaacaaaaaatgtgcttttcgtgcatttctggtcgagtttaagccgcagaaataagtaaaaacctaagaatcctaatcctactcatatgtaataagaaatgcggcaaaatttaattatatttttagcgttaaaatacattaatcatatgacctaatcaagacaaatgaactgttgttccttcatcctccatgtctctatgaattttatatttttgatttttgccaagatttcactggctgttattttgcccacaaattgctaatttggaaacaaaaatgacgttgaaaaattaatttgttcatttcataccgtacaacaaatcgattagcaactcattaataaaacagccatgccaaattggtcagactagtgagaaagcattgagttaaattgactaatagcaaaagccaacggcattttccaatcgatagcaaatggccccaaaaaaacaatttcacgcaataaccaaagcacaaaacgtttgtcagtgagtgagtgcttctgctgctgatgaagtgcgactgggcgggggggggggatttcgcaaatgtccgaaaatggcccttgagaaatggaccgcaaatgcccgaggcgcacatgtccgaccgcatttgttttatgtcgatgttacgtgaaggctcttggatagcagccaatgggattttgatcaccttaaaacttcggataaattaacggtatttaaggcgatcaactttcaaatactgcgtttgaaaaattgttaaaatgattacgaatttgacattcattttgaaaaattcgggtcgaaaatacgatttaattatgtatattagtgcaaaaaatgacaccacacacattgccggacgacatcggaatgtgcaggtgcgcctcggttttcactgctcggatggtcccctgattctcgttcaagtcgatgtcgaacggttggcccggctgtgactgccgcttttccttgtcctcccgacgacgaagatgaaagtcgggcattttgtcgtccaatacttcaaatccttctccccgaaacacgctccattg

SEQ ID NO: 7255 - DNA, 936 bp, Heterodera glycines
aaatgaattaattaatggtaaatggcattgcccccccccccccccccccccccattatgtgggggagggtagggagggagcagcctccccctccgggcgccaactgaatgaataaatttatatttgttttgtatgtttgttttcatatgaatttatggatgttcggcatggcatcggggtaataaagggaaaaaacgattgattttaaaacatgattttcaatttttaacaccagaaaccgaaaaaaatcggggttgaccgattaattttaaaaataggaacgtgagaaagaattttatttgaaaaaatagggtttcgttttactgagaaattttgcaactcaaaatcccgaaaaattcaaaattcgccggggaaggagggtaaaaattgaatgaatttaattgcaaaagttttttttgggttaaaaactgaatgaattgaagtacaaagtttttttgtacaaacaaaaaccctgaaaatatgctgaaaagaaataggtgtcaaatttttccactaaatttttttttcgagggggtggggagcgtcatttttgtcgccgccacagactgactcggcattttctgatcccctcaaaaaggcaataaatttgagcgtgccaattattcgagattctcagtattgggaattaaacttatcaaattttttttactaatttaacataaataattattaattgagcggggggagagttgggcaaatcggggggggggggggggaataagtttacccaacgaaaagaataataatgcagcaatctgcgcccgcgggcggcaaaagcagcggactttgaccccgcgggacggggaacaaagcaacagcatccatcgactgtggcccaccccaaacactttcccccttcgttagcatttagcaataaatttgggcaagggggagaggggcaaacgacggcggcgg

SEQ ID NO: 7256 - DNA, 340 bp, Heterodera glycines
  misc_feature (257)..(257): n is a, c, g, or t
cccccctgcctacgcccttgatggggaaggaggttctactgattgttcaatggtttcattacagggcttcctttttcatgtaaatacatgtatttttttcttgattctccgtagcctacctaattaaaattgattgagcggataaactgaattagagtgaaaaaagaatatttttacaaatctccgtctgttttttgtaccaaaaaaatgtgatgaatttctgtttcaaaatttgtttctgaaaagtgtataaaaangcgtaaattttcgtcatttaatgaagaagccttggcaacattcgtaaaaaaaatgaaaattttaaattctcgaaaaatgttcg

SEQ ID NO: 7257 - DNA, 2570 bp, Heterodera glycines
gtagcagaagagaagaacaatggtttccagtgactgggggcctcggtcgacgtagtcgcccaggaagacgtactgctgctctggagggttgccgtgcgtgtggaagatcctctgcaggtccgtgaattgtccatggatgtcgcccacgacgacgaccggcggctgaatcctgacgagcgtcggctgcattctgaagatgtccgtggccgccttgcagagttgtttgagctcctcgtcggtgatctgtggaaaaaatgaaattttttaattgttgaaatgtcatgtcaaaaaaatcccacctcatccgtgaagcgttggacaggcgactgcctgaccttcctgatgatcgcgtccacgaagctgcttgacaggccatctccttgcacaagtgttgaagtcgttgccgaaggccgagactgctccgccgctgccgccgccgttgcatcgaagcagtactcctctcttgccattgttgcgccgggcacgtcgcttcgtgggattaaagttgcagacgatgagcaatatataataacaataatatgtgggcaatgaattatgtgatggaacaatgcaaatgcgctccttttatatacattatttccgttttcactatgggtcaagtccagtgcagtgttagacaaaattatcatttcgccaaatagcgtaactgacgtaattttttgcgcactaatttaaaatttacactggtaaattccttttttgtgggccagagttttttcactataaatcggtgccctagttattttccccgcatttcagttggattttacgggtgtttggatggatatgttcccttttttgaccatgccgaactcggcctcaaattggcattgctttcgccacgttttgatgttttagtggacaaacatttcgatggcaaaagcaaattggtaatttggagaccaatcaaaattcgaaaagacactgacgcggaaatgccaaaactgtctgtgtttattgaccatgccaattcaattgattttccattgcccgaccttccgctgcccgacaaaattcgctttaaggaccttcagatttggtaattgaaattcaaacattttgttgacgacaaatgtattcccttttcaggtacgacgattccgtcctcgcttttctccgtgccaatcagcaaatttgggacaaaactggcaccaatttgcgtttgaaaaaacaacttaaatttaagaaaatttaaaacttaacttttttgaaagcctaagtgttaataaaaaactaaatctgctgattttcaaaataacggaaaacgtacttccttgaattttcttaataactttttttcgaatttttctagaattttttccaaaccaggctaggtaataaagaaatttgatatgtcccggcgacgttttgtcctgctgctccctgctcggaatcccccattttggccctttgcaattgggattttttttaatttccgggggagggggaaacgataactggcgaatcatctgcagggggaaacgtattgccatcatccattggcacaaattcacgtaacttctaaaccgttatcatattttgttacttcgtttactcccatcagcgcaaattgtgccatgtgaattggtcaatgaacgaactcgagaaaaactgacattggaggaaggaccaaatcataaatggggttgaagcgatgccaaattggacaaattgttcagtgggaggacgaaaatttgacggacaatttgaacaatgtcaaaattcgtttgtgtcgcgtcaaaaattggattgggtgagcaatgaaaaaagaattttaagaaaataatacaaattttcaacttttccgtatatccaatctttgaacaaaatgaatttatgccattgtccccatcagcggcgtgtcaaacaaagaataggacgtcgaattgtgcggaagtgaaatataattgagaaatgatttaaagcccgggcgcccgccggcgggcttttgcagatgcgcccggtccggtaaattttgaaaaacaaacgtgcccgattaaacgttttcttaccggttaattgcaaaccgctggcccgagggctaaaaaaatgggtcggggtcacttcggcgcggccatttcggcgcggccacttcgacttggaaattttaaacagatttttattcgaaattggcaatttttagttaaattacactctttgaaaattagcatctcaagaaaaatcatcattgcattgttcttttctgatcactgattgctatgtgtatatattgtatttttgctgtgttgtgctgaccggataaataattggaactgattttttttagtgcaaatcccacccaaaaacatgcataattaccccgtcacatagggattagaggtcgataaaatctgcatttagggtcaaaattagtaatttaaaaaatcggcgcctgaaagttttgaaattttgaatgcaaattggtaacagatttttgccaaaattaaccttttttgtgattttaagccacttttacgaaaaaaaataagttttgtgagccccgacggcgtgccgacatgccgcgcccgggggaaaattggaaattttaa

SEQ ID NO: 7258 - DNA, 2691 bp, Heterodera glycines
  misc_feature (13)..(14): n is a, c, g, or t
tcgctgaaaattnntgttaatttgaaaaattatatttgaagggaaggggagaaggacgaatagcaaaatagagaagcaatgaaaagtacaaaatgaagcaataagtgaaaatggctgcatatttatacagtccaataagcgaatggcaaaatcggaggaattttcaaatttcatccgaacaaaaaatttgtttatgcgcctttgtttttttatataaaggcgagtcaaatcaaatcgcattaccattcctcgctattcaaaactattttcattctttttcctctcccctctttttaacaaaatcctgcacttttttactttgatcgtcccaataaaaaaccacatgcgaattccttaaatataatttgcaatttttcgatattttctgtacaaaattttgggtcaaaaaatgacacactggtggtcagtgatcaggaaaacataaagaatcgaaaggggctttttcgtttggttcgtcatagtaaaaaaaagtgctaaaaatgccttttcgtcttttgcacatttcgcttgcctttttcctgtattttacattggcgtttcttttaattttcagcgaacaaacgaccaacgtcctaatttctgaaaccaccattctccaaatggctgctccctccattcgtctcatcaccacgtccaaggcgcctcctgcgacgggtcacaggtcggaacaacggaggccatcaaaaccatcttcatgttttttgttttttcagccaggcagtgctcctcaacaaccagacgctgtacatcagtggccagaccgggatcgcggcggggtcgacgaatgtggtgccgggtggagcgcgagccgaggcgaaacaagcgatgaccaacattggcgagattctgacgtacgccggctcgtccttcaagcacggtgcgtgagcaaaaacctgatcatccagccatcatctgtgaatttgcgccccttttcagtgatcaactgcaacatcatggtggccgcatgagcgacttccaggcggtcaacgagacgatcaagaacttcttcaccgaggacacgtaccctgcgcgcagcttcttccaagtggtcaagttaccgaagagcgcgtacgtcatgatcgacgtggtggcgatcgttcagggccagagctgagctgaagaacgggagaacgagcgcggcagacgaataacagagatgtacataaacctgtctattgtatatttgcgtgatcaatgttcatatcgatgtattgttcttttctgatcactgattgctatgtgtatatattgtatttttgctgtgttgtgctgaccggataaataattggaactgattttttttagtgcaaatcccacccaaaaacatgcataattaccccgtcacatagggattagaggtcgataaaatctgcatttagggtcaaaattagtaatttaaaaaatcggcgcctgaaagttttgaaaatttgaatgcaaattggtaacagatttttgccaaaattaaccttttttgtgattttaagccacttttacgaaaaaaataagttttgtgagcccgacggcgtgccgacatgccgcgccgggggaaaattggaaattttaaacagatttttattcgaaattggcaatttttagttaaattacactctgaaaattagcatctcaagaaaaatcatcattgctgtcttgaaatcagcaaagtgatggtaaatgagaagagtaggtggcttttcattttaatctcaattttgttgctagatacctaatcgtagtcagattcttagttttgctagaggccccattcaaaacgaatttcaaagccccaaaaactctttgaccaagcggtgaacggtttttccggacaattgccgtctttctcggtttcgaaaaattttgacttgctgtaaaggattttagcggacttctgtaaaatttaacgaggaccagaatacatacaataggcatttatctgattggcgcaacataatatatacatacaatcgtgatcagaacgaggacagttattacacgcaataatacaataggatcgaatacatgatcacatcaatatacaatacacgaatgtacatttgttgttcatctgtgcgctcttctgcacttcggctcactggcccgcaacaaccgccaccgcatcgatcatgacgagtgcattcttcggcaacttgaccacctggaagaagctgcgcgcagggtacgtgtccggggtgaagaagttcttgaacgtttcgttgacatcctggaagtcgctcatgttggtcaccatgatgttgcagttgataactgaaaaggggcgggaattcactgatgatggatgatgtgatccgacttttgctcactcaccgtgcttgaaggacgagccggcgtacgtcagaatctccccgatgttggtcatcgcctgcttcgcctcggcgcgcgctccacccggcaccacatccgtctttcctgatatcatcccggtctggccgctcacgtacagcgtctggttgttgacgagcactgcctggctgtaaaaagcaaaaaaattgagctttcacaattgttgtccactgtttccacctgtagccggtcgcagcaggcgccttggacgtcgcgatgagacgaatggagggagtagtcatttggggaatggtcgtttcagaaattggacgttggtcgtttgttcgctgaaaatttgttaatttgaaaaat

SEQ ID NO: 7259 - DNA, 1591 bp, Heterodera glycines
  misc_feature (1492)..(1493): n is a, c, g, or t
tagggctgggatttttatgtgctaaaaatcctgaaatatgtaataaatatgtgctaaaaaacaaaaaataggcctaaatatgtgttaaaaatgcaaaaatatgtgctaaaaattggaaaaaccaagtgtatttacgcaaaaaaatcatatttaatatcagtctttatcacttttcgcccgacctccaattaaaattttggcgatatcaatcaatttgtaaagtcccggattaatttttccatcagttgaataagttccttctgggaactttgaaatccagtgacgatttaacacagcgttcgatttggctgctttaggcgcatttaaatatataaagaaattttctaaatgcttaagaaacgtaaagtagtcaacttttagggtgcattttcagattttcttgtattttttttacgatttttctcaaaaatgccaaaatatgtgcaaaatatgtgccaaaaccccgaaatatgtgccatatgtttttatgtgccaaaacgccaaaatatgtgtttttatgtttttataagtcgctctaaatcaaaaattgtttgagaaaatgctatttttgggcttctctcgccataactaagccgcaaaaaaaatatgttaaaacataaaaatcccagctctaatttttaaatgccaattttcaaagattataaattttaaattatttgaccaaattattttttaatggaaaagcaatgaatgaatgctatgacaaaaaaacaaaggctaacgaagctaatggcattttgttgaatatttaatgaaatccaactttaaaatatttttcataagaacgtgtatgcgttttaaaattatttagccaaattattttagcggaaaagcaataaatgctatcaaaagtacaaggaaaccaacaaaaaaaaagctgcccgttgaggtagttaaaatcgataaaaaatatatttttattataaacaagcaaaataatttattccttcttaattatataaaaaaattccaagatgctggcttattagaaataattgatcacttatttttctaatcaaatttattttaattcgaatttgttttctgcgataaaaatgccgttgttttcccaccggattggacagcggcgagtgccgtgcgtgcggcacgttcagcaacagatgcgcagcagcgagtgggccgcgacggcgacgggtccgtggcgagtgcgacttggccagcaaacgttcgctgtgcgaaatcagcgggacggtgtcgtcgaggcgacactgtgccaaaaaggaaaattcattcaaaaaaaggaaaagcctttttattagcgacaaaaaaatcattcgcgcgaaagcgaaacattttgtttggcatttaaaattatgggaacattttgaaaggtgccattttgttataaaaaagccatcaattgaaaatttcaataaaaaaattcaaaaaaggctaatagaaaactcattgagctatgaaatgatagcaagatcatttcatttttgttggnntcagaaagttttgaccaaaaatattttatgtttaattaaaaattttagttaaattatttttattttttatttcttgctatcattcgatacccctaaat

SEQ ID NO: 7260 - DNA, 3002 bp, Heterodera glycines
agcaaaatttatttacctgctcaattggcacgggtttggcaatgcccaaacggacaaattgaccaattggagcggcctaaaaacagaagagaaaagatgctttttgattatgagaaaataaaaaaatattttaaattgaaaataaaaaagttaattatataaaaatttaaaaaattccaacgtaaaaattatttaattaaaaattaaaaaacaaaaaaaaagtaaaataaattcattttgtgcaccttgagcacctccaccgccctctccaaactgctgctggacaaatcttcgccgttcacaaataaaagacgatcgcccggcacaattcggcctttttaataaaataaaaaataatattaaatttaaaattaataaatttaataattttcaatgatttttaaatatttttcattattttcccaccgtccgcttgtgccgcgccgcccggcaccaaactgcgaatgacaatgacccgctcagcagggtgggacgggtcctgaccattgaatgttcaaattaattccaatttccataaaatttccagggcaggtgggagaatgaatgctcgagaatggtgtcaagagtcggggcccctcggcactccaccggcaaattttaaagaattttttatttgcatgttcacacccgaaccgaggtccccgcaacaaaagtttttggaaattagccagccaaaagccatgttagccaaatgctcgaattcgaaactcgaaaacataaatgaaaactctttcggacttcagtcagtcattgtaccaaaagtttgcaagaatccgtgtaaaacccatttttaaagccgtcgaaaattttccgattaataagcaccgaaaaggaaggcaccgtattcccctcgttcggcacaaaattcccccaaattttgcctgatagtcggccacggaaaagccaagccctttggcgtccttgcgcagtgtgaccacaatgggcacacaatgccacaccgcaaagccggacagattctccagcgagcgggagcgcagccaccggttggcaccagcggcggacgacgcgcggcatcgtcgccgcgccgccgtgccgcccggcgacagcggtcgcgcaccgcttccgtcgtcttcgtcgtcgtcagcgacggaggccgccaaatcggccagccgaagctccgactttgcctaggaaattaaaaactcaacaatttccagtggaaaatctcagataaattaaatccgattttatggcgtccaaaaaaatgacagaaaaaagtgtaatttatatagataaaatttttatgatgttgaaattttccaagtatggcatttcgaaaatggcagaagataatgaatgtgacaaaaaagataaaaaaaattctaatttaatttttgtttacgagggaaattattaaaaatttaaaaaaacagtttttgctactgaaaaaacggaaaataattattaattgtaagctaaataaaaattgattataaaatatttgatcataaatgagatctgttttatttatttaggtatatagtttttttacaactttcgtttgccttgtaaaaacctctaaaataaatttttttcgaattttttcacgagctcttaaaatttctaatgatgaataaaatcactttgataaagtgctgatcaatggacatcaatgaggccaatattgggtaggccaacggcaaactttgctcggatggcatcacaaaattaatatgctcttaaaatgaaatttaaaattatttcaaatttaaaaaaaaaaattttaaatacccttttcagcccttcggcaaaaaatcagacggacaaattcgccgcaattcttttgcgcgccgttcaattcgttgcgaacgcgcacaaacgattcaccaaaaagggcagtttcattgacctaaaattttgtaataaatccgataaaaggattaaaattatcaaatttttggaattaatccgctaaaatttattttaaatttattaattaaactaaatttatcctcccaatgttttggcacctgtaaaagttcgtcgcccgctttcagtgcgcccgtttttgctgccggtccatcctttcgaatgctttcaatgaaatggtgggaacacagctgacttcctttattaaacaattaaagctaagaaatttgtgaaataaaaattttgagcattataaatgagcgctaattagttaaaggcaccaaaatttttttaaattttttcgttaaaaagaaagaaacatgtaattaattaatagcactgtcaattaggcgtaattaattaattaaatattacagatagaataaatttattaaatcaaaataataagttttatgaatatttatttctattattggtgaaatggcacccaaaaaataatatgcagctaatttttatatttttttcattaaattaaataaacccataattaattaatagtcctgtcaattagacagcaatcaatcaattaattaattagtcatacatttgcatggaatttcccacacagttattatgaagtgaaatcaaaaatttttcttatggatatcatgttgtttgttacataagggtaagaagcagtcagtctatgccatcgaaattcaattaattaaatttaatcctttttttgccaattttcaccgtcacaaatgtccacggtgccctgccattcgatgcccaatccgccgtcctccaacacacgctcgtccggcctcacatccaccacaatgacgtcatattcggggcccattcgagtggcccaatagctctgaaattaattttgagaatatttttacaaataaaatagaatattttccattaaaacttattgtaattaaatattttagttaaaatttttccgacttttatttttaaatatttatattcatttttataagtatttattttacaatttatagttaatttttaatattttatccaaaaagttattttaaaaatttgtccgctcctttttattaaaataattattttttttatttaaatttaaattt

SEQ ID NO: 7261 - DNA, 1698 bp, Heterodera glycines
gtaattaaatattaatagttatgagttttcagccttttcttttttaatatgatatattcatttttataattattaattttacaatttatagttaagtttcaatatttatcaaaaaagttattttaaaaatttgtccgctcttttttattaaaatatttattttttttatttaaattcaaattttccctcccccattaccttatagtcgaccaacgacagttcatattgttgctgagtttgtgtaattggtggcaatgccgagctgatgccgccgactgtgcttgaggaggcggccgactcattttgggaggcggcgacggcggccaattcctaaaaaggcaattaggcaatttaataatcgatttattaattaattgatataaaaaagtaataatgggaaggaataattatttattgacaattgaattgagttgccttttatttatattatttaaataattatttcattaagcatttataattagattaaaagcgaaaattttatttatttttcaaataatccaaatgaatcttttctactataaaaataatatgaaaacacaatgcaacattaattaggaatttttttgttttgcctgctcatgtagcatttttaggcacttcgcctgcggcgtgccctcctcaaatcggatcagtttcagccgcactctttgcccacttctgatcagtgtgcgcaccgattcggcctcaaattattatggtgaattatttttcttaaaagccgaatttttatttaaaaaaataatttttaatcttctcgcccaagtaatcagatcacaaatggaatagttgttcagaatctctgtgccggacataaaacggtcaaaatttttaatttttcataagccagaatctaatttttgattaaaatatggccaaattttttgattttaatttaaattattatttatttttaaatgattttcacatggctcagcccctccaggcttcgtccgttcacttccacaattaaatcgtgcagctgaatttggcgcgacagatgggccgacgattggggcaccagcgatttgatgaacacaccactgatctcttctgaacacagaaggggcaatttttagacaagaaaaacatatttaaaaaataaaataataaacaaaaggaaaaagccgaaggaaaggatttgtggggcgggggggggggaaagaacggagccaaaggcatttttccgttaaaattcttggaaaatttaaaagtttggcaatgtgttaaaattttggcaaaaaataataaaacactcagtctaaaaaattttgagtgagcccttttaaatttattcaattttttaagtttcctaatcatcttattaggttaaattaatccccaaaatgcccatttaaatctttttggcacaatttcaaaaaacgaatcgattttcgccctatagtttcgaaccctttaagatttatccaattttttaaaattttcgaattactaagaggtttaagcaaacccaaaggtccccctttacacaattttggcacaatttcaaaaaaaactaatcgattttctcgtgccttagttggcacaacgacgcttcactctcccttaaattcgtacaaattgatcgcccattttaggccgagtttcccacccctttaagcggcttcttcttctggggagattttcttcgcccttggcccgcccctctcatcacca

SEQ ID NO: 7262 - DNA, 2574 bp, Heterodera glycines
  misc_feature (2493)..(2493): n is a, c, g, or t
tttttttgagcgttttaagccatttttagcagtttttaatgcatattttagtgtatatttgagcatttttggggttttagtgcattttttcgggatttttagtgcatgttttatgcgtatatttggcattttttagtgcatacaacttataaccctattaataatatattcatataaaaaagactcatcaataatagaagagtttcctttttttgtagttttaatattaggttttaacatttatacttattttgaaaaataacttgaaaattttgttaatttattgtttctcgaaaatccctgataatcaatttttcagtatttggacattgtttccggtgattattttttcaaaaattttcataatgtccatgtctttctcaaaaattgctttctattaacttttcgctattgttttcataaattttctctacacacatacgggcaccgaggacaatttataatccttaaaaatgcccaaattttgcagttttgagcatttggtcaggcggtgccgaaaagggcagattatcaaaccctgaaattttaaaattaaaatttttatttaaataatttggaaaatttaaaaaactcaaaaatttctcaaatactcaaaaataagcactgcctaagaaataagctcagttggggggggggcactgttttacatatgggaacaaagaatttgactatttaatatttacagcttaataagtaaataaactttagatttggagggaattgccgaccaggttcatcaaagtgaagggattgtgccatcggtgaccaattattgaaaaatccaattcttctctctttaacttaaactttattcattgcaaataattttctctttgttaaaacgagcttaaatttcattagtgaaactgttctccaaacttgaaaaatttaataattattttggcaaaaatgtctctttaattaaaagttttaagatagaacacaaaagggattttagaaatttgtacaatttcaacagttaaaaaatgtttatttctcagcatcgccggtctcctcatttcttaaatttttttttaatagcgatgactacaaaaatgacctttcggacaaattctgttaacaaatcgtattaaaatttaaaaattttcccaagcggcgcctattgtcaccgcttaaccccccccccccccccggtgcagaaaagtttttttcaaaaagcgcaccgcaaaaaagtggttcaaaaagcaaaaattgtcttgaaattccgactttttaaaaaaaggagatccaaaatttggtacaggccagggacgctcgtttaaacgtgctttttcaaaattccataatggctaaatttagtaaacttggaaaattagagaaattctaactcgtatcgttaggtttgaggccgcactttcacgtttaaaaaattaacaaagggtttactaagccatacttagtcgttggtctaactttttctctgtccattttctcttcaatcacattcgaagaagtccgaatcgatgtccaaggctaaagttaatcgtaataaagcagcatggaattattcaaagttttttgcttgcttattgatgaaaaaatttcacttttctcattctgtaatgcacaaatatgagaggtttttgagcaaaaaaaatttgttgagcctatgtttttagcaactataaattgcatccctagttatgaggccgagaccaaagtgtcaaaatggattggccaacatttgcgaagctgacattatcaaaggattcgaattttatcccaaaatagtttgtccagccaataccctaagctattataaaatgaaacccgtgactttgctcgagtcgagaactctcggccgacactctcgatcagctcggacctatcccccaattaatagctcacacactttcaggacaactctgaaaaaagtagatgtcactagaagcaagaagctcttcgcgagcaatggccatgtcaatgcggaaaaattcgatattataagcagtgggcgcattgtgaagaacggcaaagtcagagcggataaaatcatttttaaatgtgccgggatcagttccattagtcgaggccacaaagaacgctcgatagagtttgaattcaagcaaaagcactgtaataaaaattaattggaaatttactaaattttgtgaaataattcattaaaatatttatttttaatgaaattatagtttttattgtaaaaattacatttcatcagatggaaaagacacgcgccggaaagattgccagcacatttctgcaaacgttcaacggcttcatcaaataagacagcctaaatacgagctgctgaaggataccggaattttaggcaaaattcgggacggggaattacgggaccaaaaaagggaaaccgagaaacaccacaatgccggtgggaccaaaaatacttgatcagctccggtcgagatacctgtctagcagggctggacataacttgttttcaattacggaaactcgtaaccctanactccaaaaaatgctgtaatttccgtaatccgcaattacgtccagccctgctgtcccgtgaaagatcagtcagaaatcatg

SEQ ID NO: 7263 - DNA, 1424 bp, Heterodera glycines
agatgtaaattcaaaaagaaaaatcagttggcatgccaaaagcttcatttcttctcacaaagctttttgaagaaaaacgttagcatgaaaatctcagaaaatgttatttaattttgaataaataatgggacacttaaattagtatcatagagaaggagaagaaccaagaaatttagcgattttcatgagacgagactcagaagaataaaacataaacgggacatatccaaaaaacatattttatatgcatcaaaaaaatggctggcaaattagcaaaaaaagggcaatagcagcctagaaaatcgatcctaattaattgtattaaaatatgaagatttgtttttttaaatttttttttctacgtaattttaaaatttgagcaaattcagaaaaaaaccaatcacaatcagcacaaagccttgcatacattaaaaaaaatttaaaatcaaaaaaccccttgttatgcttaaatttttgtttccaattttattatatttgctttcataaatatttgttttctagttttaatagaacctctgacaaaatgagttccgctgctgctgctggcgcggctgtgatgatgagcaaattcattttttggaactttgaaatgcctacattttttaattaaattaattacttgaaatattaagccctacaaatcttgcaattttaaaatttaattttataaaataatttttggttttaattaaacgcagattttcatttttttttcagtcgaatcatttttggtattgaaactgttcaaaataagaaaaaaaaagtttttaaaattaagtaaaaaaatttaaaaataattttttttaagacctaataaaatataggtattaaaaaaataaattttaactgtaatattaaaaaattattcataaactctaaatcttgtttctttgactctggaaactttaaaattgtatttcatatatcataaaatgagactttttcccgaaacattcgtaaaaggtgtgccattggcacttttacaaaaaattttaattttttattaaaatttaaatgctcaaaaaccctcgcgaatgcaggttctgacggtgcaattgactggttgcctgttgttgacgttgctgctctgcaaggaaactgctcaactgttcggctggcgatggctttacggcctcattggcattgtgtttaagtgtgattctgttcagccctggcataccgtacagccatgggaactgttgcaattgctcagagggtaaaaatacttgctgcggcataatttgctgctgttgcgggtactgtgctggttgcagttgtgattgttgttgtgcgtactgtacttgttgcggattctgtagaaattgttgtggtgcctttcccttatcattcatctgtgcattgtttttgttgtcatcattcattggcattccgtcacaacgcaa

SEQ ID NO: 7264 - DNA, 2400 bp, Heterodera glycines
cctatttttaatacaataagtttgttgctcagttcaatgactttcatcatttatctgcttcttggaattgcagtacatataaaagcttcaggtaacctcaagaatgatggaattaggggtggtaaaaaatttacaaatatttttaataactttattcctacaaaaacaaaaaaaaagtcactaccataattcgaaaagaatttccattattaataattagtcctttttagtgactacgcactttattaattctcataaaaattgtttctaaattcataaaacgtttctctggaaaatggtcaaaaaattgatgttccatcctcaaaaaatttccggcattttttgtctcaatgcttaaattctttgtgggtattacaaaaccaaaacatattggtagcataatattcattaatccgttggcaaattttgaatatatttttgtattgtatcggtcctgaatgaggtaaaatttttacctaattaacgcctttaataggtttgccgtccgccgattcgttcaatcgtcgcacttttcgcgcacttttttgcattatcattgttaatatcggcggctatttctttacactaagttgttacattttgttaattcccacaatttcatcgccgatcactgcttggttttaccaagcaattacagcaattccttttaacattggctcagcatcaagcggacccattttatactttacgaggtgttttttaaaagaaaaatatattttttaatttaacttcctatttcagtactgaatatcgtcaggcattccaaacggagtttccatctgtattcaaacgaattttgaatgtgaatcgagtaattccgctgcacaatggacctcaattaggcactacacaatggtgaatgatgtcatccagcagaagatgctcttcggtaccagcccaatcattaattggcacttaattgatgccgcgcgttccttggcctattggcccagaaatcatagaaattctctctaatgttttgattactaattcatacaacagaataaattttacttgttttttattttatttgtggattggtggatagtgcttcaatactaacagtacttttgtcatgagttcgattccggctaatgttttcctttaatttatttattttttctgattaatacagggtttctttatgttcttgtttctaagaaatgttctgatttgggggtaatgccttattttcatctaaaagaagaaaatttctgaaaaatttggctaagtactaacaaaattcatataaattctttaaattttccccggtggcgcctatcggcaccgccggcccccaaaattcctatattttttcttaaaaattatcccaagctcgcgaattttgctcattttttgtacaaaatttgttaacaaattgcatttaaattttcaaaaaattttcccggcggcgcctatcggcaccgccggaactctcccctcgcacattcatcaagtttttttttgaaaaatgtgccgcaagaaaaaaaatttaaaaaatctgagttccaattttgagtaatcacgataatttaatatagttaaaaacgaaaatttatcgaaaaagtcttaatttttttggtgaatatctgttagaaataaatttaaaattcgcccctatcggcacgccccccccccaaaaaaaaaattttttttattaaaaaaaattacccaaaaatccctaaattttggttactttttagtcgaaatctgtgcaatttatgtcaaaagaaatagtatcgaggcgatcaacaaataaaggaatgtggagccaaagaaagcattcttaaaaaatatatttttgtgagatttttggacctaattcaaagcaaacccccgcccccgtccccgcgggggcgaaattttcgtgcccccgtccccgcccccgcgactctgacccccgcatcccccgcccccgtgaaaagccacccccgaaaaatgattttcgggccgtttgagtatatgtgaggtatggactgtccaaaaaaatggctatctctttttttggcaatctggtaatagaaatctctttggaaacaatgacagtggctgtcatcaggtgttatgctctaaaaatgattttcgagccgcttgagtatatgtgaggtatggacggtcctaaaaaatggctatctctttttttggcaatctggtaatagaaatctctttggaaacaatgacagtggctgtcatcagttgttatgctctaaaaatgattttcgggccgattgagtatatgtgaggtatggacggtccaaaaaaatggctatctctttttttggcaatctggtaatagaaatctctttggaaacaatgacagtggctgtcatcagttgttatgctctaaaaatgattttcgggccgtttgagtatatgtga

SEQ ID NO: 7265 - DNA, 1938 bp, Heterodera glycines
  misc_feature (11)..(11): n is a, c, g, or t
tttacttatantttggattgccacgattattatcgtactcttatcttgtcgatattgtgcatggaaattgaattgaagaaaaataaaagcagcaagaaaattttgaggaaaatgttaataattttaataattaaaaataatttcaattattaaatttcaattaaatctacatagaaaattttttcctttattaatgcaatgaataaagcaagttgacatttgaatgaatgcatactaatttataaaataaatgaccatcattaaattctttaaaaaatttaagaagaatttattatttaaattatatctttcaaagcttatgatcgggtattctgcagtggaataacttgagtcacatttgaaattcgtctgaaaacgaatggaaactccgtttggaatgcctgccgatattcggtactataattgctaataaatattttagtttttaaaattttaaaaccttgtaaaatataaaatgggtccgtttgacactgcgccgaaagtcgcaggaattgccgtaattgctgtacaaaaccaagcagtgatcggagatgaaattgtgggaattaacagcaaatgggaaattgcagagaaccaataaccgccgacattcacagtgataatgaaaaaaagtgcgcgaaaagtgcgaggattgaccgaatcagcggacggcaaccctaaaaaagagctaattaagcaaattgcgggctattatgaatcgagtgcaataagcataataaatttaaatatatataaaacctactttgttttgattgtgattaaaatcacagacaaattaaggatggcgccaattactatgatgactgcataaattcctgcaattccaatcagagaccagctgggatggacatctttgaaggccaaataaaactgtaaatttggatgtgatttcaagaataaatgcatatttaccatttttgcgtttttagagcatattttggcaatttttttagaaatgataaaaattttaaaaattcgaaattgcatatataaatttagaaaatcaaatttttttggaattatctaaaaacgctcattagcctttgttttgatgtttttaaagtcgattctgtatttatacataattttggcatttttttgagggttaaaagccattttgagtaattttaaggcatattttagtgcatatttgggcatttttcgggtttttaggccatatttggaggatttttagtgcatattttatccgcatatttggcattttttagtgcatacaacttataaccctagttatattaattataaataaaaatttatcttttaattaaagaaattgctaggaaaagaaaatgttgacaagataaaaagtgttgccaagcatttactgaagggataaacttgggcaggacaattctcccgcatttcatttcgtgacaaaatgtgggacaaaagtaattatcgtttaatgaattaataattattgctacaaagattgtggttaaacaattaaaattttgcactcgacaaactcccgcattttaattgtgagaagtaagtcacgaaagtatcggtttaaaatgaaaggtcttgctaaatttaaaaaaaaaaaaattaagaacgcttcttaggggtaatttttgatttttattgctttttattaatattattaacattttcaaaaaatactgaaaaaggcatgataaggcaccaaaatcgcgaaaaggcaaaaatcgaagtaagaaatttttaaatgtttagtttgggaacagggatgtgcgaaaatcacaaaaaaaattttcgtatacgaaaacgaaacgaaaaagggcattcgacacgaaaacgaaacacgaaacgaaaaaaataccattttcgtaccaaacgaaaaaaccggaaattttttaaatatattccattttatattaagaactttaaaattgtatactctaactgagggaa

SEQ ID NO: 7266 - DNA, 1000 bp, Heterodera glycines
  misc_feature (50)..(50): n is a, c, g, or t
aaaaaaattgaggatttatgaccataaagatctatttcaacaaagaaaanccgggatcagcagggacggtccaaggatttcggcttggaagagacagacaccgacaaacggatgaccgtgtttttattgggcagaaaaaaaaatgttttcctcattttcaaataaaattttggagaagagagggggcggggcgtactggagatgccaataggtggaagcgagaattttgtttttttttagaaatattggtatatttgtaaaaaagatttaacaaattcaacgggggagagctcgaccttggagggggtacaaatctgaaaaaagcctatgtttcccttaaaaattttgggtgcggaagtgggggtattgggggagaagggcatgcatgcactagggttggaattccgagaccttaaaaaatgattattagagcccccttaaaaattgcaagaagtcggaattccgtgtctctcaaaaatttcgtaagactaaactcagaatttaattcaagccccgataccgtaccatgcagcaacgggaaactcccggaaagtgggtcagtaatacagtatttctaaaacaaagttctgtagcatttcattctgaattttaattcaatttgttaaaaggtaaataaaactgagattccatgcttcattgatggccttttccactgatccattttccggttacgcctcgggaccatccatgtggatcagggatttgaatcgtggcagtcttattttttcgctctcaactgcctacatgtgtaggcagtctctatgttgctatatttttggagtgttgttttttttccattttcatataatttgaatgaccctttttcagtttgttttcccgacggttgacaatgaccgcagtgatttgttggtccataaaaatgaggacacatgcgagaacagcagggatgaatgccagcggagctgtccacaacggattgccactgaacggatgaaccaaccagccacggccgtgccaa

SEQ ID NO: 7267 - DNA, 1062 bp, Heterodera glycines
agctgtcccacagctattttcgatcaaccattacaccatctctaatttattctctacaagtctctctctctctctttgtctatcgcactatctgtctgccgttttcttttctctctctctctctttctctatctcaccttgaacagcttcatacaagcctcgtagacgaaaatgacggcgatcagcatggcaaatgattcttccgtgaagcgggtaatgtaggagacaagcgatgaagcatcagtcgccaccatcacaaaaagaatcagcgcggtccaaacatggacccaaaagcggaaggacagatagttgagtgacaggccctgatcagagggtgcaaaatttaaaaaactgagtttctatactttttttgaaaaaacttttaaaaccaggctaatagaggacatttagggttatcgaatgataccaagattgttggatttagttggaaaagaaaaaaagttatagccaaaaacttgtactcggacgaaaataatccctatattccttaggctaaataacccctgaaatagggattaataaaaccgcttttcccctaaactgacagtgcacatgtcgaacacgatggtctcaaacacgagcacgggcccagtggaaccgatgatggtcagtggttgtccgctgaacagatgatacatcactccacagatggcaccgctggctaaattttccattgccgcctgaaatttaaaaaaaaaatgagggagggggggggggaaatgtttttttcaaatcatcatttttgaacatgatgaaatgggactgctgctgatcccaagaaagaaccggcgttcccgttataaatgggtcagaaatactgtattctctaagaaattgaattacctgtttatttacggtaatctacatattaggacctgaattgagattccctagcattttggggggcgggattttttaaccaaaacgttcctcaggttcttactgtacctacacagaacaatcgagcattattcattcatttccacgatttctcttactgtattatatacactttcttactgtaccttccccgtccttact

SEQ ID NO: 7268 - DNA, 2243 bp, Heterodera glycines
agagattgtcctcataccgtatccatttaaaaaacacaccgtttcactgacatatactttctgctttcccaatttcgctttctggaattcagtgtttagcagccattccctacatttttcttcccattcattagtggtgcggtgggaatgccattttttgcttttgcgtcgcctttgtcaccgccaacggcgccgccgctttttggcaatccgtcgctctttgctttcccaccatttttactcttctcaaccgctgtcaacagttctttttgtgcctgaattttcattaaattcaatgcataattattattttgtattcatctaaaaaaatgaagtgatcggatgaaggaagtcccggaactgagagggaattttcctgggacatttttacaatagcccaagatagggactgtatcccaggggggagggggtaaaaatacacggaggacatacaccaacccccccccctacccaaaggggggggggggaattttttttacgaaaaagagaaaaaaacgtcgaaaaattggctgaaaacggaattttgaaaatcgaaatttgacccagatatgctgatcgaacggcagtacattttgataccattcttttatttttttcaaaattcaatccaaagaattaagatttggtttttgccgagactctcgagttgcacaaaagtgcacacaataaaatatgcaaatgtacttcaaataaggaggcactacaccacctgaacacgactctgttgattggggatggaacttggcggttcaatccgaatgttcgggtcccattccccgggtggcagcacagtgacagcgtccaagaattcgtcaacaccgtccaaaagatctgaccgctgtttggctttgtaggcgacctcgtggaaaatctgagaaacacagcagcgagtcagcaaatgcatagtaattaaaaatttgatttttttaaattgattttttagggaacaggacaaagtttcgccgccgaaaaattaccccgtcataatttagccggccgaaatttcgccgagacaaaatttttgaaagcatttgttctattaaaaaaatattttttaatactttttattaaaaaaaatacctgttaataaataaaaaaatttcggagagtgtggaaatgtattgcgcccatatgcatatgctcccacgatcttattgatcatctctatgtattcacctcatcggacattaaagtggcaattgcgcgtccaatttctttgaactgtgccgcatgcccggaggggccaagcaacaaaaacagaaagcgcgttggcaccggcacttcagtcagatcgccaagcagttgggccttcttgagacgaacaaacgcagtgacatgatgggtgaggaagtcaacctgagtgcatgtcacacatttttggagaaaatttattaattgctaaggggtaattaactaattacctctcccactaaaacattggacgcctcagcgccgggcggcaactttttcatgaagtgcatatttcgtgcaaaaaagtcactgctctgcgaattctccttttgcatgtccttgggcaaagaaccaaccttagaaacaaaaaaatgcaccaggattatctaattaaaattcttggcataatttatgtgacggaattatataacctaatgaatgaggacaattactgcaaaattcagtcgtcgtggtgattaagcaaatttttaaggcatgcattgatatgggggaaaaaaagctgcaaatcccatactgatgcatttttgggaagccatattaagtgttataaagtctggaacaatttgaccaaactgctaagggctgacagttttgaaaaaagcctggaactggacatgggttccatgttgggcctggatttcctgaacaaaaattcaggcccaggaaaaatcaggcttatcatggccttgatccaggcatggacctattactcactttgggcagctcaagctgattgccggatgtttgccgcttcgttggactgtccgaatctgtgcaacgtccctgcagatttttgccatgggaaaatgtgcggccaatgtcggaaatggagcgaacggcgctcaaaaagcttccctggcttgatccgccgtttgttgtggcggaatgccgtacctttgagagaggaattggcaaattttggcacagtaagcaatgtccattaaaacaacacaggtacggcatgtttcaaagtttttaggcggagggaggagggggcaaagcggaggtga

SEQ ID NO: 7269 - DNA, 2588 bp, Heterodera glycines
atcaggacaatgccatggagaagacatgatctgggatggggacagaaaatcattcattgccattcattgactcgactattttgatcaaactaccgtaattggaagagggcgtgcagagaaagggtggccacgtggggcttggacctgtaaatataaaaaaaatatccatctgctgatcactctctctcgttttgtcattttggcctctttcctctctctctctctctcgctctctctcattttcggcatttcaccaatttccctctcgtctctctcctgctctgtgctaaccatcactctctctcattttgcacatttttggcatttccctatctcgtctctgtgctcaccatctgttcccgccctcctccacgtcctcctcgaacttcacccatcttgccgtttctcgccattcctccacatcaccacttcgccacagttcgcccatttccgtgaacactgctggcgaatcatcctgctcattaagcagaaacatcactcgagtgccgggcgcttattaagtgtccacgattaggaggaggacgggaatgccaaaatcacacaattacccaaatcctccattcgctgcatggtcgaaagttgtggcatttgctgcaactccagggagtcacggttgcgcgacatgcgccgtttgcggatggattggccacccgtctcatcggcacggtgaatgcccatagaccttaatggctaggaggttgatatttcattttttgcgccgcaattccggattccgacagatggcgctgagattaagcatttggggttttttggcgtcaggattccgcaccgccgcaattttttatgccggaaatgcgcatttcgacagtttttggcgccggaatcctgcatttcggcaattttggtgccggcacttggcaatttttggcgtcagccgcattccggcatttttggctgcggaactatccctggccagcaggacagaccaactgggttgtcccgcgcccccataaaggccatttttttttacagattttgcccccattcacatccaaagtgattcgcgtcggtcagcagcgatctctttgtccgtttgatgaatgttggccaaagtgtcggcggaagttgtcggctgagtttggcctgctgctggctgaggctcttccacaggtgcagcgggtccggtaattgccactttgctagcggatccagaggctgaatgttttctcttataaattaggaccgtaaacggcggccgccggaaaatgcgtcagtaatacagtatacgacggtgaaaaggcgttagtaatacagtagtatgcgttagtggaaaatatacattatatgccaatggaaatgcgtcagtaatacagtatttatagcattaaatattatacaaaatacgaaaggtcaacaaaatgtatatgaacctcattaatttcagttttttgaaaggttcaacagttttacaaatatactgtaattggattattgtattgtttatttccatacattcaattagcgcataaaatcaaaaaatcaattaccttatctcgtttttttaagaaattctgattcactgacgcatttttccaattctttggtggggggtatttgctaaattccaggacaatgcgcagaaaaaatatgataaagcatacaaatacgggcaacattgcgataatgaaaagctgctgccatgacaattcttttgagactaattgatctttgaccaactggattttcaaaaatgaacttatggcgccgcccccttaattgactcattagacatttattagcctaaatatattttaaaaatgaacttacggcgcccccttaattgactcaataaacattcattagcccaaatacaacagatatccaattttcacctttgaaagctgctgccatgacaatttgtttgagactaattgatgtttgatcaaaaaataggggttcaaaacgaatttatagtgttgccctcttaattgacctattagacattcattagtcaaatacaatacaaaatgaacctgtggcaccccccccccccttaattgactcattagcccaaatacaataaatatccaatttccaccttctgctgctgacattgttgaaggggcagccgatgacattttgtcaccgttgttttggctgttgttcatcttcttgaggttgtcagtgaattggcacaattaatggccaaccttgaagcgattggttgctgcttctttaacttataaaagccattgaaaaaatgaaaaatgcacatcctagagaatggcaagaaatatttttagcgagaatcaacatcagaaaaaattctgagtggaaacaaaaagaatttctcggctcgagactctcgacggtatgactctcacacacgccgccacacacgcacatactacgtaatttgctgctaaaaattctcgatcacgattttcgagttgagaaaattctcgggttttttttttggtctctctgcctcgactcttggtatcagttttcgagtctagggatcaattgtcggtcgctgttctcgagtctcggaaaatctcgactatagtatttaatcaaagcaccttttggcgctgaaatttagg

SEQ ID NO: 7270 - DNA, 3117 bp, Heterodera glycines
ccatttcctctctgattttttcgtatccatttatcactttcttttgcccttcccaatatattttcctctccaatttttctttgctttgctttatttttacgttcaacaaataaacatgcgtcacaacaaaaatgtacgattcgattttactgcgcacttcgaaaatttcctccgtaaaaaaatccgtgtataaattgtccaaataaaaatgcggagcaccgtcgcagggaacggaagtgaagagcatctcgtagtaccaagaggaaaatcctgtaaagaaagagggaaaagtggagagagagagagagagagaagaggggagagagagaggggaagagaaagagagcgagaaagagggggagagagagagagaggggagaaaaaaggagagggaagagatgagaaatagaggaaggaagagagagaggaggaagagagagtccatgtccggaatacaaattaatcccaaaatatacgcctaaaataggcataaaggtaggccggcttttgcgccgcggaatttgcggcggcaataaaaaacagacatttgcgccgcttcattcaaaaagatttcgatggtttgaatgagccgttggttcgcttcccatcggccgaattaatcttttttttttcttttttttccctttcgtttaatttgttcaaaattctttaattttaccttttacaattgcttcgcgaattgtttggccacagaatgaaacgtccaaattcaacaacaaaattaaaaagaattgcaaatgcatttttaagtttcgattggccaattgcttttctaaagactgagaaaacccatgaaagcatattaaatattaatttgaagaaggcacggataatgatgctaattgataacaattagggcccaatttaagcagaaaatcattaattaataattttcaaaaataacgaaatatgcgaaatacgcaacaacaaaaaaattaggtgaggaaaaagtgtattttttcatgcttttagttgtggcaattagccaaaatcaaattgtaaaaatgctttaaaatccgtcgcattaataaaattaaatggaaaaaatgcagattttttaaataattagccaaaagaaatattttccatttctaacaaatttatttatatgcagaaataataaaataaaataaaaaggaaatcaattcgatcaattgacaatcacaaattaaaaaaatgaaaaaaacattcaaaattaattaaattttattttcttttaaatcgatcgtttcattggccttttctgatcaaatcagtacctcgctaattgactaaatttgcccctcttcagaagaaaatgtacccaacgtcgatggcccgccattcgacgccgctttcgttttggccccgtgcgattttgaacagtccgtcctcgccccaccatttgttccacgagttcacccccaaccaatacttttgtggcgttccgtccgtgccgttctgctcgccccatccgatcagtttgaccgcgtgtccgccctttagctcaccccacgtgtgctaatagagaaacaaatcaaacgaattgtcgccatcgggcactcttctgagaaattagtctgtcgatgatcagacccattaaataatattgtcgaattcgtttcttttggccaactctgatcagcgaactcagaccgtgccacaatttgttgtgccgtactctgtaaatgcctttgctgtagcggtaaaagtcctcgtacacgtcgatgctgaccaccaccgagccgaagtagtaaatctgaacggtgtgtccgtccgtttgtgccaattactgctgctcgagaccgaaaatttcccgagactcgagaccgagacttaaccccgagaccgagactcaaccccgagccgagaccgaaaaccccgagaccaaaaaaaccagagacttttctcgagtcgagaccgagactctcgagcagcactggtgccaatcagtggtgtcttgcctctgccatgattcctctctcgctgccctccaacattttgccataacattcgtccatccttcgctcttggcatttcagctgtccttcaaagtcgtccatgccccagtggttcgttttgatcactgaaatgttaccttttggcctcccctttggcattttccttctcacccgtgcggtagcgcgtctcattgctcggcggcagaatgcgtccgctcagtttgtccatggccatccgcttccatcccgcttggcaatgttccgtacactcgggcgccttccgctccttctccgggtccgacttcagcggtgggaatacgtacggcttgcacccggtgccgttcaccaccggcgcacccgtcaaatagccgtacttctccaaatacttccatgccaattgtggcgttcccccgttgcagctgaattgcaatttgcctaacccaccatggtttcccccatttttccgttttcccccattttccgcattgaatttcaattcgtttttccgtttggcttttcgcttcgtacccatcggcttcctttgtgcaactgatcaggtccatggtcgatgagtacaggttcgggttcttggtgaacaccaaatagttgcggagtgtcaagaaaatgcacgccctgtcgtcgcgcgcggcggccgttgcgacggcccaacacgcgccgcacttcccctggtcccgggcgaggccaatccacgcggcgcactgcgggaatttgtcgcgcaagtcgtagtgccgcgggaagaccgacatgggctgggcgtaggccaaagctatgtactgtaagtagccgcgcaacgcgttttccaactcgcgtttatcgtactccgtgtactgtaacagtagaacgatggttactgtccaagacccaaatggacaattcgcgcttttttctgtcccatttaactatggcattgcaattggcataccgtaccgcttccctgtacagtttctgcatgtgttccgggttaaaatattgcggtggttgcggctgtgggtactgattgaacggagtgtagtaatgtcgcgcatattcgtattgagaagcagctgcgtaatgcttatacaattggtcagagtactcaaaaaattggcgatcgttcgaattttgctggtactgaatcggccatgcctgcttttat

SEQ ID NO: 7271 - DNA, 1314 bp, Heterodera glycines
ctccttccctttttgctattcgttggcattatgccaagcatgtgtcctttgcttgaatcggacattatggcaaatgtttcgtgcactttcgcctgtgtcaatttgtctcattatactaagtttccttagttcttcttttcttttcccgtaccctctcactgtctcactgtttacttctccccactttccttttctccatcattctctttctccctaccctctctttatcctcactctttaccccgctctctctctctcgccctcttcccatccacctttctctctctcctcctctcaccccctctctagtgctgttcgagaccaaaaatttcccgagtctcgaagccgagacttttctcgagtcgagactcgagaccaagaatctcgaacagcactacccctctcagtgttcctttctctcttctctctctctcttctctctttctttttgcccacctcccatcccattccgtcgcttttgttgtctccgttgatcgttttcaccaaattctgttccttttttagcatttccctttttttctcttccgttatgttcagacgccctttgccgctcaccgtttgattctttcaaaagcattacattatgccaaaagttcaaattgcctaccaataatattccatagggaatgccttcgtctaaatttgccacggcattccttttacaaatggctccaataagcgacgaattgcacggcaaataaagccacgagccttctttggggtctaccgcggcacaaaaggaatttgtttcatttgaaaaggaaactgaaaaaggaacgaatggaacagggaaaagttgagaatggcattttcaagcatttaaaattgacaaatacgctttctttgatatcattaggttgggtgttcaaaagccaaaatgttcctttcctcttcctctttctcttcctatttcccttcctctttttcttcctttttctctttttttcctcttcctcccccgttcatcttttcctttcgcttcttcttcctctttcttttcctctttctccctctccccgatttccttttctcttctacatatctctctttctttgggcctcactttcgcttccgtccgccccgcgggtgcagttctcgcgctcccccgcccctctgatgccaacccaaaatgccattgccaattccgcttgtcccttttctctccgttcgcccatcgccggcacaaatgcgtccttcacaatgcttttcaagcaatttgtgctcattttcgtccaaaatagtcgtcccagggggaggtgaactttttgcacaaatcctccgcctgggcaaaat

SEQ ID NO: 7272 - DNA, 1567 bp, Heterodera glycines
  misc_feature (40)..(41): n is a, c, g, or t
gagaaaaacatttttttgctgggggaaatgacggaaaganngaggggggcaaacagagggaggggccattcaaaggggaatttacgggaaaacccattatcattaacggggggggattggaattgaacgcacaattgaaatcatttacataaactaataaaaattgatttaaaaatttaaaaagtaaaaagcaattaaatgataaaaatttgaggaaaaatataaaaacgtattttttgttaatgagcaaaattaataatgcaaattaacaatggtcgcagaaacaccgaatgatctttggtcgagcaccgatcgccgccgatgcaaattcattcatttgtcattcatttgtcagcaaaaacttccattttcttggcactcaaaagggagtttttcaactattttataaaaaaaataaatcataaacaattttgtaaaaattgtaataaacagtttccttacgacgaaaatccaaaaatggaccaaaacaataacatttcccaaatactcaaattttattttttaaattttgttttttcgattatttgcaaatcaaagggaccaaagggcaatttctccgtttctccagcggtacaaaaacagctaatggtcggggaaagcttttaattgagcatcgatcgacggaagatgaaggaaagccgagccgtgtttatttgaacaattttagcatttccattttatccaacaaatgaatatttacgatttttattttctattaattaattaattatcaattatttaattgactttttgtttatggcaattctttcgcgcaaatatttctctttttttccttttatttcatgaaaaagtcaacactttcagcagacaaattaaccgacaaaatgaaccttttgccaatttcgcttttattcattgctgtaaaattagcagtgaatgcgccaacaaatgatctaattggtaattattcattctgtgcattatgcccaaaaaggcattttgtcattgtctgcccattaattgcgtaattaactaattaattaacccaagggaattgccccgcgggagagattcgcaccgattgtcggccggtgtgtggtgaaaagaattgcgcagacgttctatcgccggacagtgcgaggggcaattgcttttcgttgcgctgtttcccggggtgcgtttgtgcgagcggaattcggcactttgggaagggcggcggcgaatgtttgacgaaggaaaaatgcgcggaaatggcgacgaaagaccaaaacggcaccaaatgaagcacactcagtggcaggaaaagcggacaaatggaggaaaagcggacaaatggaagaaaagcggacaaatggaagaaatgaggaaaagcggacaaatggaggaaaagcggacaaatggaagctcagagaaacggatgagatgaggaaaagaacttgagttatcctatattaatgaaatacaaaattatttatcttaaaatgcatttatatacatattattataatgaaaattgatcattttcatttcataatacaaacaaaaaagcctttaaaattaccaatttaaatttaacaaattattt

SEQ ID NO: 7273 - DNA, 1104 bp, Heterodera glycines
aattaattctttattaatttgacgcgcaccgtctctcccgggaaagccttggtctcctttctggccaagttgtcccggcactcctggaatgccgtccaccccgcggtcgcctttgaagccaggtggaccgggctgtccgggccgaccttctttaccctgtaataaaattttttttgaattttttacattttttgataataaattttacccttggccctgctgggcctggcagtcccttttcgcccttcatcccaggcagtcccggctgtccaggaatgcctgcttggccaggataaccgcgtgggcctgtatcgccaggttctccctgaattataaattaaaaaatttatttttatgcaaaaaatttaataaattttgaaacgggcacacaccggcacagaagcagcaattgaaggcatgtgagggcattttctatattagtttctatgcaactaattaacactacgtaagcgaaaaattttggttagtatttataaataaaaaattatttgaaaaaatttaatttaatttttaatatttaatatagtaattttatgattatgattttataaaaatattttgataaaaatttaatagccaattataaaatttgtaaaccaaaaatgcaaaaatttatattttcatatttttaaaggaagttattaaaagaatatattcaagtataatcgtgttttgtttttaattaaaaatttttataataaatattattttttaaattatttaaattgagaaaataataattattcaattgatttaagtaaaagagcataaagcatttaaaataacagttaatttttttgatggggaaacaaaaacccgcgcgcgcgaccttttcaccctttgcgcccggatgcccctcagggcccacaattgtgcctttgtgctgggtcagcgccgccggccctggcggacccggcggtccgggaaagcccaggtcaccctgaaaagtgcaaaattagcggtgtgccgaaactcgccttggcgcctttgacgcccgggtagcacgggcggcccaaccacggagccgcttggtccggcgctcggggaggacccggcgggccacttggacccggcaaaccttga

SEQ ID NO: 7274 - DNA, 1475 bp, Heterodera glycines
  misc_feature (5)..(5): n is a, c, g, or t
ttttntgggtcgaaattctgggaaatttttaaaggccattaatccaatatttttgactcgccagaataggtttggtatttaacaattttttaattaatccctttttttaggaaacaaatttggctaaaagaataatgtttatgattaattcattagtaaaaaaaaaattttctaatcaagtatttttttacatgtcctgggttgccatcattgccggggaagcctggcgtgcccactgggcctcggtcacctttcacgccaaaaggtccgggagggccttgtgcacccttaaattaaaattttttttttttttgctagaatatttgacttttagtccttttggcccttgcagtccttcagggcccggaaaaccgcgtgtgccggccaatcctggaggcccttgaggcccaggcggtcccatggagccttaaaatcaattaatattatttgatgatttattcttaaataacgcattaataaatgtcagttaattaattaattaattttagaatgcctttttctccaatgcaaaagcatccgcgctgtgtacaatcacgacaagctgattgctgaattgaataaataattatggtaataaatttatttatcgggtattaattaatttttctgacaatgacaaccgtttccactaaatttgtcccgacaatgaacagaatgacaatgacaagaagcaatggcctgaacagaaaacaaacttttatatttaaagataatgaacaaatgaggataaaattgaaaagaattttagaatgccttggttatgaaaagaaaatcctaatttttcagtaaaataattttttaaattaaatcactttcttaaaataagaaagaaatttgttttgaaagtattagcatttttgcaaaatgacaatcattttcaggattatcaataaaatgtgaacaaattaaaatagtttttaatttttaaagtttgtttaatttcattgcaaaattgaaaattaaattttattaaggcaatcaaattttattaagccaattacctcccttaattagtttcaattaatgccccaaaatttaacatgccataatgcaaagctgcgaagcatttgctccatctgcttgatcagcggctgcctttgccgactttggcattgttgttttgccgttgttgtctccatttccctgttgcctttcgccatggcgactgatcaccgaagaatttgcagctgatcaccaggatttttaaattatataagaattctaatggccaatatatcggcattaaaaatattaattaattttgattttattcacaaacaaattgatcaaaatttatatttgaaaatgtttttttcaaattttccaaaaataagaaggaatttttgtgaaattacgcgaacttttaaagtaatttatattaaaatttaaaattatcttatgaataaaattgcaatcatttttttaataattaaatttcttttttacacctgctg

SEQ ID NO: 7275 - DNA, 3667 bp, Heterodera glycines
ttccaggttgaagcagatacttccccatccatcgaccccaataaatccctccccccccccccccccccgcctcccccgtttctttattatatcggagaccaaatgtccccaacgaataggcccagacgcagctgtccccccccccctgcgaagaatcgactgaattggttgttggtggttggtgattaggggaaattttcgagaagtcttaggccggagatgtgccgattgatttaaatttaagaaaaagaggaggaaaagcatttgtatcaaaaaaggaatagttttgatgctatcatttaattggtcaacaaattattaaattgacacaattgaaaattaaaaacggtgttaatttttttagtgtctttctcctatgcttattatataaaacaatgtttgcatgatggaagttgttaaaaagaaaataagtaaatacggaacaattatataataatttcttttaaaagaatatttgtatgaatttattaaaatgatcctttgtaatatataaatatataatataatataatatatattttttaaatcagttaattaatttttttttatttccctttgcaacaatgccatttcggctattagtttgaatcatcagtccaaaatagtacatatttaaagaatttaaacatgaagcggccataacagttggccgtccgaatcgacaaaaaaatttgaggggggggggtcgagcgtaaatgttgcaatttttcattgttttacttcagcaaaattataaatgagataattgtaagagttatatttattaataaaaaactatttttacaaataaaaatatacaaaaaattagcaactataaattttggtctatattacgaaaaaatgattttccggtgatctctgattgatttcattgatgctcttcagtcgagcatcaccgactttggcggcacgtccaccggttgatgaccgtactcatcctgtccactgccaataccgtagtcgtccgtctgcccactcattgccccgacctcctcctcatatagttcatcctcctcctccgccgatgcatcaaattccctgctgctgtcttccgttccgtagtaataattctgataatcatcattatcatcggccatgtccaaattggtgccagccgaagtgtacgatggcaatgagttacggtcggctgcccccggtgtactgtaaggaacggtcgcaagcgaacgcgcatgggcgggcggtggcacagctgataaaaatttcggaaaggatgacctttattttgaatagatatcagagtttaccttcggattcaatcatcgggtgcattttatggggtggtaccggtgctttaaggacgattggcttaactaaattaagttaaaatttcagattataattatttgaaatttcaaacggttttttacctagcgactttttgtcctttcctggtgcttttttggcggcttggactttcttggctgaataaattcattacttttcgacaaataaaaaaaaacattaattgcctgtttttggtgcgccttttgccgatttacctttttttgttggctttgcatttttaactgttttaatttatattacaaaaaatattttatttataatccttctacctttaatgcctttggtttctttctttgctttcaatttgttatcttttttactaacttaatattttattattttaaatcatttccatttttttttaccttttgccgcttttccttttgctgggcttttgcctccttttggcgatgcttttccttttgctggtgatgccgccactgctcctttcaaggaatattttaataaatttttaaaattgtttttaccttttttattgtcttttttgactgcttttgaatttgctaaaataaataaataaaaatatattttttataattttaataaaatatttttgcccacccatttccattaggacagccatcaccaagcaaaccatggccatgaagagaatggtacgcattttgggaggataatttaaatgaaaatgtgatatgtttttcggcattttcaattgctttttatatgctccgatgccaaattttatttcgaattatttaattaaatagttggccaaacagagagagtggaaaagatgccgatagaattcgattttttatgttgacgaatttttttttcatttttcattcataaatttttgttttttccatttccggtgatttcttcatttatttgccaacatcaatttccatattcatcaaaaaattattagtggcatcattttaattaaaaaattattttgaaatgaaaattttcataaaacgattggttaatttattaaaatatgtattttttataaaatataaaaataattattatgaaagaattaaaaatactcatccttaaacagattttttggccggataaataataaaaccttttttattaaattctcaacttttgtgcctaattgcatttatcagatttatgtgaaagcattgctctaaatagtgcactcatttacatcaccatcaagcataagtcagttagccagcaagcataatgaatttcggcactttttctttaaatattttcaggacccaaccgacccgagaaaagtgatgggccggaaacccataattacggagggttttcaattacggaaatccgtaacccgtaattacgggggtctaaaagctccgtatacgttagcccgtcatatgtatttaaaaattttataaaaagaagatagtatttaatattatgctttttatattgatttcaactttcatggaaggaaaaagaaatacgcaaccaggaaaatttggaatttctatatatttgtaaaaaaacaattgtttaaattttgtttggcattgttttctcaaatgttgcatgaatttatttttattattttttatttaatttttagttttggtttttcttcgcaagcggatttttctgttgacatgtgtttgtgcgcaattcttttcacaactttcaactttaaattcttcaaataatctgttttggataagcattgatagatttgtggcattggcattccctattttgtaatttcaaataaactttttcagaaaattaatcacattctttttaagttttcgtcacattccaaggttttccggaaaatatgtgattatcgtcaatgccttttccttgtcaattactttttatgttattttttgtgttttttgtatgctctaaaacatcacgaaatgtaaactaatcaattaattaactgaataaatttgttatatatttttttaattaaaaggatagttattgtgagcctgttgatatatttcaaggtgaagtgtatttgctcgctactcttatcatggttatttttactttggctacaattgtcattaatattatcatggggattatgctaaagggtaaatttaattagataattaaaaatattaatctaaactttcataagacatttttaattggttgataaaaaatttttctgtgatcagaacaacagaagcaattcgtcccagtctcaaattgaaatcactcgtcgcattttcaagtcgctggctgtgatcatagcagtaatcttttgcctttggttctttggttttctgttagcaaatattatgggtcgaggactgatcaccagtgatccgtcactgcaatttctgat

SEQ ID NO: 7276 - DNA, 5697 bp, Heterodera glycines
gatcatcggacagtcgcggctaaattcgagtcgcgacatatatatagtaatatgcagataggtagctgctacactatcattagcattgtgcatatgtagcctagctgcagctcaagctaaggattttttagaaaagaaactgtcatcgtgcatgcggatattaatccttagcattgtgcatatggatttatctgcagatagcgatttatctgcagatagttagcattgtgcataccagcatgatgatgatgcttttctgctgacgcattttccggtcacaaaatgaatggggggggacaaaagaggagaaaaaaggggggggggagggaccaatcagtgggacacctccgatttgagcaccagcggaagacgaaaatagaatgtgcactccctaacacagaaaatgattcgcatataaacttaattgaaatagccaaataaaaagccaaaattctctctccccactttcaaattccccacaaatctgattttacctatattataacactaattgattctgccgaaatcacttttgatagattactgttttcttggctcaatttgtgggtatttgtgtttgttctcgaagtgcggtaggataaaagcgccttttgtgcgccgtcggtggcatcgcatgtccccccccctaatgatgtgatgcccttaatcactcctcccccgcctaatttgccaatatttattttctactgaccttctgccgccgatgccctttagaattctctttttctttctctctcactccttcaagcaaagcttccgccaaagcatcgattgcggcggcttttccccgaaaattgcctctcattttgactaatatttgctcaaaaataaataacattaattttcctcccgcactttaaacaacaaacaaaaagcacagagggcggataaatatcgaaaaacgcaacgcataagggaacgaacataagaagaactgaaagtatccaaaccaattaaaaccacagaaaagcattgtcaattaattgctattgtaaatttttggcttttttttttggcttcgacgcaattcaaaaagtcaataaaacataagagaaaattctttaatttttgtcgcttctcacgatgaaatttcgcagaaaaaataggtaacttaaaaatccgatctctaattcaaaattacaatcggacaatttgtgttcattcagaaatgttttgacaataattggaaccccaaaatgagcagataatgcaaacacaagaataatggaagagaattgggggggggggggggattgatcgcttccgtacaaaagggggggggaggcattgacaaatttggcaaaaatgccaaaaaaggaaaagtgcaaagaaaaagcaaatcgaaaagggataaccaattggaaaatgcgccaaaacttgtgatttttgacaggcgttgttccaaaataaagtaaatgttgttgtttgttcgagttcagctgggccttcgtttaagcagtggtttttcaaaaaaggcaattccgattaaagtggggaagggacgaaccgggaaaagcattggaatgaatgggagtgaatccaattgttgcttccacgaaatatgtcaaaaatgccatttaaattttattatttttctcggtggctcgcctattaaaaccatcggattttccttcgcttttgaaattttaaaatgttcaaattctcttttacctgatgaatttaaggtaacaattttgtttattatagtcaatgttttatattttagttttatatgtataatattaataccatttaaatttaaaacaaaaaaggaaacttcgtcttttttatttttatatttgccatatttataatataattgtttacaggatacaagaaaacattttcttaatgaattttgataattccatggaatgcttcacattggcaaaaagaggcagttttaaaagggaatgaaagtagcaaattgacacccgccgaagaaagaagtccgaatcggatggaaaaaggcaaaggcaaaagccatccccgcggggagagccgtgccaatcacagtcagtgccgccgaaaggaagtccattcatttccctgcagcgctcgtcagagtcgcggatcgtcgattctgtgcagcgccctccctttgagcaacccgccattggccggcaattggccatggccaatcgccggcgttttggccaccgcttccgtttgcatttggcgacagtaatggaccagcactcgttgataatactcgcgaggggtcaaagtgcgagcggtggaacacagcgaagtgtttctaaggggggggggggggaaagggagggaaaatgccacgacggaaccctcggaacgaacagatccaaagactcgctggaggccaactgccgttcggaggtgaaggacaatgtccggggctgctcaatccatttgaagtaataaatgtcctgcaaaaggcaaaggtcggaaggcaaagcggacaaagcaccgactggcggaatgaaagggcgcccgccaatccaattgaggtcaggctgccgcccattgatcaagcagtccagcaggtattcctgaacgaattggtccctttattgtcagttgctgtgcatgccaacctccggcaattgggcgagtctgtcgagttggtcgggagtaagtcctgacgagagaaaaggtaagccaagcgaagggaaatgccaaagagagcaagccgagaccgtaattcttctggagaaaagccacgtaggagaacacttcgccaaggtgaatgacttttccgccaatggtcagaaagctgctcccgagtgccctcccgtacaaatggatgtcctggatgtaagcactgccgacgaggtcgatgcacattgtggtgatgatcaggcctaaagagccggtcagccaaacggagctgctttcctgacagaccgatcacaatgtaagccaacgtagcaggcaaaaaagtgacattctgtgggacaatgtcgccaaatccgattgtggtcactgtgacgaaacaaaagtaaaaggcatcgacgaatgaccatcgctcccataattgcatcagacaagcgccaccggcggtgtaccctaaggaaaaccgaatgaaagtgacggatggacggcgaagtactcgcctaacatgacgacgaggatgaacagtgcggacacgcgtcggttgcgcttctccagcggcgtgtactgctcctcctccttgtcctccaccccgtccatgtcgctgctctctcccccctccaattcgtctgcccgtgctcgcgtgtcttcgctgtttgttcccgctctctcctcaaattcgtcctctccatgcactgttctgatctcagacacatctttaatgaccaatcttcaattatttgttattggttccttaattgaccttgaaatgtccccgcttccgaaacggtgtccaaaatgggagggaatggcggaggctttagccttctctgagcccttcgcgaacagacgcccaagcggaggtgcggagggcgaattcggctttcgctgccgcttccttcgttgttgttgttgtcgtccgttgttgtaacggcctcccgcgacaattcgtcaattgtggccaaagtgccacacggtgcgaccacgtgattggccacaaagggaccttctgaggccatttcctcgggaatggcttcaccccctacaaaaaggccatcatggccaacgtcatttgcactttcgtaacttgcccgaggtggtcgaaacgctcggcgcaaaagtcgtcgctgtggcggacttattggcacggcgattttcgccttttcgatttcggaattttctccgtcgcttccaaaacaaacaaatctgacaacaaattgtcaagcaaaaccagcgaagccgagagaaacagtttctgcgaatttgaaacagtcgtttatccacccaaatgcacacgcctaaaaatggggaaaaacggagggggggggggagagagtgccgaaagcgaagtcggaattcgtacttgagagaaaacggcccatgtcggcgatagtcaccaaaactgaagcaatcgcatattttggttttgggatatgttattataaagtaaataataattattttgaagaaattcttaaaattgtggaattcggaaatttttaggacctgaagtcccaccaaatgttacacatttaaaattaaaaaaatggaatccctaatgttaaacacaaaaagattgtccctaataattgcctgaggttaaaaaattagctttaaaatatggaattaagatagctgactattttaaattaaaaaaataaaagattaagcaattttcaattttaatcagcattccataacttttgcaaaaagcccggccccatcgaacgccgcgcccggttcagaatttgggactgctgggcctgggctgcatgttaaacggactctttggaaccgggcggcccgggccggtcaatcttacaattagccaagttttttgaaaaaagcatgccgaaaaaggaatatgatgaaacatcgagaaaattaaaatagaaaaattggtatcgatgtggcgaagtgtcaaaagtatcgatgtgggtgatcagaagaggcgggccatttcagtacggaacaaatgattttaattaattaataattattttaaatatattattttaaaatatttttaaatattatttgggggcaaaaaatccatcaatatattttacacattcaatgcattgcacttttattattcacaattgtatttttttatatattttataatttaagcatattattgatagaataagctttttgccatggcattacttgtgaggtggccaatttatctctctttaaattgaataactgctcttgcaacaattggcctaagccttttttctttgttttgtaacgcataacattttgtgcatgcaatgtataaatctgttatattttcattcgtcattctgtattttcgccaattgttctcacttccgattaaatagatagtatctgatagatcacgagaaagacatttttcaaatttcatttctaatcgagggctttcgtttgatgtatcggaaatagtgctcttgttttacccatatatatttttaaagtgcatattcccaattgaatccctgtttttgctagctcaatatgtagttccttaacagttttgatctgattttccttgtaacttttgatcagtttcattgcttctcgatttttaagaaagtcctcaaatttcgacttatggtttgacgttaagtcaataaagcaaaggatagtaaaaaaagttaaaagtaaaattttcatttctaaaatcgttttaaaattaaaaattgacaaaaaaattaagagaaaattagaagtaaaatattttagaaaaatgaatttgctttattatgagaagacaaaaactattattttgactaggttatgctacgtattttaatcgaatataaataaagtgcaataactcgctaaaaagtgtcgactgatatggcaaaaatctatcaataatatgcttaaattataaaatatataaaaaaatacaattgtgaataataaaagtgcaatgcattgaatgtgtaaaatatattgatggattttttgcctccaaataatatttaaaaatattttaaaataatatatttaaaataattattaattaattaaaatcatttgttccgtactgaaatgacccgcctcttctgatcacccacatcgatacttttg

SEQ ID NO: 7277 - DNA, 937 bp, Heterodera glycines
  misc_feature (12)..(13): n is a, c, g, or t
  misc_feature (29)..(29): n is a, c, g, or t
agattgggaatnntatgctttttgcacantttttgtgaatcaaaaaattaaaaattcattttatgtattggaattggtacccgtttttagagtattccaattcttacagaggacattgtcatgataatcagtgaacatttattgcttaaatttaagttttaacgataaaaagtcaggttcaaaatagtgacgtaaatgttttagttactgaaagaccaaaaaaaaaatgcgtgattccatatgacagtgctaggtcgtttcgaaaaactaccaattttacagattttttcgaaaaaaatcggtcataacttttcttaaacacaaacaaattaaattttatttagctttcagaaagttctgacaaatattaaaaaaataaatgatttttcaagctacaatataagagcatattatagcaaaattatttaatttggttggggtttaagaaaagttatgacgaattttttcgaaaaacctataaaattggcagttttacggaacgcccatgatgacagtttttacaaaaagagccagcatgccgtgatgtacaaatgaagaatattagcaccaataaggacttttatttgaagaattttcgggctcttatgttcaatgaaaaggacaaaaaagaattatctttcaatgaaaaacaattttatgccaacttttgcacacaaattttcgtaaatcaaaattattgacaagcacataaggaatgctcgagactgtcgggaattttgactctcgtcaagcagtacttcctcttaaagctatcatcttgatgatgatttcttcgggcctaagaacactctgttgaacactttttgcacaaatcttccgcccttttttggctttttgtcatccgcttcatcatctgctggaacgcacgcattgttcttccatttacagcgaaaatggtcgcttagtatctctttgc

SEQ ID NO: 7278 - DNA, 1334 bp, Heterodera glycines
  misc_feature (43)..(43): n is a, c, g, or t
  misc_feature (100)..(100): n is a, c, g, or t
  misc_feature (1300)..(1300): n is a, c, g, or t
agcataatgtataagctattttttttgatgcttctgtgccaanatattcatgggtcgatttgccccggcataattttcaaaataaaaataaataaattgnaaaataatatttattatgtcgtacgatttcgggaaagattttatgacttcaaagcgcaaaattttcttaacaaaattcattgaaaaatgaatgtttaaaaaaggacaacatttttgcgtggatatcaataaaaacaatcacatgaaaagggcattattttattcttaagaaaattttacaaatttgaaagaaatctttttttctaataaaattataaaataaaaaaactaatatgtaaattttagctttatctaaaatattgctatttttgaatgtatacgagataaaaataaaaattgagttcgttgatcacaagttgtataaggtcccaggggccggggtccagacccctgcccctgcttaaaaaacaatttttttttttgtatcaactgccggggtccagggattttaccctcgtaaagtgctatttagctttattgcagatgaacataatcgattaactcaattcacacttagatccgaacctaaatattttattaattaatttttctctattaacaattttgaaaataatgtaaaattaatgttctaaaataactaatgattattttggacgtaaaaattttagtttttttattacaataaatttaatggacacgcattcataaaattcctgctacaaaacataaatctcactttaaatgtaacaagaaaattactactaagaagtgaatttcaaaaaatttttaactcaattcacacttagatccgaacctaaatattttattaattaatttttctctattaacaattttgaaaataatgtaaaattaatgttctaaaataactaatgattattttggacgtaaaaattttagtttttttattacaataaatttaatggacacgcattcataaaattcctgctacaaaacataaatctcactttaaatgtaacaagaaaattactactaagaagtgaatttcaaaaaatttttaactcaattcacacttagatccgaacctaaatattttattaattaatttttctctattaacaattttgaaaataatgtaaaattaatgttctaaaataactaatgattattttggacgtaaaaattttagtttttttattacaataaatttaatggacacgcattcataaaattcctgctacaaaacataaatctcactttaaatgtaacaagaaaattactactaagaagtgaatttcanaaaatttgacaataattttatttaaaaacttacc

SEQ ID NO: 7279 - DNA, 2135 bp, Heterodera glycines
aataatttattatttcgagtaatgaatcaactaaattattttccgacgatttataagcataaaaagcggggggggggatgtctgagtccgttccgtgtcatgcaaacacagaaatgaattttgccgaagaaaagcggctggggcggaacgtgcgcaaaaatgttgcgaagattgagacggagatatccccttttcgcacatttactgttaaggcaattagtcaaacgtaaatttgcaaagttagacaggaatttatcaaaaagcgatgacaactggcacatgacatattttgcgaatgttagccttttggtacaccgataataaagaatatcaatcaccgatcagacaacccagacagatttactttattagctttagaacacggatctatagacatttctttaagtaaaacaagaaatccgttctacggcaaaaaaaaaaaactgataaaatcatttaacttaattgtattaaataaaaaacataaatttacttaaaaaccggaccttctgtctgaaaatcttcggttgtgaaggaggtgccattgtaggcaaaggatatttatttggtgaaaatttattatttcttaatagaccaaaatggctttggacaaaatatgtcacaaaaatttgcggattttggacaaaatctgttaacaaattgaaaaatttcaaatccgttaaaaagtcaaatcttaaaatttttaaatatatttaattaaagtgtcaaaacatacacattggaaaactaacacactcattttatatctatgcgattctgaagtacgtttaaacaaaaaaaacttaaaattaattttaattttggctaattacatgagttgttcagttctttgcaatttgcccatttgatttggcaaacgctgatctcctcatccttactgtctccactcttgcctgaacgttactctccttgcactcctcaagtttcgaactttgcttaatcgctaaactctccgctggtcgtcctccccttcgttgatcactggcgttggtgaaggtgggaagtcagctcgaaaaaatttacaaaaaacaaacaataggccctaaaattttcaaggaagagctctgatttaaattttataacaaatcgtttaatttattatttcctgaatgatttaaaacaattggcaaaaaatcatttttttatataaatcagattttaaaattgagctttcgattaaattccactcctacattatgccaccttgtttaaagtcatttttaaaaatttgctttttgtcaccattattcaaccttagaaatccctattttcgggtattcacccttaaaaatccataatagcatttttacctctttatttactgtcttattttgtacttttttcaccctttaaatccgatccataatcataaggtgaatgatgaaaacagccatagaacagcggttcaaatgtcacataaattttgtttaattgatcatgattctcgcggaaaaataacacctattaaactccagagggttctcaaaaatggcacaccacagctgtttaatttggagacgtgttgtttaattgttaatcagttcgatgagcaacgttgcggttacatcggtcttgcaaaatttccagcgctgtgggatgcatgatataaataaatggcaaaataaacaaaaatattattttaaaataaacagaaaatttttttaaatataaaccgaaacgttttataattattgtcccaaaagtggacttaattgaaaaccgaaaattaaaatgaattttctatcaatattaatttggcacaattctacataatataattttttatttcattggagtaattctatttttattgatagataaaagaagagtatgtaaaaagtgtatttttttctacactatcttttaaaatataatttaacaaatttttattatttacagtacataaacgaatggaagtggttgggattttgctcacttttcagaacatatgggtttttaagtatgactcaagtgcagtatgctctaaccatatatggtaataacattttttaaatatattttatttgcttttcaaggctatagtttcactaccccgtttttcaacattttgctacaccattttgatcgaaactaatctagtaatttttttttaa

SEQ ID NO: 7280 - DNA, 2586 bp, Heterodera glycines
atatatacatatatatatttatagtattttacacttaatgcgcttgtggcaaaaatcatcataattgctaattcatagtttacccctcgtacccagttacgtaaaaaaatgagcggattgaaaagattccgaattgtctcatcgcctaaaaaaagaatggtcgatgactttccaaccaatctcaaacatcttcgcgatgtaattctatttggcttttccggcctgttctatgtccgtgccagagttgcagatcttcagttttcattatacaaggtttcgggtcgtctattctggccaccattatgaattaacacggatttaggcatgtccgttgaagcgtaacgggatgttatgtaagaaaaaactcgacgaggaactgtattgtgccagttgtgaccaccgcgccaacaaggcaacccgcaatctgtacatgagattggagctccgagattgcgaaaatccggagataagccagactgcgactgtcttttccgcggtagcggaacattacctaaaccttaaggttgagcaatttgccaaaatggtagaagagcagcccggacagctcgaagcactgcttaaatctaagattgagcagactgtcgctgtcaaactcagtataaaggtgcacaaaattcaatatatggatgtaaaaatattcttttttgagtttaaggcaaagggagagctcgagacgttggactgggtcgctgtgtccgtacagcaggagaaccgtgagagtgagggagatgacgaggcgtcacctgatggacaaatgaacttgacacaaataacgaagatggataaataatcgagattgagaacaggagcgtgaattcggaggcctatggcccgcctaagaaacgaacaaaaaagaactgatccaaatcaattggctccgtctctatggccaattatttgtagtagtctttggcctagttgatgttaacccggattaatatcatagagagggaaagagagatagaccattttgttagtaccatatgtatctttgtacaattcatccaaaaattagtttttcaagcaaccacagctgaaccgacgatgaaaagggagcaatccacagcggcgggcattctttcattattatcggcagcagcgcacaatgacaatacagcggcagcctcagcctcggatagcaatgccaagcgactacgtcgtcatagttgggactttaagacgatggcccattttgaagaggaacgggcaaaggcggaggaggatagacagaaaaaagagaagcagcctcaacaaccagcaccttgtttgagcaaaaacagcattatgtgcaccgagtggaacggttcgcactgcaacgccatgtgaccgagtttgtagttaacggaaagcatgatgagccggaagaggcgcttctctgcgccttcgagcatatcatcgctcgtgcaatccgaaacgcagaggattcccatcagcaaactgacaacggaagaggcgcatctgcgggcgacggtgtacgtcgtcaaaggcacgtcataagacttggaattttcttaatggtagaggtgagattttccctaagcgttattcgctcctttgttaatgcaaaagttttctttgcaaaacaccaggtctaaccgacccgattctgctgcccattcgtcctccggagcaaaacacggcagaagtgttgatggctgagctggacaaacttggccagtcggatggcgatgaggatgtgcatggtggagggatcagcaaacgttctttgttgctcagcgatccaattgaagtggtcgtcacatgtatagcacctccggtggtgcggcgccacgtttttaccaataccagcattggggctatgacgaccggcagctgatccgtgtgatgaatcaggacgacaacttttgtttattcatgcactggttgccacccgttcgtacacggaccaggaatttttaaaggcaacttcgcgacgacaacccttaacagaggcggatgatgatcatcagcgggattcagtgaccgctgagatagcacgacgcgtgataacgagaaaaaatttttgtgctggctacgaagcactgaacagtctggtgtccaaccgggagcggatgaatgcgacagtgacggagctaatgcaagctgcagaaattccagcggaccaagagtcgtatgagatggagcatatcgaccaaattcagcagttttgggtcggttgttggtgtttgaatgagtgctgaacggtagttttttaaaccaaacaggaccaaaactacgctggcatatacagaattgtgctgtttgaggatcactccgaagagctgcttcgcccaatttggaagggcccaatgggacgccgcctctgtgtgtcactgtttttgtcggataggcattattatggtatcaaaaagatacattgcgtttcaaattgggtcgaaaatattgcgtggactgtgaatgtgtttacacccgtgacactaaatacaatatctcgtgcaagagtcgctccccataatgtgctaaatgttgttagttgtgtttgttgcgccagcagatggccagtcattttttttttatgcccttttatttccttcttgatccagt

SEQ ID NO: 7281 - DNA, 1035 bp, Heterodera glycines
aattaacatatgagggattcgaacctgcgcggtcaaaaagggaaggcaggagcacaacctccgcaccaccgaacaacacaaaacagtgcaaatgtttatttaattattgcaataaaaaaaagtttggcacgtcataactcggcactcagactcatttcgcagaaaataaaagcacttttcttaagaacccatgggtgctctatccacccaccaaatttcatttggaaatcccacggacacctggggaccttcctttgtgagaaaaaaaagtcgcgcgcgccgcatcgatcaaacacacacacacatcccccattttatttacatattatgcccatcgattattacatcattttgtgaaaattatttaattgtcggcacttttcttgctcatacattaatagaaataaaaattgtttatttttttttggattggacatcattttaaagcattgtgataattggagaatcgcgagaattcagtgccggcgacactttacgcgatcggcccttatttttttcacaaagtttaacgggccgcacgcgggtggtctgctctcgtgacacgactcaaacgcgagcggacatgcgaccaaagctgttcgaccgctcgcgtgagagttcagtgattgggtcgcacgcgtgcgatccccaaatgtgatcgggccgctcgcgtgtgactctaaagtgatcgggccgcacgcgcgtgaccccaaagtgattgggtcgcacgcgggcgacacaacagtgatcgggccgctcgcatacgacccaaatgtgatcgggccgctagcgtgtgactctaaagtgatcggtgccgcacgcgcgtgaccccaaagtgattgggtcgcacgcgggcgacccaaaattgtggcgggaccgcacgcgttcgacccaaatgtgatcgggccgctcgcgtcagagttcagtgattgggtcgcacgcgtgcgacccccacaagtgatcggccgctcgcgtgtgactcgaaagtgatcggggccgctcgcgtgtaacactaaattgtttgggtcgcacgcg

SEQ ID NO: 7282 - DNA, 399 bp, Heterodera glycines
tcggaccgctcgcgtttaactctaaagtgatcgggccgcacgcgtgtgaccccaaagtgattgggtcgcacgcgggcgacacaaaaagtgatcgggccgctcgcgtacgacccaaatgtattaggaccgctcgcgtgagagttcagtgattgggtcgcacgcatgcgacccccacaagtgatcggccgcacgcgggcgaccgattagtgattggagcgcccgcgtgtgacactaaagtgattggctcgcacgcgggcgacccaaatgtgatcgggccacacgcgcgcgaccgacgagtgagtggaccgctcgcgtgtgattcttaagtgatcggggccgctcgcgtgtgacactaaagtggttgggtcgcacgctagtgacacaaaattgtcaggaccg

SEQ ID NO: 7283 - DNA, 3947 bp, Heterodera glycines
aaaaatttttaattaataaggataatatatttgtcaaaaaatatatttctaccgcaaaaaagtccaataattcgaagtcaatttattaaacatggccgtttgtataaataatggagcctgattaaggattttcaaaattttgtttttcataaaaagggagttcttgtttttgttaaaacttaaaatgtgagtgatgttgtaatcactcgccgggtacgtgatcagaaggaagcatcggatgagcgctgacctcagcttccgtcggtcgaattcgcgctgccgcttcggtgttgggtgaatgcttgtgcagtgtgagcttaggcagattcataagagtgcggggaggagcagaaggtaatatatagcagtaagttcgagtgcttagaacaaatgggacgttctactcggaaaacgacgacgacgatatggtcgttccgtcaacttcagctggacggcgacgacgacgacagaggcgcagcggggggcggacgggtcccagctgctcgggcttcggctcctttggcccgccgtcgtcggacagcacggacggctcctttgtggagttggctgcgtggagtgattgatgatgggatgggggggggggcgacgacgatgatgatgatgatgatgactaatttataacataatcttgctatataaaataataataataatttcgatatctgttgaccgcgcgtgagcatgcgcaaagcgaatgggggggggggggtgtggggtaaggggggtcagacgcgcacgcgcagccctttgcaactgaacagcgcacgcgtgactgcaaatagtttgcctaaaatgggcggggggggggggttggagggaaaattagagtcgacaaaaattgaatccgcccacctcttcaattgactcagacgggacgcggccgaaggcggacgacaaccaaagcggaagccggtgacaacgacgacgacgacgacggtgaagtcgttgacgacttcttcaccgtggtcggtgtctgggagcgggccggctcccggtcgcgtgccacgcagaccgagaccatccaagtgcgcttccacaactgggagcgggcgcggcgccccgacctactgctcgcacgctgcatcgcccgtctgatggctcgcgtgctggacgggcgtgcggagccgctccgcgtcgggctgtccgtacagccgcccggctgggacaactgcttccacgtgccgatgcgcccaccacagcagaacagtgcgcacgcgctggcggccgccctcgaaacattcgcgaagcagtacgacgagctcgacctgttctccgccgacgtctgcttcaaagtgtcggcggtttgggccttgcccggtgagctcgtcctccgcatcccccacccctgtccctcgacaaagtttgacccctccccccaccgtttagccgcgcgcgtggagggcgcatgtgccgaggacgagcagcgcgcacgtggcactgtccgctgccaatcctttgtgccggttgtgaacggggcgggcggcgaccgctggtgcatggcacgcgccatcgtgctggggctggcccagcggcgcatctgcgtactggagcggcgcaacgtggtccacttccgcgccttctgtctggcgcagcgtggcgaagcgggcgcgcccgaggcacgtcgcctgttggaggacgcagcggtgccgctggaccgcccaacgtacggggctgccgaggcgcaacgagtccagcgctggctggacgccagcctaggcgcccaccaagtgcggctggtcatcttcgcccgcgagctggcctaccgcgtggcgtggaagggcgcgcggccggcacgctttaacctgtgcttggtggtacaggacggccactacgggtacatacagtgcccggagcagctattccatgtactatactacctttagccaaaagaacttgtaaaattgaaaattgtttaggcgcgccagtactgtgtggactgcgagcagccggtggaccggcgcacacacccgcaaggctgccgggcgctgtgcccccagtgtcttcgctttggctggggccgtccctgtgcgcgggagccgggccgcgcgccgtcgcgctgcgccgactgtctgttcgtgttcgagaacgcggactgtttcgaggcgcaccggcgccgggtggacccgccgccgcctggctggcaacacgaccgtcgtcgcggcagaccccaccgtccgatgtgtgaggagcggcgcgtgtgcgcccgctgtcgtcaggtggtgtggacccgtcacggcgcgcacgcgtgcgccctcaacaacaatgttggccgacagcaagcagcacaacaacaacaacagtgcgaccgatgcttcgggattcacgacgcgcagtggaccccccacttcatccagccgaagcgggcgcagtgtcagctgatcgccaacgacgcggagcgcccagccgccccggcggaaggcctcgaggacgacaacgacgacgacgacgacgatgataacgatggcgatgctgacgatgtcaacgacaacgacgacggtggtgatgcggaacagaatcgacaacgtcgacgacggcgcacgctgcgctttctgttctgggacgtggagtgtgcccaagtggcggacgaaaatgaagagggggacgagggggtgccggcgcgaatgctcaaacatgtgccgctgctggtgtgcgcggaggtgatctgtgagcggtgtgtggccgcgggcgtggacttggagcgcgagccggaccgacgggcgcctggctgttgctgcggcggtgcggcttggcgagacggacaacaccgccggtggctgatgcgcgcgcgcgaggacgcgttcagcgacgacgacgacgacgacaacgcagacgcggacgggggacggcggtggcggcggccgaacccgcgccgcttgcgtttcttccacgacgcggcgaccgggcgttcgccgatggcacagtttgccgattttgtgctccacgacgggcccgtgaatgtgcgcaccgtgatgctggcccacaacggggtacgggggtgtacaaaagcggagttgaagaaaagctaccatctacgctttgtaggggcgttacgatgtgcatttgctgatggaggagctccagcggcgcggagtgcgtccccggcggctggtcgccaccgggctgcgcgtctacacgctggagctgggcggacgaaatcagcgcagcgtggtcgccaaggactcgctgaactttttcggctgtgccctgtcaaagctgccggccatgttcgggctggacggcgtgccggacaagcagttcttcccctacaactacatcagggccgaaaatatggatgtggcgcatgtgggactgccgccggctgccgactacgacccggaccggatgcgcccggcggagcgcgacgcgttccagcgctggtacgcggcggagcaacagcgtcgacccaaccgactgttcgtgctgcgccgggagctgctccgctactgtgccaacgatgtgcgcattctgcgacgcgcctgtctgcgcttccgccacgtggtcggcgagctgtcgggcggcgtggagccgttcctggccgcctccaccatcgccgggctggcgctggccatctaccggcaacaacatctgccccgtgatctgatggtgcacacgccggagggcggcttcctgcgcggacgacgcgcttccgccgcctcgcgccacttcttcgcgctgctggagagactgcacccgcaatggcgcggtcgactgcgcaccgcccgctggtccatcggcgaagcgtgcgtggaggacgatggttaccggctggacgcgctgctctaccgcccggtgccgctgcgcccgctcgtcatcgagttcaacgggtgcttctttccggtaagaaggggggggggggggttcctttttcctgcacttttttccattttgcctcgtccaaggttggctccgagtgctacccgaggcgc

SEQ ID NO: 7284 - DNA, 1815 bp, Heterodera glycines
ttttaagattttttaatactcaactcaaaaagttgtagccgtctgttaaagtgtccctattttaatgttacatcccaattaaaaaaacatatggatggaaaaaataggcgtaattactagagctcgcattttgaggcagatgccttttttctgcacactaagttccgatatattaagcataaaaaatgcattttccacttggtttgaggcttctacttgaacttttattatgctttttttgccttttcgagaatttcgtgccttaaatgccttttttggcatttttcccttttggtgccttttggcattttttccgaaatattccataaaagatgcaataagatcgggaaaatacacccttaagaaatgaaaaacttttcaaaaaatacacccctaaaaattaaaaatttttctcaaaaattgatcgccaaaatttcattttttttcttgataaaaaattttaggtttaaaaattttctaatgcgaaaaacattataaaaatttaataatcatttaaatgcccaaaattaagttgtttgattaggttttatgtttttttgctccctaaaaacccttaataaaaaaattttaaattccttttttcatgcctttttcaggattttcgtgccttttcatgccttttttcaattttttggtgcctattttagtgcctttttcgcgatttttggtgccttttttgcgagctctagtaatgaataaaataataataaaattccatttttttgtgacaattcttaattttatgcaaattttttaaaattttcggataaactttttttattgaaaactgacagctattggtcgaagcagggctggagcgcgcacagaaaaatcctgcggtcgcggatcgcgcaaaaaaaatgccgccaatcgcgtatcgcggtcgcgcatttgtcaagattttccagtttataaaccatttttaaattttttggataaattatcaatatccaaaaagcaaaaccagttttttgtagttttctgatcaaatgaaagaagcaacaaataaatatgaggagtaattatcagatcaatttccattcaatgatcagaatttctcatttcctaataattcattcactttttccggcactcattttcagagaatattttgcgttcatttgacccgccttttgcgcagacaatggcataaatgaaatgaaatttaatgtgacggcaccaataaaagcaaatcacccaatgcaatctgcttgaagcataaaatggacatcgttcaaattatccaaattttcgtcctcccattgaaccgccggccctccaatttggcatcgtttcattatccatgggaaaacccatccatcaacttctcctttctccaattttagaatttcgctggtccgttcgttcaccaattcaaatggcacaatttctgttggctcaaaaaattcaatttgaattttgtagcaggcagaagaagtggtggcacggagaaatgcctaaacaatgggaaaccgaaatcaaatggcaattaatccaaacattttacgaaaaagttgggactgacctcctttaaatcgatgacccatttactaaatcctaacgtaaaaccatgacaaatcaatcgcttgggttggccatcatttctcggagtgtgcaaccatttggacaacgcttggccagcagttggagttgcatttggcccatcaaaatcatcaattccatcgggaagcagttcaccggaatggacagaatcaatggtgagatcaactagaattgttggcgaaatgaaaagaatgaaggggtcccagttgatcaccatccataaaggccaaa

SEQ ID NO: 7285 - DNA, 3448 bp, Heterodera glycines
  misc_feature (52)..(52): n is a, c, g, or t
  misc_feature (91)..(91): n is a, c, g, or t
  misc_feature (95)..(95): n is a, c, g, or t
  misc_feature (108)..(109): n is a, c, g, or t
  misc_feature (126)..(126): n is a, c, g, or t
aacaaaaaaataaaaaattttatttttattttttcagggctgtgaatgcacntcgtggaatgcgctgaaagagatatgcttcgtgcacacnccanttgagctgtgcannccagttcatgtgcaccnaatgctgcaatggatgtacagttttgggatgtttcggttttatgtgcagcgattgctgcgcataaaggggatcaaagccggcgggctcggaaatccgctgctgagcaacagagatgaaaacgcaatgacggattacagtgttttttggccccgctcctcatgactttacggattgtctccatctttttaaaaaaatcgtcaccaatttcggattacagtatttccgttcttgaaaacgcaataataacaaatgacaccaaaaggtccataatttttggtgaatttaataaactccccctcgaccacccgccgccccgctcattgtcaactaaaaaattcttgctcacaggcgaataattgcaattttcttgcacgaataaatttgttggcttcagtaagtaaggcttggaatatttgcataaaaaagagtaaaatatgaactaaacaccaaaatatgtgcgaaaaataaattttgccgattaattttttccgtcaaaaaattttttgtttgtttttttcatttttcattataaattattaatccaattttttcatcaaaagactgaaaaatatatgacataaaataaaaataattttaattatttgactttatttaaaacggggtaaagatgagacataattcagtggtgtcatgaacaatcgaaatcggaacttcaggatcaaaaaaatcagatttttgggtcaaaaactgtgttattttacaatttattcagtcaaaaaatcaaatattatttttcagctttttttttttgcttttcgcaacgcttttttgcagcgcattttttcaaaaaaaaacttttgtgcaactgggcggaggggccagcggtgcctcctgcccagaggtgtcaccgggaaaaaatgtgtaattcttaatgcgatttgttaacggattttgtccaaaatctgaacaaattttgcaattttgagccaattttttaaaagaaaaattaggagtttttggaacccggcgtcgccaataggctccgccggggataaattaaaaaaaatttaaattttacttctgaaacgcccaacacattttgtttgttttttatgatgagcgaaaaaagggaaaataaattttatttatataaatattaatattaattgtacgaattatagtaaatttgatgtgataaaattaaattgccaattcattaaagggcattgataaaccataaagatgaatttgggcattttatatttcataaaaatggagtttaatgggcgccagaaaaacagacaacacaaaaagactcgccattgacaactcatacaacatcttgggagaaaagctagctaacattggtaggcttatggacgaaaacgaagatgacggcaacaacaccgactgttctatttcacgccaattgttccaaatctgcttgacgcttctacaacaggtccaaagccaacagagtgagcttttcactctcaaacagcggcaaattgcggacgaagctgtgcaagatcacgagcggcggcgaagcgttgtcgtaatgggtctactcgaatcgcagaaacaaaagccatccgagcgagtcgctgcggaccgaacggccatctcaggcgttctcgatgagcttggcatcgagagcccgatcactgtttacagaatgggttccacggaccaagcaaagacaggtcaaaaccgcccgcggttgatgaaagtaattttcggctgctcaaaacatcagagacaaaccttgacacaatggaacaaactgcgcgctcaaattagtcaaaaaccggggatgagcaacatcaaaattcgcccttcactcagccaagaggaactcaaggcccgacgtgtgctgcaggaagagtgcagcagaaaaagaaaggaagatggcggcgaatgggtggtttacgctgacaaagtgatgctgaggtcagacattgcgacatttaaaaataacaccaattgacttgctattttaccaaatcacactcaaaaaacatttataaattcgcacttttccggtcttaagcatgttaagcccaataaccccaaaacgaaaataggggaagttaaagcatgcttagttaatattagatcactttacaacaaaattgatgaaatagctttaaatttggtaaataaaaacatagacatttttctgttaactgaaacatggacaaaggaggaaaacccaatcctctttagcccatggatacttgaaaactataactttgttttttgtcataggaaatctcaaaaattaacacgtgggggtggttgcggtgttttaattaagaaagaaattgagttttttgttaaattttctgaaacaaaatataattgcgaaattttggtttttcaattacaaaaactaaaatcaattagatttgtgcttgtttatcgaccacccaagacaacatatagacaaaccaaggaactttttaaatttttagaaacattctatagccataattatgttgtgttgggtgattttaattttccgaataaagacctggtatggaaggaagggcagcccatttctatgagtaaatttggtgaaattttttgccacttttttagtaagcttacttttttcaatgccacgagtggacccaccaggggaaattcgtggttagacttagttttgccggcaaatgatcaaattgtaaagcaatgtactattgaaggtggtgttttttcatcggatcacttagcgcaaattttcacattgactattccaaaaacactacaaaaaacaaacttcttttacactcgacggttttttccgtcgaatgtttctctttttaatattatggtttcttctagaattagcgctttatctaacgagcattttagtgtgaacgaaaaatacaacgcctttaataatacattgctagaaaccttaaacgagtgtattccaatgaaaaaaattaccaaaaagatttgacccctaaatatccaacgcatttattggcctccatcaaagagaaagccagactgtataggcaatgtaaaactgacccaacaaaaaaagcactttatgatagcattagtttacacataaaaatacaaacaaataaatttcactcgcaaattgagaaaaaggctatttcaaagggaagaaattccatttttaaatacctacaaaaatacgatgttaatccctttgaaataccgaatttagtctttgaaaacaaatgctatcatgatgatgatgaaaaatgtgaattatttgccaacttatttgcaaattcgtttaacaattctgatgttgaccaggctatctaaacttgggcaatagttttgttaatcaatgctttatatcagatatagacttta

SEQ ID NO: 7286 - DNA, 1026 bp, Heterodera glycines
ttcattaccaagttttcttaaataaggacccacaaatgctcaaattgtttcactttctcatataatccctttatgttttaggcatttgccaatgcttcttcatctcctgcccaattcatcattgtcctttactttcggatttcacattttgacctttttgtccctcctttgccctttaatttgatcaataatttgacccgggaacggctgacattggcactcattgacaacggcacttttttactcgtccgatgtccgctggtgcgtgacgagcccaaatgggccaattgggagagggaggcgaaagagtggccaattgatggacaaatgaacacaattgtcattggtgaacatgaacaggaggaagaaagcgaagatgatggtctttatttggtcaatttgttgaacaccggctgaacaaaagggtccgactgaaatggcatttttgaaagtgccaatgccaatgccgcccatctcattaaggggtggggaaaatggtttttttcgagaaaatggtaacaatttaaaaaggtcaaaactttaagctcagcaacaccaatatgatttgtctttgattctttcaatgtttggcttaaaactctaaaatgattcatttttgggcttattctttcgctttcggtgcctaattgaatgcattttgcacgttgattagaggaggaaatttgtgcttaattgatgagatgggaggagaacagcaattaattttttgtgatcagtggaacaacaattttccaaatatgtaattttaatttgttaaaaattgagattttctttaaaaaatatttttagccaggtatgggtacttttctagtttacaagaccaattccatataatgtactcatttttattatgctttcatcggatgggggcgggtatggacataaaatggcaaaaatatggacataaatttttcccaatttaaggtatgaattctcaaaatctcaaatcagctaaacgcaaagtagaactttcaaaatggctgcatattgtattaaaaatcattt

SEQ ID NO: 7287 - DNA, 1940 bp, Heterodera glycines
ttttactttacttattttcctttatataataattatgcataaattcttcctaaatatttttatgatgatgattcaatgtgaaagtggataaaattgtccgttttgtccacataaaatgaaaaaaaggcattcgtcatcgcttctctcccaaacactgcactgatttgtgaatatggaatggacaaaattccgatcagcagaaagataaagccaataaacgatgagtcaccgtttctattggcttttttggctttttaagcgattgcaaagccaataaacccactaatttactaatcattttacccattttcagcaaatttattcctttcccaaaatcaaaatgaatttaatttgcttttcgttcttttttgttgttcttgtgacaaatgtcatcggtgaagggtaattaaatgaattcaaatcaattttcaaatgctttctgtttctttagacttgccgaggacaaatggaaaaagtgcgaattgaatgggaacagaatgatcagaatgggaaaggacgttaaaaagtaatttgcaaataattttggtgataattaattaatgttcccgcattaattagtctgctgatttgctacaagagcaaaatggccgataattttggatggaaagtgggaaaagtgttcaaaaggcgcaacgggaataagcaattggctgaaagatgtgttggcacagacggcacgaagggatggcacgcgctaatgatcgaacagaaggaaaacgggatgatccttaagtcctcttttgggtgagtgatttaatttaaattaaaaagcaaatttaattttagaaaggatttatccgtggaaataggccccgaattttttattcaaggctccgactttttggacattaacatcacaaagggtacagttgttcagagcatttaatttaaattgatcgagtcattagcgttaatgagttcctcttccgctaaattggccgagttccaaaatgctcttccgttcggtgtttttttgaatgatttcgacggcgcagcgcttggaattgtcgcatttgaaattcattgtgccattggaacaaatgacgtgaacacttgcaaaacgatggtaagtgaaatttaaaaaataaatttgaacattttgaatgaaaaaatggttggctacggggggaatagaacccatggcacaaaacaactgagatttgaatgtattaagaattttttttaataaaaattttaattttgtaggctaccgaagaaaaaagtcgaaaattgaccactcggggaattcgaacttccacaaccactcgggcaactccgccaaaaacaaagctgaaaattgtaactccattcaaaactgaaacaccacgcgttgtaatcgttttcattttttaaaaatttaaataatgctttttctagtctgaaattgaaaaatcaccgaaactgaccaccctggaaacccatacaaaaacaaacccaaatgtcggaacttcatctgccgtaatcatttccctcaaattaaattaaattaaaaatttttagccgaatctgttcactccacgtgattctactgtgaagcatttcggcacaaattgcgtccaaattgattttccagctgaaattgcccaattttcgctgaacgtttccgccgcactattcggcattgcctgtaaacaatacctaagaaagtacaaaattggacaattgccaaaaaattacgatgaaaaaatggaaataaaagacaaaatggaagcgtgtggaaaagtgccgacagagacaaattgcaaaaagttaaaaaaatggaaattaaaattaaattaacccctaattaaggtcatatgagctaattggatgttatgaaagcaaaagtcagcagaaaattgccaacgaggaaattgccgaagtttgccgaaaacacctcgcaaatgccaagttttcggatgggtttcgaattcggaact

SEQ ID NO: 7288 - DNA, 3855 bp, Heterodera glycines
aaaagtcaaccagaaaatttcccacggagggaattgccgaaattttccggaaaccccttcgcaaaatgcaaatttttggatgggtttgaatttcgaacctgtgccattcgtatcccagggagaaaagtgatcgttgtcgaatcaattttggaattttcattcaccgagaataagtgaatttaaataaaggttgaaaattttttaatttttttatcaaagttataccatcacccgaaatgcttcaattgatgatgtgaaggaatttgaagctgcaacaaaatcaactcaattatttttcatcgaatttggccaccaaattgggcaaagtgcgctccgtggggaaagcggcggcacggatttgtcattggacgatttggtcaaaaaggcaaaaattatataaaaataatttaatattgttgtttctttaaatttagaatgaaacaattggccactttttgggctcaatcgctgaacaatcaattgatgggggttgggcgaaatcaattcattttattccgccgtctgacagatttctggatgtttttttccaaatttcgaacccgccattttcaagactgatcagtaacgagacaaatttgatgccatatgaaaatgacccgaacaaagtaagagttgggaaagaaaatagaaaaaggttaaatattactagacgattccgactagttgcgatttgctgggaaatgattgtgaggcgacacgcgaaattctgcggaaaactcggaaagttttggagtgctgctccccctctaatgctgctggtccatgcatttgtaaacttccgaagcccgacctggtaaattaataattcaagcaaatgtactgtcattttctgttagagtgaatttgcggtgcctaagggtacaaatccgtctcagccacaaaagtcacgcttcagcagtaacagccaatcggacgacccattggattggtgggacgatattttatatacgaaagaggatgcgcaacaaagatacgactattttatggaaggtgattactgtatgagaaaaaaacattgcttaattggctaattaattaattatgttggttctaatttaagtgtgcgcaccgtgtttcccaccaaaaaagaaggggaaacggagaaggaaaagacaggcaaagctaaatttgagcaaatggaccaaatttccaattgcgatccgtttcagcaaatcatgtagtatatatgtagaatgaatttataaattttttaacaacattcagtgggcgacccgactccgcaacaatatgttgacgctgttgaacaagggataaaattaatcatgtgggatcatttttatcaatgattaaaccgataaatagtgagataaatagatactttagataaacttttgtccaatattccttgctttctgttaaaaagccgaaaaataaaacacttctcaaaattaatattgtttaaaaattgtgaactgatagaattattatttagtgaccattttcctcgggtcttcccgcattttatagttttgatcatttaaacaaaaactatactagggacaaaacttgcgtaacattcaccacggatctgagccatgggccggacgaaggcatcgaaattttcgacgcgaaagacggatactgcggtcgatcttgggttggacatattaaggaatggcaacgtgtttcaattaagtgtaccaatgttggtttttattatcgttatcaatttaattaagttcatttctaaattatcagtccaacactgttgcccacgagtttttacatgcgctagccctctggcatgagcaagaccgggacgatgccaacaaatacatcaaatggaatccaacgccacgaaatgttagccaggattacaagaattttcttttgcaattttacattaaaaaacactggcataatttaatattttagcaaaaagagccggcgaaaacagaaaattacggctttccctatgattttcattcaattttgcattatgaagctgtgaaaacaagagggtcagttattttaaaggtataaatgaaaagaaaataatttggcaatgaatcagctattacgacatgattacgctgaaccgtttttaccaacgcacaatgtttcactcaacatatgaactttcgtttaaagacgccgccattatcaacaaaatttattgcgacggtaaatcgaattaattcattataaaatagagtgaattaatttaagaaaattgcaaaaacgtcgaaaacaaatgccaaaagggaggatatcccaacccaaagaattgcaagcaatgcctttgcccggtgggatacggtggagaaaaatgcgaaatggtcgaaaatggtaaaaaaaaaattaaaatgataaaaattattaatatttcagatggaaattgccaaactgacagggcaaatgaaattgaagcagattggcaaattcgaacgttgaagccaaaagtgagctgcacaaaaaaggatgagtcatgcggatgccattggcaaataaaggcaacatttatatgaaatattaaaaataaaattaaaaaaacgaaaacaaacaaataaaattaatattaatattataaaattaatttaaagaaaaaaaacatatttacagccacaagatggcaaaaaggtgatcatcaaattgaaatggctgcatgaaaaggtgctcacctgtgatgacccttgcggcacttatcgagtcgaaataaaataccgaaaagacaaaagggcgcggggtaatttaatttaattaaataataattatttaaattttgtaaaggtgcatttatttgctgttctgcccaaattgaagaagatgaaacaaagaattggattgaggcgggtgcacccggcgaggacattctcatttcggcttatcccaatcagactaattttgaacaattgacggaattgttcgaattgacttacgaaacgggtatgggcacgtaataattattattttatgctaattgcttttaaattacttagacggcgccaaaattttgccagcgagcgattgtccggacggtgtgaattggaagccggagagatcacccggacatgttctgatttgcaatcatcccgataccggcaagcttgttgaatgctgcacgaaggggcagaaatgtccattaagggctaactcaacattcagctgtaaactaattgtggtaaaaaccaagaaattattaaatttttgatcaaaaaaagattttagctttggccatactcttttagacagttttggcacactttgggaaaattttataaaaattttgcgaaatttgggtgtggcctagtctcagagagggtatgaataagtaaaacggaaatattgataaaaaattattaagctaaacggtcaataccgcgagatcagaggcgtaaacgaaagcaaaatcttctttttcgaatgttttgtaagtgacattaaataatttaattaattaattgtaaaaaaatacattgtcaattaattaaaaattaattgattgattggttaaatttatttttaaagaggcgagaaggagagatgaaaagcttttggggttattggaaggacaaaagcaaagacccaattcgcattggcgattttcaatgcttgagctacgaagaagccggcatcataaatccgccagacaaaacagtgattgattacccattgcgcttcaaaagtgccaacataaacgaataatgatgccaaagggatgaaccaactgcggagaatggatgtgatgcatagggcgggtgtttttacctatttaaaagttttcctttttataatattttattttttagtgtatttaactttggttttgtatttgtaaatttatttatattgtaaataaattatttaatcata

SEQ ID NO: 7289 - DNA, 1805 bp, Heterodera glycines
gggttgactgattgattgttgtaattatatagatgaccacccgacggtttcccattggtctccgccactaatggatgatcatttctttaactgttcccctgtcttaatgaattattaagtcattagatcatcgctaattaggcatgatcgctgtctgggctgatgatcggcgtcgtacacttttcgttcattaattcattcgttttatcgcaatattatcagtttatttctgctgctggtcacatttatgatattgctttataacattatctctcgtattcagcttaatctctccaatttaattgcatttaatgcctattttaaaaatataattattcactgatgggacggaattttttttaattaacaatgctttaagtatcaatttactacataattcgtgtttttgctgactttgttctttttttcccaaaatgcacctttcacgcacctttcaccttaaatgaagtattttggagtttttggatattaattccaattttttacgccttagggttccattttgggtttccgaattccaaaatttcggaagccttggagttcaacaatgtttttaaactccttttttgccttgctgtcagcttcccttctgatcatctgaaatacatcttcaatatttgtaaaaaaccaatttcaatttttgatttatttattttttctatttggcaattcttttaaatttttttcatacattgaatgtgaatggagtgatatgaatacaactccaatttaatcacccttttgactttttaatagttaaaaatcgaaaaaaagagaagttttaaactttttaatccatctttttattttattaaaaaaagaaacaaaaatttttttcgaaaaaactttacagaaaattctggcactttttatttgaccaatattaaaaaagacaactcacaaagttttttttttttttgtaattttttatcttagttttggcccatttctttctgaatttctattttacatttccccggcttttctcctttccattttagtgccatgcttcaacatcgctttttgtcaccaaaacgtaaaaatatgtaaagtggcacactaatgaatacttaatgagatgccttggccaccaaaactttttccgacgatggcaccgccggggggggggagagaatcctgcgcatattttataatttgtgtacagcttcattttatgggaatgggaaggcaattaattaatggcaatgcacgtgaataatgtggcatcttttataataattatatggccaagaaatgtcagaaaatgagtgaaaatttgtggaaaatgaaaagttttcaaggaaatttttttttttgaaggagagttttacaaataggggacatgtcgtaaattgctttttctaatagtagggtttatattttcggtgctaaaaactggcaaaatagttgcttaaacgagaaaatagctattaaaaagtttaaatttagggggtttaaaatgacaaaatttattcaaaaggcaacaaaattaagccaaactagaaaatcggtgctaattaactcgaaacgtagcaatatatcgccctactaattagtccggtcaagcccgtttagcagtcttttgattatccatttaaattgaggcaaaacattcgcttttctcgccacttcaacattctgatcagtgcgagagcgcctctcgtcgatcaatgattaatctcatcaaagtttccgatcattaggctgattctgatcacttgcatttcatttgtttatccgatggctttcactaaaattttggtttgcatatattcttttccccc

SEQ ID NO: 7290 - DNA, 4275 bp, Heterodera glycines
gcaattggcaccacatatgccaaattaacaccaccggcggagggcctttatgcgcttatgggttggcacgcaaagttcacaaatcaaacattaatcaaataaagccccccgtatttggaagaaaataaaaagccgtccagagagaaactcccggctttacataaaatgccaaaaaaggcgtattttttgttttgccaaatttggatggataataagccaacaaaacaaaaaaatgacaacgctatgagcataaatgtcaaaagctattttgtacaaattattttcattactagaattaattttcgtttgaaaaggtggcacaaatccgcttagaaattaaaattttggcgtcaatttctcaattaaattttcatgcctataaatttttttccctttcaattgtgcactttttctgattttttttggtccaaaaatggcagccctaattaactactaattacccccacctctccccattatgtaagtaatcatttttcgccctatggccatgcatactgtaattttgtgctgttaccggtttcaaaatttactcccacacattattaacccaataataattaggtaatttctttgtgtgtctttttgtgacgtattctgcccattgtgaatgatatgagagtaaattgtgggattttttttttgccctttcgtcggatgaaaaagcaataaattgattttatattatatatttatataaattaaattataaccatcatagacagagttgcgcatcaacagtttaaattttgtcgacaaccataaccaaaagagcaaatcggagaattgtgtttcattcttcaagggattttgatcagtcaaagcattttgctatttctgcttttaacaaatatttatattgtctaaatttgaaatgaatggattttggtttaagcttaattttcaatgaataaagtgataatataattttaaaccgttttttatgattttgagataaaacaaaaattcaaagacccgacccggtgcatgaattaaaaaatcagacaaaaactctttatggctcaagggctataaagataacgaaatttttctgtttttttataattaggctattgtatcccgcccaaaaaaaggtttggctcggagcacgcggtcgcttcagtccctccctaccttcagcaatttgtaattttacaaaaatttcgtgaatcgcaaatttctacgaaaatttcataaatcggcaatcgaatctctgggctgcttcaagtgaattatggagaatggtaatggtagtagtgatgctcgagtggcttgttcttgtgtctcgactcgagaaaagtctggggttttttcggtctcgataagtctctggctcaaaatgacggtctagaatctcggaagttttcactcccgaacatcgccaataatcggtgtgtatcaatcctgaggaccggcattttcatcttcttcgatcatcatttttgaatcctcttttcctcttgccttcccccgatcagtcagttatattcctcatcatccctcagcatgcatctctgatcaattttagcttctattcccccacttcccggtctcctgttgatcagcttttcttcttatctttcctttttttctgactagctttcctgccattctacgatcagttcctgtaccaaaaaccctctttctctctctcctgctgccgttgtattttattaataataaatattattattattatttttatttatttttccaatcaatgcacaatttttaatacaatgggcgaattgacggacaataaaacaaaacaacacattcatttatttattattttgtttattgttttattgtttggtcatatgatctgctgacgagtgagtgattgagtggaacccatccaattttgtgaaattaaacacaaaaaatgaagacggacggacgacggccctttgggggcatccgtcgctttttgtcggcggaatggcgaaagtgcgaaatggcgaaatttgtgtgagagcggagtgattgatttcggttgctgagtgtcggttgaactgttcaatgactgatcagtgacaaccaatcagatcagaggaggaacaaaaatgctgaggtgttgggttagggaagggggaaaacgaaaacttttgctatttcggcatggatttggcaaaattggcgtgaaatgagtcagtggccatttttggcgtaattaacctgaaaaatgccataaaatgaacccatatttggcatgaatttgataaaagtgccgtgaaaagtccaaaatttaggcaaacaaaaatacttggctatttttggcatagatttatgtgaaaatcctgaaactaacccatgaaatttacttaaattttgatcattttggcatgcatttagcaattggcgtgtagtactccgatttgaccatttttggcatgaatttggttaaagtgccgtaaaaagtcccaaaatttaggcacaacaaataatttggctattttttcggcatggatttggcaaattggcgtaaaaggtttatttgaccattttcggcacaaatttgctcaaagtgccgtgaaatgaccccaagaatttacttaaaccgataatgcttattattttggcatgaacgtggcaaaattaacgcgaaattagcccatgaaaatccaaaaaaaaatcttttgccattttcgacataatttgcgtgaaatgaatccatgaaatttattaaaacgaaaattttggctattttcggcataatttatacaaaattgcaatggaataaaccctagaaaattttaaaaacaaattaaataacggtcaaggacgtttttggaaatgaaaaaatgtcctttgaatcagcacgaataataataataataataatctccttggaaattcacttatacgtggcaatttgatgtgaactaaattaggattttccattttttgatttgccaaaaagccataatattaataataatatcaaaaataataatttattttctgccttcattttcttcagcttttctgtccatgaatcttatcaaatttgtctctcaaccataagtcgtcctaataatttgtttttatgccctgctgaaatattattttatttatttataccaaaaaaaatattttttaattaaatgatgctttaaaagctgtttcaaacaaattattttcaaattattttcaaattttaaccctttccttccgccttcattttctcttctccaatatatccgttgctttgtttcttggcgaatcgtctttctgctgaccttggcacatttgcagttttttcccccttaaaaccattttaaattatttttgaaaattaatgttttacatttattttcaattttttaatatttttccccattttttattccattttcgttcgtttcgcatccaattcaatccccaacaaaataaattgctgtatttgtgctttgtgtgagtgcgtgaattcccgtgggaacactaaaaaaggccaacaattggcggcggagggcgtcgcgtcgcttttccgccgatggctaatcttttgtccgtccgccgtgccgggggggggggcgccatttttggactttccaaaatcggtggaccgcaaactaataataataataaaataataaatccgtccgttaattccctggggggcaatggaaaatgggagaggaattaaaaatgggattcattttcatctttattttcactcatcgaacggacggacggacagcgaaaataaacgacgagagcaaagaccaaccaatctcatccacggcactattttagtcctccattctcaaacaaaatgccataaatggaggagagaatccttggggagaatggcatcgccgtgaaaatgccttgagaatgtcaaaaaatcaaaaatttgtgccgagaattgggggctaagatgggaatgaactggtgtcaaagttggggttaggaagaactatgaccatcatcaagccatgtcttgaattggacaaaatttgtttgcaactgctgtgcgtcgagatttgagattgggtcgtcgagaaagcaaataaacaaattataattattatttgccatcaaaagaggggagggggaggggagtatttatcaattgtgatattcgtgtcaaaaaggtcaaaaatgtgtcaaacacattcattgatgagtgggaggggtggatgggggagggagggattaacgatttgccctcccccctcccccgggggggggggggaggatgtgctggaaaactagtagaaacccaagtcccaaagagaggctggaccctgc

SEQ ID NO: 7291 - DNA, 1907 bp, Heterodera glycines
  misc_feature (1111)..(1111): n is a, c, g, or t
ttcattgctattcaaccgtaaaaacaattcattaataaatgtaattttccattttccttttttggcatttgccattctctcccgcacatttttcccttttcttcggcagcggaaaacaatttttttcttccatttaattatattttttctttttattgagacaaaaataagcaatttttatggcattcctttttttatgtaaatcctcgcattgaattgaatttacataataatttacatgcaaatacataatgctacagacaaaatcatcattttccttccggcatttacctttttaaaaaaattatagaaaaaaaataaaattatttttttaattaaaaattttccaaaaatgccctcaagcgtttctttcggcacgcggcgccgctgccatttccacgagaaattggaattggaattcctcaaaaaaaacaacaattatctaagggatgcgcgcactttaatttcccgcattattcacccacacaaaacacacgcattttgccctgcggcaatgtgccgttgaattaaaaaagtaattaacttttgccgccggcggcacaatccccccccccattggcatttattcattttcattttttggcgttttgtttgttgtttttcttccggctaaaaaattaaaatttggccattcccccggggggcgggcggtgaagcggcgaatgtacacacaaaggcaccgagcttcagcagcggcagcaatccgcaaacatccatcatcaattttagcaagtgcacaagcagtacctcttcttctccgtctttgccttgcctttttgtgtaaacaattgtctctgcttctctgcactgtgtgtacactctcccattttgcagcgctattttctctctctaatctcccttccctgaactgtttttctctgctctcccctcactgtttctctcgcaaattgctccctctttttttctatgaccactctctctcattttccactgtttcgcacccaatgcttttctgccttctcttccactctctcgcctccctgcactatttccatcccatgcataaacaatctcctcgtccccctccctctcctcccgtccattagcctccactcttttttagccttcnccgaataatcccatcgctcatcatcagcagcaccaccaccacagcccctcgggggtggagagggggtaaaggccaattttaagccgagccgtcgtggacagatgggcggggggggggggagaaaatttggggaacggaacggaaagcaacggactgtcgatgcttttgcccttccgtgtccttcccccgccccatcttttccccatttgtccccccccccctccgggcgtggtctttggcccgactcaaaattgctttttctaatccgtctcccccccccggcgctttcgcttcctcccccccccctcggggcccattgttcgcaattaaaacgaaggggaaaaaaagaaacattttcacatttttgtttgttgcaaaatttccaccacaaaaactttttttcctgtgctgctgtttctgttttcgcacaccttttgctttctttgcctttcttctttttctgcgagcaaaagtcatttttaagtgggggaaaaatttcattttttgagaggagggaaaagcatttttatggcatttgtaaaacgatctgtgatcacagttcaaggtttcatcgcaattatttatctttaaattttgctcaattttccaggtgttttaggggctttggccccggtcaaatggcaatttaaaatttatgaataatttctaactttttggattaaaaaattgatgcacaatattacataaatcttactgatcaaatggtatatccgaagcacatttgctcctaattaaacgttccttctgatcaacaggaatgccatgatgttttcgg

SEQ ID NO: 7292 - DNA, 1918 bp, Heterodera glycines
  misc_feature (16)..(16): n is a, c, g, or t
  misc_feature (32)..(32): n is a, c, g, or t
tttttcgtcgatactntttgaatggggttttntttcaaacccccacttaaaggttctttatttgtcctcatttgaagttgattggttgcttaaaaataataattaaaaagctaaataaatttataaatatttttattgcgctaaatttttaaattagaaaatgtcttataatattttagtgctattctttttgccatctgatcaatgttacaaatttatttttactattataaatttgttaaattctaatagttaatgtttttgttgtttaaacaaaacaaattttaatgtaaaattttagagtttatttccaataaaaactatttttctgtgaatttcgcgtgaatattaaaaaaaaatatttaaaaattgataaaattatcaaaaaaagttaatgaaaaagccctgaaaataagcgctaattgagttaaaatttttttgtttccactttttcagcgtggtatatccaatctttcctcttttttccattgatttttccttttcctttagcttttctttatttcgttcaaactaacaacttgggataattcaaaagtttataagtcaaggtaagctcattagcctgctaattgtaagtttcaaaaaaatttcatcgggaaacaaaaaatgccaataactccatttaatttggtcaatttcgatttttaataacttcatttgacaaaataacaataaaaaacattatttttaaaagaataaaataatagttataattcatctttgtttatttttcttccattctcccatttttgtcgtcttggtcaaattgcctataaaaattttttataattatttcaaaaaagttattattaaaattcatttttattggtttttccttcaaaaatttttcatttcaattttagataacaaacctgaggatttttgcctttttcaacaaacttttaaaaaaaaataatatgtaagataaaataggatttttaatattttttgtaaaatttaatgtgaaccgagactcttgatttgtcaaatttcattcctattttcagactaagtctccactataaaaatgagaaatttctcaaattaagaaccgagactctcgattaaccaccaaattccttactagtgatattggagaccgcaaatttcccgagaccgagaccaaaaaagcagagaacttttctcaaatcaagatcgagactctcgagcaccattatttcttaccattccgtggccaatgcatcttccgaaatgtatcgcgattcaatgccccacatttatgtacatccctttgagcacattgagcgtgtactccttgtgaatgtgcgtggccacttctttgtccaacaattcatttattaaatttattttttctgcgtctaatttttcgcctccattttgttgcttcttcttcttcttcaatttgagtccaattaaccatttttgacagatgggaaagctttaaaattttgtaaagtttttaagatataaatataaatttaaaaagattttattgtaaaatgacatcattattcgattatggtcacttttttgtatgaataaaaattataagttcggatttgagtctgtatggattttgatggttttttttgtaagattatttcgcatgaaatcagcaattgcaatttagtttaagcatctaagggacggacaacatttagaaatttacaatttttaaaattataattcgcaaattttgtacattccaatccatctgtttgcgataattgaattcattatctgggaatttttaatccaaataaattcggtcccagataattaatttaacaattgatttaattaaataaatttatcaataaaatcagcccccaaattaaaaaaaaataaattttaataattatttgaaatttataggcagtttactattttaatttgataattcatatataaaatt

SEQ ID NO: 7293 - DNA, 6793 bp, Heterodera glycines
  misc_feature (6742)..(6742): n is a, c, g, or t
  misc_feature (6744)..(6745): n is a, c, g, or t
  misc_feature (6747)..(6750): n is a, c, g, or t
cgttgtcggtgtaaaaaccggtcatctgttgggcccttcttgaaacacggaccaaggagtttagcgtatgcgcaagtcattgggtgttcaaaacccaaaggcgcaattaaagtgaagttttcttacggaactgatgtgtgatccctggcactgcggtgttggggcgcaacatagtcccgtctcgatcgcatgcgatggggcggagacagagcgtatgctcggagtcccgaaagatggtgaactattcctgagcaggatgaagccggaggaaactcttgtggaagtccgaagcgattgtgccgtgcaaatctgttgtctgacttgggtataggtacgaaagactaatggaaccatctagtaactggttcccttcgtagtttcccccagaatagctggagctagttacacagttatactcggtaaaaagcatgaatagaggaataaggataaaaaatatccttaacctattctccaattttaaatgggtatgtatccagggtatctttactatgattcctggcgttaaaagaaagaaccgcgataccgtagcaaaattttcaacctatacctaaaaaccgttaaggggggcaccggcggtggccaggtttttaacagatttttaccaaaaatttataaccaaaataaaatgaaaaggttaatgttgtactagtgccgttaattcttattttgaaaaaatcggttccggcaatggtaccaaaagacaggtaattaccaacaattatcggctaataccgtttctgttaccgtgcaatttagttaaaaccacgacctcggaaatgcccatatttccaagaactgctggcctattcaatgttgtactaattagtaaaattttataagttacaaataatacacctaaattttgtgccgtttagaaaatattttcctaattatttaaaaaatagctttttatagcaaaaattcattccacttaaatatcagaatttggttaaatgattttattcaaactcattgtatgacttttctggtgaattttttgacagggaacagcttccgccaccaattttgttcattttcggacgaattagttgccgattcatgtaattgtctcagcttaatgtaagctaaaaatgtggagaatcaaataattaaatgttttaattagtcatcttaaattattaattaaatactaattaattacagttaaaatttaaaatgtattattattactctctctgatcgtgttttgtattatcctgaacgttgatttattgacactttgtgaagcattttgggtcaaacagcttggcgtgattattggcattagtagtgccgttgatttatctgatgaattccaactcatcgattcaaatccgttattttccaattcttcagtcaattgaattggcattggccatttccttagaaatttgagtatgattattggcattacgccttatttttatttagcatatgaaattttttcgtaaaattctataaaattcaatttatcgagaattttattgcatgattaggaagttttaaaaagaaaatgaattaaaatgacaaacaatgaaaaaaaattatttgtaaatgattttatttgtttttccattaaaattttaaaatgccattaatttatggatttagtgattttttggcaatttttacttcatttttgttaacagcaacatatttgatcatgtcttttttatttaaaaatcacctattcatcagaatgaacatcaatttttcaaacataaatggcacagaaccatttggataccataaaataatttttgccgccaaaatagaaagcgcggcaccgttgaaaaagccgacaaagttgccataaatataattacctgtaattcgattcaatttttaattttatcaaataatcggaaaactttttgcccaaaatttgagactccgcagcaccattcgaaattttttcatgttgcttttggtcctcatcaattccaaaatttgaatatttgccaaataccctgaaaatgccaaattaaattatgaaactaatttgaattatctccaattttaaaaattatttgcttgctcaaaagttcgctaaaaaattaaaatatcaattttgaaattatttagttatatatatttgaaattatttgaaaattaatatagatacaattcttttaatgatcgctataattaaatctttatatttatttttagtttaaattttttattttttctcaccggaaagcgatttgagcatcccttcgtgcggatttaatgaaaatgccataatttccatcattgatttgacgtcagttgcatccaaaggttcgtcagggatggcttcgatgttagggattaacacgagggccaagtcgacatcaatgccgaaaaagttcaactcaatcatcggaatgtaagcgcgcggagttttgttcagaaaggtgactttcggatgctaatgacaataattttggcaattaaataaaaaaattaattattattttaaaattattagtaaatttaggccaataatattatagggatgaaaaaattagtggattttaaaatagatcaatttatgaatgactttttcacaactttattattcaaaattttcaattttttagaattttttaaaaatatttttagcaataaagcccttattctcttattttctctttaaaaagaacgaagttttcaattttctgatcattaattcgtaaatattttagctttatttaatgcacataaactcgaggcatttaaaaattatttcaattaaattaactaattaattattgattaattaagcgataatgccttgcacaacaggcagtacaacgaattgtcatcgcaaattctttcgtttaaattgcaataatttttgccaaaaaatgtgtccatttcctccttttgggttactaatgtttgtcgcattacgcaaattatgtcaatgtccgcgtttgttgtccgtgcgcctaacaactgggaacccgtctccaacactcgcgcattgtcgttggactaattaggagggattaaataggaataaaaaaaaagaaaaagacaaaaatttaaaaatttgaaaataaatatttttaattaatctacaggataaaaatttcagcaaaaatgttatttattttccttttaatattaaagacaaattcgaaaatttttcgattaatacctagggctaaattcaggctaacaatagatattccttttcttggcattcttttagttcacttctagcttcccaaaaaaaaagaaaattgaaattttaaggtttttcaagatcttcccgatcggtaaaaactttactgttacagtaattaacacgttttactgtactgctcaccagaaaatcagttaagtagataattagcaatatgagcgactaacccatgccgaaatgagagatttcagtgtattcaatgcggatattgattcggttggctgcgcttcatggaacccattttcacgcagaagattgaccagcttcataataacatttttttttattaatttaaaataaaataaatttaaaaagtttacaaattcttcatgcttttcttcttcagaacttttaaaataaatttgctgtgtattttgtgggaaatttgtgcccagatttgttttacatttatccataaatttgccttcatattctttatacaattttctgtcttaataaaaatgttgagaaattattttactgttttatattggaattgttcagccatccgtgacaaatttcgtcggaaattttcgtccaaaacgatattcctatcaccgactgtccgtcataaatcttaccgaggcagggccagtttggtctagtcaagttcgaatgaaccaagatttttttcgtgatataattgttagggcttcgttttttaggcaaatgcctaaaatttctgcgcacttaatacgctcaaataagcacgaaacacgcgttttccacttcgtttgaagcttctacgatgatttttataatgcctaactttgcctattttggaagtttcaaaaattgatccccaaaatttttttttttttgataaaatttttggtttaaaaactgtctgtgttcgaaaaaaactgtaaaacaattgaaatataaccaaaattaagttttttgattaatttttatgggtttttcaacaaaaacgcgttaataaaaacattttatttgcctgtttgtgcctattcggggatttttgtgcctatttaatgcctatttgcgatttttttctgcctttttaggtgcctatttcgcgattttttgtgccaaaaaaaaacgccttaataattgtttgtaatttttaattgttgccaaaatattcaaaatattagggagatggatcgataatgaatcttacaaataagaatcgctttttgtctctgctataagagatttggggtttcattcctcagcatattgggatatattcccgaacatatgggattttcagttttgggtttctagaactcagtactgttctctttatgccaacaatttttcagttgactgctaattaattgccaaaaattttgacacaacttaccaattcgctgctgctcgcccaatgctctccacccgttcaaataatactcaatgaatcgatcggccaagttctgtttgcttgtcccagtgatttgggccaacattttgccttgcagtttcttatccatactttgccaaatgctttttacgctttttggcccgtggggcgtgccaatttcaattgcttgtgctaatttgttccggtgcaattgtttcctgaccattttcatctcctcatcctcctcatccaattttatgtcaatttttttgccttccatttcaaaaataattcgcttcaaaatgccgtacaaaaggtgcgcaaatttttcaaaatcaccctccgttttaatcgccaaaattttggtctcattgagtcgttcctccaggaacaatgatgtgtccatttcatttaattgtttgaatttaaatcgttcttcctcatttgcccttttaattgccagaattttgttgatttttgcaacaatttttgtccgatgcaaaatttcgttcacaaaaatgccaatgtccaaaatccgacgctgcatttccgtgggatttgtaaggaattgggcataagcaaaatgtaaaaattcatcggaaatgaactctaaaaaaccaattttaattctttaaataatatgtgaaaacgcagaatgggaagggtcaatacttttaataattttgacttctcaaattttcaagttttaaatatattttcgtaatatttacgatcgctatttgaatcaaacattttttcgtccattttaaatattggccaaaatttatggataggggagctcattatctgaataattgatgcaaattggcaaaatcatttggctattatgtatgaatttagatgaaagaaattattgattgtgatcaatgatcaacatttatgaaaaatagtgccaaaatttctagttcaattattttttgaaaaaatgaggggccctcttcccatcctgagtattgctacaaaattggcacaattcacttggcaaattggacaattctgttcgaaattcatcggccaatattctgttctgccatttctcattgctgacaggactttgcactgagttactccaattacgcggcgaattactagtcgaaattttcaaactattagaaactttgtgcctcaaggggctaaacagcatattctcgctgctgttccatgatggactgtcggagtgtcttgatggactcaggtttggactttcgtcgtacctgcaacacggattttaattatcattattttgagagcgggagccggaaaataaaaggattaataaaggagaaaaatgtggtttaagcagtgccgaggcaaatttggaaaccatttgatcaaaggttgaaatttttgggcctaaataagtcgtgaccaaaatatgggataaattgccccaaagcaaatttggaagcctaaaaggcctctagtctgaaattctcgttattaaaactcacgtgagcaaaatattgggtaatcagccccaagcgccaaatttggaggcctaagatccctgtggctaaacgtggtctaaaagtggcacaacggtttgcacctggacggggtatcaaagagcgcttcatcgttgcattggtcaattattgtgccgtgtgacgatggcaccaacagtctgcgtctctgccgctccaactttctcttttgttcactctctagcctccttttccgcttctctgtctgtctcgctgccatctgttgccccaatttcttcactctctcctcctctccaatcagttgttccatgttctgatcagctaaatcagcttcacgttgcttcttttcatcttcttctctttccaatttatcttttaattttttgtttttttcatcaaaatctttctgatcagttgaatacaaaattgtcataaaatcctcgatcaattcaaattgtatgaaatttattaatcgttctttggcctcctcatttgcatcaaatccttaaaaaatatttactaaatttctttttccattttaattatccattattatggcgtatatttattatgggagaggattagaggatttcaccttccgaaacgaaaattaaaaatttctaaaatctctcatctgcagctcttatctcggcataccgtacaataatgaaatatggtatataatatatatatatatatatatatatatatagagagatatatatatgggancnncnnnnatgcttctcaaaagagagggattacacatatgtaaattttact

SEQ ID NO: 7294 - DNA, 3628 bp, Heterodera glycines
cttctgtcccagcaatctgcgttgcttcatttgggatcaaattctcagcctttttgccatgcgtgatgcatgcatttactgttgggttgcttatccttagctttaattcgtctaaaagcccaaataagtccatcattttgcagctcaacaaattaagtgagcctgctttggcaacataaaatgtttgctcgacttcaattttgccaaatttgaatgtaccgaatccttttccaataaaggaaatttttgtgccgtcgaaagccttgccaatttcgttacatttttcgatcggtggtcgtccaacatattcgtgcgtcaattgatcaatgacgacaatgtccgaccccgtgtcgagatggaattcgactggcttcttgttgaacagaaccgctgtttttagcagcgaaatggaattgacggcatgcgtggtcattccaatacgaaggtggccaacgcggttgtttcctttctttttggcattttggcgtttgcgccactcttggacacgctcgcattgtttgtccaaatggccgacaaactcacacttgcggcatttgctcgttttgtaacggcattcgtcaggtcgatgcacgccgaagccacatcgccaacatattgtagttgcctcagtgttggtcctttctttgaatttgttcggcaaattatttggctttggactttccttgacgtatttgttcgttgaattgtttggctttgaattttgtcgaatcgaattcactggcctcgaagaacttgtcgcttcgattgcctttgcttctgaaattgtggattggaagctgattaagtcttccaccactccatcatagctgatgttggcgccatctgctgacaattttgtcagaattcgctgtcgcaatgcagcttcgttgggcgctttgagtgccatcaataacatgaggcaattaaattgctcttttgtcagctcatcgaatttaaaatcggtcagcaattttctgtgccgatttatgaactgcctgaattgttcgccttctcctctcaccgcttttaaacactcgtagcggtcgatgaatatggactgagccttggcaaatagcttctcaagcttttcggtcgtcactttaaaactgaaatctgtgaccgacgacggcagaactgatctgctgtattcgctgaaagccgattcgctcagcttattcatcaaacatttgaccttgacttcgtcgtccgccgttggtgctgtgcaatccaacgcgaatttgaagcgctcaatccattccgaaattcggctcttgtcgtccgttggctcgaatggtgaaatgtccggcaatattgggactgaatttgctccttgattgggctgtgccgccgcatttggtgcgttttgtcggatcgcaatcaattgagcaatttgctgtgattggtcctgcaccattttttgttgatccgccagcattttcactagctgatcgattgtcggattttgcgcaatttttgttgatcaattttcggtgaatttccttgtctttgttgagtaaaccgcacctggcggaaaccgcaaccacctgggtatcttggtttttttatgatgaataaaccgcgcctggcggaagctcacccttattgggtctattgcttttttgaagaattgatgaatagcaattcggaatctgtccgaaattgccaaaatattccgacgttgagcttcttttttaagacgggcgtcgccaattgttcggtcttcaagccgacacaataaaatgtttatttgatgaacaaataaattaaacaattttaaataaaaatgggcgaagtcggaggcggaataaataaattggaggagaacaaaaatttaggtgaagagaaataagtgcataaaaagcaactgaatgaatgaggggaatggacatgcattggacaaaataaatcaatagtgtcttacattaataaaggaagacacaacaaatagagagtggggaaaataagaggaaaagaaagagacaaatgcaaagggaaaataaatacaattgtgaactttcatctctcggggttgaccacccgaacagtaatacataaaataattaaaatgaataaatataccataatctatttctaaaaactctaaaatcaaaatgtttaaataaaacaatatttaaataaacatttattgattgacttattgatattggaaaaaagccacttccagaaaaatgatccgaacaatgagacaagaattatgatctaataaaataattaaaattcataaattaattatttttaaactgcaataaattattttacaaattcgaaattaacaaaaggtatattaaatacatatttaaatagttattattaataaataaactttatataaaagtttatttttttaatttatcataaatttttgctttataaaatcttaattgtatgcaaataacgagctttaaattttatgacatagacattaaaattgatcatagcaatgcataaaagacaattgtttaacaaaaattcaacatttttctcttagccaacattgttttaataaatatcaacactggcgttgatatttatttaatatcaacatacattaagccatcaacgtaatataaatgctatttttaaaaattcgataatttttaaaatgttaagcaattttttaatgacttttggcggaaaaataaaatgtggagagagatagaaaagtgagagagtgctgaatttcagtcccagtcatacaaaagcatttttgtgaagaagaaccagggattcttttttatgtaatacatgtttttttcctggatttgccttttttgcaattttggtgccttttttcatgcctttttcagcattttaggaaaaaaatagaaaattttaaaattttttgcaatttttcttatcatatttcactgcaatttccaaaaaaatttttcccagcggcaataaattgcaaaaattcaaattagaaaaatatttttattaaattgtaagagcaagagaattatcaatctttagaaaaaaaacaattaaagcaaacacaattcctaagacgaatcagtttttttgttgatgaattgatgttttcaataagttgttcaataaaaaattcgataaatcaaaataataattactttttcagaatctaaaaaatgaaattttatttgcttatttttgttcctattcgagaatttagtggctatttaatgcctatttcgtggtttttctgactaaaaaagaatccctaatcataatatttgatacagaattaataactcctgcaaatacaattattagttgattaataaagaaaaaatgagtattatgtagagtagagcgggaccgggaccaaaacacggacaactgagtacaactgagtaccgaggtcccggttttgaccagttttgaccgggaccgggaaattcccgtggtcccggactaatactcccggatattccacctttaaggacccctttccaggcagggccagactttgccgggtctaatgcaaacaaacagctgcacttcttaaaaattgactcgacaaattatagggactgtaaaagctgtgaaatttttatgaaagatatccttcatagatcgcgcaattttctattttgactcctataatacttacaaatacaataaataa

SEQ ID NO: 7295 - DNA, 3219 bp, Heterodera glycines
  misc_feature (124)..(124): n is a, c, g, or t
tttttgcaatttgggtccttttttcaagcctttttcagcattttaggaaaaaaatagaaaattttaaaattttttgcaattttttcttatcatatttcactgcaattccaaaaaaaatttttcncagcggcaataaattgcaaaaattcaaattagaaaaaatttttattaaattgtaagagcaagagaattaacaatctttagaaaaaaaaacattaaagcaaacacaattcctaagacgaatcagtttttttttgatgaattgatgttttcaataatttgttcaataaaaaattcgataaatcaaaataataattactttttcagaatctaaaaaatgaaattttatttgcttatttttgttcctattcgagaatttagtggctatttaatgcctatttcgtggtttttctgactaaaaaagaatccctaatcataatatttgatacagaattaataactcctgcaaatacaattattagttgattaataaataaaaaatgagtattatggtccataaatgaaattttaaattttccaaaaattctattaatatggatatatattttttattgcatctgatttttttaaataaataccaatattattaattttcatccttgaatttttatgattttttgcggaccatgccaaaaactgacattcgcgcgctactttttggcgaatttaaaaaaaaaatcgattcaatgtacaaaattttagccttattattaaataaaaaatgaactcacaataaaaaaaataaaaaatatatttattcatgaagggcaaaataatctttttttttatataagatcaaattatttaaaattatttcaatttcttaatggctaaattaatattttaataaaaataataatcataaaaccgaagacccaaattgttatttcataaaattaaaaaatttattaaatttcgggcgtgatttcacgctcaaagcatgattataatcaaaaaattggcaaataagatctaatgaaatcttattcaagacaactttacttgaccaatttttaatattaattgtttaattttggaaaaaccgattcatggaaatattttaaccttaaaattttgataaattaattcatagattcaaacatataaaattgcgccgatattaaattagaatatttttaataaatctccataaattagaaaactattaaaaataattgaaattatagaggattttatgaaagccttcctttttcgaattagttcaatctattttaggaaaatttttaacaatttatttaaggatattttaatattaaaaataactttaaaattttttatttcattagcgttttatgtgtaattattagtcacaaagaggcctaaaaattcgcttatattttgtgaaaaataaaaaaattgtttaaaaattaaattttaaaattttaatccttcaaccccagaaatcaaacttttaatgggctggatgacatgataaaaatatactaaaactagtctagttattgaataaaaacgtaatacttaaggcggcgttgtaaaattatgcaaattaattgtataaaaaaatataatactctgtctttggacctttattattttgatttatattaacgatcttcctgatgctttgccatcaggagtaagaattaaattatatgctgatgatgttaaattgtatatttgttataaagcgagatttgacacagaaattatgcataaagcattgcataatttatcagaatgggcaaataaatggcaaatcagaatctcaattaaaaaaacttttgtactttacttggggaataaaaaccccaaagaaatatataaaattgatggaaatataataaatgttgtggatacaattagggatttaggcataaatattgataataaattgcaattttccaatcatgtcgcacaaataataaagaatgcatatttacgtatgcgttaaatcaaaatcttctaggatttggattattttgtacaaaacttatgttagaccgttattggaatatgctcctgaggtttggaatccatctcttctaaaaaatattaaaaaaattgaaaaatgtcaaaaatatttcaccaaaagagtttctttttaaatgtagccttccacccattccataccaaaatagattagaataccttcaactaccaacacttgaaagcaggagaaagctttctgatctgttcatggctcataaaataatttatggccgaacagatctgaatccctttgaaatacttaaaccttctaaacgctttaacattcccttttatagacttaactcgaaatataaattaggcaaaaaatttataccttttgcggggcgggtaacaaaaatttggaaccaactcgataaaaaccttattgaaataaactcattaaatcaatttaaaaataaaattaaaactatttcatttctgtaagattgaccggaaaaataaaagtcgaattattaattcattaaacaaaaagtgatttggtcattatttttattttttttttattgacctcacattatattttattttttggcggcgatctcgtttttaattgtttatgcgctttcttgagggcattttaattaatgttttgtcctcaatgtaagcggatttttggttttgtggactttataaaataaaacaaaaaaattgtttttctttttaaatttccttttgctttgacaagtgaaagatacaaacagccagtaaatagtgcatcaaattacctaaactaataaaaaagaagagaagaaaattattcaattaaagaaggtgtgatttaatataaagttacaattagataattgtaagtacttgcattttaatgagttcatttagaaaattaaataaattttatcaactataattaaacggtacatatatagctggcggcaagccgagaaataaaaattgaagatttggggataaggagcagtcgaagcaaaacaaataattttttgaagtttttaatatatagtatttttattttaaatttttctaatagattcaaagtgttcctaagccagccctccgttcggtatcaatgttaatatgtaaaatttatgttcgttggtttaaaatgataaatcttcaaataaagggcagaacaaagaaataagtaaaaaaatgaaaaaccttaatttacttaagacctaattttatgctacaaggacaaaatttaattcattcaattagaaaataattaaa

SEQ ID NO: 7296 - DNA, 5845 bp, Heterodera glycines
aataattaatcattaaaaaatcaaatgttaataaaataaatgtatcatttttataaaaacaacttgttattttgtcagtaaatgaataatttacaaaaataataaatttgaatacaatcaaaattgaatataactatatgaatttaactagtaatggaaaatcaagtaaaatatagagattctggaaagcaatttaaaaattaaaaaaattaagagaattcgcatattttaaaatggattattcttttctacaaaatttcattgaatatacaaaaaacacatcacacatgtaaaaaaatgttttaacataattaattataaaaacaactgaataataaaaatatttgtgcattatttatatttttaataattagggttgctccccgacatgtttcggggaattacgaaagtcataaattgcacttgaaataagatggaagtatctttaaatgagtttttaagacttttttgttctggactttttctttttgtgttttttagactttttatgaaaatttcttcctccccgactaaggtgttgctccccgacattttttaaatttctccagccatccccgacaaattctttcggggaatttcctccccgttccccgacattttgctccccgaggctcggggaggaaccctacttaaaataattgaatttattaatattagaagataaagatcaaattaaaatcgaaagaaaatattaaataaaaagtaaaaaagaatattaaagtttttaatctattttaatttatatattttattattctttaatatatgctattaatatatttcataaagtaattaattttaacgaacaaaaagtttatcataaagaagtattattaaatcaacaatttcttaaaggcaaattaaaaaaaccaaattaaaaataaaatataaattacacaataaatataaatttaatccgttaaatttttagagttatcacgaacaactacgtaacctcgataagctagcaagataagatttataaaatatacacaaatataataatatttaaattataaattaaaaaatagtaaaagtgctgaaaaatattattccgttggggacccgtctcgatattcagggatttaaagagaatataatattattttgtcatatataatttttttagttctagtttatagaaaatataaaaaacgctttggttattttttcaatttctattttatattggaagtattgaaagtgactttgaaattattaatcattttgttttctgtaggtgccaatttgaacaaactttttgtaattatacaattaccattaatgtgtctattatttaaaaaattccaaaatattcattgaatattacaatattaaaattgcttatcgaagaaaacttatcatcttattataataagtaaatcccaaacataatttttttcattaaaattgggaaaacaaaatatcgtaaataaacttattatatattttttcttttgcccattttgttttttgtttaaattatgcaaattaaaaaaattatacacgtgaaataaaaaaggaataattgataattgacacaaagcatatttcttataaataaaatttttacgtttataaaccttaataaaatgaaatattatgatattttaaattacaaattataataaatattaaaatataaaaataccaaaaaaataaatattaatttcaatgaaaaagttttaaaaattaatttaagcatttcctcagtatgttttaaacgcctttccaaaatcgagtaaattaaaaataaaattttacttggaaatataaattattaaaatttgctaaataataatccttttctcaaaataaaaaaaaacaaatatttgtttttaatgggaatattatgatttcttatttttttatcactacaaaaaaaaatagtttatagttaaaattcatatatttgtcaaaatgactccagatgaaaattatggtaaatattgatcatagtcgccaaactcaatatggtttaaaaactgtctgaatcgatgttaaatgcttagaaatgtgcaggaaaaactgttatgcaaaaccaatttaaaaaatataccagagttgtataaaaaaatagacattttaaatctatgaaaaatttgtctatttctaattcttcactcggcgccggatttttttaatttaacatttaaaattttgtctttaacagactaagtttaaatttcttataaaaattaagttcataaacaagcgttgtataataccggttcataaatattagtttcgaatttattcctgtggcgccgagcattcgtaatcagaccgggaagagaaggattttatacatttttgttttcactaaaaaatattttcactcttttaattaaataattcgaatatatataataaataataattttcttaatttacaaatttaaaaaatagtaaaatagcttaaaacgctccatcttggaagtgaccttaatgattatagttttgttttgaagagcacaaaattgctaactaattgctaaacaatgaacaaataaattaattatcgacaacattgaattaataatgaatgaatcatttattcttaaatttactgtaaatcatgtgctaatgcacaagagtaaacaaaaatgctagtggcgtaagtttccatccatttgtatttacatctatatatatacatataattgtactatttaggggaacacttggcaatggcgtcagccggcaaaaagcacacattccttctcggacacaagcggttcagctcaagaacctacatggaggagcatgccgtttccgctgcgtcagcatgggaggttcatggtaaatagtgctagtgtttattgttttaattaattttgtttttaaaaaattgtaggtgaggtgtacgaggctgttcgccttgtgaaggaaaatttcacggaacaatcaactcgctggatgtgctttgcatgccagcgaaccgaccacacattccaccggtgtccgaacaaggtcttcgttcataattttttcaatattagctaatttttcctttaaaacaggcgattctggacgaatttaaaaaattcgttcacgaattcccacaggaccagcagaagtttcggctggtcctgtcggacaagattgccatggatggcaaaatgctctgcgaattagttccggggttcggtcagtttttttttcttgttttatttctcatttaaatttggcgatttttaggcgggaagatcgtgcgccgacgtgaacaagaggcggccgcaaaattgcgtcagcaagaagcggatgctgcgaaggagaaactgcgtcagcaacagcagcgggagcaccttcgctccttgggggttggttttgcctcacttaatgaaagaatttcttacagctggtagagataattctgtcagctgtaaagtatacttacatgtgcaatgtttttaaattttttttacagcgaatgcccgcagctctgctcacgttggaaacgggccattccatcgatcaccttgacgcaaagagcaacatcgtgaggatgttgatcgagctggctgaggaggaggaggaggagaaaacccaccattattttttttttgtttcattatttcattttattttgttcacctcccacggctgtcccccttgggacgggtggaggggtggtggccggcgggcggccgaatgttgagaaactttttaaaaatttcgatgcccaggcgcctcaatagcgaggcgtctctaacccaaacggccctctttagggctgtgagattgcaagagttaaatctgcccgccggccacaacctgatcattcactcatatatttgttttccctttgctttagccatagctaggagataggcaagtgtaagcatgcaaatcactgtttggcatatgtgttttaccatatgtttacaatgcttacactagcctgtctccagctaaagacccctgccgtttttccctcacttcgttgaggttttttacccggcgggtcttcttctcacccccacttcatcatttatttgttttttgttgtgtcaacaataaatttatttgtaaattagcttgcatgaattttttaaagtttcgaaaaactaatttttatatgacttttttgtacacaacgtagttttgggaacccttcaagcgatcttgaaggggctctctctcgaatgccaagcatacaccaaggcttggaaacgatcatacgagatcgcttccgtggccagcaaaagatgtccgtcggctggctcatgtgtcggtgacttttgcacaaaagtccgaccctccacagccatccgagagctcagggaaaccgaaacgttccccgggaacagtttctgcatcgacagcacggcattttggggaaaccaatgtctcctagcagccagttcatgtctcttctacaagtggtttgcaaaaccacgctcataagccatttacgaagtcatcggatgcaactcttgggagtttggcatccatattcaacttcgcctcgactctaccgctggaagaagtgcgacagtcgaaactgtgcttcttccaggccgtgtgctcaaatggcacaacatcagcatttcaacaataggagtgagccaagcaccggctcccctactgaacgctgacttcctgattgaagggcgaaatgtcgcccttgtccgtgagaaaatcacggactctttccattgtacagacttgaaagccgcccaagctttcaattgtactctgggaattgacgcatgcacgggctgtcttcccgatcacacagacgggacagtctcgtgccattgtcgcgtcgccaatctcgagggtctaatggaagaccctcagcggagacttccgctctcattccgccattacgaactgcggaatcacggaaggcgaatattcgccataaccggatatagtccggtccaaatgaacattcaaatggacagccttcaaatgtccttggaaatgcaccagagtttgtgtacaatcacaccaaagcacatctctggctgctacaaatgtgcgacgggagctcagttctcctactcgtgccacactgacattggccaaacattggccgatattcaatgcgaagatggttcgcatttcacgagcaaatgtggcccgaacataacggaccacactgtcgtgctcccattccagcatgccgaaataagcacgacatgccaagtcatgtgcttggctgggagaaccaaattctccttggtgggacaactccattatatcccactccgacaacagtcagaattcggagcccgagtctccgaaagcctcgaagaggccagcaactccaggctgggctgacttcagtttcgactgggcgtccacccttcatgctctgtttaggcttaaaacaggcctaatcttcttcattgtcttgatgatcggcattgcaattatcattttcgttgtacacatctctcctgtgtacaagttatggagaacatttgcttggttgctcgtgaaccaagctccgcgacccaacaacgccacaactttttccgtggctgccattctctttttggcggccggaggatccttcggatgggaacctcgaaaaggggattctttccccgtttcatgcggggaattaagaatccccgaccccgaattttcattcagggaagcggaggggaatacagtacccctccatcaaaaaatcgattaccgtaatcgatcgccaaaaattgatataaaagaagaaaatttgaaacaattttcattccttcgctatcatcaagccccaaacaacactcaacgcctcagcaaactcatgccgattctgttccgagaacggcctccctttttctcggcaccaacaatcagccgaccaaca

SEQ ID NO: 7297 - DNA, 1135 bp, Heterodera glycines
agtcttccggagcaggacaaaacattcgccgccgcccccacgtccaaaatttacgaactaacaaaacacggtatttctccgcttctcacctttaaaggtatcgattggccagtagaatgtgagatagtttccggcgcacagacacgggggggggaggggagcagctcaatttttgttcacctatggtgctctgtctcattgaaataatgtgcccggtcctcaaggtaattttaatatattttccactgcgatgttttgtcccagcgacattttaggctgtgtcggggcactttgccattctctttgtcaatttttccccttttcgcagtttgtccgcgattgatgatatggagtttcgcaaggtgcacgtcagagggtattaccttttcgaccgccaatttgtcattcggtggcgctgtcggttggaccccgcaaataccggcacttcgaattcggaaaaatatggggcgtatgtgatcactccgatgagactggagggcacaaagtacttttctgttcggtttcaccttagtttcctaaattcactttttgcaacagaaatataagaaatgaccataaattgttttttttcttattgtaattttgggaacctttcggcgtctgaccatcttttggtgcattaaagaaatttcggaaattggggtttacacgtttttgttttgaattcgagtcgaagctcaaaactacctaaagccaaattgtccccactctaatcgctaaatttgttagcgttacaattatggttaaccgaggatgggttccaaacgaaaacatcgaatccgaactgaagaagggcaagcaactgcgggagtccgagctgaaggatttgaacgcggtcgtcagaagtgctgagaaggtgggccaagtgttgcgttatgttaacccaaccatttgtttatcttttgttttttcttagatttagtgtttaaattcagggctctcctttcgtcaaaaacgacccggaaaagggaatttgggccttcaaggatttggaagaaatggcaaggcaaagcgacgccgtcccaattattgtggatgccgatttcgaatcgactgaaaaagacggaccgatcggcggacagaccattgtcgtcctgcgaaaccagcactacag

SEQ ID NO: 7298 - DNA, 3841 bp, Heterodera glycines
tttgaggatcagccttaaatccgctgaaatttaccttctttgataagcgtcactttgctggcctcggcgtcccccaaataattgagaatgaattcgaccaatgtgttcagtttttccctcatcggatttgttgtttcttcgctggcggtttcgttgtccaattttttctgtttcaaacgattagaattagtcggctgttgttcttcttcctcccgctcaaaacataaagcctaaaatgacccggaataaataggagaagaaaaacattactacatcgatgtgcaggagtttctcgacgataagcgaccaaatttcggcagagatttcctcgtccctaatccaatcggcaaaacggagcacatttcgcataaaggcgagcagtttcggagacggctgtttgatgtgcggaaagcgtttcacaaaacatttgagcagaagaggcgtcgtcctgaaaaacaggaaaacaaatcaaaaagaagtgaaatttgacggacaaagggttgcaggagacaacgttttggatggaaaggttggccaaggcgtacagcgactcttggaaatggtcgtccaccaccgctggcggacgatgcgcctcaaaatttgaaggatcttaaagttgggaaaatggaaagcaaatttcaatgggctagaaaacctgcagatttaaagaaattgtgtgtgtcgtcttaaaaacattgtttcatacctttcgcattgccaattggcaagaaatggtcgacgaagcaattgaacactgaattgatatggtggacatggttgatggccaaagcgcataaaaagtcagtaaattgcgaaagcatttggggaggaacggtatgccaacgaattttctgaattttatcgaaaaaaattttgcgactttcccttaaactcacgcataatttaagcaccaagtctgaacaattcacgtccaaaatatcgtaggaatccaaaaactaaaaaaaataataaaaaaggatttttcgaaagacgaacttggctaaggaaggaagtgcgcgattcctcactccacaattcgaatgagctgagaatggaacatactgatggtatttgtccatggagccgggcatcatctgaaaagggcaaataacaaaatgaaaccaatgagcaaagataccattacaaaatcctgaataatctcacgtccgcaaggcaattctttgccctttgaaaggcatttcgtcggttttttctcaggcattccgtaatcaaaggcgaaataaataggaaaccaatgaataaacacagatcaacaaatggaataaaaacaataacaattacctaaaagaattaaatgctaatttaaaaaaagaataaaataaaaagaagttaaaaataaattaggtcgtttgtcatttgtgctcagagccccctttgattttcggggtgtcaaaagtgagtttaaccagtgtgaagcgatttaagcaaaccataagaaagttaaaagcttgcaaactacattagacaccgagtttatcaaacagataaattgcccactttaatacctatcttcttaatttccaaaacattttaaaaactggcgtaatgtttataaaatatttgaataatgaatcgaattgtaaaataatgttgcttattagagacgggaaatttcaaatttgcggatcccgatgcgggactggaactcaaaattctttgcgggacaggataccgcgggattaatcccgcaaatcccgcattggattgcggactgggatcccgcaaaatcccgcgcgggatcccgtcccgcgccggtctctattgcttatcgctcgccaggcgcaccgtaccctcagaacagaaccgagttaacagtatgttcatatgcttacaaattagaattagagtttacattctggcaccatctctgttcttccccattaatctactaaatgttcatttgtcggtggcgtcgagaagagaaatttatacttttttaaataatgtgtgctttattcttgagcaagtcagttggaaaatgtgcaaaatgaaacaattaaaatgaatgaatgcatttggtgcgtttcgctacgcttttcctttctcagtagagaatgaccgaattttgagccgatgattcttcagtgcagcttctgtgcagttttgagattgtcggcggcggaggcggcggcaaaaggcgctctttgccggaggatattttgcactgatgcgcagaatgccccccgagggagacggactcctcattgttgaagcagtattgcatgtactgaacggagggggggggcgatgcttttgaagcatttaaagggaaattaatgccaatcgggcgatttatcatatgaaaagggaatgccgaccgcatcttcgatccatttgaagatgtgcacgtcgtatggcacgtaaggctgccttaaaaaggatgcaaaaagtgatgccattttttgtttggtcagagttcgcttctacctgagcaaatgctcctgaacctccaaaaaccttttaactaaatcaaaatgccgttaacaaaacaatcaattagctgttaataactcacggtcctccagcgtaattcgctctttgctgcctctgcgatggcattggaaagtcagtgaatttttctttcaaaagtgccattgtctctttgctcccccacctgatctttttcattgctgaaatgatcttcattgcttcccgcatgtccctactaaaatggcttttgagttgtgttttgcttttcccttcctttgctttgccttaatccgtggatgccatggatttctctgattttacgcccaaagtaatgcaacttcgtgaaggtctttttcaaggttgaggagcacaagtcaagagaagctaatcaaaagggtgggaaagaaagcgccaattggccgactgtcagtgccacggcactctttgcccacctgtgatcactgcaagtccgataattacgtagagaatgaccaactgttgaggaagtacggggaaaatgagggaaaaagcggggggagcgattaattaccgcgagatacactgaaaaaaggggagggggtaaagtaaaaaagtacaaagtgaggggaagggaacacaataagtaccacgattggtgacacggatattgcccaatctgaaaaagggaaggaatcgcgagggaacggtcgaaaaaaggacccaatggtggtgatggtgttgaaggagaagaaaaggccgtggatgaacgaccttaaaagctggcgattagctgaactgatcactaaggctgggattctctctctatctttccctcttccctctcacatttgttcctctctcttcctcctctcctccatcggcttccgttcttcctctctctctctctttccttcactctccctcctcttctctctttccctcttccccctccctccccccttctcgctctctctctctctctctctttcccttttccctctcatatttcttcctatctctccccctctctctcgctctctctattttcctctcttttctcccctccccttctctccctctctctttccctctcacatttcttcctctctctcccccccccccctctctctctctctctcctgttttccgtccccttctctctttccctcttccccctccctcccctctttctctctctctttcccttttccctctcacatttcttcctctctctcctcctctctctctctctttccttctcacatttcttcctctcctctcctccatcggattacgttcttcctctgtctctctctctgtctctccctcccttctctctttcactcttccccctccctctcctctttctctctctctctcccttttcgctctcacatatcttcctctctct

SEQ ID NO: 7299 - DNA, 2682 bp, Heterodera glycines
  misc_feature (1860)..(1860): n is a, c, g, or t
aaagacttaccaatggtcgtaccctaaagggggggggcgattgatcagaagggaaagtgatggactgtcattgtcgatcagtgcttcttacctgtggaagtgatcacagtcagtgcgtagagactggaagcggcgaaagtccactaaaatagtccgaatgagtggaaaaatggggaaaatgcggcaaaaatgggcattggtcagcgaattgggcatttggatgtacaaaattaggcattttttaaaattaaattttctgttttccttttcttttcccaccgtacctttgtggccaaagtgtgctctgaatcgctccacatttgcgcctcggccgtgaacctttcgtcatattcgtgagtccgggaaagcactgagagaaggggacgcattcgacgttcgacctgagaagtgaaattggaaaagggaaacgcccgggggaggcaatgtcaaagggaggagcacgtcttctaacatgccatttgccaacaaatggccatcaattagtcggcgagcctcggcatttctctcctaatttgggtcccagcaccgaccatcgacccgttcagtgcggagagggaagtcgcaccggcagagcgacaaatagcaacagtttccttcattatcagttcataaatatgcaaaatttgggacagtttgctccgtcgttgctccaattcgttgtccgcctccaaaaagatgaaaacgatggcacccaacgaaatgtaagtgaacagcaaaatgttgagcccaactgcaaaagtcggcattaaacacacacacttttggcatcataaaatggacttgtgaagtgctaaccgtgcggtaaaagaattttcaggtactgaaaaggggacgaatgagtaccaggggagatgaaaagccaatgaacggcactcactgaccttcatcgtcttctgcagtactgtctcgtgctcaccggaggactgcaacaaaaaaggcacaaatagggcttttttgccttccccccattttttggcccttcccgtcaggcgaaattccgttaaattttggcactttccgtctttttttcgttttgcccccaccctttagtgcacctgttctccgctcattccctcctcaaattcgtcgtatcttcttctgaactcgtcgttccatttcactcctcggattggtgccaaagacggcgtttctgtatttatttatttattttttcttttttggtgagtaaatttccgactaatttaaaagtgaaaaagggaaatgccttctccttggatttcgcttttcccacgtttatttgcctcttttgggcaattcccaaatttattcttttatttacctctgccgaggtaggaaatccaacactaaggaaagtcaaagttttccctaaccgatgccaattccaatccttccgtgccaacaatcattggccaatgctaataccataatgccatccactaaaaccaatgccaatgccaacagaatccctttgtctgattgtgccaattcggttcggcttcctccctctaattccgaatctccgccacttttctccatttcaattcgctttttcccgtttattcctaatttttttcctcctaatttatttcttttttaatcttttcttttttgccctttgcttttcattgtttttttgcctttaatatctttttttgtcgcctttcctttcacttcgctaacattcattcactggggtcgaacaaagaaagttaagttcccccgggagttattccctttggaaaaggaaaagagacagacggacatcgaatgggacgaaaaggaaaagaggaaaagacaggaaggaagaggaggaagaagaagagaaggaagaacaagaggaagaagaaggggaggtgnaaggagaggaaaggaagagaaaagggaagggtgggaagaacggataaggaaatgaaggaaaaggaagcggcagaggaagacggggagaggagggcgcgatcagattggcaatacaaatggataaaattataaattaccgccatgtgaaaggcgtgacacggaccgagaccgtggcaaaggcgggggaaccaccgaagcagcgatcgaagggtgccgatggaaccaagtgcggtccagcgaagcttcggtgaggcgacgcgtgaaagccgctgcaccggtggagcccattttgggagtcaaatagaagaaaatgaaaggaaaagggggaataaggaaaaggaaagggaaagggcaaagaggaagaggggaaacatgtatgaggaaaaggaagaggaagaagaaaaaaatggaagaggaaaaggaatgggaaaaagtagagggggtgcgggtgagggaaaattaagacagagagagggataactcaagtggccaagggttttgaggccacagcaaattaattataaagggaagggatgcggcaaagaaagtgggacaagcagtggaagtgaaagcaaaaaagaaaagaaagaagaagcgtcaattgggcagtgggagaggaggaaaagctgcaagcagaacaggtgagaagaaagagggggagagaggggggggggagggaagggatggcattgggtgctaatgggcgagggacgcaaatcaaattgccgagccgagacaaagtgagaggatggattattcccgacgatgtgcttgtgctcgcttcccccgtcctttcattgttcccgtggccaattgtccgct

SEQ ID NO: 7300 - DNA, 2133 bp, Heterodera glycines
taaggatgagacgcgcgtcgttcttcgtttcccttcctttggcgacgacccttccgcagattcattcatccacgccaattacgttcgttcgccggtgctcttcaacgatttcatcgtcacccaagcaccgatgagcaatacaatcagcgatttttggcgggtaataaaggctaaaaaagggaaaaaatagctatttaatatggagaggcgaaaattcattgaagacagactgaattgaatttcttcaacaaccgtaaactgtacaaaatatactttaatttcacagatggtttggcaagaaaaagtgtgttatattttcatgttgatcagtcgcaaagaatcaaaacgttgtgccccttattggccaaaaaagtttgcttaaattttgggcatataagatatttgtttatttttgtctcttgtaagtctcagttcaaaaccgttggcattgcatggactgaccattcaaaatgagggcatcgaaacgtcttctcgtgacccttttttccgagtcacaaaaattcgtatcatcggaccagacaacaccgaagtatatgttgtgaatgcttatcaccgctaataagaaaaacatctcaattactctttcagcttcgcttggaacattggcaggcggacatgaataactcggagaatgtcgaggcgccccttcgtctgctgcgcctgtcgcgcagttgcacagcgcccactatcattcacgaccatttagggatcagtcgcgcggcatgtctcgtcgcagccgaaatttgcatttgccagttgattcgcggcgggccaatgtgcaaagtcagtcctaattatcttattttgtattttccatttttacatataacatttaattctaaatgaagagcatcacaattgcccgaaaatattgtgtgaacagaacataaaagatatataatttgttttcagtatatcgttcaaaatgccgttcattatttgcgttctttccgcccattttccgttgaaacgccaatgcaatacattgttagtcttatttaatctaccaatgtggttggtcaaatgatttttaattttcttcaatttatgcaccttttcgtttaatttaaattttttttgagtttattcaccgtgtcgttcaacatttcattcgccctttcgttggcattccatctggttttgaacaagattacattcgatggctcgacgaacgttctcaacgtcttttcgtcgatgatttcgacagggaagtgagtaattatcttttttcctttgttcccgtttaaatattttgtttcggatccccgctttccgcctgctttctcctcgcgttgatcccgacatgctaccgctggtacgtcgccgtgaaaggcccgaactccgccgagaaatgcatgcgcccgtgggggaactgcccctcccggctgagatggaatgcgcaccctcaggcggtatgccatacaatcagcaaaacagcggtgcggaccctcttgtaaacatccaacttcctaaacgatacccacgcggacgccgttactaatacatacgaaactgacatctcacattcaaaatgactagaaatctataacaaacatgacgaaataatttagacagctttcaaattcataaaacctctgttaacaactaattgtaagactagtaattgtaattatgctttaacaatgaataaatataataaattcgcgttacaaataagtggaaaatgtcatccgtatatgaaaaagaatgtcggaaatgttcaacagtgttagacggagagtattatgagcaaaaagggaatggggggggatgggtacaatcaaaaatttaattgtgtacaaagctctgccagatgaaaacaaaagggcccataacttaaatgcatgggaactgacatcattcttccttttcctcattttcttcgtcaacaatgaatttgttgctctcgagtaatgtgtccattttgttggccgtcggtttgctacttttcctcacttggctgcttgatttacgcctggcttcattgattagtcggacggcttcacgttgagtcgctttgttgtacggaaacgttttgtagtgttggtcatcgtccagtggctataaggaaataattaattgatttcacgttaactagtaattgcctcttca

SEQ ID NO: 7301 - DNA, 3195 bp, Heterodera glycines
  misc_feature (3112)..(3112): n is a, c, g, or t
  misc_feature (3120)..(3120): n is a, c, g, or t
attggatgcgttcgcttacctcggcgcgccaattctccccccccggctgctgttgcgaatacaaatccctgctgctttgtaccgtaggcattccggcgaaggacccgtgctttttcaagtaaatgaccgcttctttgacctacgaaaatgcaaatgtagaatgtcataattcttctgcgcgtaatgcctgaatctcctcattgtgtcggacaattttcatgtccttgtcattcggattgagcataatgaacggctttatgtactttttgttgtagcgttcaagcttcattcgaaactaaatttcaaacttgtcctttatgaattatgagatttccttgctcctcatttgcttcgttattattttgtttttgtgttgcgaatgcccacccaataatccccgcgcagtccggcgatactttccatccctccgaccatgtgactgctgacattatcggcgatcatctcaaaaacggtctttttgtgcgcttcgaattgcttgaccttcaagtaagtgaccaacttttcaatggaaccgccctgaaagggagaaaattggaatattgacagataatagctgtttaaaactaaaaagacctgcacaaaaactgtgaaaaggatgacgataattgtggtagttgccaacatattgcggcattcgaccaattcggggtccaaagacatcactaaaccgtagcaaacggcaccacgaatccctccgtaacccatgatgaactgatcaacaaggccaatgcgttccacgcgacgtttattgaccaaataagtgagcacaccgacgcctaaaaaacggggaaaatcattcatctgtttgaaaatggaaaagtgatgaaacattaacgaaccgatgaagcgatagacgagacaagaagccaaagtgaccaaaatgaagatgaagtccaaatcgtgatttttagaaactgcagaaagaccgaggaagacgaatataacagcttcacaactgaattcgtttgcaggatttgtatggatttcgctggaattgtcctacctcgaggaaagcgttttcatgaaataatttatggtaaccagcgactgctccgaaatgtttccgactatgtactgcttcattcccatgccgcacactacgattctaaagggcgagagtttattcacttgcagtgtgaatatgacattataaatggttaaaactcacgccaaaattcctgagagtccaagcgattcggcaattaaataagccaaatagggaaagagcaaacaggtgagtggctgcacaacactgacatccttgcccaccctaaagaaaatcgaataagaacggtaaattcggatgggacagggcccagacgaagaaaccatgcgtgtgcaagtgatcggccaaaacgacccccacaaaatgtacaattttggacgaggaggggtcgctgactgacttcttgcacacgcaggcagaaagtgttctccaagaaaagacaaagcaaacaaatgtctttcaaattcaattcagattttgtggtggtttggtctttgcactggtcagtattaagttctgacttggtgactattcccgtaataacggcccacaatccgccgaccaaaatgccaccgacagaaacccaaaaaaaggccaacagtccaatgaaatagtcactccaatgcacaagctcagggccaacgctggcaattgcgttcattgtgtggtaaagaacataaaaaggaattacaattagagaataaatgagaaaaagggacgaattctcacaatggtaacggcatcattcagaagggactccccaaacacacaaatgtacagcaattggttgacatggatctcctcaaatacgcaaatgaccgccacggggtcaaccgcggagatgagagtggcgaacagaaacagagcgatgggggaggggttgccgtggaagaaactgttgaaggcgtacagagtgagacctgaatttgatgcttacttttaaattaaaaaacaaattgacgaaattattatcggagaatcatagaatatcgaaacgaaaaagaaacgccaaatgttacaactgattcgtatgaggggagaaccaaatattaccaaaattttgacagtttaccggtcgctgcaatattccaaagagttccgaccacagcgtatgtggtgatagtcccaatatttttgaaaaactaaaatccgccattaatttttggtacgatacataaaaattccttttcgaacatttcgttgacttccttaacttgcctctttgttgggcaaaaagtagccagcctcaagcgcaattgggggcaaaaggtaaagaaagaaccaatccggtttcaggtaaatttcctgaacattttgatcattgagaaaaatcgtattggtcagtcaattacacgttcgggaaacataatatgcaaaattccaccgaaaatacttcccaaaacgagcagaagtgccgagtcgggcaaaatgcgatttattttttcaaaccgatggaaagctgaaagtaagcagaaaacaaattgtttaattctcaagttacgttaccaattttagcgataatcgttatgaaaaaccaaaaggcaaacgtaagttgcgtctgatgctcttcgaagtgcttaaattatgcccatgtttttgaatttataaatttgacaccatttcgaagaacacaatgcgatctctgtgtccgtggtgggaatgacctgccaaatgcacattttggaccgacgaattgttgaacgattcggacggaacttgagaagtattgagtaacgacgggaatatagacgaagattggacctcatcagtgaaattgtcactcatctgcaagcacaaaacaattttaatttaaccaattccaaataccgaatattaatttagagaagagtgaaacattctaacatattagaactaaattttataatatttttattgaatttttttaaaaaagaaaggcaaaagaatacgaaaataatttatatgaatatttttatttgaatgaatgtggaaagaataagaccagggaaatcaatgggatcgttcaaaatgggcgtcttggcgagagaggaaaaacggatgggaagagaagctgacaaaacgaagaaaaagatatggattcaatanatgggtanattcattgttatattagcaatgtcttcaaaggaaaaatattccattacatgcttttcatcagtggggaaattaag

SEQ ID NO: 7302 - DNA, 942 bp, Heterodera glycines
gggacgagagaggtgtgaatgtgaaatgaatgatggcatttaaaaacgccatttaaatgcctttcttataacgagcgacacacaaaatgtgatcttttatttgcaagtgaatatgtaaaacattctaaagttgtgacgtcattgggcaaaagtaattattgaggaggaaaagcagggaaaatgggaaagggaaagtgtgaagggaaacttacaaaagaagaagcggatgaagaaggagggaaaggctttttgtgggtttggtgacctttaagaggaacaaaaagtgacagaaatggcggagaagacaaagtaatgggagcgaaagcagcaaagattaagtggacggacatatcgcatcacatcaaatgagaggagaagagaaggaagagagagagagggaggaagagagagaggagagagaaaattacatatgagaataattagagtgaaaaggaaaaagagaaattaagcaaaaaggaaacttaatgagaaagaaggaaacgaagaaaggaggaacaaatgaaaatgatttgtgttcgtttggagcacatgttcagcagcagcagaagttgaggcggggaagggcagcccagcagatggacgaccccccaagaagcaatgaaaaaagaaaaaaggacaggtcctctcactctctctcattctctttcattttgtcagcgaattccgatggcatcccccaaattttgtgtgttttgcacctgccaaaagcaatgaatgcaccaacaaaagcattagaatattttggaacatccaacataatgggcggaagaatgacagaaggagccaaaagaaaacgaacgaattggctcagaattggggttaatttccattgccatgggaatgaatgggggggggggcggtgggtaagtgaatcaaataagaagtaagtaaaattgttggctttgtgtgatggtgggacaa

SEQ ID NO: 7303 - DNA, 1002 bp, Heterodera glycines
ggggggggggggacgagagaagggggaatgtgaaacgaatgatagcatttaaaaacgccatttaaatgcctttcttataacgagcgacacacaaaatgtgatcttttatttgcaagtgaatatgtaaaacattctaaagttgtgacgtcattgggcaaaagtaattattgaggaggaaaagcagggaaaatgggaaagggaaagtgtgaagggaaacttacaaaagaagaagcggatgaagaaggagggaaaggctttttgtgggtttggtgacctttaagagggacaaaaagtgacagaaatggcggagaagacaaagtaatgggagcgaaagcagcaaagattaagtggacggacatatcgcatcacatcaaatgagaggagaagagaaggaagagagagagggagggagagagagaggagagagaaaattacatatgagaataattagagtgaaaaggaaaaagagaaattaagcaaaaaggaaacttaatagaaagaaggaaacgaagaaaggaggaacaaatgaaaatgatttgtgttcgtttggagcacatgttcagcagcagcagaagttgaggcggggaagggcagcccaacagatggacgaccccccaagaagcaatgaaaaaagaaaaaaggacaggtcctctcactctctctcactctctttcattttgtcagcgaattccgatggcatcccccaaattttgtgtgttttgcacctgccgaaagcaatgaatgcaccaacaaaagcattagaatattttggaacatccaacataatgggcggaagaatgacagaaggagccaaaagaaaacgaacgaattggctcagaattggggttaatttccattgccatgggaatgaatgggggggggggggggcggtgggtaagtgaatcaaatactaatgtaagtaaaattgttggctttgtgtgatggtgggacaatgagacgaggcgggaagaggagggatgagaaaggaaaatgaaatggaca

SEQ ID NO: 7304 - DNA, 1104 bp, Heterodera glycines
attgtggttttttggaaaattgtatcctctccccccagggagccaggaaccgtcctttgtttgacgaattcgaaatggccaccgactgtttaactaaattatttggctatcactttttattgtacatgtttagaattcctttctcttgcgcttcgtgttggtcaaatggttgtattttctttcttttttatttattgtaatacatataaataggttgaagccgcgaaatgcggaattccaattgatatacagcagctccccgaactttattccaatgcgactgctttgccaaaatcagccacaagaaaaatggaaacaattaacgaggagactttgagtacagtcattacattaaacataataaaaattgccactaaaacacagaaaaatgcaaactgctcgaaaaggagctgatcaagcaaatagccttttgtgaggagagaacgagtaaattccaatcggcgggcgactcgaaaaacacccttttatatgagggattgttacagcaatcaaaagtattttgaaatttaattgttaatttacgtgaaaaacaatttaagaatgatttgcagcgggttcaattggctgcgttgggacaaacacaactccctaagtgcgtttgactaaaatgacggtaaagttttggcattttatagcttcaaattgcccgaactgtccttacccattatccaattgaattcttcaatttctgacgacaaattgatgcttagaataaagaaagtcgagcacctgaaacttcccgaggttataattttccacaatttctggtataattttttgtagggttggaaaccatccgactgtgctttgtacgttttcttcaaatttccttttccccatggtacgcatcaaactggacgaactcccactatcaaagggacaaattctcccggtaatttttgttaaagaaatttttttataaattgatatttttagaatttacggatgtttttcaactggacataagtcgcaaaacaaagcaatttttgcgcatctgcaaaagacagcctcttaaactgggaggtttattctgaaaaatagaaaatcacttttcttcttagatttatcagaagggcggatttt

SEQ ID NO: 7305 - DNA, 946 bp, Heterodera glycines
  misc_feature (883)..(883): n is a, c, g, or t
gagacgactttacgagtgagttagtggaagacgcctttttaagagggatgtgatggaaattgttcctcagaatgggtgtttttcattcttcggctcactttctaactaaattcagacgaagcgtcgattttatctgtcgggtgaaatatggaaatactttgccggatttgccttttgaaccgaagtttctgcaaagtccgttcatctcgttaaacaggttgttattattattgttggttatttttattatatatagtgcgtttgtttaggttcattggctataagccgtccagtctcgagaagtgtttcaaatacgagttgttgacggaacccgatctaaatgtgaagattgatctgatcgatccgatgacatattattgcgaacctgacgaaaaaactacgctcgatcccattgatgaacagcttcttgaggatgaaaacacctcccaattaaacacgcgacggtatttctgatcagattttgctgtttggaattttctttagttctattcaacatcgaaaggtcgttccatggatgagaaaaacggagtacatcagcacggagttcagtcgttacggaattgggcaaaccggagctgagcggccggacaccaaaatcggatatggaatgaaaaatcgcatcaaggacgaggtaaatgatacgcaaatacaaaaagagaatatttgaaagtctcttccactaagtcattcgaatataaagaccgggattcacaaattgcggcaatccaacgaactttctctgaagtccaaaagccggtccgtcaccattacagcaaaaaaggagtcacggcggtcgaggaaatgccgatatttcctgactttgaggcgagtactttatacaattacagcaataattgaattnttgcatttagttatggagatacccattcgctccagtcatttttgatgctgacccgctgccata

SEQ ID NO: 7306 - DNA, 3197 bp, Heterodera glycines
aagttttgtttaagcaatggcggacgacgacgctgaaacattcaaactttggcgcgtacgtaagactgttatgcaggtagttaatgtgaaggatcttggtaaagtgtttgacttacgtgtctttctgaccaaagaggcgattcgtttgttacataaatttgtctgcagatgtgccacgaccgagggtatttggttacgcaagacgagttggaccaaacgctggaccaattcaaggaccaattcggcgatagacccagcgaacggaggcccggcaggggcgagctgaccattttggtggcacataatgacgaccctaccggtgaatcctacagagaaggagctttactaaaatgccgttttctagaccaaatgtacgtgttcttcccagatgacccgaaaataggcatcaaaactatcaaacagatctgtcaacaaatgcaagaacagaacatcactcgagcgatcattgtggttcaaagtgggatgacaccgagcgcaaaacaggtggagaaatttgattgggagaagtgttggctgatgaaccactcatttatcatttaatttgtaaggcgattgtggacatggcgcccaaatacattctcgagcactttttggaggcggaactgatgataaacatcactgaacatgagcttgttccggaacacgtggtgatgagcagcgaagaaaaagcggaactgttagcgcgatagtcagtcccttttgctgggccgactcattttcaactttttaatctgatttagcaagctcagagataatcaactgccgcgcattcaagtcagtgacccagttgctcgttacttcgggttgaaacgcggccaagtggtcaaaatcattcgtccatcagaaacggcgggccgttacattacttaccgactttgcaattgatgtttaattcagaggatttgttgcaaattgtcacttgaataaattgtttttgtaattgaatatatttattgctgtcaaactctcaagaatatatttcgaattttttactttgactgaatcttcctatattttctcaacttgtgttacaatgacttcatttacccatcattttacatatttgggtttctttcaactcaatgaaaatttggacaagggttcagagtgcctgactgatggtttgcagcgcagaacaatcgaagaacaacttattgacagtgccgaaatggcacagcttaattctgaattaatccgcgctaattgcgaagacagcggtttcattgatgaaattgagttgcgtctcatttccggtgccctgcaatttgttcatcccaattcgccgattccttttgagcgaattccactgcacaaaatcaaacatataattagctttgagaatggccgaggtgccgtaaatgtgcttctggtcgagaattttgcttattcatcggaccacaagcttggccttgttagcaagtgccatttatttgaaactcaacgcggcgatgatgaccgaggagtggcaatggttgaagaattttgccaaggatttaagcagaaatttggagaaattctggagaaactatcagccgagcaacaacaaaaacaatgattataattttttacatctttttgttgttgttttttattttataaataatactttatggattaagaaattaggtaataccatttatctgtgtataatcgtataacacacacacgtgatacattatatagttttttccgtgtttttattttcttttgagatgatgtccttctcttctacctccgaaaattcatttgacgaaggtctggcgaatacttcgtttgttgctaataaatgccattttttgaagtgccactgccaatcgtgggaggacgtgtcgaggggcccccttcccttcccgtttctcgctcgacttcgtcatcttccttcacgcgccattcgtggactgagttaaaagccgatacgaatatttcggacgaagaatacggttcgttggtcgtatagaaatgtgaaaaactaattgggtgtttccgcttcagcagatcagtgggcgcgagtcggacacggccaatcccttcgtcagatggaattctcggacaatgactcgactttcggaacatttggctgtgaaatcgatggcacagcgtccgacgcattaaagcgaaatttggccaaaatggcactttttggaattatcgtagcgatgatcttcggaaaggtacaaaatggtaaatcttcaggccatttttaatttttagagcgtttacccttggggggatataacgaaaattaatgaaatgagcgaagaaaatgcgacgaaattgcgcacggagttggacaaaatagtggccgaaaaatgggaatttgagttgaaattggtgaaactgcgagaagaattggagacagagagaaatcgccgtaaggaagcggaaaaggtgggccatatcttacatatcgaaaacgattaaaatgaccaattatgaaacttcattttcatcatttcattcgatagacattacggaaggcgcacgaacagttggaaattgatttgaacgatcgaattcgactggagacggaattgggaaagacgcgggcagaactggtggaaacggaggaaaaggtggcggaagcggagagagaggcggacggaaaatggatgggcggtggagggatgggccaactgaacagagcgtaccgcaaagtcaagcgggcgcagttggcacacggcaaattgagggtgggaaattgaaacacgaaatggcagggcaacgaaagcgaagggaaaatgaaaagaaatggggggagggcgatttgaaagacgaaaaaagagggaatattggagttagttcgatgatgttcggtgagtctcaccactgaatggccttcacagtttcaggagacctccgagtggtgggtgccgttgtattggcgcgtggcgcgcgtcactctcttcaacgaacgctgaaaatgttttgtccgaatgctctctttcggtaggataatcaacagacaaaagcaccgaattttatccatttctttgtaaatatacatacgctaaactcaacagttcaatgtgttctcatgcttttgttccttttttccccttttttcacgcaaaataactttgaaatgtacagaaaatgtcataatgatcaaccatctttcatcatttttcgtaagtgatcagaatccttcctaaatgcagttaattattcggcaattc

SEQ ID NO: 7307 - DNA, 1589 bp, Heterodera glycines
  misc_feature (17)..(17): n is a, c, g, or t
ctcatttcgttatgacncatcgtcggataccagcgatacgaaaagccaccatttgtgacggtgaggaagggacggcggttggcggagggggcggcaaaggcggaaggagcggacgatggggcgaagaatgggacggaatgttgggatgatgaggaggggaggagagacgagacaaagctggagagtggagggattaaaaagacaaaccaacggaaatggttttgaatttgaccttttttgtgataatcttattgggattccctcaaattagttccagttaccccccccccccccccttcactaattagcccctggtcagtccctcccccgcccccctttgtttggtgttttgtgtgcccaccaaattctcttccggcccctcctccgctggcaccacttctgtccgtcccccgtcgctctctttccatttccgccattctcatgccggtttcgtcctttctcctctctgtgcctttgtccgctgtccttccacaaggcaatgccctcttccacgagttcagtgttttcggcgacaacatccataaccccgaggccatccccgcggtcaattccatcgtcgctcccagcagctgtgaaataagataatttggatggaatgccaactcgtctttaaactatcggaaaacgacctgtaattgcccggggggctgttcgggccgaacgcactctccggagaaggcgcctccgcgcgacttacagccgacggtgtgcggaagccattggatgagcactgacaattggtggagatcgcacgcggaagcgatcagcgaggggaacacgaacaaaagggcgaacacacccattttgaacatgaacttttcaagtttggatgtgtctgtgccctgccgaaagacaaacaaatgaaaagcgatgccaatgaattcgctttaaaaaagattcttcccaattgaaacattcttcgtctgatttatgccttctctcaacaccaacccgctttctgaagtgattccgttctttgcacattgcggagaagccggaaaggataaggtaaagtccgagcagtgcggacgaagaccgagggacagtccaaagccacaaaagcgcactttgatccgcattgccaacggaacagagtccgctaagctcagaggcatcaatccgatcagtccaaagaacaaaagctgcgagaattgccgggactgtccacgcgagcaaatggagctgaacagagtgccttccgatggcctcctccgcccatttccgtgccgccgacaaataccttcgagggacggcattcttttgctatgtttatgttctcatgttacttccttttctgatgatttcggcacaattttcactttccgaaatttgttacttttttttggttttaccaagtaaaagtgagcatcagccaccacatggaagcagccaaagagaagtaaaagtgaagcaaaaaggagaaaacgcaaagcgaagggagcggagaaatgccggagaaagcaccggcggagtttgggccatccaaaagaagaaatttagggccggagggcaattggatgcaggcaatggcatcaaaaccgaacaatgaacggagcaagtggggaagg

SEQ ID NO: 7308 - DNA, 2408 bp, Heterodera glycines
  misc_feature (2262)..(2262): n is a, c, g, or t
cggccgataagatcatttcactccttccccagaattcgtcggcaaataatgtcaccgcaaatgtcggggctcctttgcagaggcctaattgccgaaaattgtaaaaaaaaaacctgtggcgacgcaaacaattttgaacggggcgcgggcacttagctgaagtcggcgtagggtcgaacagtttgaaataggcggtgatcagcgtgaactccagccggtggattgtcgtcgtctcctttttgctggaaaagtgaaaaaaattcgttgagaaaaataataggaaaaattgagaaattttacaaaaaaattgacccattaaaattttttccatttttcgcacttacaccgcaggctgtgatgcagctgctgacaatttgctgagcagctccacttcctggttcatgttggacttgcacatctgcagtaagggctcaaacaaaagtggtggtgcgtcggccccatgcgccactgaatttagggaaaaaataccggcaaaaaattatcatcggcaacagcaattctttcactcagaaattcgaaatttaatgcactttttgtaaaaaaaaattgtttgttcccatggtataccaattaggcataatttacaagctcttttatttaaaaaaatcggtgccaacacattcccagttttttggtggggagggacaaatgggcggacaacacggcggttttttggggataaattcctttaatagttatccaattttgaagccaatacgtagaaaattaaaaaaaaattaccaaaagtctgagttttttcaaaaaaaactgttccgacgcgttcatccgccggaaggattgtcaacgaggcggaacaggtcgacgaagaagtcggtcaacagtggacagtctcggtcagcaaatagcgattcccgacggtttacaaagttttggtcggacaaattggcactggaaaatggcgatagattttagaaaaaaaaccggtggtaaaattaaaaaaaaagaaaatcaaaaaaataattttcttgccataattggagtctattcgaaagcctaatggattaggaagatttaattaaattagtttttttaatcaaaaacaaaatattagggaatcagaggtacaattcccgaatttccagtcagaattttgccagcaatttcaaaatttcttctttttcttacctataaattttttaacgtttaactatttaaatttaaaagttttttgggtcggacaatatttatgacatacggacccattaaatcaggggaaaatggggggaaaaacgaaccttgtgatgacgacagtggaatttcatgtgctgcagcaacacaatttcgttggttctgttcgggcagcgcgcttttgaggaggccgcagaatttgggcatatgaaagagacggacctgaaaaaaaaatacaatttactaatttggacagatggagtactggtgtacccaaaattttgccgctaaaaactttaaaaaattttcaaactttgaattctttcaagaaaaagaatccgagaaaagtttttataagatatcagaagaaaaaaaaattttaaaaattttcagcgtctttttggaaaacttttagtggtgaagatttgtcctgttctgtagaaaaccaaccaattaaaaattgtgaaaaattgggacattttgagttgggaaattttggatggtaaacattttttcttacaaacaacataattatgattcacacattggatgtcataaaaactaacccattgcttcggatgccacgccgttgcctcttgtcgtattgtttctgctgccgttgctgtccacccgcgcaagttggtttggtcgcgtccggttgagaacagcgcgcactccatgaattaaagggctaaagaacaaacaaaaactgagtaactatttggagacgagaagttctcataaatgggatgaaacttggctgaaaataacaaaacacacccaaagttggtggaatttttaaaaaatgggtcaaaaaccaaaaacttgttggctatacagagccgcgaaaaattttcaggaaaaataggaatgtaaaaaaatggttaccggttttcgtgatcttcttcctgttggtcgctgattgctgtgccgtgaacacagacaaaaaatcaggatgggcaagcaaatggtgaattgtttcaaatttgttttcaaaatttgaaaaaagtttttcaatcgcttcttttttcttccctttgaagaagcggttgttaaacagcttctttgccgcgtaccccatccagagaacantttgtttggggccaaaatttggcccatttttcgctaaaaaataattttcatgtaacaaaaatcgtttctctcaacttgaccgccgccttcatcagcctgtagacgtcgtattggtagtcgccaccatcgctaacaccattttgctc

SEQ ID NO: 7309 - DNA, 2052 bp, Heterodera glycines
atttaagagcttactttttttccaagtgcgaaatcgaaaagtcgataattgaggcgcgcactccattagagacgacatcgatttgttctcctcgataaaggtacctttaacaaaaacattattttccactgttttgcttttgctgcttaccgaattttttcatcgaccgggcactgctccacgagaatgttcccggcgtgcagatcccggtgctcgaattcgagaacgtcttctgcgatcgctagggacaaggcgacttgatggaaaatggagtaacattcgcggccattttttatctatgaaaaaacttcattttagtttttttcttttcttgaaacctaaccgtatacttctccagatcttttcccccataggaaaggccgatgattgcgaaatggagatcttcatgggcgtaaatgtctggccggtcgttctccaccaattcaggctttgccttcttaaagtcatcccatgctttcagcaatttggacggaagacatccttaacggaaaaatgagcttagcacggtttgacaaactttcttttaaaaacatttgcttttagatgtatctccattaagaaaataaaacacccataagcccaaattagttgttaactgcactccattaaacatacctttgacgaccttgctcatgcgcaattgtgtgaacgatggcgtgacaaagtcattgccggcctcggatagctttgaaagctcgttggtgatgaacaattcgttgaagacaaattttgctggctttagatggtctccattgacgagcttcaaacactgatcctcgttgacagcgaacgggataaccttgaaaaacacttgaaaaagaggcaaaacattaaaacaaaacaccttcagcacaatgcaaacaccatcaaggggtcctttaaagacttctccaaatgccccctcgccaatttttgaccagccgttgaaagaactaaaccaaacgcagcgttaaaaattgaaaataattaattttcggtattacagtgaggcgcaacaaagaaaaaaaagaaaatattgctcattttaagttttccaatttaaaaaaaatcaaaaattggtaatactgccgatggctgccccctttttttgaagaatttttttgttttcaaaagtatgaagacatggtttccatattcgtaattttaaatgctgtaattactaatttctaaaccgtatcaagccctgggggagattggtgaaactgttttattactaaaacaattaccccgcagaagcctcgaagtcgcgccaggacacaacatctgctggctgctggccgcagaattctaggagaactgccaaatctgaaaattaaaccattacgcgctaattttgaattttggcatgaaacttttacgctgtttaaatggaggatttaaaatttaattaaaaaccaaagggggcgggcgaccctattggattgcaaatttttttacgaaattccgccaaaaaattttcctaaaacatttccagcgatttttcaaaacttaatgatgaaaaactaagttctttcaaaaaaatagaggaaaattatttgaaaatattttactcttcgtttttaaaaaaattctgattttttcttgcaaaatttctaaatttgaaaatttttttgcccggcggagttatgtctcggcagagtttcggccggcggagttatttttcggcggagttttggggtgcaccgtttttttttgtaactcaaatctcccaccctatgttttaaataagattcaaactaattattttaatataatttaagttgcttttcttttaatatctacctttttcaaagaaagttgacgagcgcacacttcgtcgttttaacgcccttatgctcatgtcgtgacgttttttcagcttggcctggaaatccaaagctagtaaattaaaatttctattttaaatgtaaatttttgtacaatttatttcataaataaaatatttagaaaaatgcttttacaatttttaatcaattttttataaaaatatttttgaaaaagaaaatacagtaaaaacaaaaatactccgtt

SEQ ID NO: 7310 - DNA, 887 bp, Heterodera glycines
  misc_feature (23)..(23): n is a, c, g, or t
  misc_feature (70)..(70): n is a, c, g, or t
aaaaaattcaaaaaatccattcnctaattgttttacaaatatgcctctctcgtattttcaaaaatattcncaatgttttgcaccttcaatgcgcaagccgctgctgccgcctgtgccgccgaccgatctgccgccgcgccgctgtcgtcacaccgtcgccttccaccaccggacgcagttcgcactcgccgctcgtcctcactttgggccgtcttaaaaaaacaaaaattaaactcaaaaatagaaaatattaaatttttgggcaaaagtaaagaattgtggtcccaaaattgagttttcttgggctcaacaatcaatttctgtggggtttcgaaggtattgatcacgaatctttggcgcaaaacttaatttgaagctttaccggaattgggtaaatccgagtttagaaacacataaacacccttcggaaactgattttgagcccaaaaattaaatttgggaccacaattctttaccaacatttattttttttatttataaataatgtaatcaataataaaaaatttttgaagcatatccaataatttagaaattttttttaccaaatttgccatcctttttgtcaccaccgccatgttctgtcgctcctcctcgttgttgtccacctcgtccgttgcctcttcgtccgcagcgcaagccgctgctgccgcctgtgccgaccgatccgccgctatgctgccaacgcgtcgccttccgctactggacgcggtccgctcctgttcatgatttttacacattaaatatttaaaagaatattttgtaaaaaagaaaatacagtaaaaacaaaaaatactccgttaaaattaatttctaaaaaaattcaaaaaaatccattcctaattgttttacaaatatgcccctctcat

SEQ ID NO: 7311 - DNA, 2005 bp, Heterodera glycines
  misc_feature (32)..(32): n is a, c, g, or t
  misc_feature (1985)..(1985): n is a, c, g, or t
ttggtccggcggtttccgaagggcgtcccctntggaaacttgttttgagttttattgcatttttattagaaattttttgaaaattgcggtaatttgggctaaaaaccgacaaaaatttgtcactgaacaaccgattacatatgaccaccataataatgtatgcaaatgaattatgtgtgtttggaggagtgtgcgcactctttcgttggcgccaatttgtcgcttagtgaattttaaatttcgttgttgcaaccgcgccggagtgagtacgccgaccggctggccgattgttttgtgaaagtgtgggtccaacaaaatgccaccaaaatgtgtgaaaatttttagacaagaaggacaagtgcccacccgcaacccccagcaaaaataaaaaattaaattttcaagaaaatgtgaaatttaaaaaagaattaattaggatatgggcctggtgggaagtttttggcggatatttggccaaatttattggataaaaatttaatttttcaaattattatgggaggggatttggttcgatattcggcccaaatttgttggcacacatagttaagagggtgacacaaaacttgcggtgcccatggggcccaatgaagagagagggatttcggtgcggcatcggcactgaatttagggggaccttatacgcttaataacacaacgggcgaaaatccaatttatgtaggctcgggctgtagccggcagctgtcagtttgtgtccccatcaggcataatttgtatagcaaaaggcgaatgagtcattagcgacattgataaaataaaagagaacgcaaaaaaacaaacatatctgcttcaagtttgtgatcaaaattatcattaaagaaggcatacccataaaaaacttttgcggaaatgtcaactaaacttagaattttcaaaaattcagaaatttttaagtgcataaattcgcccttccttttgcgggtttttgtgtctattaaataaaacaaaagatttctgatatatcattgaattcatagtttgtgaaattgtaaatgaataataatttttcaagaaatttaattaataatacatttttaatgtatgggtgcagtgtaaataacacaataaattaattaaaagatcgacgttactaaaggagcaattaaggtttgatttaaatggttttaaacgaaaataaatccaaagaattaaaatttcgaaaattgacaaaagtttgctaaaaatttttttgttccaaaattagtaaaccctcaagaaatgcatgtgcatggccaattctgtcatgttagcacaaattggccagaaatggcacatccaagcaggtcccatcccgatggcattgccctcggcttccctccaacaccgcaagcagtagtgccgtaaagagattaacttgtccattcgacatccattggcattagagaggtcattacggcaattttggccaaattccccccccccccgctcggtcccactcccaagcggggcatctaatctcgttttggcgggaattgtgctgctcaagaattggagtcaagtgtgcttgctgctcatgcttctgcctaacagcgacaaattgttctttgggctgatgtcaaaatgaagtgtaccaagtgccaaatttggcgattttgttgattattatttttaaatgaacgtcagtcacttgactaaatattgaataagctatataaaattaatttaacgaataaaaatggatattaaaaattgttaattttctgctttagcctcaaaatctaatttttggttggggaatttttttttcaattttttatatttattcagaaatttttttggtagatgagacaaaagcaaaaggtgctaggttgtttcataaattccaccaagtgataataaagttacttaaaattatccaatttaattaaaataaagaatatttaaatttaaataaatgttccacatttaatttttttgggccaaatctccaccaaactatacaattntaaaaattttgaaaaaaaaa

SEQ ID NO: 7312 - DNA, 2351 bp, Heterodera glycines
  misc_feature (2328)..(2328): n is a, c, g, or t
gataaaaatcagcttttttctcaatcatccgttgtgttacaaaacgaacattggaacatttgccctccaaaactaaaagaaaattaaacaaataatagaagtaaaatccgaaaaaaagaaaataaaatgttatctttttttataattttcatttctactcactgtatttgagaatattcaaatcggtcaacgtcgcttctggccattggcatgcaatggcaacaatttgcacgaatttggcatgcatttcgttcacctataaatcgtgctttttacactttttggattaaataatggttaaatgaatttaagggaataaaaaaggtcaaaatcgaaagccatttcctttttcttgactaaaaaatttttaatttcctaattttttttttgcccaatttccatcggttaaaaaagggcctacgtaatttggcgcatcttttgccaacggaaggccaactcgcgctctgatgtcacgcggaaagttgagcgtgggaggatagtgccaatttagaaccggaatgttagacccttcaaaaagggttaacaaacctaaaaattatttaaaattgttacataacaaattaaataattgaatttgaacccaccagccatgtgcccatcggtctttgaccgtaccattgaaattcccttaagacgaaaaatgccgggcacgcccagcaacaattggcacagcgtttgcacctcactcaaacattgttcagactaaagaagcttaaaggaaattactttgaaaaatgattgaattatcaaaattccactaacaattcgcaattctcaccacaattttcattttctcgagccaatggcccattcggccaagcagaaaatggtcaaacgcagcgcatacgcgaatttgggaccattttttgtggaattttatggaggaaaccatttcataaagcagttcatttggcaactttttcggggtcattttatgagtttgggtggtaatttaggagatgggcaaccaacttataacggcgatgaatgcacagccatattcttatctaataaatctaggcttaattatcggcaattcactttcttacctaatcgtggccggtttttggcgccagtgccctccaaaaaaaacttcgtatcccaaagtaattaaagatttggtttgcaacagtaatgtttaatccatttcagcaacatttaataatgtagaaggtcgaaccaaagagtctaatcaaaatcaaatagattaataatttctggcaccaatttacaattaaaaatagacaaagaaaacaaaaaaggaaagccaaaaatatttggttatttaattgctcgattttaaaataaattcctcggtgcactcatcatgaaaatcctttaaaataaaatcttcatcggcttctaccgctccgctgtcctctccctcttttccttccactttttgttcctctttctcttccattctctgttcatctccctcttttccttccactttttgttcctctttctcttccattctctgttcatcttcctctttctcttcccatttctcgttctctgcctttttctcttctactttttgttcctcttccattttctcttccactttcttttccactttctcttcctctttctgtacctctttcagttcctgtctctcttcccttttctcttccttccactttctctctctctttctgttcctttccctcttttccttccactttttgttcctctttctcttccattctctgttaaaaattttatggatcgcaggaggggtctgattatttcactcttcatctaactaatcttttttgataaacaatagaaaaataaaatacttaaaacgtaataatttaaaagtaataaaagatggaagacacccggaattaagaatcctcgacagcacagaatcaaagcaaggcagaactaactacttgactaacggatctgttgtctcttattgcaaaaaatttttctctttaaattattaagctttgtatttttatttttttattgttatttttatttggttatattaaattaattttaaaatttaatttaaaaaaattattcttttagaattaaaaaagcattaattattctattttaacaaactaaattaaattaaacatttttttatttttatttgattatattttttaaaatttaactaaaaataaataatcttttatgaattaaaaataattttgttattattttttattttaataaacttaattaaaaaaataaaataaaaaaacaaaaataaaacaatttgaaataataataaatagaaaacaaacgtaagcaatgggaatcgaaccactaacagcatatcancaaaggacagacacactaaccac

SEQ ID NO: 7313 - DNA, 2102 bp, Heterodera glycines
ttttttttttccccaattttccatgggttaaaaaaaagggcccttagttaatttggcgcttttttttcccaacggaaggcccaactcgcgcttttgatgtcacgcggaaaagttgagcgtgggaggatagtgccaatttagacccgggaatgttagaacccctcaaaaaggggtaacaaacctaaaaaattatttaaaaattgttacataacaaataaaattaattgaattttaacccacccagcccatgtgcccatcggtctttgaccgtaccattgaaattcccttaagacgaaaaatgccgggcacgcccagcaacaattggcacagcgtttgcacctcactcaaacactgttcagactaaagaagcttaaaggaaattactttgaaaaatgattgaattatcaaaattccactaacaattcgcaattctcaccacaattttcattttctcgagccaatggcccattcggccaagcagaaaatggtcaaacgcagcgcatacgcgaatttgggaccattttttgtggaattttatggaggaaaccatttcataaagcagttcatttggcaactttttcggggtcattttatgagtttgggtggtaatttaggagatgggcaaccaacttataacggcgatgaatgcacagccatattcttatctaataaatctaggcttaattatcggcaattcattttcttatctaataaatctaggcttaattatcggcaattcattttcttatcaaataaatctaaccttaatttcgcatcgaaaagtaattaaagacacattttaataaaaaattcaacccagaaaacaaaaatgaaagccaaaaatatttggttatttaattgctggaattctttaaataagttccttggcgccactcatcattaaaaagtatttacttattttgatcaaaaattcaaatgtgcaaaaggacaaaggaataaaaattaattttaattaaaaaatagacgcatttctaacttatgttttatcattgttgatactgaaatggaaggacgcattgacaattgataacactgtatttttggttgaaagggaggaaaagcggattaaaagagagactgtcaagggatgcgcgataaatgcgtgaattgcaccgagaaaaatgaagtaacgacaatttcgagactctcgcgcagatcacaaaagtcaaaacagtcgtaaaaatattttgtgatgaaataattacgaacggaaggaaaatttctttgatggcacattagagtgggagaagaagcagaaggcacaaaaaattaagtaattgttatgatagtaatgaaaaaatgggagacgaaacggaatggcaaaactgtcaaagactgtgcaccaaatttgtttccgataaaacaatttgaaaaccaaagctaacactcgtgcacagtccattagacaattggcaaatacattttgtgaagggaatatgaacggcaaggaaagttcagtaatggcatttatggtgaggagagggcgattttacactcgagagctgagataattttaacgaagccgaatgccaaggacaaaggaaggcattcgggccgaacgaagcaaatttgaaaattaagcaaaaaacattttgtgggagatgaaaggcaaggaatgttcagtgatggcatttttggtgaggagggcgatcgattctggcaaaaaaacaaccgacagagcattcattcaatggtgtcgaagggcgagtaacagttcaatcgattcgcattcgatctgttccgttgacagtgccgcacatctgtacaagagattaatatcattaatgtcagatcagtgatcaaaattaaaggttgaactgatctctatattttcacaatctacccccccctccatttccccttttctctattcccacaaaaatcagttgaattctccaaaaagcaccttttcgttcctacaaaaatttatctataaaaaatgtctcaaaaatagacaaaatcggattaatataatggaataccaattttaaaaaaattttggttttaccaattgccctagtccgtgaatccgtgtacgttgtgcagatgatcgacatactctctcaaaactaaaaaataat

SEQ ID NO: 7314 - DNA, 2620 bp, Heterodera glycines
  misc_feature (22)..(22): n is a, c, g, or t
ggtcggcagaagtcgaaacaantcggaaaaaatccggtggaacaaaagaagagcaaaaggagaagaaaagttggacacacgaagagcatttcttcactattaattatgggtattaattagcccaaagtcatcagccacgaaatacccgacaataattcgcgataaaagccaaaaagggaatatgaaagcgctgctgccgttcggcctttttatgcacaaatgtaattaattagtaattgatcaaagctaattaaattagggagaaatgaatgcttttcctgggatttctcgattatttcggcgattgccctaggctaacaatttgctgttcattaatatctctgaatcaatcactttagttatattggaggtgctcatttggcagctcttgaacaatcagagaaatgagatgacctatcagatttattactttaaaatatttattattttaaaattatttattaaataaaaattattttcccatcgcatttataaataaataaatcatcacaaatatttataatttattggacattattttggtcccagaatacaaaactagccgaaattaaaaacaaaatgtacaaaaattcattgaaaaatgaaataaaaattaaaattctgtcgctaattgtgccatttccttggggaaacccgcaacttctgtgtatcctttcaacgtggaaagcctccgccaaaatgtctccttttgtgccacgtccattggccctgtttctgccacggtgttcggccgtttaatgtgcaccaatcggacgggctgaccacggtccgtgccgagtgggggccaatccctttcgccgttgagcatatttggcacactaattgagagacgagatcaattattaaaaatgcgattataaatggctaacaattagaaaagaatggaatttgaaaaaagccgggtggaattgtgaaacacagcagctggacgtattttatggcatctcaaatgccaaaaaggtgtaatgagcatgttgacttacccattcttcacaaaactgccgtaggcatgtaccatctctgcgcgtactcttctgtcatcctcgtccaattcgaaattgcccagcaatggcacgcccaaagtgaatgcgtattcggctgcaaatttcggatgcaattaacaggcggcattcgccctccttcaccagtgtgtgccacggcgcggaacggcaacagtttggcatggcctttgttcaaatggtcaaattggtgcagaaagacgggccatccgagggcggacttcagccgagcttcggccaaaattggcataatgaaaaggacgtcggaaaggaactgaaaagggggtcagagaaacttgaaacgaattatcattaattgcccttaattaatccgttgctaattgccccccttttgccagtgtttcttttggctattctgataattttcggccttcccttctgacctaccaaagtgtactgcttcaaccaatgcattgtgtcgttcgtcggcgtttcgtcggcatagaatttgatcagtttttccacaattgcccttttgcgcttctcaacctctctgccattggcatttcgtccaatttgttcagaatggatgattttttggataaatttgacgagttgttcgtgcccaaatgtgttcagatttgtcacggttaatgcagaattgaaggtcagcagagagttaggactatgagtggcttaaaaaaggtgggggaattggataaacaaaatgccaatgccaaatttgtacactctcttcccccctctgagtgaaacatcatgagaattgaaagagttgcaaaaacttactaagaaagagtgcctcgtgcggtgtaaagcccataattgtgggtttcggcggtgccgtacgaatgagcagcgacagattggcggagggcacaaattcgccgtccacccgggggttgaaccgcgtcatggccaagtcgagtcggatcagatccaacttttggatggcatccatctgtaaaaagaaagcgccgtcacgccgtgtgattttaaaattaaaatggctctcaattttttggattttttgtttacccatttgggaatggggatacgtaccccttctatccctccctgggattgtccctatttgcttgaatggattggactgaccaaatcctccaattccgcgcgcttgacacagtcgcgcacattttgctccccatttgtgccgccgcatcccatcgcttttgctgtccgatctgagccgtcacggactaaatcattaacggcccacgggcacagcgcagaaccgctcatttggatggcctggtggaagagatctgtgagaaaacaaaaattaaaaaattgtgccattattttaatcgaaaaataataaacgctgcttaattaccccgcgtctgcggcgacagtgccaaaattgaggtgctcgccgcgcccgcactttggccccagacagtgacgcggtttgggtcgccgccaaatgcggcgatgttttcgcgcacccacagcagcgattgtcgctggtcccagaggccaaggttgcccgggttctgatcagtcccatccgtgaagaagcctgaagggacggacaacacgtcagaaagcaatgaaccctccgagataggcaattttta

SEQ ID NO: 7315 - DNA, 3476 bp, Heterodera glycines
ttatgggctgatcaaaaaaaaaatacaaaaatttttttgaattagcactttctgtcttttggcgttttaattttgaattcaaaatttgggatccctttcagcgatctcgatcccgaaaaatggataaatcaaacccttcttttttgtagtttttcaatttctgtttattatcaaattttatagcaattacaatgcttcaacgtctatttgttggcaagaatttcacctgtctgccgttgttcacttctcatcgcagttatccgggctcaaatttcactttccccatagattggtatgaaaataagtatgtgttactgcaccaacgcgcccgtgaaaaagtttcgcccgattttcacaagcaggttattattatgttaatggagcattttaatttcctgattattcatcactgttgcttataattccaatcttccgccttcttaagaccaccggccttaacggcctttacgtgaatgaaaatccgcacaaagaccttcgcttgctttaccaccgcattttgcgcgtgattggaatgatcccggacagcagtcagtaccggatggccgtcgaagaaattgtcaagcatcgcctttcgcttgttgaagcggttactatataaaatgtcgtggaaacgtgtttacggaggtttttaggtcgctgatcacgaatctgacatccatttcaaccttttcgaatcccggacccaaatttgaacaaaaaataggaaattcaaattttggtaaatttatgaacaaaagtgcgaatcttcaaaattttgattttcgactttttgttcgaattcgggtccgaaactcgagataggtcaaaatgagtgtcagattattgtcagcgaccctgaaaaccctcgtaaacatgtttccacgacttttcagaacaaaacaaaattttcccaaaaagtatgggaggcaccatcgatagtaatccaaaattctaaattacagaactttgtctaaattggatttatttctcaattgttaagcgattgttggattgttttgatgtttcaggaacccgacattcaacaattggagcagaaaatcggcatgggtcagattgaagaagtagttcaacaggttgtatccaaatttctttgttttggtgacacgactctatcaaatgaattgttaatacgctctttcttaaggccgagtatgaattggagtgtattcgtctgtttgttgcacataaatgttgggaaccgctggtggaaaaagcggatgaggcgcaatggcggtggccaattggaccaggcccataagggaatcaaatgaccgtgaaaatttgacgccttagaacgctgtattttttctcgttacaattattttaacgaattcacgtggagaatataaacagtataattatgggatgttaattaggataaaaaaagaaaaattttgtcattttaatattatgagcaccttatgtatcaactcgtacagttcttctgggctgccaataaacaagggcgtagccagacccttggctttgggtggggtggctgaattaaaaaattcgctttttagggatgtaattttctttttttttaaattccgaattaggagtatgtgttttgcaggagtttgtatccttttttcgccaaaaatgactcttgggttatgttaagagatgtgtttaaacttttcaaaaaatttgcccattttttgaattttttgttggatttcggggggagggagctttagccccctcagcccccctggctacgcacttgccaataagtcgaaatatcactattatttacacgcatttctccgtatccgcactttcccatcgtactctcctcctctgctgctctccctcttccccttcactctctgtttcacatccgttttctttctctttcacaactttttccagtgcggccattgccaattctatttgcagcgcatgtcgttcaatgtcatgtatctgagcaggggaatccccaaatatttcccgttaattattcctcgctttactcgcttcgccgcctcctccaattgagccgccattgtgtccatggtgggctgtgcaagcagtgcatgcagtttctgcatgcagtccgcgcgttcgccaagcacttgctgcacgcgacccgcgcgcgtgctggccatattggcacgtcgaaccacttccgcattgacttcgcgcatttgaaaaagatggagacgatatctgtgtgggaagttgctcataaaaagtcatgaattatgtgaaaaagacaaagggcggagtggaaatgacaaatgagaaaaacaaactttgtcagcatgttttgcacctcttctcgtccttcgatttctttgtaaaaggtgtgaagaccgctgaaaaacgcaatttaatcaaaatgaattttttccaacaaatttttgagttcccccttatacaacatatgtactagtggtcaaaatgttacttttcaaattgttgtttatccgtggcattggcggcagcactggcaattgcatcaccgatttgaccagccatcccgaggagggtgtcgacaactgcattcatttatttaggccaacagtatttagcttgaattcagtaaattgttccgagacaggctttaggttaaattggagagatggagttttgatttcacagatttaattttatgaattatttttttgctctaattcaaataaaaaacaaacggaaattaatttgactgtccctctcccgctgattaaaagccgtcgcttttccgttgtatctgctactgttgattgttgatgaaggcttttcacatatcttcgttttcaccgacacacagaatttatcggttgcgtatcagcggaattggcgccggagttatgccattgaaacagtttttgcttggcattttgatgggctttttgttttttgttgtccaccggcacttttgctcgtcattttatgctgccaaattcgcgggccctcgtcatgacacattcggacaatctttggctgatgatggcaaaagtccgacgatgaatagcgattttatttttgtaagcatagcatttgttggcatttttaattgtttgtttttttaggttggtgtgttaagtgcgcaggtaaattgatttaaaaaaacaattcctgttgagttaatccatcgattataccctttttttacgtttttttgataaagcatttgcttctccccttccccacagcgttttctcgacacgcgtgcatttcaaatttggcgcagttgggcgcgccgtgtgcctggccgcgtgctgttctttgtcgccgacggcactgtgctcagtgcgcgagtgcgtgcggcgcgcatgccagtggttgtgttgcgtggcgtcgatgacgcgtaccctccgcagaaaaaagcgtttgcaatgctccgctggatgttcgacaatcaggcaactaattaaaaaatgccgatttgcctttttttatcaattacaaaaccaataccgcattttctaaaatagaatacccggaca

SEQ ID NO: 7316 - DNA, 4699 bp, Heterodera glycines
gtgtataaattaagaattgactttaaaaacaccaaaacaatgactaggagcgtttttagacaattgcaaaacattttaattttaaaacttatatataaaatttagaatttttaaaatttttatcatatgctaaaataaattaaatttttaagtgaacaaattttttttcaaaaattctcacaaaaagttcaaaaatttgtaataatgttaccttgttttttttggtttactattttatttcatgtatcagcgacatttacattcttaagaatagagattgttttgcttatacgtacaataatttataaaataaatttaaaatggaaaatttaaatatattattttattatacacacataatttttagttatatttataaatataaaatagcttattattcctgatttaattgctgaataaaaaatatatttaaaacaaatgtaaattaaattttatttttagtcttttttaaataatggccgacataaacatgaattgcattgtcgaatgcccagggggccaaacaaactttaaacttaaaggcacacttcgttacgtaccagtaaatgaaaagaaatttcgaaaaataaacacagaaaaaattaatgaagacgaatccgattggaattttgaaaacattaaaataattgattggaaatatttgctcaaattcgcacttaattggaagaatttattaattattttaattttttcaacattagcactgtttattttattaataataatttttatatttataaaattttcaccattttacaatggataccgtattattagcagaaatttaattaacaatattatttttattttattatttaatcatgcaaattcaaaaacatttgcgttcggagggtcacatgaatgtgacaattcaaaattaaacattatgaatgaaataaagaacaaaattttgtgaagtgaaaatgaatcagcacttaagattttatggagtgaaaatgaatcagaaatgattaaattaaataaaaaggtgaacattaagaataagagtgatttaacaaatttacaaaaagaacaaggagcaattggtaatagaaaagctagtacattaaaatttaaaggcaaagattgccataaaatttatattaaatatagtgattcatttgtcaacatttttaaagcattgtcaaatttaaacaaagacaaaaaaccaaaaattgaagataaattaaatggatataaaaggaataagaaaaagcctattttttaccttaattatttttctccatccattttaacccaaataaaatattcacaataatgaacaaaatttccttgctaaaattggcgtccgaaatattcggaataaaatccgaacaagttgccaagacaaataaagacgattggaaaaaattccagcaactcgaaaatgaggtaaaaatcctggaggaacgaggtgcgcgaatatacagcaccatgaatggaaagcggaaaccgcatataaataataaaaattgggttttgtcaatggacaaaccagacgatgttatttttggaggaacaaaatcaataaaagaattgaatagccaaattttaaaaattgaaaaattaccatggtcccaagctggaccaggaatagtagttgatgggaaattttacccgttaatgagcttagaaattgggggcatcatcgaccaatttgacatatttaatgaattttggaaaggcatcgaaagggccaacaaaacaccaaaaaatccagaaaatttggaccaaaattccgaagaggaaaaaataaatatttctgaaaattcagtaaaaaaatctgtagaaaattcagaaacaatccaatttgaaattattggagaaacaaatgaaattgaatttgagactatgtgccaaatttttaaggaagagcgaaatgtccatggtaaggactccgtcaaaagaggcgacgggcttttgaatttgaaggtaaaagggtcacaaccccaagttagaaaaatgtcccttaagggaattattaaatggacaattttggcaattttcatcctttttggccatgtcaaaggcatggacaacaccaaaaaattggatgagagcatcatcgacgaattaagcgatgatggtgccattgaagaaaaggacgaaaaatcacagatgcacatgagcatcctcaattgcccgcctacaaccagcaatgcgcctcaaattcaagccgaaatcggcacactcatacaaacccaaataagcgcaatggccgaaaattggctgcgatcggcttttcagcaagggccaatgaatgaagcaacaaataaaaaaggaaatggcggacaaaaaatggggaaaaaaagggcatttcctttttcccaatcaacggcagaatcaggcgaaagttggaggaaagttggaaaaacgggcgcatcacaatggcagcgaacccatgaactgactaccgccgcagcagatgccgtcgaggctttggccgaacatcttcgcgactacaatgttgccgtgtccattctcctggtcacaattgccgccggacttgccgagatgaacaatcactacaagggcaacttcaaagggaacagaaagtgaattgtcggccgccggagtgtcgctaatttcatccttagcgacgaaaatttaaaattttatgattcatctgtttaaaataatttcacgccaaattcataacctttgtgattttaagcctttttattagtcagcattgtttacatttaaatttctgtcagcccgcctatgtaaaattgccgtatttaaaccattgcaaaatcaccattttttatcgttcaaatcgttcattaataaatatatttgttcgatcaaaattcactaataaagtgtgaaatataattgaagtattgggaaatccaataaaattaatttaatttaaataaaataaatatttaaattaattcttattgactatctgaaaaggagtcaataaaaactgtgctttaattttgtcaagaaattgtctttcttcttttttgaaaaatgttctcctctattaatcttgttttattgtcttaaaataattatttgttttgaattaaataaaatattttggatttgtcaaattcaagaagaaatttaaatgatttgattttttgggtttttaatattttttacagatattagtttggtttcaaaaaaataaacaaatatatttaattaattaattaaaatctgtaatatttgataatttaaattaattataatccatttttatttttttcctttatcgtaataaataaaattatttaaggaattcttaaaatcttatcagaatttttggcataaaatttttcgttttgaagatagaaaactcaaataaaaaattgattttttatgtataaatttatttttttaataatattttatttgcgttaactaatattatatagattttttcaattagaaattgtatttcaaaaatattatattttaataaatatataaattaaatgttttcagttttcttacttcctgagaatcgtatgttttcattgagctgcaaaatttactaattttcaaactaaattcgctatttttctattataattttaaaaaatttataataaaattaagttttaattaattaattcttgctctgctttcaattgatatttaaatttcataaatttccttttccaaatgtgctcgtttttgttttttaataaaaatttttacctatttaatatttataatttttaaaatatatatttatttaaagttatgtatgatatatttttagttttgttgaataaataaaaatgctttttattaataatatttacaatattttgtaaatttatgcgaaatttttaaaaaattatatgtaacctgggatatgtggcatggtttataaaaatatcgggtcgggattcgggacgagaaaaataaattaccaaatttttgcgttttaaagtcgagcgacgaatttattgcttttaaaaatcttttttacggcgctttttccaaaaaacttttgcggaaccgtggggcagacggtgccgataaggaaaaattttagtttacaatacgatttgtaaagtgattttgtctaaaaaagctgttatttctaattttggcaacctctgtagcaattattttgggcatttttcagtttttttagcaactaaaaatcccatccctgattttcgggatttgagattcggcattatggcggcaaccctgatgcgtagagctacctcataatttgattaagtttaagcaaaattatgattttttatttagcaataaaataaaaataattaaatatttcaactatttctacttttgaaataccggctcaccacggcatttacaaatctgtcagtctttacattttgggatcatttatacaaggtaatttgaataaatttgttaaatgtctttaatgtttttaattagtacaatcatttgatctggtgttacaaacgccagtgattttgaagtattttttaaatttattttaggtgtaatcagaaaaatagcattattttcattttagcagggggtgggtctggcggtgccgataggcgccgccgggaaaaattttgaaaatttacttctgatttgttaacagattttcttcaaaaaatgaccaaattttgtgatattagcaagtatatttacagataccaaaaatgttcacattttcaagaaatatatggttaaattcttctaa

SEQ ID NO: 7317 - DNA, 922 bp, Heterodera glycines
  misc_feature (756)..(756): n is a, c, g, or t
  misc_feature (914)..(914): n is a, c, g, or t
tcaaaattgggtaacatttttggtgattaaatgagtgtaaatatctttgacatggaaattatgagggcattctgtgcattggttgatgctcaaatagttcttctcgtgtcattttcaataagaaaatttgttttgtttggccaaatttggtggtcgccagtcagattacatttaaaaacaatttggggtcacattggttaatatttgttgccttaaaagtgtccaacattatttactcattgtcagatcaaagacatggcctcctattggcgtctgaaaagcattgaggagtacgagttggaaatgtccacgaaaagcaaagagacacgtcgctatgtgttcaactgtttggacgacattggccaagtgcaccttccgtccgacttggacgacatcgaccgaatgtgcgagcggagtgaccggcttgaatttgtcgacattctgaagcaaatgctgagcatggaccaggtacagcttgaactccttattggactcaaacattgaccatcacaattctcaacctttttaatttaaggaccgtcgtctgacaccgacccgcgggttgcaacacaaatttgtaaaaatgacgcatatgatcgagatggggcgcactaaatactgccaggtaatgaacggttaattgtaggcaacatttgcaatttagtcacataatttggtatgaatgtgttttctcccatcttgacatgaataaaatcccattaaaacgcacttcaaaactgacaatgagccttctanattataaaaatatatgccttgaacttggcactgccgggtaaaaacgtctttccgtccattttcattgcatttccattcttccatccatgcccaaatttgccccttcagatggctgctcagcggatgaaggtgtgctatcgcctcggctcctccgcggntgccgggt

SEQ ID NO: 7318 - DNA, 3538 bp, Heterodera glycines
aaacgcaaacacactgcgggcactgtccgtgggccatcgcggcagcggcgcaacaagtaagctaattgggtttgatttcttgactgggtctctgatttttcaggccgccctgctccccggcgctggcaacaaccccgcgggcgccgctgccgaccttttccttccggcgaatgccgcagccgcggcggcgatgcaacggcaaatggcgtcggcggcgcttcagttcccccatttgttttccgcgcccgtccaagcggccgcacagcaaacggccaaaaactactcacaacagctgcaactgttggcacagatgcaacaacagcagcacatgtggaggagggcattttgttggagatgaggggacattggaatggacacaattcttttttaaataaatgctccgtttctgttacactcaattagcggagtggaatttgggtgggaagggtggagggattaggatatgtttttacattcttggcattttgtcccccaggaggaatgggctgcccaagtgctgaacggtgtccggccgatgaatgcgcagcagcagcaaatgctgcaacagcaacaggcgatgatcgcccgactcaaaaatgacgcggccattctcatgcaaaattcgttggccgaacattacattttggagaggtcgggcaaaaaaatgacgaaaaatattgaaatttggacgagtttttaaatatctttaacgcccaaataaataaatatatttattacagtaagtccagtcaacaaataatttcaacaaatgtcatcagaaaaaggcatagaaaacaatcttttaataaatttgttttttgcaattggcttataaagttatgtaaatttctggttttaatatgttaaatgatcggaatgcatttttcctggaaaataaactgagactgtcggggaaattggcaattggtgggaagaaatttcaatgaatgataaacccttcaaaaatccctagagaaaagaattgagcgaattattgtaaaaagggaaaggttttaagagctgttccgaataaaaaagtttttttttttggttgactgttccgtccatcacatttcttcaaaatcacacgtcgttttcgacatcagtaaaaccttttcctggcacgttcttggcgtttttggaagaaaaacagcccaaagccgagaacacccacaacaacggcaaggccaatcagaatgaggaaaattgagccaatccaacccaatttggacggcctgcggtcggggacgtggtcacgaggggcggcgatactgtgaatgggagggataaaataaacaatgttatttcggaattattacttttctgcgaagggttccaccgagtcacggttggcactctcaaatggcttctccactcgggcgaactcttgctcaaacattcggatgctcaatacgtcatgattatctaaaggagacgagcatttttcccagttacctaaatctatctcaaaggtgaactttcgttttttgtcctattgataaaaaatgtctatttttgtatgtattaagtaacaaacattttgactgcttcggcgctagttgtgaattttaattttattaaaaccaaagggagacccttttggttggcaaattgtttggtaaagtattttaaccgtgaaaattattccttcccgtggattttccaggtcactaatcaagaatctgacatctgtttcaaccaatttcggatgccgaacaaaaaaataaaatcgaaaaatttgaattcaacttattttttaatccgggttagcgatttgacaaaataatatcatgttcgtgactaacgaccccgaaaattccacgggaaggacttttcaagatttattatgacagaacaattttgcaaactaaaagcgtacaccttttggtttttaacaaaaattaaaaaggcgagtttttttatcaagcgccaccgtttcttacctgaaagttctccagtagctgctgtaattccgaaatagtaatttgtgggcaaaataacatggtcaacagtgaaacagcgatgccattgcgaatccccagtaatgtctgtgaacaccttttgtaaacaatgttgggatggactagccagaggatttagcaacaaaaggacaaaatatggtccattaccgaaagagtgtccgccacgtaacggaccaacacttgcgtgtcgtggtctttgttccgaatctttgcttcacaacctaatcagcaaaaacaaacaattcaaagtgtaatagccagttttaccattgtgttctccgcccaattgcgtgtgagttccatccacgtcatggtcataatgaagcgagccattggaaaccatggccgaaatgtacggatgcgaatgctcaattagttaaaatattttgcttctgatttcacgagttttacttgatgaggtccgttgtgattgctgtaagtgtcaatgaaaatgccaagtcctcggaaataatctttggagccgaaaacagggccaagcgtatccgggtcttgaacataccaaatggccattccatctgaaaatacaaacattaaaagaaaggacagcaatcgcacctccgaacaaagagccagtcgatccgtgcactcggaaactcactataaattcccagtctcgcgcggtgttgggctaattttaagaatattttttatttttactgaagatagaacatgccattttattccacaatccaccactgagactctgcaaatcggatgtaagacggatatactgcggagttaaaatggcattgccaataatgtcccagaagggaaggtcactatcagcatctggaaaaaagaaaaatatactgtattttaacatattttttttagccatccgccaattagaaaggtatcaatgacgaaaaaaaacttacattgatatggctttacgaaagtatgctcccgtttgagaaatccacgcatttctgccaccgaaatgccgtcgatggcatcggctgttgggtcagaaagaacagaaaacggatgagtgattaaagaagcaaaaaggcacagacggagaagagatgtctttctaattgtgaacattattgaccgaggaaaatgaaacttaagaattcgcattctctaaaatgaaattaataattttgtataaaaaaaaagtagcagcattcgtttttaaatgtgaacagaaaaaatgacgaaaaaatgtgctggcattggctaacaatgagaaaagctaacaaaaagagcggaagaagcggagaacaaaaaggaacaaagaaggcgaatgcaaagacgaaaagccaaaaaatttaaaaataaaagggatatcgttgtataaataaaacaatttaaaatattgcagtttgctttaaatgagaaaaaattaggggtttgggttcgttcaattgcttatggaagctatatgtaatatgttggttgattggttgtttttgttgttttaaattaacagattccaaccattttatcataaataatagaattaactttaaattcatccgacttttgaatatgcgcatttttggtgggcgttaaacggggtaattgac

SEQ ID NO: 7319 - DNA, 3799 bp, Heterodera glycines
  misc_feature (3779)..(3779): n is a, c, g, or t
gcattttcaattacacttcgccatgggtcacttattatgtgaccgaagatgccaaacaagcgacgttcgggtacagcacagcgccaggcgaaggtcatcagagacattcaaaactaacaaaaaaaacttgtttcattttgcattttagggaacatttaccggctaaaggattatgagcgccgattcagttccaaaatcggtatttggctcgtctttttgctgttagctttacccacgaccttgttgcctttcttcctctggtcagttttagttctttctaaagcaatttttccatttctcgcattcattcatggttttatagcctattgtaaaacaggcaaaacatagaataagaaaatggcaaccaatgagtgcgtaaaagcacggagtcatttggtgatataaaggtaccaagtgttaacttcgaatattttaaaagaggacgtaaaactcgaaaatattaatacaaccgcagctaaaaatctttttcgtatccatagtagctcattaaaaatgaatatagtctaaaaatcaaggccctaaataatttaaaaattttaaggtacaaattccaacagaaatatgcgacaaaaagcgggacatccggtcaacaaaattctaaaaaggctcaatgaaaactaaaggcaattatggagtgcgcaaatccatgccacctttatatttattaccattttgtttccatgcaaacttgtatttgttgtgttaaaccatttcattccttatgctgttgacgtaaacgtgtggaaaactgactgaattatcaaaacagtaatttcccgcctctattgaccagttttaagttaagttgttacaaccgacagaacagtctctttttagataagatcgaccttgttacaaaaatgaggtaaatggtacacttcactgtgtagcattaaacattcgactgattgttactaatttgaaaaccgggcggggactgagcaagcgatcagtcagttttaatgtcgtcgttgttcgtttacacgtacatgttaaagtcgaagatttttatctccctttcccgttctttccttttccattcgcataggaaggctgttcattcacaaaagtcttctgatttagaaatattcctttattttcaaagatatttctgccatttgtttcgcgacttttgcacattccgtctaataaatgcaagcgtaagttatacgatgataagtccatgtcccagacttttcgggttccagtccctgtcctgactgacctaaacattttgttctactccacttctcgaaccggtttaaatgtgttgggggtcttttattaaaagccctgtcccatgcgttcatgtcattcgtaagttttcctcttcttcagagtcacagaacaatgcttttgcaaacgatgggctttcagtctgaagaaaagcatggaaagcgagaatgtaagttcgcctcagttgtttggccaattgtttgtttccctattcaaaaaatcattttttcagttcgaaaggcatttccgtttggccgttcaatcggtcactgcggaagactatgaaaagatgcgtcagtatcggcaccgggaggactctctcgcgactttggccggtcgtctcttcctccgtaaggctgtccaatgcctttgcggcgtccgttgggccgacattgaaatttcacgaacggaacggggaaagcctttcattgttcgacccgagaacatttccataggactgaacgtttctcaccaagttggtttttgaaagaatctattccaggtacttatgtagtttaggggacagatttcacatacatttttagattcataaaatgtgtttagaaattaatgaaaataagttttatggggtttttggggtcgctgatcacaaatccgggctcagatcagcgctaccgttcactacatgagctgtacagggacaaagaattgataggctttctgtaccaataataccctcataggcaagatgcccatgaggatatcatccgtataattttcgaattttatttttcctgtaccaatggtacccgcatgggcaagatgccaatgaggatattatccatacaaattttttattttatttttgttcgagttcgggacaggggttcgaaattggcaaaaatgggtgctgtattcgtgacagcgacctcaaaaaccccttaaaacttattttcattaatttcaaaaacctatttataggcatttgaaaatgtatgttaaagtatcccgtaaactgcacgagtaccaaaattggaaccaatcttgattaaaatgccattttttcttttttttaattttacaaaaggaggatcctcaagagacacatattttattctaacttttaacttttattttccccgtctgcgcaagttctcaaaaaactatgcgccatttcggcagaaaaccttcatttctgtgcaaaatcgctttgcatttatgttgcccactttaaaatgcggcgccaagtccgaaccttggcattctgctgttggtgcccatcatttcggccgatcagcaactgttgctgctccaactggctgttgttggttttgatcagtgccgctgttttccagatcgccacccgagggcaaatccaacgcaattgtcaccgtttgactccgctcctcctcctcctcctcgttgtccattccaaaattatattatttttttcaattaatttttatttaaagctttaaggcttggtgaattaaaagcaggttttctgcaattactcctcatatctttggcatttaaggcaaatttattttaaaggctttaagaagaaaaataatttttgctcaacgaattcgtttttgtggcagttcacttaaaaataattaacagaatgccaaaataaaaaagttgccaaatttgaaaatatcaatcaaacctccaatgtcatcctgtaccattagggctcgcattcgtccttgaaattgtaatttggttcaaaaacccacccaaaaagcgttaaattatgcgggtcaaaaaaaaattgaataaaattaataatttttcattgcaaatattaaaattttacgcgtccttggatttcacgactttttcccattttgtccttgggaatcagtatacccgtccttggaaagcgattttttccatgcgaaccctgctataaaacactgaaagcttttattcagtcgcttaatcgagaaaattctagaaactgacaacattattcacagaatgttaatgatactaagttcgagactgaaaattcctaatactccagacaaaagatccgttcaaattttaaccaactcttctgcttatagccacgtcagtcgctcagcgcgcttgagtttggcactgctctgctgcacaacctttgtttgtgtccgatcagccatcaaacaacatttcggcacaaggacgaattgctggcaactgtgcttctgctgatcggacaagcaaaaagtgttcaggtgggcaaaagtttaactgcgattgcactggaaaaggattaagcttttccccaaaaacagcgccggtatttaccggtattttagatcccgattttggtaaaagccagcggtgggacaatcggcaccgaattagcactgataaaaatggggttttgattttttaggtaaattttctggtttaacttttatttttccgaaatcaaaaacgaacatttgtttttaatttgatattttttttatactgaatgggccttagtttgaccgcgacataatttttatttatttttaatcattttaattgtttttttttaaatatagacttgtgtgatcatcaantatactaattttttcacata

SEQ ID NO: 7320 - DNA, 2044 bp, Heterodera glycines
attgggaagaaaatgcaaaaatggtctttgatcagccaaatgaacacgttaagtgatcagataaattttgctaatgagcaaattattggacagtcgagcagcggcggaacgggttataattagaatgtgattatgacaaaatgattgaccatgaaataattttgagagggtggagcaatttgaaaaaattccaataaaatgaaaaatttaaatgataaattaacaaaattttttaattttaataaaaagaaaaagaaattgaattaatttaaatgataaattataaaggatttaatttaattaaaagtgaaaaaaatctcaaagccttgacaagataaaaatattagaaaaatttaaaaagtaaaattgaaaattataaaatttaatttcctttaaattgtttaaatatgtacaatactataaaataaacacattttaaactattaaaaatgctaataaaaactaagaacttccgttgtcgatttaaaaaatttacgcgaaattttacattaaaaaggagcgcaaaaacattggtctttgaccttgcgatcagaaatgatacaactgatcagaccaaaaaaattggtcattcaccggaaataaaaaggggcgggggcacaaaaaaggctctgatcgatcagtcagtcatgaatggcgtcaaaaaaatgtgatggatgctgttgtaaatgtcacagggtgtaaattaattatgcctttttatccagtttttaatggaggggggggggggggcggaaattcgaaaattggaatatgtgcgccccgcgtgacaatcgtgcaaaaaaaacgcgaaaaatatgcgcgcgaaatttgcgacgattgaaacggggaaaaaggaaacaatgacattttttaagttaggtgaaatttagacaaaaaaaattaaaaataaaaagccagactgttcatgaagtagcaccatttatggttggccttgtttctaagaattgtgtgtatttattttaagtaactcggagaaatttcattttgttaatttttataacaaaatttcgtaaatattttttcaaaaattcgtattttttacaaaaattacaataaaaaaaattaacaatttacctgccattactgctggtgatcaatttttgatcatttctctgttcattggaggcatcgatcactttttggtttcttttattatttatttctttaactttaatggagaaagctttttgaaataggcaatttttaacaaattaatcaacctctgctcctaaggctttttttcctccgattaaatggcattttaaaaatgttgacaagccaaaattccgttcggcatattcccagaattaaatggggaaaattaattctcgaatgaaaaaccacctgctgctaagaatgtgtgtgcgctgctgcactatttgtttgacaggtgccaaattaaaacgaaaatattttttaattaatttttaaagcggtaaaaatgattaatgggaaaaattgtcaattttgaattccgattatggaacaacatctgtcgtaaattatacaatatttatttgtttaattcgaatagtcttaaagcaaaactcaaaaccattgccaaattctgatcagaaatggctcgaggaaaaatgatcagacttttgtattccaagatatgacggcttgaaagattccggatcaagacgggatgttagaattcgaaccggactggatttctgggttaaaaatcctgttttcaggactcctggtccgagccaactttcaaaaacatactcggatcggaatcaggaatccggaaaaaccctgacaagacccggtcttgtttcggcctcaagacgacaatgacactttctttagcctaatgaatccagtcagcagaaaaaaatgaattgacataattctgagcatcaactcattatcctaatcactcaatcatagctcgtactttgccggccccgctgatgagtgaaaggaatgtgatttgaatgaatagaaagaattctgatcattatcaatcttcataatctgatcagccctgggggggggggggggggggggg

SEQ ID NO: 7321 - DNA, 4370 bp, Heterodera glycines
  misc_feature (4089)..(4089): n is a, c, g, or t
acgagaaacttgccatgccaaaatggatttaaaaagtacaattttgaccagtgactttccccccctccacttttgggccccattagagcgcattataattagtaattgccttttcctcgaactttttgcgcttcatttatttgtttgaatttggcgcgtgccattttcgcttcatttgtttggcacaatgtgcccagcgaccgacgacgccaaccccccgtgaaaaggtcaccttttcatgaccaaattttcatgaatattctctcatcgccccgcgattgggaacatactgagcaggtggcaccagcctaattaggggaattaatcacacatatccatcattaaatatatattcgaggggacgtacggctgactgactcatcatcattagcagcagatcattatcgtcatattaaacatcataatgagttttttggtgccaaagtttcgcgcactctctgtgcccgaccccagcgcgccgttgtgtttggcattttgtgtgacgacggaatgaaatgccaaaaagcgcaattaattaattgggtgaaaggtaataatgagaaaagtaaaaaaaaaaattatttttgcgctactccgaaaagggtataaagcacaacaaaacacagaatgccaaagatggacgagaagggcaattattggaaaatctgtacagtaagtgaatgggtaattaattaatgattgctaatttgtaagcaaaaatgtgaatactgtaaatgaccgaatgatgacggaagttaattaataattattatgataataaatttggggaaaaagtgagtaaaattttaaaaatgcaaaaagtttaataattttttaagtgcgcttttacgtcaaatttttgctgttttcatgtaaaagtgctttttgtttttgtttttctaagttttgttttaaagtgcgtcagaattggcatttcaaaaaattgaactgaaaaaaattgcttaactttttgtggaaagaatatcaaaatagaaagcataatccgaatggataaaagctgcattaaaactgcaaaaagtgggcttcttaaattatgctcaaaatgcactgaaaatggaaaatatgtgtagtttggactgaaaaaaataataataaacaagttatggatggtatcatagcaaaaacatagcaaaataaaaataaaaatctaaaacctaaaaagtaataaaaattatatatttttttatttttttataaaatttttaaattattcattttaaactttttgaaaaaaaaattctataaaatgcttaattttttttaattttatcatcaaaaatcattagatttatttttataaggtttccttctacgttatgccattaatttcaaatatttaaaacctgatcaacgaaattaaatttaaatcaaaatttgaaaaaaaattctctttgtccccttataaataaaaatatttgttttaatagaaacaaaaatatttctttaaaatatgcaaaagacaaacaaaaattatgatgaatatgtaaatttttgttagcagtgaaggaataatgaccaccaaaaaatttaaataataaatatgcaaaaataatgagacaataaaatactaaataaaaataataataataataataattatacattttctgtttatttgatccggacagtggccaattcggaggacgaacaaaggcttaatctgttggccaaacaaatatataacaaataatcggcactgattttatgcctattgtctcccattatttttgttattatttatttcttttgtgggttacagtagctaagcgggggcactctgttgtttatttgaacaaatttggcggcgagtcataatgccaaaagtcacaaaactatttttgttatgtgaaaataggcaaaaaaaaaattggggcagatgagaaaacaattacaaagcttaggtatgttataaaaagtgtgataattcctctgctgacagcagcagagaacgcattgtttaataaaaaaaaataaatttattacaaattatttaattaattattaaatagaattaattttataaaaaatagttttatttaattatttatttagttactaatttggaataattgtttttattaattttattttttatattatttaaatttttataaaattacttttatcaattaattttaaagaatttttattcttttatcattagccttataaattagtttctaagcttgttttatttatttacattcataagttcaaaaagatatttttttaattggcaatttaaaaaatttaaatttttgctttaaattggcaaaatgttccgctgtcccttcctcctcattgtcctcaatttggccattgcgctcctctgttttttgctgcgccttttgccctcaacttcggcacaacgcctggaccgctgtttcgacggcacaaattttgtcccaagtgggttaaacggaggtcaagattatcggtatcatttcaatataacatttcatggcacgtttaatccccagaaatattttcctaaaaaattatgaatattgatgaatatcttttgaatttatggcttctattccagaatatattcttaatatggaataacggtaattacaatatgacatgtaaaagacgaaattatattactagggggatacggtagattcggtttttggcgctatttgaataagtagaatgttttaaaatttcaaatttttctaacttaaaagtcacgaaaacgacaatttatctgtgtctgtgaatatgctacgattaagcgatttcctaacctcctaacagtatcccgcacatatggagttacggtagtgtgtgggatggattacggtggcagcgccgtatttctttcgtccaggcgctcagagctgcacggacgaggccgacccgttgaccacccagagtcccaccgtcactgcaatgccaatttgtgaagcattttttgataccgaaccgaccgcaacggatgtgacggctgacacgcacccttgctatatgccgggtaaaatttccgaattttaatttttggtttttgaatatttttttagacaataagccaatggccagcaaatgccgacgccgatgcaaaacttgctgcttgttgccaaaatatggcagctgtgaaggtacaacaaaatgccttcttatacatacgcggcacagtagggatgcttgagagcgagcattttccgaggctcgaaaataccgagacttttctcgagtcgagaccgatacgctccagcatcactactgcacaatagtcctattggtttgattattaatgttcgttgatcgaaaatttcccgtgactctcgagcatcactcactactaatgatgcctatttaactaattataagctctttttagctaatgatagaaatcaacattgaatataatgcaataatttcaaaaaatgaagaaaatccctcagatggcacaacctcttccaatctcctggattagtatgtaatcgcaattttttgtgccattttttaagaccaacagtcggcacaggcgaccactccccaagtgccgtgcaatccgtccctttgttcggtggagaaatttgcggtcaaagtgtgcccgcgcacgtgcggacgatgcgtggactatttgcgcagcatggagcaaaccaaatattgcgacgatacggagaatgttgacaactgtatggtgctgaaggtggccgggggaatgaggacgaatttgaaaatagtggcaatggcatttagccaaaaaaaaaactcaaaatttgaatgctggcaatgacaataataaaaaaacctaatttgaagatggcaatggcattttgctgagaaattgagcaggcacttgaacaatggcatttgaaaaggacaaatggcattttgccaaaaaataaatgggtgtgatggcattttgccaaatttgtcaaaattttattgtcaaaatttttaatattggcaatgcatggatttgaaggagcattttgccaaaaaaaaatgaaagttgagcccatatgccaaaaaatatcgaaaattgactttggcactgttgaacgaaaactccccgaatattagacaaaaagttgagaatcttttttggatatnctttggatttatcttaggctaatatgctttctacaggaatcgggccttttgtgcgtccgccgacgcgggcgaaatgtgccgcgttgacgtgcaacgacccggcgaacaccagctttgcgagcatacacgcgcaaagggagcgccgctgtgaccgcaaatgacggccaccccggggggcggtgagcacaaaatgctataaaaaattatttatttattaaataattatattttttatttattttacggaaatactttttaaattttattttaatttttttttt

SEQ ID NO: 7322 - DNA, 3024 bp, Heterodera glycines
agaattacattgggccataatcagaagaatcccttctattttaaccaccacaacgtgagtgccaaatggtaactgtttatgaatcagattattcaggtgcgcgacattgagcttacggcctctggcaggacatatccccagtacccgtacaacctggactacaagaacaacaggtatgcaagggcttatcacgatgcccaagagcacctcggcatggcgtgcacaacggagagcaacggaatcagctacagcatgttcaagactgcctattgcctctatgtcttccaaatgaccaacgcgcaggaggactcgccaggatttgagctgatcaaagagggctgtactgcagtgaacatccgattcactgaagcagtacccaacgagggagttacattgattgcgtacggagaggcagacgggctcattcttattgatcgtaaccgttagatcactagtgacctcacagtatgagtcagaattattcctctgaaaacattctgatggacacgcctccgagggacgggatagtgatgtgctttcccgatgttatcgagaagtcgccaataaactttctcttctgtcttgtgtatctgttcggtgcggcagggacggcagccgtaggcacctatttattcctgcgagagagaagaattcgtaatggacaacagattcatcgacagacttctctttgagaatcctgcgacgaaaaggtacttcaccggcacatatcccgcagatgggttgccaaggtgttcaagatttccgtgcagtctgattgttaacctggtacgcttattttttgcttcattcgctcatcgtatttccattccggaccctgcaggtatgcccggaactcattggtgtgcgatatgggcacagtctcctgctgttgcctacttctttgactcatatggagagatgcctatcagcttgatcaaaaaatatttatccgataattttaaaaagatttactataataagaggcggtttcaatcggtgttgtccaatgtttgtggtcactatgtaattactttcgtttattttatgtccgtcggattgggtttcgaaaatattatgcaaattttgaatcgttcaaataaccctgatggatttgtttatcggtttgtaacaaagagcatagaataaatattaacgaaattagtcttcatcagatgtgtcatcatcatcaaaggcatggaaacagaaaaaagtaaaggcccaattccgaataaattcagcaaatccatttagtccatcatatttttcataatattcgttgaccactttttggctcgtgccgtcctcttgccttaagaaacccttcacctaaaatagcaataaaatatgaaacatattttccattaacctcaatacagtcttcagcatcgaaaatgtagagtcgattcaacgatgtcagcgtgcgaatcatcatacatccgcttacacgatagtcacgatggctactgtatgctggagttagtgttgtaaaacgaaagaaacatacccaaggtttggtagtggcgtaatacagccaaattcacgagcaacttcctcaaggattggcacacattcgatgagtcggaattcggtgttggatgtgacggtcatttttttcaataaaaatcgtaaaataagattgaggaaaattaaagtatgaaatatttgtacagtaaacagtacgcgaaataattgaacatttcaaagcactttatgaatcaacactgaagaaacacatgacattgttacggaggaagttatagaattcatcaattcccttttctttgtcgaagtagatagtctcaacgcttaggacgtatccaaactgcttgacaattcccttgaactcaatttggtctccttcttcgctgatgtagatgaaacgcggcttgtcctggtgctcgaaaacgtaacgcttctgctcctcctcgtacggcaccggaattttgcagtcgaacataaccgcaaccagatcaaatgctgtgcaacattcggcgagagtgaacggctcctcctttttgttcagttcttcgtccattttctaaaatattatttctatttgatgatattaataaaggttaacctcaacagatcgtagctcgtttgatggttcatccaaagacaggctttcaatcattgtttattcatcaatcggcgtagtcaaattgttgaaattcatagttggtttggctaaacagcattgtaaaagacagaaacagaaaatattcatgttaataaataatgaaagaagataagaatgattttgaaaaaagggtaggattaaggatagaaacaaaaaaacgacgccaagccacttttcccgccaaattttgaatttgaatctaatgcgaaaggttttcgtctcaataaattatggcgttatgtatatattgtggcgttttgtcttgttttgcgtattttcaaagtttttccaccggactacagtacccctcgcagtgatgacgtcatcatctttgctgcatatagttgataattatcctttttctggcaactggtttcgtggcagagtggtagtgtgttgggttggtggcagaccaaaagttcgagtccgcttgcctgtggctaatttattggaattattcaccggactacagtacccctctcagtggtgacgtcatcatctttgcagcatatagtggacaattatcctttttctggcaactggtctcatggccgagtggtagtgtgttgggtttggtggcagagcaaaagttcgagtccactagcctgcggattatttattgcgaattttccctgggctaccgtacccctcgcagtgatgacgtcatcatccttgcagcatatagtggacaattatcctttttctggcaagtggtctcatggcagagtggtagtgtgttgggttggtggcagaccaaaagttcgagcccgcttgcctgcggctattttattgcgaattttcaccggactacagtacacctcgcggtgatgacgacatcatctttgcagcgtatagtggacaaattatcctttttctggcaagtg

SEQ ID NO: 7323 - DNA, 2403 bp, Heterodera glycines
atagttgataattatcctttttctggcaagaggtttcgtggcagagtggtagtgtgttgggttggtggcagaccaaaagttcgagtccacttgcctgcggctaatttattgcgaattttcaccggactaccgtacccctcgcagtgatgacgtcatcatccttgcagcatatagtggacaattatcctttttctggcaagtggtcgcgtggcagagtggtagtgtgttgggtttggtggcagaccaaaagttcgagtccacttgccttcggctaatttattgcgaattttcaccggactaccgtacccctcgcagtggtgacgtcatcatccttgcagcatatagtggacaattatcctttttctggcaagtggtcgcgtggcagagtggtattgtgttgggtttggtggcagaccaaaagttcgagtccgcttgcctgcagctaatttattgcgaatttcagcaggactacagtacccctcgcagtgatgacgtcatcatctttgcagcatatagtggacaattatcctttttctggcaactggtctcgtgtcagagtggtagtgtgttgggtttggtggcagagcgaaagttcgaggccactagtctgcggcagaatttttcgaataaaaaaagtcgcgcacccctgcaataggtttaggcttgcagaaaaaaagtcgcgcacccccctgcaataggtttgggtttgcaaaaaaaagtcgcgcaataggttttggtttcagtactgaaaattttggcgctcagttggcccgcgctcacttggcggcgctcatctggctggcgctcagttggccgtgcacccctcccataggtatgggaggctaccgtaatccggtggaatttactgccctaactacttaccgcattttttaaaacattaaattaatagtttttgatacaaattgtcaataaaaaaagcttaaaatccacggaccgggtcagtttagtacgggccgttttagtacgagcgcacatttttccactataacttttttatttgttatccaaatccaactttcttgatatcattcgagagcccttcggatgctctattagcctgcaaaatttcaaaaaattttgttaagtttaaaaaaagtttgagccaaaaaagtttgaaaatctggttttttgaatttttctgaccataactttcttgaagcttaacaaaatttttcgcaatttttcagattaatagaggacacttagggctatcgaacgatactaaaaatgttggattttgttggcaaagaaaaaagttatagccaaaaacttgcgctcgtactaaaccgaccccgacccatttttaaacgttactcatcaatagctgtcgaatgataccaaatttgtccggttttgaccattttatagaagtgctccattttgttcaattttccgaattttaaaccggttcaaaaaccattttttttttgccatttccgcacctcaggagtatttttccttagcattacaggccatgagagaacgaatggcatcaattttattcattttttttgtgggtggtagactatagtaactccaaacagtgattggaatggtgtgccaaaattctttaaattttcccaataattttttttccacccgctgcagcacaccttccgccgcatttgtttgtatttgtagcgaaatgtgggctcatcagtgtccacgtaaagagaagggtttttgcgatggcaaatggtggtggtggcggtcatccgccgctgctgctgaacttcttccgtgtcatgcaaccgtttgaacgcattccgacaaaatcctgcaaatgtacacattcattttgagggcatcatttaaaattaaaaaaaggataaacttacaattagcccatgactacagtatgcccctcaaatgccatccaaatactccccccccctcccctccggaccgcctcggctgacgcccactgttaagcgactgagtgcacttatttatgggggtaattagcgcgctaattgatgagactgaccaatttcgcctcgccacacccactgcagcgggcatttgcacttcgcttccggcacgttgtgaatgcacgccatgcacacctcctcgatgaggttggtcagaatgatgttcggaaacattgcgccgacgtccgacaagtggcaaatgtgcgggagttcggtgcgcaacggtcgctcaatgagtgccgacagcaggacggcatcaatttggacagaaactgcggcaaagtcggccattccggcgccaatgtccgcaattttggcatcgttgcacaactcgtcgtgctttatggtgggccgcacatcgtcctaacataaaaattgcactcacaaaagcgttggaaaatgaatttttggttgctgatggaaaattatcggactaaatctgttaaaaaaa

SEQ ID NO: 7324 - DNA, 5745 bp, Heterodera glycines
gtttgtcgaaaaaatgggccaaatttcacgtgtcaaaatatcccaaatccgctggccatccgtggtgtatgataatggaatccacaactgtaaatcgatgcctcttttgtcgaaaatttggtgattggaacgaagaaaagcgatgacggagtgatcgatgtacctaaaaatgggatgaatgcttttattgtcatagctcagattttgaattactcaatataaagacgcttaaagcgaattttgctgggcaacggacggtcgtcgggcaacggaaattccacaaatttgtcattgaacaatacaaacagcttcggtcctggtcctttgtccttgcgaattttgatttgtctccaaattgtcaattcgcttttgccatcgaaatgtttgtccaccaacgcatcgaaacgtggcgaaagaagtgccaatttgaggccgagttgaggatggtcaaaactggggaaaatgtccatccaaacgtcgttgcaaatccaactgaaattatagaaaacagtttagtcaaataaacgacgaatttgtgacttttaaaattcattaccgtcggttcatttttggcagcaattagcacaattttggacgagttccgaatgatgtcaaacaaaagaacagaataataattcgttggaaactttatttttttaatgagagtcaaagcggaaaacaaaagatttttatagtcatgaaaagggaattggtgaatattttttgcatatgaatagagagagccctgatttttttagatttttcctattttttacggattgtacttgatgaaagaaacacgaaaatcacattttattaaaacaatttttgaatttttttgccttaaatggggttggacaatgtttaaatgggaaacgaaagatcattgacaaaaacggaaggggcggaaacattttggcataaaatgaccgattggaagaggaagcaaaagggaacgcaacagaggaggaccaccaaagaggagaatattttgcaaaattatgactagggatgggaatttaagtcaaatgacttttttgctgactctaaatgaccttaaaatgacttcaaaagcgatttttagtccatattttatggccatatttcgcgattttatatacatatttttaccatccctagttatgaaaaagtcaaactatctaaacgattaaaatggaaaatcatacataactagggatgcaatttttaggcaaaagcctatttttttcctgagctccccgtggcctgaaacgcacgaaaaacatgtttttttcgggtgttgttaagctacttttcgagttattagtgcctattttctaggcttttatttttagcgcctaaaaagcctaaaaaattttgaaagagcctatttttgcctattttggcgttttgcccaaaatttgttaacaaaaatgcaataaaaacggaaatctttgcatagaataaagaaatctcggaaaataaaatccggaattaaagattttattcactgattgcagttacaaaatattttcttagaaaatattgaacaagaaaaaaaaatttgggggaagaatttttgtgaaatttttccaattcttagggatgtatttttgaaaatttttaggtcgattcttaggggtgtatttttgaaaaatttttaggtcgattcttggggtgtatttttcgtttttattgcattttttgggaaattttccaaaaaatgccaaaatagtggcaaaaataatgacgaaacgccaaaatagtggcaaaaaattattttagtggctaacttccgaaatagttttttttagtggcgaagctccaaaatagtgattcctagtgatgaatagtggcactaaaaatgaaaaattttcgaaaaagaatgtgtttttcgtgcatttctcgtcgagttaaagccgcagaaaaaatagttaaaaaactaagaatccgatccctaatgatgaatttgtgtgacttttcaaattgcttaccgtcggttcatttttgtggcaattaacacaattttggccgagttccgaatgatatcacacaacaaagagcagaataattaattgcgttagaaatttttatttttttttcaaatgcgagacaaagtgaaaaaacaaacatttttatagacatgaaaagggattgatgaatgtttttgtatctttttgtttatgtgtcatgattagggaacggattttgctctagtgcagtttatgagtccaatcgacctttatgagtccaatcaattgtcaatcccgggtttttatacaataactttgttcatgttcgataaaccctacctttttggtatcattcgaaagtataaactgaataatgtatgacccaaaaagacaggcacaaactgctgcaggcgaaagagttgggaaaacggcaaaaatgagataaaaataaaaactttattatataataaattaaaaaaaaagtacaatggcgtcaggctatgcctactacaaatggagaaaattggcgagaagtgatgtcaaaaattgaaaaattaaaaaatttgaaatgacgcgtcccgccgtacattagtgttaaccggacggcaccgtgttttgtgaattgaataattaaatttatttatttaattttatcgatcactgagtttttgtggaacgcccacactgagcttttttgtggaacgccctagcaccggtaaaatctatgccactttaaaagtgctttacatgggacggacaatagaggctgcaactgttggaaaattttgcgcaatttttggcaaatattaaaactaccgttaatttttttaattttaaaaattagagtcaattttttgttgttgtttgaggctattaaaaaaattctttaaaagaagtcattgacctaggaaaaatggagcagcacaagtttttatcagattttattctagaattgtcattttttaactaaaatatcccaaaatatgtacaaaaaccccaatatgtaaataaaaatttttcaaatggttattttttggaaaaaaatcctcgtaaagtgaaataggcaaaacttttttttgttcaattcttttgaagaagtcatggtcatatgtttaggaacacctctttttttgaataaattctttgatttttgttatatttttataaaattttaattattttttccgtttgacgcacatccgaccaaactgacaaattactgtagaagatattagccgcaagaaataaaaaaattaaaaagttaagaaatttgtccgaatgcgggttcggattcgaaacatggatgttttgcacaaatccgaccaatttcagtcctaaacagctactcacgcgaaaacggccccgaccgattcttagggggtctaagaatctctatttgtaataaattgtttgaaatttgccggaaattccctgagaaatttaatgatttttttaaatcgttaatgggatttggggaacaagctgtgctcctgcaaaacccacgccacaacataaattttttgcctatgtaatcgaatgaatgcatttttctttcgaaaattgtgtagttttcaggattttgacggggatttacgacatccattagcattattaggaccggcaaaattaaaaagtgtcgatttgctgctgttactctctcttttcagcttcattctctcctcctccttccgtcgaatttttccttttcctctctttctcttccgtctctcctccttccccaatgctattttcatccttttcctcctctttctccccctccttgcttcgaatttttccttttcctctctttctcttccgtctctcctccttccccaatgctattttcatccttttcctctatccgtccaattgattatttgattgattgatttgtgggtggggggataaggtaaaacgcccggcaaatggtcatcattttgcaaaatattctctttgttggtcctcctctcctcttctgttgcgttccctttttctgtgtttttcgagcttctcaaattttgttttcattgttttccgctttgttctctaattataaaaatggtactacaggagtttgtatccacatttttggtcaacattttttcaaattctttttttggtttaaaaagttcagaaaacaagtatccgccgggggtttccgaggtcgctgatcaatgatcacgaatatggaatcctcttgattttctacttctttcccttggttcaatcactctgcagaaattcaaatattttgattttctttttgttcatgggttcctacatatcgacaagctatgcttcctcatacttttttttaattgcgcatattttataatttttttaaagaaaatccatacaaattgagcccagtagtccaaaaaaccagcctttttgttgaaattcgtaaacaaatctcactcaaattttcaaaatttttccccggcggcgcctaactgcaccgccggacccctttcttcccaaaaagttttttggaaaaaacgcgccgaaaaattatgtgaaaagcaattctggatttctaagattattcgatcatttagtccaaaatgattaattgtttgaaataactgaagtaaattcgtttaaaaatttcattaatttaatttagctttaacttttagattttataaaataaatagcaaaataaaaattaattttgtgttattttcacttgaaataaattaaaatttgaattttttttgaatttaaaaattcccggaaaaccaaggtcccgtcccggcttctcaggtcccggtcccggttttgcccaacattcccggtccgctcaactctacggtagtaccataaaaataaagtttccaacgcaattaattctctgcaatttgtgttatgtgccaaaaaacccccaaaatatgtgctaaaacccaaaaaaaaggccaaaatatgtgccaaaaattgaaaaaaactgctcaaaaaataagttaatttctcaaaaaagtctcattttttatcaatttcgctagcttaatgtaatgctttttggcgtaaattttttttcgctctcaaagatttactcatttttcggaatttcttcgctaaaaatcaaattttgctttaaaagtgaaaaagtcatgaaaagggtcaaaaaaatacaaaaaaaaagaaaattttgaaaaattattgggcatttatttgaccacgaatttgagtgccaaaaaagacatttttgtaaaaaaaaaacctaatttttccaaaaaatcgccaaaatatgtgacaaaaactgccgaaaccccaaaatatgtttttattcccaaaaagcccaaaataaatatgtgctaaaaactcgctctgattgaaaggaaaacaggtaaaaatgctatttttgagattttcatgcgatagatgcgcaaaaaaatatataaaaacatataaatccgttccctgataatatccgtcaagaaataggaaaatcctaaaaatccaagctttacccaacgcaattaattcttctgctatttgtgtgacatcattcggagctcggccaaattgtgctaattgcctcaaaaatgaaccgacggtaaaaggattttaaaagtcacaaattcgtcgtttatttaactaaactgttttccataatttcagttggatttgcaacgacgtttggatggacattttcccctcttttgaccgtgctcaactcggcctcaaattggcacttctttcgccacgtttcaatgcgttggtggacaaacatttcgatggcaaaagcgaattgacaatttggagaccaatcggaattgcaaggacaaaggac

SEQ ID NO: 7325 - DNA, 5768 bp, Heterodera glycines
ggcatcaaaaaaaaattaaataaaatgcccaacaaactttttctcaaatgcttttgcctttattcggttcagagtacggcacaaatggaccggaggttcgtctactgtctgttcgcgctctctttttttgccaacttttgcatttatgccccctgggcattcaaaaaaatcatttaccaggcaagcaattgatctgattgatgttgaatatctgatgttgccttttggctttgtgccgttcagattccccccggtgttctcagatgccccttggtaatttgcgaccgcaacatggacaccccctggttccgcatctacgaatgggtccgcgagttcctcacgcgtcttttgcccttcgttctcatagcctacttcaacgtgaacattctgatcacttacaggtgatgaccgataaggtcgagccaatcttttgtgatttgttatgtttgaggaccaacaaaaaagaccgtctctcattgtccagccaatcgtttcatcggaaggccgtggtcgagaaaagcgaaaaggtccaacccatcgctgagacaagagcctaatgaatctgatcagttgcaggaggagaagcggctgttcactgtgctgttcgccattaccgtcattttctttctgtgcacaatccccgcggttggccaaagcctattccgttgttgcttcacttttgcaccgctttttcatctttccaggccccggtgaccattttcatctccgatcggcagagccaatcgctgccatttcaggtgggtgaaattgcgtatttacaattggcatttagtggacacaaaacaacccttttaaatcccattttgattttgaccaacagatattccgttccgcctcgaatttgttggaaatcaccaaattcgctcttaatttttacttatattgtctcataaacccaggttcatctcactttgcttttctctaattgtcatttttgcgaattgttaagacattcggagggtttgcctcagagtgttgaaatgcaacggttggacttcgttgtacgaaagagtgagcagcggacacacgctgaggaccattccgagcatgccgaacagcaggtgaaggagcaattaatgggcgacggacgaaacgctaatgaccatcgatcaatttttggtcgggaagcaacaaaaccattttgacaatacggaatgggtctgatcggagttcgcgcgggagcagaaaaagtcggaacagtcatttggccacggaagagagtcaaaggacggacccaccggcggaggggacgaccgatcagtgccaaagtccgatcggctacactgaacggcagacaaaccattcgaaccattcgtcagggcagagaatggccagtcggacaacgccgagacggagcagtgcccgcaacacaacggacagtcatcggacgaccatttgcagcaacaaagacagcagtcattggcacgcgcaattgtgaacggagcgaatggagaaaaaaatgaaaaaagaaaatggaaaggaatttgtacattttgaggagcaataatttaaagatcatttcaattaaattaaatatgaaataaatttattaaagttcataggagaaagtgggggaaagacaaaaattgcaattcaatttgatcccttcccttttaaatgtatttctttaatttgtgccaatttacgccgctgtcctttccattcgctttttccggcactttcccttttaattggtacccaattttccgggctccatttccatccgccttcttccaaatgcatttgacattaagcacatgaatattttccgcttatcccaactcatccctcaaaagcaaattttccattttttgctttacttttgccaatttctgttttgccaattgcgtcgtttatgtcatttccaaatttataataaaattttatccaaaaatacaaaataaatgtttggatgaagggacattatgctaattgataattaatttccctaaaatcatttaaattaaaacatgtttaacccttgcgaatgttctcacagttcgacctgcacttgaacaacaaccaacaaccggtcttccgtctgtctttttctgctgactctgagatggtccccctttttccccatttccccccattttccccctcagtcaataaaatgcgtacaaacattccccaattacacttcacaattagacagccatcacattctcaatcaacacaaatgcttaactaataaaaaataaatcttctttttggtccattgccatagccaacgcttcatctcccaaattccatcggcggtgccattctccgtccgtctccccccccccccctccggtgctgcttttcctctgctcttccgctgatctcactccctccccaccgtttggtcctcaattatttctcattagtgccattttatgcttattccttcttctctccgcttcatcatccgctgtcattcttcagctgctgctgagtgttttttgccttcgttttcgtcccttttacaattgtataattctttcaattgagcaactttggcattatttcctcctccttgtttgttagcatttgaattagccgaggttcactcggttctcagccagcagaatggccaactccagtggccatgacccaatcgcgcggtggctcactcggctaaggcctcgttcgcgcatcgctttggtcattttcggcgctgtgatgatccacctcagcatcggcacttaccacaccttcggtttgattggaaagcatcttacaaacgcaatttgcagaaatgaatttggataggcaatatgctcccttacatggcctcgtacatgcgaaatttcaccgacccatcagtcaaaattgagcatctcatttgggtcccaactttccaaggtttggtttgccagaaagcgcaaaatgaagtgccccttttgctgggcaggctgttttccgttggcaatggtaatcggcgggtttctgtcccaaagggttgggcctcggctggccgctgccattggctgctacacaatgtggtgagtcaatgaatgggtgctttcttctgctgctcattaatagggttgagcgctaccggtaccggccggtaattaccggtttttttggtaccggtaccgaccttctgattttcattatttctcgcttgggttcaattccccactgggataaaatatttttcatatttactttaccattcattattttaaataaaattttaatttaaaaaaaaattttttttctttcattttaaacagcctagaaatcgaaaaagtaaccaaagactgggtcattttttgacaaattctgtaaattaaaaattttcccggcggcgcctatcggcaccgccggcccccctttcttccccaaaagtcttggaaaaaacgcgccgcgaaaaaagcggtgttgaaagcaaaaaaaaaaaaaaagataaatcaatttacatggcggacccagacccccttgtcttgcaaaaaaactgaattttagtgttctttatcctgaatttgaaaaagaagcctggtcaattaccggtttttaccggtaccggtgtaaaaagttggtacctaccggtttttgcattaccggtcagtaccggtaccggttttttttacaattaccgattaccgctcaactctactcattaatcccttagttttcaatttaatttttgcacagtctctaatccaattaagcaaatcatttgcatcgaaattagaatttgtcaaaaataataatttatttatttggttaaaaatggcttttccccaatgcttttggcctgtcttttcccttccgtccgtctgtccctttacttttcattcattctttggccccaattttcagtttgggtgtgctcctctcctcatggacaatccgccattcctattacggctttctgttcacctacggactgatgtttggccttggccagggaatcgctgtcagaaaatgccattatgccaaaactagtccctaattgttcagtatgtgatcgcagtctcttgcgtgatcaattgggcccccaaaatggtcggcctcggctcgggcatcgtcgccgccggctttggcatttcgtcctccatttttgcaccaattcaaacgcgcattgtgaacccgaacaatgtggcggccaataaggacggatatttcaacgatcagcatttgctgtgaatggcattttcatcaattggtgccaactttgctcgcttaggtcgcgtgttcccggattgttcgtcactttggccaccgcttatttcttcatgcaatgtattgggctgttattcatttgcgacccgcctgatgaggtccgttctccgtcgttcgtttcgaatcgtttcttaattacccctaattaccccttctctctttgtcgccacttaattaaccgatgcatttgtctcgtcccgtccttgtcctcctcattaaataattactgcaaatggcttaacctgctggttcgtccgctctttcagtttgtccgtcgctttttgtccccaattcgacctctctgatcgacatggcatggctctccaagaagcgcagtcattggttagctgccaatcggtccccgctgctttcctccgggtgggccaccgccaaaatgggactccaacggatggaacgcttcgggcgttatcaatacgctcggtttgtcagtagagcaacgaattttcaaaaacaaacaaacaaaaaacagactggcaacagccgctgaacaggaggaggacagtgacgaagagcaaaagcagaaaaaggcaaagaatggcacggagaaagaagcttttcctccccaaatgctaaccaaaaaccgaaaaaaaagacctaggaaagaaaggaaaagcactttataacacggaaaaagaaaatgccaactttagagtgaaagtgggagcaatgaacagcaacggcatttgaccaattcctttccgactcctccgaacgaatcggacgaaacggcagaagaggaggacgacgacttggacattggcaagcaggtcaaccgacaggggacacggcacagccgacggactgacactgacagaaaagtgccgaacttttcaggggcctccgatttcgctgagcacgcggcaaatgctccgttcgtccaccttttattttctgttcatttcgctgttctgctgctctttttatgggaatttcttctacaatttgtacaaagtcataaataataatgacacaattaattaattttcatttaatttttcagactttcggcgaaactttcatcgaagacgacttttttctggcctttgctttcagtttgggtatattaagagggtaactaattttagcttcattttttgcttccgcttgtcaggctctgtggccaatgcgattgctcgcgtcggctggggacttcttacggataggacgagtttccaggtgccaatgccttctgattaaatgtcaaatttcggcattttcttcctccttatccttcggttgtcccaggagggcttaagcatgtgactgattttaatcacagacaacccgtgaaaggacctatttaaaaaaccgtgacctgtgattcgagatcacggacaaaaaaaatttaaaattgttttttagtttgaaatatatagtatttttttaaacaaaaaaaacccaaaatttttaattttattattttttcacttattattaaataaacgaattgctatttcagaaaaagttgtaaattttcctatataggcgccggagaaaatgtttttgcagttttattaccatatagtaatgcgatttgttaagagatt

SEQ ID NO: 7326 - DNA, 1283 bp, Heterodera glycines
tacgacaacgcttccggcaaacgcgcagcagttcctcccgctcctcgtcacgaatgcagcatcatcagcacaacaacgacgaagacaccgaattggaggcgtacacgcccgatctgttgccttccgccatgtccgcttcaacctcacaagcgccaactccgctgccaaccaccagccacgcatccgtcgctggcccatggcagcgcggaggctcagtgaagtcgcgcaactcgttgaagctgttgaaacgcaaaatttttggtggcaccggctcgaaaaatcgcgaaaatggcggttgcgatgtggcggaaacgacaatttcggtactttttttgatcaaattgtgtcggaatcaattcgagtttcagctattacaatttatcaaatcctttctaattaagactgctccgacggatgaaaacattgtgtggacagctccgtcatcaccacaaattggtcgcacattcaacggtgttaccggcatgccaagacgtcgaaattcagcaagacttcgtgaattgcagcgcctgcttcgggcataccatgaacaacgaagaagtgaatggacatcgacgccaagcagtccaaggatccatcaacgacaacaaatgccaatgaaagaagcaccatcaccagtgggatatcatgatcagaattttgatcaccatggaaccaattatcccgttcatataccagtagcaaagctgagttactgtcgtggtgaactcggccctgaacgccctctaattcttcaatcacattctgtggatcagcagcagcaacaaaatttgcctgggccaaatgtgctaagacggaaaatcaatttgtcagagttggaattggcactgttaaacggtgccaatacatcatgcccatcaagcttgttcacaaattccagccaaacagcttcatcattgcagcaaccactgccaacatcggcaactgttgttgtgcacactcagccaccaggacacgcaactgctgagcaagctgcgacaacagttgttgaggaaaagcatgcttatcgagcaaccaattttcagcatgaacaacagcatcaacaaattatttcgttatcaaagcacctacagtaccagggtgctaccacagtaacttcaacaacacacttttcgtccgctgttgggtctccccagaagcagcagatggatttcctaattaaaaaggctaattaccaaccaccgattgatctgccactgataagcccatcaccatatgaacaaatcatttcatatgtggcaccccctgtaaatatgccaaaacaa

SEQ ID NO: 7327 - DNA, 2014 bp, Heterodera glycines
caacattgatcagagagccagaaaagatttgtatgaaatggcatctgaaaagccgaacaacaagcagaagaaaaagaaaaagcggcgaaacaaaagtgaccaaatgccaaaaacgcaccatggcattgttggacagtacgcggaaattcaaaatcaacaaatttctggcaatcaaatggcttcttctcccaaattggccaagccacaacagcaacagaatgccaagacttatccaaaaagcggttcttcaaatattttatcgctcggatttaatcagttagttcaacgccattttcaacaaagccaactaccaccaaaacaacagcagcaacaacaacaaaatgctgtcgttgaaccaatgctcaagtcggccaggtcggagcctcgtcttacggcacgggccaaccggcgcgagcattggctgctgatgagccgcccagaaatccctggctcatcatttctatctccaaccccgtcaattgccgctttagagcatttggaccgtgttcgtgatcggattagtgagacaaagtcagggattaggggtgctaaactttcgagagtcttgaactcgaaaacatttggagatatgtgacagccgtgtttgagtcgcgcggtgggcttggccccgtgttgagcgatgtgcaggccgagttggagcactggttgggcgacacgtcccttctattggccatcgcctgtgaggtacattggtcagtgccggagcggttcagaagccgacagctggaaattgagtaagttttgctgttttatggtactttattggttttaaacattaataggggtaacaataaaaaaacaatttaatacaattcggatgccgagaatcccgaacatcgatttttaaaattaaactacattacttaattagcaaagctctaattacacatccgagtttaatgccagaagaataaattttggttaaataatttttaattttaactaaaatctgtattttcaatttttcaaattaaattccatcggtctgcagcaaaatgccattattactactgctgtgatcaaaaatattggcccttaaggcttaagcaatgcttacacgcggtgctacgcgtgaacaaccgccgcgtgctgagcctgaacgataatgacaatgacgaggaaacagcggcggtaaccgcgaaagttagccccgcggacagtccgtttttgatgccacggcacgggccacggcaccgttcattctcaacccattcgctgaacaatcgttccatcggcggcggcagcggcgggcgtccgtttcccattgcgttggcacgatccaaaacggaggagtcatgcattcgagatgccgagctggacgcattccagggtcttgaatgctttacagatgaagcgccaccataaatggaataataaaaaatgtatttctctatctaaggaatttatcgccgtttttatccggcattgcttccgctgcaagacccggctactgttaaagcacatcaggtactgtactgtaatggggtttttacagtttggggacaaaaaatgatgcgccgacgcggaaaaagtatcgactcgacaaaattttttgaatcggcatctagctgagatctctcgttccatcttaaaattaatcgagatttaatcgttttttagtcgattttcattaaatcgctagctgttacggtacattcaattggtggtctattaccgtataggaagctactttgactgtatgtataccttaaaagggctattggacacttgaaaatttgacggacgagcacaagtcgccattggtcccggacccggcacgttttctgtaccaaccggaacagccggctcagttggtgcgcaagtcgctggtcgcggtcaacatggcggtgctacgaatggtcggcgacgagcgtgactatgacgcggacgaagcacgcggaaagcaagcaaagcccggactgaaggaaagtgatctgtaatggatccggtagaggatgtgatcaccgatcagaattgatgttttttgggcact

SEQ ID NO: 7328 - DNA, 2215 bp, Heterodera glycines
  misc_feature (63)..(63): n is a, c, g, or t
  misc_feature (103)..(103): n is a, c, g, or t
  misc_feature (2050)..(2050): n is a, c, g, or t
  misc_feature (2079)..(2079): n is a, c, g, or t
tcatagtctaaaggtttgaaataggaatacagtaaggctcgatgttgtaaaactgaattattncaggactattcatcaaaaatgactattttatcggtagacnatggcttgtgggcaaaattcaagcgattgacgaggatttgcttccatgtaaccgcattttttacacagttttgccaagtaaatgaatataatttaattaattccgaaaaaattccaattaattaattacagaaaaatccgacataattaaggttcagacaaaacatcacaaatcagcattgatcaagaaaccggtgaactgtttgcacacaatttgactggcttaaaccatccaatcaaattttgcgtttttgcaaggtaattaaggattaattaggagggtgggggggggtcattatttcgtaattgagccgctgtttagtacgttcaagccaaattcaacacatcttgctataatatctcgacatggtattcccgaaaatttccgttcaattttacatcttcaaattgtaccaaatccgtcaaatattgctgagcatcatcatctcccacaacaaatgccgttgggcataattcgagcaaacaattcacattccttgctggaacatcagtttttgcgccaacaaattcccatagaatttgatggaatggcacttgggaatggttggattttttaaaagattcaaagatttttatatattttattttggggggcattttagtaatttaaatattttattttttaagggcattacaattcattaccaaataaagtaaattcatctgtaacatatcccaaattgtcattcgattccatcaaatttttgccatacggtcaaagtgatcagcaccaaaaaatcggtacattcgatgtgatcagacaattggtcggaattgactccgccaatgccaaattgcgcttcaatccggcatttgttgaagcatttgagaacggactgtacaaatttggcatttctgttcaggatgccattggcaataaagcaattgtttaccgaaatgtaaaattcggaaatatttattaattaatttgaagaaaatttgttttgaattttcaagattcatcttttggacgacaaatttcgcttacgttttcgctttaatgaatcgcttcatacaattggagccaatctgacaacatttattgggtgagtaaaaatttttcgattttaaattgcgacttaaaattaaaaaaatttttttttttttttttggtttttttggcattgaatttcgggaccaattcttgatattcttcatgaaataatctctgatcacatttttcatttgatccatctataaataaaatttaagaaagcttgaaaaacgacttcaaggcgattacaggattatgccatcattaccaatacgagacgaggaaaatccgggacaaaagtaagaaattctggcacaattaaaagcaaattcgaattcatgccaaattgaagtttcgtcatgtgtttccatttgtggtcaccaacaaataatggtagtggtgatgcaattgttgaatttgcggaaagtgaacggttattgtccacaaatgtacaaaattcgaaagccaatgaacaattgcatagcttatactcagaatacaaagtgatcaacattgaggtaatgttttttggagttaaatgccatttaaaaataaaattaataataaaatatttacagtttatgaaaattgaggtgatttttttccaagatcggaatccaaatcccatttcgggatttgaatactgtgatcctatcccgggctgatacgaagcaagcctgatccggacttttttcaaaattcctggctctataaatcaaccagagagtagattttcagcgcaaaaattagacttagccacgccctaggttagcaccaaaaaactaagcaaatgcttcaacgtcagcccgagatttttttttgacaatactttttatttggagaaatgtgttttttaacaaaatgaaaatataaatttcgaacaattcaaagactaagtttgtgaatggctcttcgggtcaattttatttttanatctttttttaatgaattataatttttanaatttatttaaaaatgatgctttttcagtcatgtgctgctgctgattcgtcgacatcatcggtactgctcaattccgattcttttggctcgtcgatggtgcagccaaatgccaaagcagtgctcgtctgcttcact

SEQ ID NO: 7329 - DNA, 4440 bp, Heterodera glycines
  misc_feature (107)..(107): n is a, c, g, or t
atattgtgattaattattattttaaagaaatggtatttcccttaactaaaaattaatctttaaatttcaaaaaatttcccaacattcagcttcatacaactccaccngacaatccgtatagtgtttatgcgaaaagcaacaataaattgacgccttcttccatgtttgctatgcccgaatttattcatccaaaaacattacggtaatatacggctatttactgtattgtaaatcagaataatttattttttaaatatatttagaagtgatgaattggaatattgaagatgtttattcagagaaatgcctattcctataacttttctctgtttggattcgcaatttctaatttttttattattttttttttgtcaaatataataaaaattgttgaaaaggaagattaattaacaattgcattaaaacgggaattacgaatttctatttggattaattgaaataaattacaaaaaaaatcattggagtttacagattaatcccttaaaattcatttaaaaattaatagatagaattggattatctcccacaaaaaaaatgttgtttgcaaaacgccaacgcatttctttgcctttcgccattttgaacaagaaaagcggcttattttttgcgtgccaagatgagcttccctaattaattttcacaaattgacattgccctaggcgagattcattcattcgacacgaaattaattaaataaaccgcgctaatcccccacgccttccgagtccaatccctgttaaaatgtttaatgctaagtgttaattaatgccattttactcgactttttcaaacataggttttccagctcccctcatggcattttgtaatgaaagggcgggggtggggcggaagttatgcctcaaattgcttacatgaaagatgaagctgccctaaggcatacaccgatcatttctatggctttttcttcttcccaataacagcaaaaaatgttctaaaagctcttttaaaatgtggaataattttaaatatttatttttaatacaatgattatttatttttatccaaatcatggcaacattcatttgtgacctgctgtagggaatggatttaaaaaactgttacaaaaatttattcacataatacaattttttagcatatgattgtcctatcaaaaatgcacataaagtctattttgctcgtgatcattgatcattaatgattaaaatttaaaaccaaatttcaagactataattatgtatataagaaataatcctgattagtgatcaaaaattaaaaaatggctaataatttaatcgaatttatatccgattacaacctcgcaaatccttatcctcgataaaactatatttgttaaaaacaacatttttaaatttttgtatgattcagaaatgatttgctttcattcacttttatctcttctaatgctcttcattgccatgctattattgaccatgcaaaacagagcagttgactcattcctgttgagccaccgaaatttggtaattaattttaattaaaaaaaattaattgaaaaaaagaatcggattatatataataaaataaaaaaatgtatatacagataaaaaattttaacattaaaattttttttcaaataccttaaggcaaaatgattttttttaattcattaaaaaatttctttaaaaaattatcaaacaacgattttttcaatctgtaaaagattagttattttttcacatttattttataaagtacgcctttttaattatgagaaaggcaaaccgaataaaaagaatgtagcattgtcatttcccattattatttgcgtgcgtgaatgcttaatcctctcatgagctaatccattttataagtacaacataagatataaatccctctcttgacgtataaaatattgatttgaaaaaattttgaaaataaattatgcaactaataaaaatattttgacattaaaataaaacaaattttagttggttcctttcgcgtccaccaaaatggccatggccaacaatgtggccaaattggacaccacaaacaataacaacattggcgttcgtcggcggcaccattttgtcagcctttttatgatgaaagcattgccaaaatctggtgatggagatgatgatgaacgacaaattggtgccaagaatgtgctgtttcaaaatgatggcaaccacctgctgctgcaaccgtcggctaatgatggtgccattgccccgcagcgagtgcactcgcgccggaaacgattgcacatgttatccaccttgcgacgcgttggcacaccgcgccggtcaactgaactgcttaaacggcttgtggttgaacaccagcagcagaaacaacggcatgtgccactgaaacggattttgtcattcgatcttctctggatgttcaagagggatttctgagattcaaataccaattttttttttaatttcaaaagcaattaattttaatttgtaatgtgtaatgtaacaaatgtcacatgtacagtgtatcactgaattgtttttatactgtaaaaaactgatatgaaacaacaacgacttaattaatgaaggatttgctaggaagttgttgttggcaaaaacaatatttttttaatccatgtttattgcaccaaggcactaaaattttttgtcgaaaaacattatttaaaaatataaataataataataaatcccgcccgtagagaaactgaaaaacaattcctctacattttttgattttcttaacttgtaatttcgttcaaaaaagttcatttttcaaattacgaagcccaaaacttagatgagtcctccccatcggcggatagacaagcaaaacatatttcataattctatagattgacatttttgagctaattagtatattcattaccatttgcgcccccccccctaattttgtagccagttcagtacaacaaataaggcacttgtgggcctcaccccatccccctcccccgaggcattgtctggtgccaattatgcaaagttctgccagatgatttttcttgtcttgtgctccagacagaacaatgcctgcggcattggcacattttgtcgttgaagcgaaaactttgagatttaaaggcatcatttatcacattttgagtcagtcacattggcattttgtccaccctcaacactttcacttttctacccaaattcttcctttttccagctgggacaaattgccaatttattaaatgtcatccagctaaaatgaaattttgataaaatgtcatatgtggcactgtcttggtgtaatttttcatgctttaaaaaaagtaagcatcaaaaattgatgcaattcatgtccttttcccattggccgactatttcaaaattattacacaaaattatttatatatatatctataaaaatatttaaaatatttagtaaaaattgaattttcaattgaattttaaaaattttctcttctgaaacggcatttattaatagcttgtagttatttttaaataataataatttggcagtactattttttataatattatatttaattattttccatgaattagacgataacgtcattttatttattttataattaattaattaatgcatttttatttttgaaccataaataagcttccattttccaccagaaagcaggtgattatgtgtaaatgtaaacaattgttgccgaaacaagacatttttccttgttaatttacatattatggctatggctaaattaaggaacagagttataaaagaatgtgaatgaacattgttttgtttatttaaaatagcttattaaaaaaaaatcatttggtcctattttgaagtaattaatgccttttaattggaaaaaatgaaaaacatttagaaatatttattggcacacaaaaatatacttcggagataaatgaacaaatttttcacaaaatatatgaccgaaaaattttgcaaaattcttaatttaaacaactttctggccttttttcccgtttttagcacatattttggcacttttttttcgtttttagtgtatattttaagggtttttaggcgcttgtaatgtatgtgtatttcgggatttttaaatatgatccctgatattttcccaaaaatttagcctccagaattataaacacaaaatttgtgtgttggctttttgtataattttacaattttaaatgtccacctatgccccttttgcctaatgccatttcttccccgtttttttctcttcttctcttttcccatttgcattttctatttttgaaatggccctttttaggggggggggggggtaatttgaggggtacacccgccaaaaatggggtacataaaatcggatgggtaattcaaataaaaacagaaaaaaaacaccaacgaatttgccaatgtattcattacacgaccaacacaaccacacaagacattttcacgtcccactacgacgggggc

SEQ ID NO: 7330 - DNA, 987 bp, Heterodera glycines
  misc_feature (51)..(51): n is a, c, g, or t
gagatcgtggatgatcgaatactgatcagtagcgaatgatcagtagtgacnagatgaaaattttcgtggaatcgaacagtctttggaaaaatcatttattcatttccaattcttttacacagataaatttgatgatttaaaacatttttgactcatcttcattatttggtcaataatttaaaatcacataattaaaagatcttaaaatgactttcggtgagaaatgaaaatttcttgaattgagtatcggaaacatcggacctcaaaaaaaattcttacaactaattccggcttcaggaaatcgctaaatttatcctcataataacaaagacaaatccaattattattttaaaatatcctaattcaaaagattaaaattcttttttagtaatgctttggatgcgaaatgaaaaaattcttaaatcgagagattgagaccgagaatttctcaaaaaaaaatttttaaatggataaaattttttaaaaataatttgaaaatatttttcatattaaatataaattattggatttttccaatatttgtagaaatgatttgccaatcacatgccctccttcaattaacgttttcatcttccaaaattttcgcccattatcgtttcaacatgcacttgaatattttaataagcataagcaatcttcaaacatttattagggcatttaaagaaatttatcaaattaaaaaaaataataatttattcgacataaaaagttttatgctttttttgaagcctataattaaatttgttatttaataagcactttaaattaatataatatatctgaacacattaattcttctcggaatttaaaatttcattacaaaaattacttttaacttttcttttaacctttggccttttaagataaaataaattgaatttcacatagagcaaaaaattgtgcattttcaaccattaggaaattcaattaatttctcgccatgatcaaatttaattgttagcctaa

SEQ ID NO: 7331 - DNA, 3777 bp, Heterodera glycines
tgacggtgataattggcagtgattgcaattggagccaaatcggtgggggagtacggattgtcgggttcgatcaaagcgactgaaaatggagaagagattaagaaggaacgaaggaccggtcaccagtgtaaacgattgcttcttccttcgtcagattggaaagcacaaaatgaacggcggagaaactgacgcggggcccggcttggaaatggacggacgaattctgaaatggcatggcaaatcaatcattggcattggcatgggaaaggaagaaccaaaatttggacgaggtgcggatgggaggtgaaccccgtgaagagaccgtgctcaatttgaagcgagcggatcagttgagaatgagttcttaattggcttgttatgaaatgccatttatttaagatataataatgaattaatttgtaacactcaatgagttacagtatcacgcaatgatctaccataacagaattcaatgtgttactgtactcacttgattgtgaccgtctgctgaatgaaattggtctgcgttctcaactgcacaaggtcaagagtgaccggctcagcatcgcttggttctcttctcgaccgacgccttttttccacgaggacacgcactccgagaagaagccttaaaaggaagaaagatttgcttaagcttcgtccacccatcaatcagctcaccttgcatcgcctttggtctcaatttgcattcggctcgccgacggagtgacactcagtgaaaagggcaattcgttctcattgaattgccgtgacaacgaaggcgcggatggaatcgaaaaattgccctgaagcaatcaatgcacgggactattattattattggcactcacttggacagagccgagaagtgccaaccgaacgtggcgagcggcgttcactgaagcgaattggaaaagggcgcgggaggcgaagaaagtgtcctttaacgaatgaatgggcgacaaattggaccatttgtcctaatgggccgaccaatgcgttttcgtattgccttcggctgtcctgctgttcgaccaaccaattgctcagcgcttcgaagtcgaattcgttcttccaataacggtacactgaatgctcgcgagtgtaagcgagcagagccaaagcattggccaacacattcgaactcttacaattagttaatggacattaattgaccatttgctgaccaaaacgtactttatgaagactttgctccaaaaggccatcagtcggccctttctttgcaaatccctcaacaaatccccaaagggcgctttgtcgtctcgcaaagtcgaagtggcaagccgagagcgcatgatggaactgtaagggacggaggatcacaacaacaaatgaaagggaggacaaaccgagtggcggcggtggacatataagccaaggcggcgatcagacggacgtcgtatcgcttgtcgagatccacagaccggtagaaggaggagtggagatgcttccacgactccttcgcaaacggggactaccgctcaattgcatttcgctgattggcctaattggctgaaaaggcttactgctgcacacgcataagcagaacagtccatgaccgtttggacaaaaagagtctcgaggaaaagcctttgttcggagggatcattctgagcaaaatccgtcataagggcatgggacgggtgcaaccaacaaattgggcgtgcattccgccgcccatggcgccgaattgcgtctccgtccctttgccaccgtccgtcccattcagcacagaatgaacttcgcgagccaaaaaagcgatgggcccacaaaccgaaaaagggagaaaagaaaagcacagtttgaaaggaaaagcgtaaaacgaacaaattcctcagacgctctttgctcacaaagcagcgaagtggccaaagtggtcaaactgaagccaaatgagccaattcatttgttaattgccatttctttccctcaattagtgctcacattaaattgcgttccgatttttcttttggccttccaaattcgccaaaagcgcattctctgagccgaaattcgcagtcagaaaaggtcaacaattcggcgagcactgtcattatttccaattgttttttcgctcctttgttttgcttacaattgcccagaagctgctccctctgttccgtccattcaatgctttccgtcgttggcttttcctccccctcccctctctctccgtcgcccaccccaaccgtcatcatcgtcctcaacgatttcagttcgtaagtgagcaacgcgagctccttgagcaggttgggcagactgtacccctgaaggggtcgttctgatgggtcgggaatttgtccgcgacgcttttgtcggtattctgagaaagaatttttagggggggggggtggatcagcttctacctttttccactgttcccgaacttcgtacagccctctcgcttctctcctccccattaaatgtgtttagaggggatcggttgcgcactctttggaggggggcgcttccccgcgggtcgagcggagaagcgacgctcaaaagttcggtgctgagagcgggcggaaaacttggcacaaattctgccaaaattgctctttaagcccatttaaccacaattaattaataaattaattacccagcaataaactcacttgaaaactccactcccaaattgtacaccttccgtcctcccgcatttatcaacactttcgtctgcaccggttctgctgccacagtattccgctgttgatcagtacggtcaggcaaaaatggctgcagcatactgtaactgataacgtcgggagaagaagtaagcagagaagaacgaggcgagggggcagcagtggttgtggttggtctgagaacggacagaaaatgaacagcttaagccgaatgcttaactggtccgatgggtcgagtatttgctcaagagtcagctcctgcccccgggcgccctccccgtggcgttgccctttctccccttcctccctttcttccgcttcgtccgtctcttcttcctccgcccttttccttttgtacacgacaatttgccggaagtgttcctccacgtcgacccttctctgaattccatttcaaatcataattatttgcaaatattttgcctctgctcactttgacttggatttgcttcacaattcggtcgaacacttcagtctcgctgtctctgcagtgccaatcgtgccccttaagcacgtcttccgagcgcaattcaaatgacaaattgtgcattccgtgacgcagaaaacggacaaaactggaaaagatttgagtggatgatcggaaaacacagaaatttgttatgaattacaaatttttcagttggactgggttctcgggggtcaaaaccacgcgagtgaagtcagtttcgccaaaagtgccttaaagatacaaaaaggcaataaataataaagggataaattgtaaataattaagtaattaattatttaccctcgcggccaacatcaccacaaacttttggagaaaggccgtgaaaacaaacggataacttcaaaaaggggggggggatttgtggagggtaaatgaatttggcatcgtacggggcgattttgggtcaaattggcagcagagaccgcaatgtgaacattcacactttcgttcacataaacgtgtagaggcacctccacatccatgaacactgcgatcaaaaagcaagcttaaaatgaccgcggggcattttaccattcttttgggtaattagcgattggctcggaaaatgacaaacgccggagcgacccgcagaccaaaaagtgg

SEQ ID NO: 7332 - DNA, 2319 bp, Heterodera glycines
atgccattcggtgatcgaatggggcgtcgaattcaaattcaattcctttgacccgtccatgcttaacattcaatctatcaattaacaaatggaggaaatgccagcagaggatcaacccaatgttgaagtcgttaaacagccaaacttccgggaaaaaatctctgacgccaatttcggtgccctcctccccatttttcggttgctcgtcttttccccccttcgatcgaagtgctttcacatcttttaaatggtcaattagcaaagttaaacttccgcttaaatgccttccattccgctgggcgtcgttttcaaaggcggacgtcggataagccattggacattccctgctgcaaaagtggaagaagacagcacttcaaattcataagaaagtgccgacccattttgatcggcgcctccgccggtgcgtttccccccaggggcttttccgtcagagtctccgccgttccctttgcgttttgttggcgttcgcattgttcctaaatatcgttcattttgctttttctttcctcctccccccccccaaaagtcactttcatttccctgtaacaatcctccgatattcgggacgacattcgccccattcggccgttctcagtttgagggcactgtgggttcaatttccctgccatccgacagatttcttctgccaattgaattttccaagcttaaaatgactgatttcttaacagacttcgccttgctaatattcccggaacatcgaccagattggaaaacagtgaaacactttcagcgttttgctcgtccggctcgggactcaaaaactcggcgaaactccaaagttggtcagtccgggaagagtcgccattgtccgacaaaagaccgtccaaacggctgtcttaaaaattatgaatttaaatttggtaaaatggtgaaccgtaagcgtggagaagagccaaggagttggggcgagcccgcaaaaggacagacaaaggcgcaccgacggagacattgtgagaagaaagcgtaagggaatattgctggaggggaggggtaattagtagaaattaataaatggaaatgtgttgctggaggatttcattcatcatgaaatcctcaatcagatctgtttctgatccatcggtccgcaccacttgaaaatcaacaaaatccatcaaaatctccctccccccttcccgcaaagggatgacggacggcggaacgacagcaccgatcgattgattgacccatccgtacaaaactttcagttaaagtcccccgaattctcatttaagagacacaaaatgacacaaatatccccattgattttcttttgcttttttctgcttgaccattacaaaggcatcattggtaattatggctaaatgagtaatcaatcggccgttggactcattaattttccagcagactccgcctcttccatttacggtggcatccccgtgccgggtcggcgtgtgtcggccattagaatgtttcaacttttcctcaacacgtgtcggtcatcgcccactcttgagaaactttctaaggcattcgaaacccaagaaattttcattcctaaaatatcgtaattagctaattcaaaatgtcaatgcggaccaaattgccgaaaagttgcaacggaatttatactttgctgtggacgatttgaatgttaacgctttaatgggcaaatggcatacggtaatatgattacagtaaacagtcaaaactgtagaaatttacaggtgatttattcgcctcttgttcagcccgattactgtgcgataagctactgtaagtcaatcagaggctattcaattttcagtcccaaattgaccagacgaattgctcgaccaaagcatctattcgtcaatcttcacaacagtgcaatactcgctcaaggcaagtgattcaaccacaaatttggcccacgggacaggccaaaaatacgggcccgagccggggagtttgctcattgtgacgggccgaacgaatgaaccgtgtccatgtgagaatgagggacagcaattagcactaattgatgtctttagactttccggtaaaggtcggcccaattgacaagcgcaacggacaatacgcttatttggtgctcacccaggcactgaaacagccgacgacggtgttggccagggacccaaaagagtaagtcaaagtgggcccgaccccagcaaaggtgccttctgcacctgcagattcgacgaactgttccgggaggaagtggtcgattatctgcgcaagttttggctattggcaaaatgcgctaatgggcagcgaataaagagtccaatggacaaaatgtgacaagacatcgccatt

SEQ ID NO: 7333 - DNA, 2072 bp, Heterodera glycines
tgtcataaaaatttttacaagaaaaattaatttttttgccccgcattcttatgaaatttgaaataaaatgtcttctttagtcacaaaagtcggcatttgtccatgaattatgtaagggtaaaacattttttgtttgcaaaatttcagtactggtgagggttccaaaaattgaaaattttgcggttttttgaaaagtgaattttatttattttgaaaagaatattattattttaaagggatttggattttaattaaataccatcaatattttgtgtccactttcaccaaaaatttccttttttaattttctttgatcctgcctaatgatcattcattaaaatcattaacccctcccccaatcatttccccgttttcacttttttatttggcattttccccggtgccatcattcgtcaacttcggcgattatttgtaatcattccgcaacactcacttttttatcaatttacctttttctgctgctactggtttcattttacatttgtccagagcccgcaacatttaattggtgcgttttaaattgattaattacccccccccccctcctccaccgatcatttacatcattagcggtaattgatcgttggttaatcgcctcttccccacccatttcatggccttggcatttttcgtcgataacatcgcctcctctccaaattttctaatacttatgtcattcgattaaattctgtctgtctcctcactttccctggagaaaaatcaaatttattttttatcaaagcactaattttttttaaattttcaatatttataatacttaataattttgattttgtaaattagtcaatgacacatacaaaaaggaaaaaaaataaatgaagactatttttttaaaattttaatccctgtgaaaattacctttaaaattttttaaattttgaatgatgtccaaaggcaccgcttggaatgaaattaaattttcaatattgaagaaaaatttattttttaatgtgatgtaaaataagcatttttgcctttgtctttctttcctgagctccctcgccccccgccgacggtggcggtcaactgaatttaagaagccataatttttccatttgacagttaaccaaatttataagttgggtatcactcaaaaactctaaatttttaagaagctatgttatgctattgttacactattaaacaacacttataaaaaggtttcaacatgaattcgcaaaaaaaagttagattttttgcgtattttcattcattagtgacttctttgtcggtaaatctgtttgatttattgaatactaataagagcttattaagagctttcgaatgagccaattttatacaatttgggaaaaaagtatggcttttgaacttgcttagacacagttggcgggacgcatttgccgctccgcgccccgccgaggggttctttttatatatactcgccccgtcgtggaggatgagcggcgcgggacagtgcggggtgaggggggggggggggagattagcacatcagctccgcgggactgccccgaaaacaaaaataaatcgattttttcaagtgtccgtttggggtactctgacaattatggggagcaaaaatccaacgcagaattaaagtacaggctatagtgaagctattccggaaggattcggtctccccataaatctgggcgcatcggttcagggggactgccccgacaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttacaaattatattcatctcccttattgatagaaaaagcatcagagtgcctaaactaacatgtaaataaaatttggagcgtttcagaaccctttctgaaaaatatttaagaattaattttgcaaaaaataaataaaaaacgacagactcagattttcgaaaaatttttttagagcaagctagctcggcgct

SEQ ID NO: 7334 - DNA, 3225 bp, Heterodera glycines
  misc_feature (11)..(11): n is a, c, g, or t
aaaacctaaantccgggttacacccctagggtatgtatgtatgtgtacagtaaaaatagtagtatttcttgtaaattctagggttccatcattacattacacaaaactctgctgttgtacaatgtatacagtagttgcgcatatactgtactttatatcttgatagtgtatatagaaatacagtacattcatagttttcaacagattgcatcttcttttgtatttctgttttgctgttggattttgttattttgttgtcgtccttcacctgcttccccacatttttaccctttcagcaccgtttcaatcatttgcatttgtttctcacatctcacacttcgccaactcattccacatttttttctcaatgattcatttttgaaattgcttactattcattaagaaaattatttaattaattaaatttaaattttagaaaatttatttattttcctttttccacgggtttccatattaaatgctgcttcttttgtcgtcttcaccgttctgatcagttgcgcaatgcttctttgatcgctttttatcggctgaaatccttcccatacttaacattcaaatcactcccaacctcaatttgatcacttttgctgatcaacaatttcccaactgatcagttttcgtgccgctgatcaaaaaatggcgtcctcaaacggtccctccttcgccacctctgcttcacaaaatgccgttcaaaatgcatcgaaaagcggcacatcctctggaagcggctggcatcaccaaaatcaaaatcgtccagtttctgttgtcactaatgtgtcgcgcttcaccacttttgtttatgctcctccaacaccggcaacaacagcggcggtgccgagaagcaattctcagatgacatcatcatcacaatcggtagcactaagcccttgaatgagcctaaaaatctgatcaagtcttccgctgatcaggctctctgatcttcttaattttcattttctccctttttcccactttatctaactacacgtatctttgtctcctcattgtctcacactctctctatctctctctccctctctctcgctatcttaaactctctctcattttctctctctctctcgctccctctctctctctcgctccctctctctctctctctcactctctcacactctctctatctctctctcattttctctccctctctctttctcgctccctctctctctctctcgcactctctatctctctctcattttctccccctctctctctctctcattttttccctctctctctctctctctcactctctcacactctatctctctctcattttctccctctctccctctctctttctcgctccctctctctctctcgcactctctctctctctctcattttttccctctctctctcgcttttctccctctctctctctctctctcgctctctctcgctctctctcaattcttccactttcaagagatcgcattatcaatggtctgaaagaaatccaattcgatacgaaacacagtgccaaaaaaaaattgaagctaagaccgagaatgaaatgttttattcaagttataaagaaatatgaaaatgtaaaagtgcctaaaaagagaagaaatgtaacgaagcgaaattttgattagtcgtaagcatcattgaattttcgcgaattaggtttatccttggcacaaattctcgaaggcgaaaaaaaacaccgtattttttgtcaactaaaatgaagataattgtaatcttatatacacacatatgtgatctcttctttctgttcctatcggcaaaactgattatcacttgtatatctatcatggaccagcagcaaatctcagcagatcagatttatatcagttaatcaaacgctttttgctgctgatatcatctcgtctctcctcattcctccccctcctttccctctttctctctcgcattttctttttgtctaactttctgctaaacaagattttggtcgaaattctgactgatctggcactctttgatcacaccttattctgtttatcaccctgatcactcttttgtcagagtactaatggttgtatctcaccgcccactgtctcatcgccgtctttctcttcctcctcattgcgcaaaaattatgagaatggcacttctgctggtggaggtggtgccgcacaaccggcgccgagccttcaccatcaccaacggcaccattcctaccagcaacaacagcagcagtacggtgatgcggcggaaacggaatgtttggagcattatgagagcaatttggagaagtacaaaggtatttatcatccatctgttgcattttggagaagcgaagtatataatgtggagattatgtgcctaaaggcttaattagccttaattaacggaggttgaattaacggataatcctaattcatgttaattatggtcgaattgctaaatggtcaaaggaatactaatttaattgcgttgttaaatggggcgctgagtcattcatccctttggagcctgttaaatttgcaaacgatttagcatatgaattttcggtaaaaatggttgatcaaatgccatcaactaaaaatatttgggtaaatagcgatgagttaattgcattaattaactgtaataaatatgcctccactaaacatggactttattgtcgttaaaacattattacgatgctatctacagtccaagttccaagtcggattttgaattctggcaaaatattatttgcaaataaaacattagcaattgttgaatttggcattcggtccctttaaagcgaggaatatttgcggcataaatcttcatcatcccatgtaccattttagatgaacgtgatacgatccagaagaaaacgttcacaaaatgggtcaaccaacatctgatcaaggtagggagagttcgagacttggggacagcaattccggcttattttgacatttggaagtgcctaaaatattcgatagggaattcttgatctcactcaactcggaaaatgtcccgactttccggttctaacacgggtcatgaccctaattccctagtccgacatacatttccgaattttttttctatttgaacggcccttcaacaaaataggacttttcgtgctattgttctttattagttaaagaaagtgccaagtatggtgtgaccaaaatgccaaaaattaaatacaaccgacaaattaaatccataaaatttaaattacctaaactg

SEQ ID NO: 7335 - DNA, 2055 bp, Heterodera glycines
cacatcaaacgtcttccgcttcagacattgacagaacggtagaaaatcatttaattagcttcatttatttaattatattttttaattctttctggtggggggtgtcttttttttcaatttcattaattattataagtttattcttttttttcccttcattaaattccatctctccttttcatctttttcctttttcacttttctctctttccctctctctctctctttctcttctctctctctctctctcgctctctctgtctctccgaaaatgcacaagctgtccaattaattaacaaattaattaattaactaatgaattattcttttgcgctccgcaatttctcgcctccaaaatgtcccacacaattagtattttccctccgcccaaattattgtttacattttattttgttttctttctcaccttttttcttctttcattcttcttgggtgtttcagaaccaccagttcagtcctttactcattttttaaattacaaaaaatttcgttaaatttttccgatcaatttttgtgatgaatattgctaaaaaatatggccaaaattctcaaattttttcccggcggcacccgcctatcggcactgttagaccctataattcttaattttctttaaaaagaaatttatcggcaccgccggcaccccccggttccacaaagtttgttttgaaattaggcctaggttttttctgggtcgagactaatcttaccaaaatcccgaaaaccagtgcaaaacccatactgggtgttttattgaagctcagatgttaagacagctcgtacaaaatttttgcacttgactcgaaattcgaagatttttcaaacaatatttaatatgatattccaattttttacaaaatattcttatctttttcttttaattcgttaatgccaaaatttggcaaccaaattgatgattcacaagaaactcagaaaacccaaaaaaatttcggcgctgaaatggccgggaccgaagtgtcccgtgttggtctgtcctactgtctcccatctaccaactctctgctgctgcagtccgtcccattgcctcaatcattcgatcatttgtccgctccattttcagccccccccctttattaaaccgtcacattccccggccgcaaaaatttcacacaatttttgcccggtccccatggtcgtggtcgccttcttttgtcgtccaattgtacacccaacagaaaatgggggaaaaagtgacaatttacacacatacacaattcatacaaaacattccattcctttcccccgggggcgggagaggtccaattcctcaattccttttgaatttttgtggggacaccaaaacaccaatcacagcaaaaatggacaaaaataatacaataggggtgagaaaaggaaaaagaaagtaaaggaatggaagaatgaaagaagaaaggatggttgtgattggtcggcgctttggttcgaaaaaataattaatttatttttcttttccgccccccaccctcgggcgtctcattaccccccccccccttccccctattagcggccatttcaaagggagccgaaaaatgggaattgggccgacaccgaccgatcagcaacagatagaagagaataaatagaccggggaaggtaatggcgatcattgcaataaaagtggaactgtctgatttaaagggaatgcgggagagaatgaaatacactaatttgatgccactaattcgtggccgtgactcattggctgctaaacgttggagtgggtaattaagtacccaattgcatttacttggacatttgtcgccttaattctaaaggaaattttgggtttcttttcgcagttggatcaaagcaataacaaaaaatttaaccgtgaatcggtctcgagccgagaaaattttcgggctttttgtttatcactcccggcccttggcagtttattgtcgactaaaagaatttttgggtcaatatttgtttggcatatacagcctttgcattttccacgcttggaccatatcaaaatcgctaaaccccagtgattgtgatttgtccgac

SEQ ID NO: 7336 - DNA, 669 bp, Heterodera glycines
tcgtcccctcgggggaggggcggggggggcatcgactggaagaaagggacagcggcaggaaaagacgaagaccgaccgaatgaatgattggacggatgaatgattttctgattttcctctcttcccccaccccaattcttccgttttcttccgtccaaaaagaactgcctcctcccccctttcccttcctccccttaaatgttgccggttctccctcctgctctccccccatcctctttttccgctttccgatcaatccgacaaccgtcctccttttaccaattgcctaccccccccccctcctccctccgtttctctattttctccacccattcatccctgatgttgctagtcccgcacccccactctctctcttatgcccccccccccctttatgccatgggttcctctcgcgcgcttttcccctccattatcccattttccgatcaccatcgttcctcaatcttcctcatccccattcccactaaaatgtcaaatcacgtaatgtcctccgccacattttgccgggtcttttccaattttctcaatgagatttctcctccccctctccccaaatttccccaatgccaatgccttcatcctcttcttcatactcctcctcctcctatttttttcacccatcaaccctatctcaccccccaattttgt

SEQ ID NO: 7337 - DNA, 3372 bp, Heterodera glycines
caaatggaaagtgtcgtcctcccccaccttctctcgttcatcatcgctttgatgaacaaaaccgtcgcatggccaatcgaatgataaaacgattcgtcggcgtgtgccgccattcggcgttcggccgccaaaaaatggttgccaagaaaaagacggaccgccgcatccgtctcccggacagacattgacaaattcattatacggaggcgcgaaaatcagtcactgatcagaagtgatcagagcggtgggggagaagaaatctattgagaaaagcaaattaaaaagtaattaatttgtagtttaagggcattttgtagctttctttctttgtgttttgccttcccttctctgttaaaatgataaataatattccgattaaaaacacacaaagcctaattaattcatgtaatgattgatagcgaaagcaaagtgaccaccgaatgggtgacagatggatttcgatttcaaatcagtgaatggtgggcggatgggggggattaaagtgcaaattctgtcattccataaaagtattgctgatcagcagaactatatctaaaaacatagtgattcatccgatccgccagacaaaaaattgctttggcatttgtgaaaggcacccgcaaaatgccattggcactgctgcggttggcatagcagccaaaggcaaaaaggaagcggcggaaagcgaacgacaaaagggaaagggtcaattaatacgtaattgatatgccaacgaaacaccaaaattaattaaggttgtttttgtaatttgccaattcgatggaattttctatttttatgaataaaataaaaattgaaatcaatgaaagcatcgtaattcgaatagaaagcattaatcatacggaaaaaaattatacaataaatgatttttttttaatttcggtcataaattatttgccaataaaatcaaatttattattttaatggagaccggtaaagatttatatttaatttccaaagaatactttactcccgcatttgttagagaatttgcgggacaaaatcccgtggggaatcccttcttatagtatccttatttaaagaaagcaaataacattaaaaatcatttaattcatcgcctataatgtaaaatatgacaaaagtgttcagactgctaaaacattgagtgatcggaaacattcgataagagaaacgatcggtttgctaaggaaaaagaagatggaagggatggcctaagaaaagaaaattctaagataaattaaaattaatacaataattggccctacataagtttaaagggttagaagaacaatgaaatgaataggcacaacatcattttgaaaagggtgggggaaacaaactctaagaaattgaaaatacgttgagacgacggcttaatgaataacaatttaatttattgtaagtacagtatgctctatacgagtatacggtaatacaataacggacagtaagaaaaacgagtgatgaaagctaagccggagttttcgcgccaacaaatttcagaaaactaaagtccacacagtgccaaccaaaggactttcgtctcccgaaatgtctaacgccaagactctcgaaacttggcaaagtgccgaatatttctgacaatttaatcattgggtggggcgggcgattgattgaggttcggagattcgaacggaacgaaaaggccgaggaaaaggggacagacagacactgctctaaatggcgagaaaggcaccacaaagcaacgagaaatgaggaggaaacgaccaagctaagaaaaaggacaaaagcggggagaggcaaatatttagtgaaagggttagccctttaaggaccattaaaagtaggcgaaatggatatgtgcttattttatgtacacagaaaagcgctgcgagacaataaattaaaatgcaaaaatccggtaaatttaaaaagtaaaataaaacaaatcaatcagagggaagggatagcgcggatatgccttctctttctatgcatgaaaccaaaagatgacgacaacaaatgatcagagaaattcattgtttattctctatgcaagacgagggaatgaatggaatgattgtgtgaccgttggagggttacaaataaataagataatctaaacgcactgctcttgtggaatgggtagcatctaacagaaaacaacaaaataaatgggaaggttggttggttggtgacggaagcacactgattgtgagaacgatgaaaatgatacgaatatgcgcaatggttcagagatggaaatgccggggcatttttgccaaaaaacggaaacaccatccccggagggtacatctctaacaactacgcatatttgaacaaataactatttgaaggaggggggggaaacacacatctaaaactgaaaagcctaaaaaaggggcagagaaaaccaaagttccacacattcaatgggggcatttcttttgcatctgatcagaagaaacttctcagggatatgcccatgggttagtgctgtccatcagcggctgctgcagcggatgggccgatgagatgtcgttgactttgccataataccacggatctttgacgccataatggtcaatggacggcacaatgggcgtaaacagcggcgagtcagcggtgagcggctgttgtgccagcggggtgaaaaagcggttgttggaggacaagtccgagttgtacaacaacgattgttgctgggcggttggctgcggcaaaatgtcggagatgaatttgtccacgttgaactggtagggcacgtcccctgtgtctgtcatgctccccttcttgcggtcgtcgttattgttgttcccaaaattctgttggtcgtcacgaaggatttcgcccggactgatcggctcatatgcggcagacaatccgttgggaatgttcccgttgttgatcacagaaattggctttgggcatgagagtctgaaaggaacaaattaatttaaatggaagagaaaatctttctgcgcacaacgcacttcaatgtgttcggtcgctttttactaccattgcccaaatgattggcttcgcttccaatgggcgcaattttgcgctgtttctcgacgttcgccatgtactcgtccaacatgccgtactcgtccgcatcgtcctcctcgatggaggacacagacgccgccgtcgttgtccccgtgctcagagtaaaaggcggcatcacaactgactgtttctcgtttttggcttcggtcatcgtttgttcattctgttgcaggttggcaatgctcaacggaatcacttcactgcccgcctcgtcgccactccaataaaattcgaaaggctcctcaaacgatccaatggaaagtgccgtgtctaggggagcgcggtgatagtcgtattgccgttagttgtggtgaa

SEQ ID NO: 7338 - DNA, 3419 bp, Heterodera glycines
ccgcagaggcgccggattgaggctgacgacgtttcctcttttcagatgaagccatttcgtaatagaaaccatccgtagtctggtcgtagtatctaaatggcaaatgtataactaattatacgaccaaatgtttcattcacttgaaattggccgaattcggcgaaagcaaatgctcatgtggcaaatgttgcgcggaaaatttgtttaattgctgcggtgccaacaaagacggcacagcgacgcacgaagtgccagacgttttcgcctccaatgctttctgtttctgctaaacaacgcaaaataaatcagcaattaattgaggcttaagtaatgttctaccagaagatgctgctggatcagcaccatctgttgctgctccgtcactctcttcggactgtgctccaccccggtcattcccttcatttgttccactgtgccccattccgggcgccgtttgcgccacccgcgcgtgccgttgtgttcgtagtaaaacccgtcactgacttcgtcataatacctgaaagggtatatatgtttgaattcgcgacaacttaatgaattcacggcttattgttagcataatttgtctttcattgttaccaatagtcttcctttccaccgtttggcccttttccatttcgctgttgtggagtcactgatgtcgtcgattgttttaccgaatcatttgcagaatttgaagcagtcactgaagtaaaatgaacataaaaaattagtacatataaaaatttataacaaattgtcaatggcacttgccaggttggctgccgtttgactgtgccgacgttgttccggttgtctttttactgccagtatttgttgaggacgaattggcacggggcctgtggcagttcgaatttatgacgggctgcttctgttgctgcaaatgttttttgctgcttttggcactgttctgctgctgctcgtccgtcattttcaccgacggtttcgagcagttcatcgtcgtcgttgtatctgccaaactgcccctacggcgattctgttgttgtaagattccgactcggttctgcggtgccatttgcccgttgcaagttgatgaaatatctgaaaatgccaagttagcatttgtaaaagtaggtaagaaaaatgcaattaagcaaaaaaaaattgaaagcatctctttttgaaggcaaaaaaaaacacagcacaaaaatggtatcggagtcggaaatgcatttcctattttggattttggcttctctccaacccaaatgaaatgcgatagttgccaaaaatggagaagcattttatttgtaagagtggcttcgtttctaatttgcaagggaatgacgtcaaaatcattttaattgcgcaattcgattttttgttggcatttttatgccttgacgcaattattctttcctttttcattttgcagaaatatgtctgaaataaaattgccccgtgttttgttcatccaccgaatttcatttcatttattattattacatataatataacccagagaagggaacggaattggaacgaataatccctttttcttcccattcccacctacctccgccccccccccctcctcctcgcatgacattggaaggggaaaaaaaaggggggggggaaggaatgaagttaaaaagcaaaggcaggtgatgatgaggagaaaacgaaaaaacggaggaaaggaaaaatgggagaatgatgacatggcaatgccattgcccaaaacgacgcattagtgaaattcatagggccaaaaagagtttccttcttggattttggcgtggttaagctcaactatggaaaggaaatgtcaaaaaacaaccccaaaatgataaacagagggatgactgccaataatacaaaaacggagggacaatgacaatgaatttataaggaggaggggacacatttaatccgtaaaggacggaatgaatgactcactaaagtttaaggaacaaacagtgacgataatcatttcacattgtgaaattaaaaaatgaatagcaaaactgtaataaaagcggcacctttgacgatgaaagatgtaaatcaccagcagagaaagagagagatgacagagacagtaaagagagaaaaagagggaggagagagagagagaggagttgaagaggaacggaagacggagagaggaaagcaaaatagcgaattgcagcagaacatacgatgtgcgaatgatgcgaaatggtggtggtgaggagcgaagtgatgttagtcacccgacgaatggaacgaattcgccgccggaagaagtagggaagggaagggagtgactaatgcacccactcatcaatcacaccgagggagaggcatttttgagaaaaaagaggtggggaggaggaaaggaatggaggcaaaggtgctgactgactgactaaacggtgttcgctgtcattaccccactagaaaagaatttcgaaataactgcttgcaaatcagttaaaaaatactaattaagctatctaaagggctttcaaaaatgtttattttgtttgaaaaaatcggtttgacaagagataggaaatttgcaaaaacaataacaaaacagattttgttttaatcccaaattttggggaaaacaacaacaatttatcattaaagaggaaatctatctgtagagaaaaaaaccattttcttaaaaaggcttatgtttttgacttttcggagcaattaattaaataatcaattacaaggagtttaattccttcgcaaaatttctgatcaaaaaatggtgtccaatttgtcattttgtgtcatttgcccaatgagacaaaatgtgtacagagacaaggccatatgaacgacacgtggcaatgacaaattcgaagggaagaaaaaaaagaagcggaggagcagccaaatgttggccaaagtttgagtaaggccaatttcgcaagggaaccattggccaaaagtcaatgaacaactgaggaaagaacacacaaaaaagtgggaggaaatggtcaaacatggaaaacagtgaaatggaaaatgtctttctcagggctatcccaattggaccaaatccaaaaccatgttattattctattttccaacccatttttagcgaaaaaagcagacgattataaaaatggtgcatttttagattccgaaaataactttggaaatgcaattgccaaatggcacattcccatggaagcaaaaattacgacaaatcttaaaataaatatcagagttgttttaggggttttcagggtctgagaaactgattcagacatccgcttaggaccccgatcccggactcgaacaaaaagccgaaaattcaattttcttaacattctcatttatgcaataaaacctgatcatgtcaaggactactggcacggatagaactgagatgcaaccgaaaattataaaacacattatcaaagtcactaaag

SEQ ID NO: 7339 - DNA, 1050 bp, Heterodera glycines
agtataaaaattattgctcaaaagagccgcgatttgtattaggttaatgagttaatggattaatcaacgaactggagctttttaccattttggctgaatttatatttatgtcgactaaaaacgaatgatcgcacatttacatatttttatatggaaagcaattaaaattcgagagctttttatgaagacagaaaaagatatattaaattattgctaaatttttttgtcatatgattagagggggcgggggggggggggagggtgattaagcgaaaaaagaatgggaaatatgggccacgagaaatgactgaataatgagaatgaatgaattgaatcggtatatttttggacgcatgcaacaagtccaagaaacacactgcgaagaaagggacatttgcctctgcttacaaattaaaaagtcaaataatattcaaatatttatgtaagccctgacaaatgaggcttaagctgtctggtagagatcgacctggacctggatccaggcctggatccaaactttttcagtctttggtgttttgttagtaaagccatttgaaatgacgtttgatagcgcttggcatcttttctgttcattattttgttaggtgagcaaagagcagagtcatttcaaaacaaaacaaataaattggcaaagcaaaagtatttccaatggacgagaatcagaaatgatctgatttttatagacgaaaagtctcaatagaaaaagcatgagattctcaaaaccatggaaaggtgggcaaacgaaaaactcacaattgtacataatatgtatgtgccttttcaatttaattgaattgtgggcgaatgttggttcagattttaaattaatatagcctaattggggaaaagcactcagtaaactcaattttcgagaggtgttaaagcatcacatccttagcgacattaggcacaactgaacaaacaacaaaatccgatgaactttcagcgatgttgcctttgcttatttaaaaatcgcgaggacataaaaaattttacgtacctatttcgtgttgattagttggaaaaatt

SEQ ID NO: 7340 - DNA, 1650 bp, Heterodera glycines
  misc_feature (649)..(649): n is a, c, g, or t
  misc_feature (1595)..(1595): n is a, c, g, or t
  misc_feature (1625)..(1626): n is a, c, g, or t
ggggatctctagagcttagagattttctgaaaaaaatatttatgaattacctccaccaaaataaataaaaatttctaaaaatttgatcgtccaccttaatttgtaattgatcaggggctcaccaaattttgcagggatacgtaacggaacactacaaatgcttactaattttcctagattttttaaacccggtgaaaattttttgcagacaccaccattttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctcccaatttgatagaaaaagcatcagagtgcctaaactaacatgtaaataaaatttggtgcgtttcagaaccctttctgaaaaaaatatttataaattaattatgcaaaaaacaaataaataatgaactctcttccttaataattttcctgcaccgaaggtactcactcggccgcttcgcggcctcgggtgntgcccttccccccacactggaattgttgttgctgctgctcatcggtgccaccaaacgaactgacctaaaaatgaaaggtaaaaaggcataattataggcaaaacggtatttatataaatggcgggtacttatacagtttgacccacataaaacatttcgcttccatggtgaacaactgtatatcttggtttattttttttttttgattccgcttcttcttaaaacaacaaaatcactaaaggcttatatcttatgacaatttttaaataaaacgcaaaaaaactaaaaattaaaaaaaatatttttaaaatctgtcgacgaaaacattttatttttaagtaaatttactaaaattaagccactgggtgcttgatttttcagcccctttctaaatgagagctttatttaagagagtgggtctaatttaggggggggggggctatattatagaaaataaattgagtaaaaataaaaaatgtttgcaaaaagattagcttttaaaagggacgatattttgagatttttaaaatccacatataatcaaaacaaattatcaatgactgagatttgtcatttatgtatgtgccattgaagtctcactctaaaaaatccttgcaatttctgttcggaagcggcggatccaaaatttggggtggccttgtcggcacatttccatccggtgggcatcggttacatgtccacgggcattgccaactcattaagttaaaatacaactaaaaaattcaaattttcttcaattgaatttctatgagcttgtcgattctcattttttacatattaattaataaattacattctaattatttttgtttttaaaataaaacatttaattttctattattttcttaagaatttgtattttatttaatttgaattattatcaatttatataataaatgaataattttcactaattatattttantgctaatctaataaattcactattattatnntgaattttttatttaaatgagtca

SEQ ID NO: 7341 - DNA, 2817 bp, Heterodera glycines
  misc_feature (2798)..(2798): n is a, c, g, or t
cgtatccgtatacggatttttacagatccgtagtccgtaatccgtatttttttgggccgatacggatttttacggagtacggattttccggatttttagtccgtaatccgtatgtgtgcctagtccgtagtccggatcctgatccgtacaattttttgatacggattacggattttttaaactgaacttttgttgaatattttttttgaattttcattatatttcgccaagttttgataataaatttgaatttgataactctttttctcaattcttaacttattttcaacaattaatgaattttttgtttgatctttgaaaaactgaatttagcaaagatgagttcaattatttggcaaattgggttgtttaacaaattgcctaacgggaaagctgaatgtgttgagtgcaaggctaaccaactgcaaaaatttgagtttgaacggagccatggcagcctcaaatctttgattgtccatcttttttcaaagatccatgccaattcgacgtatgctgagaagtacagacaattggaaaaaacctcaaacaaggatgaatcccagaaaaaactctcaactttttttccatgttcaagcagtaatttaagaaatgaaatgactatttaaattttaaaataattttaggcactctcgctgtgatggacaaaaaagtggtcaattttttggtgtctaccaacacttcattcaaagtggtgaatcatccaacatttcaatcattgctcgcaccacaacatattaaagttcgttattcgttagtgtattaaaagaaataaagaaggcgtttatattaggaagaaacgcattatcgaacccaaattcttcctgaagtttataaacaagtcaaaaacaaaatcagagatgaactcaaagagtgtgaatcgatttcattcacgacggatgcgtggagtgggccaacaaacaatttcctatggtcagcataagaatgtaaaccttttaaagctgcattttagtttgactgctcatgggatcactcaaaattggacaatgaaaaatcatgtgttggcggtgactgaatttcagggaacacactcaggaaaagaaattgccaaattgttgtcaaaaatcatctcggactgggagatttgctccgcgaaaattcactgttttttgcgtgactctgcagccaatatgaaatcagtagtgttctattttttcatttgatatgttttgttttatttttaggcgttctcccagaccattgtggatgagaacggtttgacaacccaaattttggcatatgaaaatgtcagctgtggtgctcatttactcaatctcgtggtccaaaaaagtattaaatcagaaaggattgccgacctgcttaaacagtgtcgtaaagttgtcgcccatttcaaacactctaacaaagcattaggaatgttaaaggacatccaaatctttcttgatcttccggaccattcccttttacaagtaaatcaatataaatcttttgagccaaatgaccaaaatttaggaggtatcagtgaggtggaattcggctcttgggatgatttcgcgtctgtttgagcaacgggaagcgctgtaccagtacgccttcgaaaatcgtaattttgagatgacgttaacaaatgaagagtggggattaatcgaagaaatgatttctttgcttcaaccaatcgaagacgcatcaaagatgcttgtaaaagcaccattgtccggtgatttaaataaattaatttttaaagcccgaaacccagtttagcccaaataccaattgcactgacccttcatggaaaactttatactgccaaattaattaacaaagacattgatgtggtgcgttgttcattggttaatgagctcgagaaatatttttttgctctccgtgaaaaacggtataacattaatacacatttttcattttaaaactattatttaagagttcattgtttatcgacatttttggatttacgtttcaaggacaagtttttgctcgaaggacggaacatttttcttgctaaaatttcgtcatggctcaaagaggaacttgacgatttcatattgccattggttaatgaatgtgatgaaattgctttggctccgtcgcccaaaaaacagaagctttcgctttttgatgacctcaatgatattgcttcaacaagcaacaaggagaatgcaggcagttaaaaatttgagttttttaataaaaaaatcatttaagatccttcccagaattcatctgaccttgatgatgagctcaacaaatatttggccagtggttgtgtaaattcgcgcgaggatccgctgacagcttggcgacaaatggcacccaaattcccaattttgtcaaaaattgcgcgcaagtttctcactgcacctgccacgagtgtcccaagtgaagccacttttaaagtggcgagagacgtttacgattacagaaggtcgcagttgaagccagaaacagcggaaatgttaatctttttgaataaggcacttccaaatatcaattacagatattaaatttttcattatctcgcaattttatttttctactggtcaaaaaatgttatttaatatttgtaataaaattttgaacaaatctgtgttggtattacaggtacaagtatttttttattgattaaaaaaaattttcaaaaaatccttatccgtatacggatccgtattttttctggatacggatttttacggagtacggattttccggatttttagtccgtatgtccgtaatccgtatggatgcctagtccgtagtccggatccttatccgtattttcccanaaataccgctctctaattt

SEQ ID NO: 7342 - DNA, 1502 bp, Heterodera glycines
aaaaaatatcatagcaaattaggtaaatattcttcacctattagtcaaatttttccaatgatcaaaaatatataattcgaaaaatgaataattctaatttaaacttaaaataaaccgtttcagactttactttaaccggtaccgtactaaccggtattgcaaaaaccggtacaggtacgatcagtttaattaattgacgtaatattttctcaggcatgcttttttcaaaaaactatgaagaggaagactccagcggtgcctaataattactgagatgctattaattattggtcaatgacagaaggtgttaagattatcccgccaaactttcgtagtcctcctcgtcagtgatttccaattctattccatcagttggaattgaatgggatttgatgatgctttgggttggacgattaggatggggaggggggataggggggtcagcgttgacttacgattttccgccgccaattgtcgcctcctcgtgggcaattattctacaaaggatgaattggaccaggattgcggagaaatgattgaaaataagaaaatggacggaattctcctagttaaatgtctggtttatttggttgagtgatcacaaaattccggacagaaataaagggtgctgtgtcgaagtgtcaaaagtattgatgtgggcgaagtgtcaaaagtattgatgtggtgagcttcagagaagttgtagccaaaaatatttaaggaaccaatttttgaaatttacaagccacaacttctttgaaactcaaccaaatcgtttgaaattttacaggaaaatagaggacacttagggctatcaaatgataccatggatgcttaatttagatgcttgtaaaaaaagttggattgcattaaatttgtcaaattatttgatggtctcgtttttttgaagggtcgtgtatactaaaatagagccaaatatatttattattaaaagattgttattcaattataaatgaattaattaatttaattatttaaattaattttctgtactgaaatgacccgcctctttcgatcacccatcatcgatacttttgacacttcgactcaccacggtttttacgaaacgacctagcacgaattatttgtcctcacagatctgcagaatatttgagtgatcgttgtgttagtgatgttgttggggatggcactggcacttgcgctggtgatggatgtaaagatgaaagtgccaatggcccatcattggtcactgatttttggcagccgcgcaaacgctcgaccagcgaaatggtggacgaagaaaatcgaaatcggctcccatttggtgacgactgtggcacagtccgtgatggtggtcattgtgaccgtggcaccagtgaagttggtggtggttgttagtgatgctagagaccaaaaatttcccgggactcgagaccgagaccgaaaaccccgagatccaaaaaaacccgagacttttctcgagtcgagactcgagaccgagactctcgagcatcactagt

SEQ ID NO: 7343 - DNA, 2149 bp, Heterodera glycines
  misc_feature (2134)..(2134): n is a, c, g, or t
agttccttgccaatttggaacgctggctgcatcctctctagacgtcggtgcatacatggaacgggtgtctctaactgcgcatgcctttcttaagttggcttttcctatcggctcaatcattgccagctctctgcaaatttcaacaaaagtaaaattaaaaacccaaatttttgaaaaaggctattcaattaattttggaaaaattcccaaattagcggagctgtgatttcggttttataaagcgctagatagttaagtaaagaaatgaagaatatcagaatttaaaaatcgaagatatgttcagcctcgggcctttttttggttgtaaatatatttcattgcatggccggtaaatgcatcagtttaaaatgtacaataatccaattacagtatgttttgtttgttttctttacaaattttattataaaatgtacaataatccatttacagtatgttttgtttgttttgtttttttttacaaactttaatgacatttcatttattagttttttttgataaaaatgaatagacaaattcataaaaggaacttttatctaaaatttacactaaatgcctaaaaatattgtattattaccgcattttcacggacttttattgtgtctttattcctaattatcccttttagaaacaatcagatgagtacaaagcattggtaaatctgcgcgactcaatgcaaaaaaatcatgaaagcatcatgaaagcaatttcctttgctcaagaaatgattggaatggaaagaaaattggacgactataccaatgtaattatatcaaagttcacagtttttggcaaatattttttggctccggtcagacattagtttttcgtatttaagcgccatttatggcatgttctaatcgctaatttaaatatttttcttagagttacttttatatttgaaaaatcaattataaaaaacctcaatttttattgagttcttaaaaattatttgtcgttgagaatttaagataaataaatattaaatatttaaattccaatttaatttagaatgttcgtattccgattaaaaatctttttgtacacatgcgaaaattttgggacccgtcaactgacaaatcgccagaagctgttgaaattttttcaaaagcctgctacacgaccgaattggccaacacccctctgggcatactcaatgttgtaaattaagcagaaattaaaattaaatttgaaatttttccagtacattcatacccacactgtcgaaggttgcaaaatggggttgaaaccgaaccaaatctcgctcttgtccaaatttgtgcctttattacaaaaaattcgaatgaagcttggcgatcaaatggacaaagacgactttaatacacgcgtcccaggtaataggatgagcaaaaaaaggatttaagggaaggtgccaattaaagatcgcagtcttgatatattttctgatttcagtcaaagaattcttttttttagttctaacaagttggttcatggaaattgacacaaaggttgctcgaatggtgttgggaaaaatcaaaaaattaattggtaaaaacaaaaaaaattatatcataaatagggctggaaatttatgcaagaaaatttgcaaaaaatatgtacataaatatgtaaaaaaaagccaaaatatgtatcaatgtataaaaagccgaaatatttacgaaaatatgcaaataaattttttaatggttatttttttgaaaaaatttcttcctaaatggtaaaatatgcacaaaatgccaaaaattacctaaataggcttagactcacccaattttttaggggtacattttaaaaaatgtttttattttttcataataaattacccactataaattctcaaatcttgaaaaaattaataaaaaactgaaaaatgcaaaaatatatattataaaccatgctctagaagcgtgaggggggagagagaggcgccggggggcagaggaccccggtgtgtttagtcaatgctttcgcgccctgctgttcacttttatctgctgcgtttagaagagaaacaagtggtcgaacgggagcacttcccgtcgcaattgagggacagagcgagaggcgtcaagaaaatgatcggaatatgccttttcttccccaattttctctnatttttcaccttttt

SEQ ID NO: 7344 - DNA, 4263 bp, Heterodera glycines
  misc_feature (4168)..(4168): n is a, c, g, or t
  misc_feature (4205)..(4205): n is a, c, g, or t
ttggccatcgatggtactcaagaatgtaaaatttgattgcctttaagcaaagttatgccatgttttgtcgaaaaaattgctaaaattggcggattttatgaaacgacctagcaccttcataagcaatcaagaaaaagtttaactaacgataattaacgaaaaactcacaacatttagacacttctacttttgaatcggcccaagacgtctttagtgccgtcaaagaaatgatgttcaaggaggatgacgagcccatacaaaattcaatgtgttaaattaatattaaaatttagctatttttaaaataataacttttttgccaattagtcagttaaaattttccaaaaagattttcaaaatttctgaaatattcagtgaaatacaaaaaaatattagatttatactggtaatgaataatttattatgtttgcatttgctcgtcagcatgataaaataggatgagagaaaaattaaaagtatatcctggtaacatcattaattttaggtgtttgctacaagacataattacgggaaaaaattttcatcgcaaatcggtggaagagctccaaaacataatcagactcgacacacttcaattggtttgtaagaaaaaatcattgttatcatgccattgatgaaagacattttgaaattttttagctaaatattttttacttatttttgatttttagagcatatttttgtttttttttatgatctgaaggctacctattttggcagtttttagagactaaaaatcgtgtcctttagtcaaagtgccatgaccaaattttctgaaggctttactaacaataaaaatgtattttttattttttgtagatgatggttggttccttttgtgccaatgtgacattcaaaaagaacccaacggaaatcttttggtttcaaagggagattttgctgacggctgttccaatcatggatcacgtacaaaattacgtggaaaatgaaatggtaggtcataatcgcaataacaaaaaccaacagttcattactattaatgatttaaatcagagttgccaactgaaaattttcaaaaatcagcatttgaaaattttattcaaaatgaaaaaatcaataaaatcagtaaaaatattttttacttgaattttttaagtcggcggggaaaatctatgaaaggagtgccatttgttaacagattttcacaaaaataaccaatttttcgattttgtgccaaagtttttggggtcgggcggtgccgataggctaaaaatgaccatttttgatgaaattattaaaatcagcataaacataataattcataaaatcacaaaaaaaatcatctttcaatgataacatcattaaccctttgaagtctgcaaaatgatgataaagcaacagagttggctaccctgctttaaataaataaaaagttttaaaatgattaatttaaaaatttaattttattcaggaaaaaacatttccaaagattgaaattggcttagtcaaaagtaaaatcgaccaaatgagtattgatcagccagtgaaagagaatgccacaattttcaaagcaatggttgaaatctttaatgaactcaacaaatatggaaacagaagataagtttaaattttcctccaaaatattcaattttttcaatcgaaaattaatttaaagcatattttgcaaaaaactaaatggtttttactcattctaaatttttccaaaataaaatttgttattattctttagttttttaatttttaggattttcataattaaatttttaaaattatatggaacgtttatatatatatatatatatataatttggttttttatcgtaatgaatattttaacgtcgtttttcgcaaaaattgtcaagtgctctatcatccaaatttctaaataacacaacattttggtgggggagtaatcaatgtatttatttgagatattatcggcagggctttgtgtcaacaaatttgcaaaatgacaccgatttcacgctgcgctgttactcggagaattgcttttcggttttggactacaacactcttcatgttgtggtaacccgatttgataccagcaacgatgaaataagagcgggcgatgcgtaccgttggctgtttcgagttgatccgtacacaaaaatcaacctccagcagcttttggcgaaatacatagagtaatattattttaaaataaattatttatcggaatgccaaaattatatgcttttctttaaaaaattgctctgaataattattttggatattcttttttacaatttcgcatttttaaacccaaatagatattttacgcttattttttattgattaaaaacatttgaaaatttttttattaaaacctaatttttagagtattttttaattatttcctgtcactatttatgccagtaaatactgatacttaattggcacttaatttaggcaatattacaacattgacaaagtagcgcttcttttggagctgtttgagcggcgacacttgcccctgacaaacgaagactttttccataatcttgcaattttgcgggattttggtccgaccggaaaatgtgctgtgcgagcatcgccgttttactacccacttgcaaattatacggatacgtgtacggcttcgtactatttttcgggttcattcatccatgcatgtgaatcgtacattgtttatttttttgtgtgatgaatggcacattttggagcaaaataacttatgactggcctaagttaattgtaatttgaatttttaacaaaaaaaatgcttgatttattcctcacccgacccaactgacatcacacacactaataaacactttgtttaaatggtccaaactttcatcttcctactgaaccgcccgccccgtctccccattttggcatcgtttcatcacccatcggctagtccatccatttcgatcgctttcctcatcaatgtcagaattttcttgatccgttcattaactctaatttgcattttgaaagcgaattttgtagggcagcgggtggttgcgcaatggaaattgcacagaattggcataatcggtaaatacagatatgtttggcaccgctgcgacatcatctttgcaaatttccaatcaaatatttatgagtccaatggcaccactttatgagtccaagaatttttcaaattaattacctatataaaaattttgaccaattacattgtttttattttaaaattatcattaatttaaattagagtagagcgggaccgggaccaaaacacggacaactgagtaccgaggtcccggttttgaccgggaccgggaccagtcccgggttttttcccggttttcccagccaaaaattcccggtttttcaacccgaaaaggtcccggtcccggttaagcccaaaattcccggtcccgcgctactctaattaaaatacacgtttttgggaggttttcaatctcaaaaaagaaaaatctcgggtttttctattttcaatctcaattctcggatagcaattttggttacaattctagagtaggcttaagccccgacccctcgtagaaggaattctcggggagcgagctcgaggtcggggcttaacctcttattcttgagtttaatttttagtcatgaaagaaaaaaaaattttttttttgttaaaccaaactcaaattaaaaattttttaaactaattaataataaaataaaatgttacaacgaaatttccctgggttttgtgcaataaaatgccaattttaaacatttgtaggccccaaatattgtgcgttggacggcggtgtgttcttcgaggatggcacgaggcgttgatagttttgaatctttcttttttgctactgctgttcgcctcttacaattttattatttcctccaaaatataaaagtgttcctttttcttcaataataattcattttaaagtgctgatgataataattctgtgtgaatttgtcgaattaccaaaaacaaaaaaaaaatttccgttttttagaattttccatgccaaatttccgtaaatttttattgaagaaaaattcacacacccgtttttttgccgtatcatttcgtgatagaaatttttttttgtcgatgtgtaacgcaatttatgaaaataggaataaaaattttgtcaattatattttgggcaaatttaattaattgttctttcattanaatcctatttatcatttcaatttgattatttgtgtgntgggtagttttgcgcaaaattcctttattaataaaaactcattgaataataattaatt

SEQ ID NO: 7345 - DNA, 2383 bp, Heterodera glycines
atgctgaaagtaaccaaattgatttattaatgcctcattagattcgaattagccttatggaacttttaattaacatattatcagaaaaaaaaccaagtttaccttcaaacaccttgaaaggtattaccaatttttttcgtacttttaaaaataatttatgcattagaattttttatgattatatttaaatatttttatttctaaaatattcaagtctgactattatcgatatataaattatattctgatgttttatactaactgctattaattttagaagttttatgtacaaataatgtttttctgtaggcaaattaattttaatgatttgcattatttttacattgtttaaataactgtgcatatctaattaatagaccttttttatttgtattaatactgaaattgaattatccttttcaccttaagtttttaatagtttctaacataatgcttttagtagaaattatatttttgatttcatttgaataaatttgttttatgatatttttcattaatttattactaaagctgtagttatctaaattatatttatcttatactatttattttttaagttaaaaaatgttcactccgaaatttgcttcattaatgtttacgggttcatgctattatgtaaacattagggttgagcggtaccggtaccggtactggccggtaattaccggtttttttggtaccggtaccggtaccggtaccggtttttttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatgggattacacacatgcacatgtggtgtagtggttaaactttctacctttcataatttttcgcctgggttcaattccccacttggatagaatattcctcacattttttttaccattattttaattaaaattttaattttaaaaaatattccaacttttttctttcatgttaagcatcctaaaaacccaaaacttaatcaattggtcattttttttacaaattctgttaacaaatcgcattaaaaattacaaaatttttcccggcggcgcctatcggcaccgctggccctccttgtcccccaaaagtcttggaaaaaacgtgccgcgtaaaaagcggtgttgaaagcaaaaaaaggtcattgatttacattaatttacatggccggagaccccttcgcaaaattggaaaattggctgctgaccccttgttttgcaataatctgaattttgaggtctacatctgaattttagtgttctttatcctgaatttgaaaaaaaacttggtcaccctcaatatacatatacttctgaacaattctaatgctaaaaaacaggcactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtcagtaccggtaccggtttttttgcaattaccgattaccgctcaactctaatagaaaccatggatttagacaaaaacacccataaaaattgactattctggcataatttataatccttaaatttggtcatttttagacaatatctgtgcaattataccaaaaaagaatggaatcgaggcgatacatcgaataaaggaatgtggagccaaacacatcattcaaaaaaaaaaaaatttttttttgagattttttggaactaattaaaaacaaacccccgccccgttcccgggggcgcgaaatttctcacccccgcccccgcccccgcgactctgacccccgcaatcccccgcccacgcgaaaagccacccccgcaaccacggggtccgaaccctagtttttcttattgttagaccgatgaaataaaatacgaccatcaattctctgctggaaagccgttaaatacgagcagaggaattattcttactgtattttcgaatgatttacggtatacctatccaatagattatcaaagccacaaaggtacacaaatttgtaattgttgtattcttttacattgaattcactcaacatttgaatcacattgtttttcctcacttttttacagtacctcttccatttccctcaattaacgtgcatttatcacaaaatgcttattattatttgaaaataataataataatttgctcaaatcaaatgatttttgcttttttatttcatcgcaaaaaactcatttgggaggattcatttctgaccatcgtttagcaccaaccgcc

SEQ ID NO: 7346 - DNA, 2712 bp, Heterodera glycines
  misc_feature (2379)..(2379): n is a, c, g, or t
  misc_feature (2387)..(2387): n is a, c, g, or t
  misc_feature (2442)..(2442): n is a, c, g, or t
tcaaaaggggggcggctttatttcagggtgggacctaatcaagggagtggggctatattataggaaatacggtaatttgaattattttatattaaatgagaaaaataaattcatatttatgcaaaatgaaatttcacataataacaaagcctttgctttggttgatgtattccgttatcatcttgcttttcagcgcacataccaatgggacgaaaagaagacaactttggtaattttctcatttttataattaggggtggatttgagtcaattttttttgctgtttttaaatgaccctaacctaattgaaagaagtattttattctttgtttgaagcaatgcatttttgttttatttttttcaacattttggagatattaatgtggttgaaatttttagcttgaactgtttggaaaatcgacatcaaaggattgtgttgttcagtcgccaaacagaacattgttttgtgcatgtgaaggcccgttttacacccaaaatcgtccattaatagataattctcaattttttggtacgtttgtttctaaaaagtatgaataagataaaaaaaaatatttattatttaatttcattggaaatgatttatatttgtattaaatactattaagcgaaagttagggacaaacccgagtaatcaaattcacgaaaatgtggatatacctgtacacattgtatcacttattgtacaattgaatattgataatttatagaaaaataacaaatataaatccacctttaaataattaaattatttaaaaatttttcccaataagatataatactttttactttgtcttcttaatatgcatatttttatagcggcaatggatcctttttggtcggaattaccagcacgaataattggcacatgctgcatggcatcagaagagccaaaatatcgcggagatgatggtggttaacagggttgtcataaagagactttagcctcattttgtggctttttgagaagccaatgatgctaatgttttcaaatgaggcttttgttttgttttttgggaattttaagatttttgggaaaacttctgaaaaataatagctatttctaatcaaaatctaaggcttattgaacgcggatgatatttcttctcgtctgtcgaactgctcttgctgcgagaaggtattgactagtgatcgaactggccaaaagcttgatttaaaaatttgtaaaaaaaatttcttaggagccaaaattgttgaagatttccatcgtaagagtgtctacttttaattaaattaatcaaatttatttagaaaaacaaaatcagtgacacaccagaatgccgaaaaatgattgaagaaatgaggaattgtatatgcccaagccaagtggataaacgggatgaatactaccgtgacgtattcctaattgattttaaaacttttaatagtaaactgtttttaattcgattaaattaggcaaaaccagttgattttctgccacactcgtgcgtggaagaagaaggttggccgcaaactgattgctgtcccgaaaacacccgcgttgaatgttgcgcattccatgaaacggtttatcagactagcaaaattgctttggatatttcaaattattattttaaataaatattataataatattttaggaagcagatgacgtccgaaaaaacgtggttttggtaaatgcgctaatatacaaaaattgaaatccaaaaacaattattagatttatgaatattcacaattactattttgatcaaaaacaagtagattagcaaattacagaattaaaaatttcttattaatttgtgttaatttagaaagctcgcatgcgcaattatgggacagtaagttatttgttgagatagcattttatcctcaccagaaataaaaatcttcaattaaatcctcatgttgtcatgaaacaattccttttttaacatctaaaattcaaaattaagttaatactgtaaattttgaagatttttatataaatccactaattattttagccattaaattgccttgaatgtgactacaatgttttggaagcacgactgataatgctcgtcaaaatagaggacgattcaccacttttttgcgagttgaaaaaatcctgcaatccgtactttttcttattaattatacaaaaatttttcaaaattttttaactagtaatttgtcgggcttggcgaaatttggccgccgtttcaacgcacacaaagaaaaatgtgctgcattgatcaagcagcagcagtcgtcaccatcgacggagcttaaattggaactgcgtcaggaattcatggactacagcaaggaagggtcctttctgatcgattaccttcgtgatcattgatcagtgccagaattcggacaattccctcncaaaaacncacaaaaattaataatacctttaacctctcccctcccaaaaaaaacccacaaatntaattcctttatccccctcccccaccaaaaaacgaaaaacaagtttcttcatcccacaacaaaaaataaatccgcccaggttttttttcatttttcctgactctcttgtttaattaaaatttaatttttatatatcgattttcgttttgtaataatctgaatatgttcgtattacgcattaattattctaataaaatatttattacaatttctacactttgttgtataaaaaaaattaaaggatgatgaaatgagaacaaaatctcataa

SEQ ID NO: 7347 - DNA, 1762 bp, Heterodera glycines
tttttgaatattttttaattacaatatatttttcaaaactttcctggtttactccttttggggtgtacagtaaattccatttagttttcactcagatcatcatttttatcaatgtttaatttcccggttcctatttttactcgagaaaaccgtatatattaaaggaaaaacggaaaataaagaataaaaattaggattcttaagtgcatatttatacaaattggagattctatactttgttgaccaatttttagtaaatagtttatgattttaaaaaagtccttaaggtgcctgtcaaaaaaagattttttcaaaaaatttcatatataaaaaacaattttaggcctaatggaaggatatggtgattttttctctatgtttccttcccactatactaattttctcaaatttcctttcacccaattttgaaaaagtctgaaatgtataaaatagaaaaaatgtcgaaaagttttcagtttatgaaagccaaaaaatgaaatatgctgatttgcagcactaaaatacttgaaataaataaaccgactaaattatcggaccaggaaataacgtcgccagccgaaacgtcgccgggcgaatttttggaccataacttttttcctactcaaccatattaaacattcttggtattgttccaaagcttatgaaaaactcttgaataatttattttattttcacatatttttgtcttttttaattcctgtgatcatccatatatttttgtcacttactctacgacatttatctgaatagtcgtcagagtaagtggttctcgcccttctgatgacttttttattttttatgaataaataaataaataaatgtaaaaaaagtgatgaaaaaaataaatgctaaataatacatgaaagaacaaaaaaataataaatacaaatatattaatagggataacatttatagttgctaaaaactgccaaaataattaatttttagtttctaaaaaccccaaaatagttgctaaaaatgggtaaatagttgctaaaaacttccgaatttaggtgtgtaaaatgacaaaaattttattcaaaagtcaacaaatattaatccaaatcattattgagataaaaatttttaaaatagaaattcttgtcaagaaaataaataaataaatttggagatgaatttttgagaaatttttcatttctttgtggtgcatttttgaaaaattttttgagtcgattcttaggggtgtatttttgaaaattttcaaaaagttaatccttaggggtgtgtttttcctttttattgcatttttgctaacaaattttgggcaaagcgccaaaatagttgaaaatagttttttttcaaaaaatttatagttttttagttgctaaaaataaaaaactagaaaatagttgctaataacttgaaattagcttaacaacagccgaaaaaacatgttttttcgtgcatttcaggctacggggagctcaggaaaaaatagtgaaaaaactataaatgttatccctatatattaaattagaccaattagcagaaaatagtcaatgttttagttaaaagtgcgatgtatcataagtagagaacgaattttgaggcatatgccttttttctggcactaattttgatacattaagcataaaaaacgcattttccacttggtttgagacttctacgttgacttttattatgcctttctttgcgtttttttgggattttcgtgccttaaatgcctttttggcattttgtctttttggtgcctttttgt

SEQ ID NO: 7348 - DNA, 4087 bp, Heterodera glycines
  misc_feature (4073)..(4073): n is a, c, g, or t
  misc_feature (4082)..(4082): n is a, c, g, or t
aaaaaccctttttttttttgtggttttggggtaaaaaaattggggggctttttatttgcatatttttgcatatttcgggatttttgtgcatatttgcatatttagggtttttctgcatatttcatgcatattttgacattttttgtacatattttcagattttttgcatattttggaaaatttgttaaaaaaaattcaataaaacggaaacccctaagaatcggccctaaaaaattcaaaaaaatacacccctaagaatcgaccgaaaatttttaaaaacaccactaagaattggaaattttctcaaaaattcttcccccaaattttttttttcatgagaaaatttttgatttaaaaaatgtcaatatttgctaaagagaattttataaaagaaatgtagcagctcattggcaagtgcactagtgaagaaaattttttaaaataaatttgcacccctaattttcaagtttttttgtgcatatttgatgcatattttgcaatttctgtgcatatttgatgcatatttcacgattttatttgcatatttatgcgcatattttggccatttttcgtgcatattttttgcagccctgttggtaagcaccgctttgatgacaccaattgtcgacttcaaatttgcatcatcgagcagacagcaacttaacacctttggcccattgtccggaaggcgagtaaaaagccatttggccaccgcttgtccaccaaacggcatggcattgttgtggaaagagagaacgcgaacagctgtacaatcgttgagaagtgaggggacgaatttccgaaaacggcgataaacacccgtaaacaaaacataccacgaagtttgtttccgaacactggccaaattttgcgcaaaatgaactccaaaattctgtcatcggttacgttgatgatcaaatgaattggacaggaggtgaaaagttgatgaaaacggaggagaaatttgatgacattttggtctatgtaactgaaaatgaatgggaaatgttgacaaacttttgaattttgccaattttacgagatctcgatgcattcaaatccgttgactttgtctggcgacggaattggcaacggttgccaacgggaattgacaatttccatttgctttgtgccattctctccaattttgctccgaattcgaataatttctaacatttgttgaggcaaattattaagacagtttcggcacttttacagctgaaagggcttttttcatgaaaattatataaaaagttatgccatgggacgaaaaaataccatgggacgcgtaaatacttaactatttacttctttttttaatttatctgaaaaagaattaagaaagaaaaaatgaaggagaaatgaaccttttgctgtccctgataggtcactaataataattaatattaatgagaggggcataaaacaattaacggcaaaacgatgacccaacaaaatggaaaagaacagaaacattttgattgaattttctctttccaatgtttttattacgtttttgtattattgtaaattttaaatcttttttaattacaaatttttatttgacattaaaaaacgtaaacatgaaaatagggatagcatcgaaaaatctttgaaatcaaaagataatggcaaaaaaaaccaagaatattcggcaaaatagctttaaagcgtttgggtaaattaaatatagtataaaatttggtattttcgcctcccatgattatttaaagaattttagcgataaattaaaagactaaatttggtaacaaattagtccaaataccctgaaaagattatgaaaaaaaaacaaatttggtcagtcattatctcaaaatcagagaacatttctttcaaataaggacaaaataaatttttaagattttaagcacaatttaaaatttaaagcaaatatatcaattaatgaaaatgtcgaaaaaaggtgacgaaatgaattttatttaatcaatctctgatcggagttgaaacggttaaactgatcgaattgaggctgaaggatttccccttttcttgtcgtctcttgcacaaattaattttttaatcgtggattaagctgatccaaaatggttgcatttaacagcgccagaaagcattaaaaagacatatttactatttaattttaaaatatattaaatttatatggtgatcagcccgacatcaccatcatcatcagcaattccattcctaaaccattgcaaatgttcgtattttcaattgcccttaaatatgcatttaaaaatatttgcttctaataaaaaaattgaaatttaattatttgcacttgattttgaagatgattaaaaaaaattttctaaaatccataaaaattatttttgtattgaagaatgggggcacatataagtgaatttaatcgaaattcctagtaaaatttaaaattttttcaaatccctaaaaccgttaaaatgtcaaaatatgcattatcatcaattttccttaaatccgcttaatcccgccttcaaacattttgtctttatcctcccctgagttcccttaaaaacaaatatttattttactatgcattcattcggcgctgaacaaatcccattaatctttcaagtgtagccaatgcaaattcaaaataatggacacactgagaagtcaatgtcaaaatatcgatacttttgcaccacccgaggtgcaatttgacggcgtcctgccgcagaaaacatggcgaagatgacggaaacggcaggatggacggggaacggagtgagtcagtgttcatacacagacagaaaaaaattagtctttttgatgaaaatctattaacaaatcagaacgaaattactaataaaaaaaaatccggcgacgcctaacggcaccgtcggactttttcctcttttctccctttaccgtcgaccctctccccgaaagggtcattcttaacagtgtaaaaatttcgcggtttccgatactaaaaacccgagaccgggaaccgagaccggcaagcgaaaaatccgggaaatttcccgagtcgggaaccgagactctcgcacatccctaaccttaaataatagggggcctaataaactaaactaaaaaaatatgcaaaagtttttgcattggaagaatttatgtaaataattttttcgcaaattttcaattcgaaacgaagtaatgtccgagcaatataatttattggttaatgattgaaaagagaaaatacaattcaaataatgtttcagttcttttccattttgttgggtcatcgttttgccgttaattattttatgccccctcattaatattaattacctttcatcagcgacagcataaggttcgttcatttctccttcattttttttctttcttattttactgcgttcaatggcacttgaattattcgatggcattttccgcgtcccattcaaatactgacacaaatattcccaaagtaacgaattttatgaaataaattttatagaaaaatagaaaacatttaggggcattgaatgatagcaaaatttaaattttggtttattttgagagggctttcactgaaatttaacgtaattgaagaaaaattttgaaaattttatcctcatcaacaatttggaaaaatgtatgcgcatatttttcttttttacaattttatgtgcaatttacataatatttttataattttattgaacaaaaatcaattgatttcaccaaaacatcatcattatccccctgctgatgttgtgcctttccctccggcgataaatatttgtgttgtttgtccttcttctttggagagaggaaaaaaaaatttttttttttgaataaacactttctcttctgacctgggctttgtcttgattaggtcatatgattaatgtattttaaatataattaaattttgccgcatttttttcattttttagggggttgcattttcatgactttgcaacgatttttggggtggtgtatatcatttttttcgggccagtatgttttcgcatgttttcgcgtgagtgcatgttaacaagggaacattccgagctgtgagtgggaaaatgcctatgtattatataccattggatagagcnggggtcgantttct

SEQ ID NO: 7349 - DNA, 2806 bp, Heterodera glycines
  misc_feature (52)..(52): n is a, c, g, or t
aaagttttgaaaaaatgaataaaaagttttatttacttcaagattaccttgnaaccaagaaaactatagaattgaataaatcacatgcttttacgcggcttgcttaaggcctaaccagcggatttttcatggatacaattttgtttttgtttaccctttttttttgaattttccgcccatatattaccaaagatatttgtataaaaattaagaagaaaatgtgaatttttattttatttttattcttttttaatttattttcttttaatcgtataattaaatgcattgaccccgttttatataattatatttaattattttatcaatcattgagttttttcgaatcgtcacatcacgctctctgacccgcccaacgatttttttctcatttattaattgcaatacaatactgttccaattggtaaataaatttaaaaatgaataaccaacctccttttcccaatttaatcccgaaattcgattcgcaatgaatttaatttgtcaaataataaaaattttttaatttgtcaaataataaaaattttagccaaaaagctataaaagtgacaaataaattcatttttgcaatcataatttacgacaaaagtgtgctgctgctgctgctgctgctaattgccataaaatgaatcgacggtaaggaaattttttttagaaattagcaatttttaattccaattagcaatttttaattccaattaaccatttttaattccaattagcaatttttaattccaattagccatttttaatttcaattagcaatttttaattccaattagcaatttttaatttcaattagcaatttttaattccaattagcaatttttaattccaattagcaatttttaattccaattagcaatttttaattccaattagcaatttttaattccaattagcaatttttaattccaattagcaatttttaactccaattagcaatttttaattccaattagcaatttttaattccaattagccatttttaattccaattagcaatttttaattctaattggccatttttaatttcaattagcaatttttaattctaattggccatttttaattccaattagccatttttaattccaattagcaatttttaactccaattagcaatttttaattccaatttttgtttctcatttcagttggatttgtaacgacgtgtggatggacattttgcctcattttgaccatgctcaactcggcctcaaaatggcactgatttcgccccgttttgatgcgctggtggacaaacatttcgatggcaaaacggaattgataatttggaaatggatagtaattcgcaaggacaacggaccaaaatcaaaactgtctgtatgggtcgatggcaaatttgtgggatttccgatgccggaccgtccgctgcccatcaaaattcgatttaagaagcttcagattaagtaattttagacttttgtatatattaaagcaatttttatatttcttcagttacattgaccattctgtgctcacatttcttcgttccaacaagcaaatttgggacagaagtggcatcaaattggaagtgtttgtgtattcatttgatacggatgtccaaccgacttgggatgtttttgtccgtcaaatttggcctatttttgcgaaaagcattcgtcatttgggctttcgcaatggcgatcatttggacaatttccgtcgtcgcacttcaccaacgattctcactgatcttgatcaattgtattcaatcgattccggtgctctgttccccgatggaattgctgatgatgggccaaatggaaatgctggtcaagcgttgaccaaatggcttcacactccgacaaaagatggacagccgaagcgattgcgttgtaatggttatttggatctaatgaatctcgaatgggtcaacaacttcaaagaggtgtgtctcgccatattttctataaattgttttcgtttttccattttttgtgtttagacatttcgccgtgccaccacttctgtcagttaccatattcaacttttttttcatgcggaaccaaagccacttgaatcatttgaattagtgaacgaagtgacaaatgagaagctgacactgaagatgagcaaaaaatacaatggatcagtgtataattggctgttgcaacggtgcccaattggggagacggcgacggcgccagttaagtggaaaaaccgcgaaaattctgatgccaattttaattatatcatcagatttgatccttggcatgacaataattcgggcgccaatttgaacagtgtccgatttaatttgtgtgcaaatagttgcattgggtgagcagcaacagcaatatattattttgtcgaaaaaacaattaattaattcattttaggccattgtcgccaccaacggaagaagaaaaagaagaagatgaagcggatcaaagcaacaaaaatgtcgtctgattaagtgtacggaaattatttaattaattatatttgagaaatgaatgatctcaatttgttgtgcttattttctctcagaaatgcctttgttaagttccaattctataaaacatttattttcttgtttttttttattggaaaatgtttttatccgtgaaatttggccaatttttacgaaaagcattcgccattttggctttcgcaatggcgatcatttggacaatttgcgcagtcgcacttcaccaacaattctcaaatggcaactcgtacaaaaaaaaaaattttctaagaattttcaactaaaacttagaatttttagataaaaaaggcactttacggttatcggtgt

SEQ ID NO: 7350 - DNA, 1768 bp, Heterodera glycines
tttcgttactaatagaatcggatgattttttgtgtaatatttcatggttacttgcgcaaaagaacaaaaagttttgcaagtttgaaggtcgttcactaatttcatttgccgaatttgggctaaattagtgtttcgtcacacattacaatgcaaaaagtgactatttaagaaactctaaattttcattaccaatataaaattttgacttcaaacattagtttatgctatttatttttgatttaacatttttttcccattaagaaatgtcaatgcaacaaaatcaagggtccgatgatgctttgccaatgtgggcggtaccggattttgatgaaatgggccaaatgccgcagcggcaaaaacaaaaaaaaatcccaacgttgaaggagtttcggaaccaatggaaggaacgaagacttctgtgggagagggaggaagcagaaaaaaaagaccccaaaacatggaagaagaggaccgatgagatgaagaaaatctgtgaggagagattggagcaatcaaaaggtgcaggcggcagcaacaaacgacaggagccggacacatacacttggaactgggacgaactactgcgccaagaaagagaatatttggacgggggtctatggggaaaatgatgagataccccccccccccccttcacctccctcccgttcgattgatcgattattttattttctatttgaaataaaaatatgaataaaatttaaattgttaaaaaacatttaatttgttacccttgggaattttgattttttaatctttctttttttcataattttcgacttgtttgcattttttgagtttttgtagtttctgattttttggttatttttatggattttatgatttatttgcgattttttaaaaaattgacatttttattaattttatttttgataagcagcgtgaatagaattgcataacgaacactcatgagaatgtttatatttaagatgttggatgacttttttttttattttgtctgtctcggcagttgatcgcttccgccctccttcattttttgtctcaatggcgtttttggctctctcgcgttgctgctcatttttctcgcccaattctgcgtacaactctcggacatgcttccgaatttcatgtccagactttgatgaggttgatgagccggaagtagaggggatacgctaaacaataggatttttatcatcattttgtgtttttgataagttcattgaggattttgcgtatttttgaaacttttgtgggaaacatcaggatgttaaattttatgattaattttaactaattgtattatttttgacaatcatttaattgaggtttttaatagacccggaaaccaaaatctcaaacaaaattttcaaaaatttcataaccagaaagaaattccattcttttctgaaaaacgcaaaattacaaaaattacaatttcccaggggttatcattttttggtaaaaacttagttttttattgattttaaaaaaacacctttaaaatagaagtcattaagcctgcgatttggatctcgttgcccgattgcgagacaccctctaatggattgtcagatataggcgaatattgttggttttggtgttgctgttcttctaactcttcgccctcatctattattaggtgtgttgtgagccttccttcacaatcaataaattggggaggtggaggtggtggtggtggtggtgccaatgccaaaaatggcgatggttgttgttgttgttgtggtggtgcccaatgataatgatg

SEQ ID NO: 7351 - DNA, 1620 bp, Heterodera glycines
acatctggtttccagtaaatactcagatccgtcgccgaacaatcttatcttccagaaatggcagattttttcacaacgcaggcagttacagatgtcgtacagccgaagggatgctatctcgtagaattccttcccttcgtcctcaaaatcgcgttcacattgctccctgtggcgatgcgagcattgctgggtttttaattattattattattaggccactctggcctttcggcgagcaaagcgcccgccgtcaggcgagcaaagcgcccgccatcaggcgagcaaagcgcccgccgtcaagcgagcatacgcccgccgtcaggcgagcaaagagcccgccgtcaggcgagcaaagcgcccgccgtcaggcgagcaaagcgcccgccgtcaggtgagcaagcgcccgccgtcaggcgagcaaagcgcccgccatcaggcgagcaaagcgcccgccgtcaggcgagcaaagcgcccgccgtcaggcgagcaagcgcccgccgtcaggcgagcaaaagcgcccgccgtcaggcgagcaaagcgcccgccgtcaggcgagcaaagcgcccgccgtcaggtgagcaagcgcccgccgtcaggcgagcaaagcgcccgccatcaggcgagcaaagcgcccgccatcaggcgagcaaagcgcccgccgtcaggcgagcaaagcgcccgccgtcaggcgagcaaagcgcccgccatcaggcgagcaaagcgcccgccatcaggcgagcaaagcgcccgccgtcaggcgagcaaagcgcccgccgtcaggcgagcaaagcgcccgccgtcaggcgagcaaagcgcccgccgtcaggcgaacaaaagacagtgcccataagccacctcttgtgcttgctgccgcctcgtccgcgctcctcctatcagactcaagcgcaggtaaagagtggactccttctggatgttgtagtcggcaatagtttgaccatccttgagagtttttcctgaaaagtgcattagttttcgctaattttcatgttttagtaattcttacttacattccttattattacaataaaaacaaataaaatttgtagtttcaaaattttcgatttagtaattctttttaacaattacaaatgccgttttttaactattttcactaaaaacccaccgcaaaaaatgagacgatgttgatccggtgggatgccttccttgtcctggatcttcgccttcaataaagaataattatttcaatcatttgtgaatgcttaattaaaaaattaaataattttagaataaaatgaaaaaaagcctcacatgagagaaaataattcctaatttttattacgggattcgggatttaaattttatttgaatataagtaaaaaattaaagaattaaatattaaatttgtaaaatctttaatcgcataaaacaaatgaataattttttcaaattcaacgccatccaaagttgtggaaataacggcgatgggcggaagagaatcgatgaaaaattgctgttatttaggaggggcgactggtggaggcagttgcgacgccaacgaaaagacccaaagttgtggcgataacgatggacggaataatcgatgagaaattgttgttattttgggggggggattttggt

SEQ ID NO: 7352 - DNA, 2444 bp, Heterodera glycines
aatatgtatataacttttgttcgcaaacacaaaaaagaaagtgtttttcctactaattaggctatggagaatccaggaaaaaaatgtatttacataaaattagcagccctattaattaatataacttttgtctaaaaaggttctttcctaattaattttgcaattattatgtcagcgacaatttatcaaatctttttataattttcttatatgtatcagctctaaaatatattttttgaaaattaaattctaaaattcataactgcaaaaaaccataagaaaaatcttgcccacggtataattttcaaaatttcgtttcatctctcattaaatcggatttgtatttgcataatgcgcgtgttgaaattcccaattctgcggcaatttggcgatcggtgagctttggattatgttttttcatctgataatatttcttcatcttttccattttctcacaaattgtgagaacttttcgttctaaaaataattttaaaagattaaaaatgggtgaagaaatatttaaatttgaccttttgaaacattttgtttaatgccgaatttcttggcccatctttcaattgtcaaaaaacctacaccaaacatttgtttaatttttgctctaaattctttccattccttgtccggatgttttcccatttgcataaattcactttttgttttcaaatatttttcaacaatttttctttttcgattctcaattttttcatcggtttttccattttttaattgcctcttccatttataaatgctgtttatttcaatgcccaaatgttttgctattatttttttacatttcattctttttccatccaattttccatttaatttcatttttaatttgtcatatatttgatcaaatcgctttaatatttggcgtttttcatcttccgaatttttatggatcatcattccaaattctcttttccattcgtaaattttctcgtaattaacacccgatttttgagcaatttttctttcaattttgtgccattcttttccagaataatatttctttttttcttgcttgaatttctcttttattttatgaaatttttccacaatttctcttttatttttattagtttcatttgaaaaacgatcacaactttgtccattctttgttggcattggcaattggcccaattcatcataatccgtggacatttcttcactctcctcttccttcacttccacattttcatcaaaattctgatcaaattgacgaacattttgtcctaattggttattctgatcagcaatttctccatgaattatttgatcattttgacagatgttttcttcttctgctccgtcgtcccatgtttggccaaatatttcagcaaaacttttttcttgggttattttgccagcctcaatttggttaattgcttttttgaatattaatgcgcataataataaaaatattaataatattttcatttttttgtaaaaatataatgaattatttttataaaaatatttttcgcaatgaattttgtaattattaattttatagcatggcttaatttttcttcaatcaatattaaccacatttaatcattatttcattaatttgacaacatttttataataattcaattattaaattttccttttatcagcgaattgggtagtaattaatatgagataactataattatgaaggtttttaaggtaactatcacaaatatcacattttcattctcatctgatgtcattaattgactaatttttttagcacatattttggggattttttggaaattttatttttattttttacgaaattagcttttttgcactcaaattcttggcaagatatccaaaaatgatcaaaaattttcttttttttctttttgcactttttgatattttttaatggcttttttcatttttaaggcaaaatttgaattttatcgatgaaaaacagaaaaataagtaaatcttggagagaaaagtatttacgtcacaaagaattgaaatgtttttgattagaattgtactagcgaaatggataaaaaatgtgatttttttgataaattcacttattttttgacagtttttttttcaatttttggcacatatgttggccttttttgagctttttaggggtcggggtcgaaaataagagatagtcatttttcttggatagataaatttaaaaattctctgagaaattaaatggcgattgcgcaccgccctccctctcacgctcgagcgcttttgcaacgtataaaatttctcaaaataagagatagtcatttttcttgtatataagataaatttaaaaattctctgagaaattaaatggcgattgcgcaccgcccttcctatcaagctcgagagcatttgtaacgaataaaatttctccaaataagagatagtcaatttcttggatattagatatatttaaaaattctctg

SEQ ID NO: 7353 - DNA, 1958 bp, Heterodera glycines
ctttcattgaaaatttcaaaattgcaaaagatgtttttcagatgttgttgaccaaaaacgaccagcgaaaaacaaacggagcggcaaaaccctcgtcccggcaaaccaatgccccagggcaaaagtgacaggggcagcgaaccgccaccccgccagcgcaaacagaaaaataacgaaaaaaattgttataaaattttaaaaaccgggctttttataatattaaatattaaatcattgcatcgcccaacgcactgaaacagcaaatttagtagcaaatgcattaaaaattataaaatccaaccattaaaatttggattggtgggtattcaatcggacgtgcatatctccgcaaatattggagtaacaggaaaaatgcatataccattcgaaagctgcgaaaaagctcttccaaaaaatagcaaaaaatcctcgagagggccaatacagacccagctaactgctcggaaatttgactaccacttgtaaaggctaaactatgagcaaatttcatgttttcgagctcgtttgaggaatttactagtacagaactataaatgtagcataaaatcgcttcgtcatgtgacaagcgtgacaagcaaaactcactgaaacgtaaatatatttgctagattattattaagaagcggacttctgaatagttttcctcagatggttctagataattatcttgaaacaatgtttttttatagaatgctaccgcatttgttttttctgagtttcggacgtgcatatctccgcaaatattggagtaacaggaaaaatgcatataccattcgaaagctgcgaaaaagctcttccaaaaaatagcaaaaaatcctcgagagggccaatacagacccagctaactgctcggaaatttgactaccacttgtaaaggctaaactatgagcaaatttcatgttttcgagctcgtttgaggaatttactagtacagaactataaatgtagcataaaatcgcttcgtcatgtgacaagcgtgacaagcaaaactcactgaaacgtaaatatatttgctagattattattaagaagcggacttctgaatagttttcctcagatggttctagataattatcttgaaacaatgtttttttatagaatgctaccgcatttgttttttctgagtttcggacgtgcatatctccgcaaatattggagtaacaggaaaaatgcatataccattcgaaagctgcgaaaaagctcttccaaaaaatagcaaaaaatcctcgagagggccaatacagacccagctaactgatcggaaatttgactaccacttgtaaaggctaaactatgagcaaatttcatgttttcgagctcgtttgaggaatttactagtacagaactataactgtagcataaaatcgcttcgtcatgtgacaagcgtgacaagcaaaactcactgaaacgtaaatatatttgctagattattattaagaagcggacttctgaatagttttcctcagatggttctagataattatcttgaaacaatgtttttttatagaatgctaccgcatttgttttttctgagtttcggacgtgcatatctccgcaaatattggagtaacaggaaaaatgcatataccattcgaaagctgcgaaaaagctcttccaaaaaatagcaaaaaatcctcgagagggccaatacagacccagctaactgctcggaaatttgactaccacttgtaaaggctaaactatgagcaaatttcatgttttcgagctcgtttgaggaatttactagtacagaactataactgtagcataaaatcgcttcgtcatgtgacaagcgtgacaagcaaaactcagtgaaacgtaaatatatttgctagattattatttaagaagcggacttctgaatagttttcctcagatggttctagataatatcttgaaaacatgtttttttatagatgctaccgcatttgtttttt

SEQ ID NO: 7354 - DNA, 4669 bp, Heterodera glycines
ttcattttcaaacttttagtgatttttttttaaataggccccagttttttttaatgttacaaagatagtacttgggttttttttaaaaaaaaaaagcgattcaaccaccccccccccctccaccgcccactcaattgttttgtttggcccccgaaattggcccaataattaaaacaaatgtttttaaacagaatgatgccctcttacaataaaaataaatgacattgtgtaacaaaataaattcttttcatatttcttttatttatgaattagtttaattagttttcactttgatgggtcaccgggacccgaaaatttgtctgtcaaaacaaattaaattaaacttgtgacacaatgtgaaattatccaatttttcgcgtcaaattatgagaaattattgtttgaaaaaatgcgacccttattttcagcactaccgtctatctatcgtaccgtaccacaataccaatgtagaaaaaaaaattatgggaacacttaatttattaaattcgaaattccaaatgtagaaatttaataaaattcggtgcaactcgaactaacattctttttcgatcacatagtcccaaatttttggaacccgtccatctcagtaccgtatagctttacaacaatttaaattccaatttgttggaataggaattcaaattttaatatgaccgtcttactacagtaactttctctctcagtaccgtcataatgagtcatgacagtagtgatcagtgaatgttgaatcacaaaaatgcacttttgtgaaaacaaaataatgacaatcctaatgatatcatgcacgaaaaatgatcggcaattttcaggttttcatagttcccaaaaatttctctcctcgctccgcgcttccctttgtctgggtccacattttaattgtggtaatttgttaattagttttttttaagttttcctaattgatcaccaaattaattataatgagtaagttgtgtccctttggtggttttgtggtatgacttttcttttgttcttttgtgtgcgcattgcgcagcagccacattttggcgatgcggcggcgttccccctttgatcatagaaagtgatcaggctctgttcaacgcaccccccccccttttttttgatcatttgtgatcagagaacttatccctagcctgatcaccaattattgtcatttgatttatttgtttttgaggaatacgagcgatcacgatcaccactctctcgatttctcccgtcgcgcaaatttatttgtttttgagtccgatcaccgctcacccagcagcagctgtccctccttcacgcacgcaccggtcaaagagtgtctgcccgtgactgatcagacagagtcatataacagtcagacggcaatgtctgtttctctggctattcagagaaaggtcaagattcttttgtaaaactcgatcatagtttttttgggtgcgacctatttgtttttgagttcgatcaccgcgctctgttcccatctgcccgcatcgatcagagaataattaatctttccgtgactgatcttaatttcgtcattagttttttccttttgctcgccatattttttggatttgatttatttgtttttgaatttgattatccccaattcctatcctcctccacggagtaattaaaatatttaactgtaatttcgtttgatcaccagatttaggggatttgatttatttgtttttgagttgaaccaactctgtcccgtgcttaagtgtgataatttgtgattcagagccattatcagcccctcttctttaattaggtacgcgaaaggtgcgcgatttaatatgatttatttttttatatttgaaatgagtccgatcaccctcatcccgcgcaattacagagcaattgtctgtcagagatcgctctaataaaccatttcgatcacatttttcagtttaatttgttttttcaatcacgcaagtaatattatgtcctacttcacccatcatttcgatggtttatcttgatcagatttatcatgggcacaaaagttataaaatctctctcgctctctatcatcactctctctctctctcgctttttatattcaatctaaaatgggtgatcagaagtctttgccattatgaccaaaatgattagaatattcattcataaaattaataatatctctttcatttctgtcaaatactttcattcaatttctaaccaaaatataataattgttgtctttctctgatcagcgcaatatatttgctgtggtaaaattatctttcgtcgtgcaatgatcatacttatcctccttttctgtatcagatcacaaataaatttttgatttattatttattattgggttcattcaccaccctcgccccacccgcgcacccaccaaaacaattaatgaattaattcgctttgtgctggttacactctcccccaatttgtggaagagcagcaaccgcagcagcagtaatagggaaggttcttttgctgcgcatagcaaatacgtcaattccgatcacattactgcacagcattaactttctctctctctctctctctctctctctctctctctctctctctctctctctctctatctctctctctctctctctctctctcaccaccaccacttattaatgataattagaaataataattcactaattagtggctaggtgagtcatctaccgccacattttttcctttttgctcggggcgaaattgcgtggcaatcactccgcactttgatcaccaatttttcttgtacacaaaatgattttttcctcaataatgaatgttctgtcaaaatgtgaacaaagtgagagccatgaacaccctgacactccgatcaaaaaagtttaattattacaataaccgggggaggggaatcatttcggccgaatttcgtcacagtcatcggaggaggttggggtatcaggccgaggaccaattttgttaatttgtaaagtctgaggcccattttgagcaagaaatgctagaaaaaattaatcgaaacgttaatttctagtacattttagcagaaacaaacaatcaaaattttaatacattgagataagagaaatagagattaaggagttagaaaatgatcaaagacaaagttggcaaaaatgggtgcagtattcgtgatcaacgaccttaaaaccccttaaaacttattttcattaatttctaaaacgatatagattgtcagtttgtgaaattagagaaagaaaagagagagagagagagagagagaaaaagagagagagagagagaaaaagagagagagagagagctaggaaaagtagaggaaaagtacagagacaaacaatgaggtagagatattgctgcggggatgagagtcacaaggttgcgcagagatgagaatggaatgtgccaaacacaataactcaccgcaagcttcgactttctccgtcctttcttcatacgtcacattttacgccccattcatggtttattgttttgttgatcagagcagtcggctgctgcggcaaacagtggtaaaactgattgctgcgctgatcagccaccgatcggtgtcaattagtgtagcgatcaatgtgtccggtgtccccccccccccgcatcacaacggtcgccgtgcgtcgccgcattcccccgcggtgcacagtgctgcgcgaccccttcccacagcgcggcgccgacggcggcaagtcgaatgacaacggcggcggacgcagcgcaagcatatgaagcggtgcaagtattcacgtgaataacacattgatttggtcccttactcagtccatcgcttcatcaaatgatcattaactaattaattagccaattagtagtgactataatagttctgtctattgtttactcggtccctcgctctttctccgtctcgaaaattccggggagaaacgtcatccattgacaatcgccaaattgcccaactcataattgtatcacttcgtcagcgccaaaattgagaacatttcgtactcaaaacaacaaggcacaatgttttctggtcattaagttttagaggagttggatttattttaatataaatttattataattaaattggtgaaataatttaattgcattaaaacaaatcaaatccaaatatttttttattttataaatttgggaaaattttgaaaaaatgacaaataattcttcacattaaatttatagttttgaaaaaagtcgtttttaaatgaatatacttactttttcatgatttggttaattttgggcactttttgattatttgtgttaataaaaaaaattttggcaaaaaaatgagtgagacaaaaataccgatgacctaggaatttttcataatttccaccaacctaatttaggttggctgttttttgccaatataaaacaactccaattttttttttactaaacacaaatcccatattatcatggaggtcatcgcaatttatctccacccaaagtgcatgtacttcaccatcatctcatcacatatcctagcatttgtccttcaaattgggcaaaattccttcgcatcgcatcagtccccccccccgacccgtgcccattgattgatgtttattttggattttggatggcattcgtggcggatgatgatgatggtgtcatatttggtgcattctgggtgccggtgtatccccaaaaacgcgagagggatggg

SEQ ID NO: 7355 - DNA, 1973 bp, Heterodera glycines
  misc_feature (1755)..(1755): n is a, c, g, or t
  misc_feature (1841)..(1841): n is a, c, g, or t
  misc_feature (1937)..(1937): n is a, c, g, or t
acatccaatcactttcccactaaataattgttcagttacgagtcgcaaatcttctaactcaaggacgtagacgctagcaaagtgagggaaaagcaaaaagaggggatcggtcgaatggaatcggtcggtcacactcacatgatgagttttagcagcaaatgttcaggcagcattctatttcttttttcaaattcaaaatcattaattataagacgcattaatccatttatttgtgattggtttaataaaagttattctttgttcataattgtgccaatataaattttttgtagggccgtgtgcagataatgcgcggacttgagctgagaatgagcgacgccactgcctatcatttgtaaggcgattctgggaattatcaatacacaaataagcatcaactcatattaataagcgaggcagcacctcgatatgatcttttcgtctccctcccccttccccccccccccctgcccgacaaatcccgccgttgggtggtcatttgacctgacccccaaagaaattttggggatgcctcccgacgacggggctggagggtgcaattgaaggacaaacagataatgatgactctaatttggaggacaactgtactaatagattttatgagttatcaaatttatcagttagtcactatttcaaaatttattgttattttttagcacacaattttggtgggcgtaatgatatgtgatcaaatttcataattacttacatgttaggtgctctaattatgctctaattaacaacaaaaataattgggggaactgtgcggtgcataatgaacctacgcctaaaatttttttcggagaacgggaaatgaaatacccgaggcctaaaaaatccaaaaatgacatcactaaagttgagcgcctttaaacgaacttctattatttcttccattttacacttatttttaattctcaaacttttttgaggcgaaaccttggtatgtaaattttcaaaatttttcacgatggtgcctgtgtgaaaatatttaaaaaataatacttattgaaaaaaaatttacaaaaaatatttgcatagtaaattaaaattaatttttatttaagaaaatgatcatgcttatcttattactgatcacttttattttaaagtggggccctactcactttcctcaatttatcctgcacatgattcagcagatccttttttctagagtgccacgggaccgggaattttgggcaaacccgggaccgggaccttttcgggttgaaaaaccgggaatttttggctgggaaaaccgggaaaaaaccgggactagtcccggtcccggtcaaaaccgggaccttggtactcagttgtactcaattgtccgctaccaggtcccggtcccgtggcactctacttttttctactgcatatcctaataataatatctgatcactatcaaaaatggatgctccgccatcatccacattaaataattttgacgctttaccatcacatcattattttttaattatccttcatgcgtgtaaatttgcaccacaaaactccaccaaaatggttgaaactgcgaccagtataattatttaagcattatgataataatgctgacggagctgatcatttttagatcgcaaaattctctcccacaaattttttaaacaaattaaaacaatttttcgcccattttctttcctccttctccgcttccacaccacttaatttggatcattttttgcaaagagtttataaaaaattttcgcgctctanaattttgcggacaaaatgaatgatgatcacgaacaaaaataaaagaaagagtgatcggcagtctttagtttttataataaatgtanttattactaatttgttccacctttcatacgtcattttgtctttttcgtcaaactcaaaactttgatcacaaaaaaagatgatcagaatggtgcatnagcatattaaactgatcagagagaagcagtgaatta

SEQ ID NO: 7356 - DNA, 3984 bp, Heterodera glycines
aattttaaaattttagagggaaataaaatcttcctagtgaaagtgcggaagcagaaaaggcgcaacccaaacattgtattccgggattcgttcaacctgatgccgtgttcgttagctgcactcatcccttcttatggtctggacgtggaggacaagcccttcttcccgcatttggccaacagaccggaaaactacggcagagaaattcgcccaacgcccgacgactatttggcaaacggtatgatgcccgggaagaggcgacaattcgacgaatggtacgctgcgcaccaccatgagccttttatgctcgatgaggcgcttgccaggtaaaaactatttttacatgtataaattaaatttttctgtttcagttattgcacgaatgatgtcaagattttgatggctgcccttgtcgcattccgtcgggaattctttgagatttcgcgtcgccaggagtacatggacgggatcgacgacagagagaaccatgatggcatcgacgtactgcgtgagtgcatgaccatcgccggcgcgtgcatgcgacactttcgcactaatcacctgcctaacgaccaccttgccatcgtccctgagcgaggttacgacaacgctcaaaatcaaagccttctcgccttacgattcttccattggtactcggaggagtacggggtggatgtgcagaccgcccactctgccggaggagagaaacggatcggcccctactcggttgacggatggattgaggcagaggggcgtgcaattgaagtgcatggtattgattatttatttttattcagtaaaaaatcaatattttaaggctgtacttggcacggatgcaagaaatgttatccaatcgataacatgttgttgcccaacggaaagacagcggggcaggtacgggagcgcgacgcaaagcggatggaatacatctgggcccgagtgaatcgtgtggacgtgtattgggaatgcaaaatcacgtctatgctagagcggagcaaagccatgaggaaatccttcgcgaactacgtggatgacgggccactggtgatccgggaggcattcactggaggacggaccggaccactgaaattgctgcgcaaagcggggccgggagagaagatctcctattacgacttcacgtcattatacccttacataaagtcagttcttttttctgtatttgacaaataaattgtaaatcttaagcttcaccactcgctatcctgttgggcacccgaaagtacatgttttaaaccaacaagtggaatggatcagcgcggcggacaatcctttcccgttggcgctgctcaaagtttgggttgtgccgccccgccaaatcgatgttgcagtgttaccggtcaaagtggacgaccgactgtgctttccgctgtgcatcagctgtgccaaagaatacccaaccggaggcgtggacaacgactaccactgtcagcacactgatcaacaacgcggatgggtcagcacctgtacatcgattgagctcaacgcagcgctcgacgagggttaccgcgtcacgagggtgttccgcgtgctagaatacgagcaaagcgacgacaagctcttccgcccctacattgcggaattcatggctcaaaaaatccaggcaagcggatttgacagcagcataagaggggacgctgagaaggaagaacaatttgtccgagagtgtgcggagcagtttggcatcaacattgatcctacaaaaatggtggtcaacaaggggaaacggtccctggcaaagctctgtctgaacaatttatgtgagttttgacatattaattttgacaaaaaatgtaatttttagggggacgtttttcgcttcgcaactttggcctgtgccagacactcatcactgacgacccggtgacgctggccgagtacttggacaacaaatcgatcgaagtcacatcgatcgatcagctggacgaggcgcacatcctcatcacctacctccacaagaaggattggatcgatgagcacgcttgctcaaacattggtgagactaaagttgtaaacttgtgctaatttgataaatttagtcatctctctgtggaccacttccgctgcgcggcttgttctgctcaaagccatgcagaaggtggttaggtcgccggggtccgagctactctacaccggtacatatgccctaaaaaattgcatgaaataaattgcaaatattttttagatacagacagtctcatcctcgtccacccggaggagcgatgtccgctcaaaactggtccacatctgggccagttcactgacgagtacccggaccacgacattgtggagttttgcagtgggggtgcaaaacaggtaaattttaagttaaattcatcaatctgtattgattatttcacattttagtatggtctgtgtttgcgacgaaagggagctggggcggatgccaaaaaggaatacgtgctcaaggtaagcggattgacgctgaactacgacgtgatcaacaaccaaggcatgcgttacgagacgttcaaagaagaagtggtgcggtacgcaacaacgggtgattatgagccaatcattgtcacttatcctaacttcctccgaccgaacattcgggagggagggagggtcgtatccatgcccctacagaaatgttaccgaccatatgttgggaagggaattataggcagcgatttcaatgtgaagaattttggccacactttgtaatgtttttgttttctgatgtatctgtctttctcatcaatacaccataaattgtatttaactcatttttcaataaaaattcatgcataatttatgaatggaagatgaaattttaaaataattaaacaaacgaagaaggcatttttaggtagaaaagtgcataattaggccacagaagatacaattgtcaaaaaattaatgaatttgaaaagcattttttaattaaaagattaaagtgatcgttttatgattgaaaaatgcataattaacataatataatttaaaatttcaccaaaatgatggagacatttgactgcactcattgcgccctatattttctgtcatctctacatcatcggataggcgcaaagttttagttgaggatgatgactttgaggatttctgatcagtctcgccaatttctgtgaacagtcgccccaaccagcattcgtggtcttgatcatcaacaatttcaaggagttccagtggaaaatgtctgtcttcgcctccccccgaaaatctctcaattatacatggcgcataagggaagtgcagctttatacggtgccgcgcataaaaatgagcagctacattgatgttgaatggtcggcgcaaatgaccgtatgcgggaaggaaggctgccccttggtccgaaattccactgacaaaaaatgttttccgcatcccattacggtcgttgtatgttgtacgcacttttcgtccaatcagatgtttcagtacaatgctccgatcctcggggtgattgagccgatcgcgcaacgatttgacagggcagttaagcagttgagcacagaaaacgctgacgagcaccatttcagcaagaatgaatgttatgacgactaatttcatttttatatacgatcaaaagttgggccacgcccatcatttagttcctgattagccccgcccactctcacctatataattcagctgcctaaaaaccgaaatcatttcaatttatctgtccaaaccaaaatcatccttcattaattcaaaacaccaaaattattttatacaaaatgaagagatccgctgctactctttctactgctgccgctccaaatcagcatgaaaataaaactgcgcccattccgactcaagtggaaactgaaccagatcatgagacaaaggggccgccgccacaaaaaagcgcgcggtggaggaccgagatttgtggaaattagcgaagggaaaatatttgcttactacatacctctgcccagggtacatgtaacatatagtctaaattttttattt

SEQ ID NO: 7357 - DNA, 1738 bp, Heterodera glycines
acaagtgaaggacattgggaggaaagtaccgatttctacggtacttattcaccgatctcaaaaatttgacacttaacagtacatcccgcatcgaattactggagaattgggctaataatgaagtgagaattcagtttcatttaactggttttaatttatttttctataaattttagcgctattctccatacacatcaaaccgggctacggtagtgtcgccagccatgttgcgtgagacgtttgaattgctaaatcagcagcaaaaacaacatgaggcaattgcaaatcgagttctgcgtcctggaaatgaggaggtggccaccatagcagtttcgtccttaaaacgtgctatggcttcgtcctcatcatcatcatcatcaccagcagcagcaacatcagtcaaaaagtcaaaattggtctcggaagatgaccggggtataattaatgtgaaaaatataaatgcaaattaataatttctaagaagtggcagctcttgcactggcggcgttcacacagatcaaaatgcgcttggctgaagacattgagggcctggagatgcgcactcgaaagcttgaagaaggtgcagccgcgacaacggaggcgcagatggaaacgatgcgccaacaaatggagcaaaaatttcgtcaaaatctgctggaagccgagcagcggattgatcacaagtgggcgacgatgctgagcaaagaacaacaaagaactcagcgaattgcggcacaaagcgcggcggtgattggacaactgatgaataagcgactggcagaggggggagaagaaaaggaaaatacgagagagacagaggaaaaaaagttgataataagtgatcggtgcaattggtgcttagagaaaggccagtgttatttggagttaggggatgcggacatgtgtttagctgtccaccgtgcactattgcgataatggccgttgacgagccaaaatgtctgatttgtttccaaaaattaactgatttggaatacttaggatcataaacgtgtaccgaatatttgctttggatcctaattattttaaatgtttgtactcctataattgtactcctatagtatttcctcatcatcacttttttcattgcctacagtaatcgttaacattttcatttctcattaactaactaaatttgtcacatttatttgctttggatcgcatgaatttacaatatttgtgtaattgtactcctacagtatttcctcatcatcacttttttcattgcctacactaatcgttaacattttcatttctcattaactaaataatttgccgtctttatttgaccacactgtaacccataaaaaatgtttgccatctttatttgatcaaacagtatcccataaaaaatgaattttcatgaacaaatcccaaatttcgaccgttttgatttattgaaggcaaaaaataataaaaaatgaaaataaatgtgaaaatgcataaaaaaaaataaatgtgaaaatacataaaaaataaattattgttgttgttgttgtgatggtggaaggggtggaggcgggaaggggaaattgaaaggcatcatcatggaaaatggcatcatcatcatcatcggaaacggcatattcagtgaagtaggcacagggtttgctgtagcagcaggtggtcgtggatgagcaacagatcgctccttcgcacttcgcttggctgcccccgaacgcggtttatgaaaatttttttttttttattaaatgattaa

SEQ ID NO: 7358 - DNA, 2417 bp, Heterodera glycines
ttcttttctaataatgctttaagtttcttttatttttctttaattttaattcttttttccatttgtaaattttcagtccattaattcccaattttacgccaatcttttgctcaaatttattccaaatttttgccgaatatttcccctttttcttaattccttcttttattgcgtgaaatctgtgaataatgccgcgtttttgctgatcatcgaattgatcattctgatcaattaattcattttgataattttgattataatttgtattttgaacactttcattttcattttcttccattttttcattgtcccatttttggccaaatatttcagcaaaagttggccgtattttaccattcttttcacataaattattaactgataaagttttgccagttgaaatgattatgaataagaatacaaaaacaaaaataagaaaatgcatctgttaaaaaaaataattatattttaatattttttaaaaatatttgttataaatgataaataatttttttaagttggcaaaatccattaggaaagaattgttaataaaaaaaattctaatgaatgttgagaaagcattgccataaaagctagcttaatcaatctgtgaaactgatcttcggtagaattaaaaaaattcaacaaataattaattgataaataataattaaaataattgagagcaatgaatttaatcacaattgaatttgcattattttttttgtggcgtcctcattgatttttttaatccatttaaaaatatgaaatttatgatttctctattagcctgcaaaatttcgaaaaatttcgttatgttgagcagaagattaaaaaactggttattcgaacattttttgtcatagcttttttgaacctaaatgaaatttttcgaaatttgtcatgctaatagaggacacttagagctatcgaatgataccaagattgtaggatttagttgacaacgaaaaaagttatagttcaaaaactcggcccaagcgacttcgaccctttcatgaggtgtagagacgcatagtcctttttcattctctaccattccattccattacaaaaggcagacagtggaaacagagaaagaaaattattaaaatagtattggaaaaaacattttctgccgtccgtccaaattatttacctaactccaaaaaagcaccgaaccagtaactcgaaatttaccgggccaaatttggtgcattaaatcccgcagagttccagttcgggaattcccgtcttgcttgctctctaattgtgattgaaaacgctgggtactgaaatatccgaggctctaaaccacgtcgtcattttgtcatcagttttttttcattcgttcgttcacgtgaacaaatcatgctttgcctgaatgatttttctctcctcacaaattacctatgtatgttatgcacactctcgctttttatgtgattcatgtttttaaaattcgtttcataatttcgctttaaatcttaaaaatttaaattttttcaaatttggcatattgaaatgaagaaaaaactggaaatttctatgcttacatcgacgagagaaaacatcaattttctttacctttctttctctattctttcgttaatgtgtaaagattaaattttccctaattttaaaattttatttcaattttttgactccattttttctaaggaattcatctgtaaaaaatgaatttatgttgtaaaaggatattactgttcatcgcaacaatatgtgtatgtccacggttggcaacaggttgagcattttattagattggataggcttggcttccaaggttccctgggcctagtatttgtcaaaaaatcatggcctggagcctactaaaacagggtttttcatttgagacccaagtcccaatgcctgcgtttttcaggccttggtccaggcagtttctgccaccaaatttttcctgggcctgttttttttcatgatacttggccaaagaaaccttgggttttttttaccaaaatcctcttgcttgacataccacttatgccctgacaataatatatattatttctggctctagttaagttagccgtccaaccaatgaccatcctcaatttcttaggccatacattttttatcttctttattaaacccatatattcttggtatcaaacaaaagcttaaagtttagggaatttataaggctctaatacactttatgagtccaatcgacttttatgagtccaaagatattttatgagtccaatcaattgacaaccccgggtttttatacaataactttgttcctgttccaacaaaacctatctttttggtatcattcgaaatcacaaagtctagataatgtaactacactagtaccaaataatacgagaaaacaagagaattctaacatttcaagaaggttacaaacgaaaata

SEQ ID NO: 7359 - DNA, 4222 bp, Heterodera glycines
  misc_feature (4056)..(4056): n is a, c, g, or t
  misc_feature (4153)..(4153): n is a, c, g, or t
aataatacgagaaaacaagagaattctaacatttcaagcattttacaaacgaaaataataagtaattacttaattaatcaaatcttttttggtaattccctaaacgctgcgattttatatattttagcttcgttagactttgtgctttcgaatgataccaaaaagataaggtttgttcgacatgaacaaagttattgtataaaaacccgggattgtcaattgattggactcataaaagtcgattggactcataaagtgcattagagccatttataaatgcaagaaaagagcaaaaactgacattaagaaaaattacaatgagaagacacgaaattaatcatttttcgagtatattcaagaataattttttttttgcatgttgcttttagcccatttaaactttcaattggtaccaagaaatatatggatttagcaagtaaagaaaaaagtgatggccaaagaaattgaggatggtcattgattgcacacacaaactgcaacagagccaaattttgtacaattttcgcgtcaaactttccattttaaatttcagcaaactcggcaatggccatcgaccttggctccgagtacatgaagatggcattgatcaaaccgggcgtgcccatggagacggtgctgaaccgcgaatctcaacgcaaaacgccaatggcactgaccatccgggacggggaacgcttcctgggcgacacggcacagaaaaaagtttgattttaatttttaaatttgctagtgcttgtatgaagtctctcgtcactctcttttcttggaccaaagcttttgtactacttgatttttagttcttttctgggtcactctgatcatgaatatggcattcattttggccaatacataacccgaattcgaatataagtctaaaactcgaaaaaaaattttttttgcaatccttttttgtttcaaaccgaaaaattctttgaaacgtaacaatcacaaataattaaaataaaacaaattggtactgagttgaacggctcggactttgttcatttcatcaaatggccgaatttgtggtacagaaaattgattttgaacaccatccactaccataattgtttggctttcttcaaaaaaactttttcgttttttcgctaatttttttgccatattttttttttgtttttttaggcacttggcatgccacggcacacttttgccttctttttggacttggtcggcaaacaaatggacgacccaattgtgcaagcgtttcaagccgaattcccacatttgacgctgaaagcgcatccggcacgaggcactgtccaatttgagacggagtgagttggggccaaatgagggcaaaatttggatttttaccaggcaatttgagtagatgttgggatgaggttcgataacaacctattagcaaaaaaaacaaaacatttttttacggttttcattttgaagcgttgcaaatttcgaaattttttagcttgccaattttttttttgccattttcagtgccggtgacctgtctgtggagtgtgcacttggcatggtcctgtccaatgcgaggcacgaggttcggctctaatttggccaaacaacacatttttctatatctttctcttttttgttctctgtctcctcggggttgtgccaaattccgtgcctttttgagaccgggtgaattacaaatttaatttttttttgtgtgaaaattcaaataaaaatcccggatgcatgcattttgcaactttttttttctgcaaattccgctgatttttaatgatccgctggcattttacacatttagaaaatgtatatttttcgtcctgggttcgctttttctctctttcctctctctctctctctctttctctttctctttctttctttccttcctctctttctttttctctctctgtttctctctcactctctcatctcccttccctctcaccatctcatttcatctcggacattggtaccatcctcttacatttttcctttctattttctctcctctctttgtctccctccccccctctctctctctctctctctctctcgtgacatttccttttctctccctaccattttctctgtctcaaattattttcagtgtgtataattcattaaaatttgcattaaaaggtggaggcatacgctggccaaacggtgcgcgacgcagtgatcacagtgccttcctatttcgggtagcgcattacgaaagcccttaaaattgcaattaatttggcaaatgtgatccgccatttttaaaggctcattgaacgggcggcggttgaagcggcggccaaaattgcggatttgaatctgttgcaattgatcggctccggcaccgccgccggactcaactacggcgtgtttcggcacaaagaaatcactgaacagccacaggtaatggtgttgccaacgccaacaaacacaccagggtgtggggctagtttcgtaggataaaaagcagaaaaatttgctgcattacagaaattccgacaccaaaaagtgtctgtatgtggattttttaaaaaaatttgatttttttagtctaaaaggtttttgaaattaaaatttttttgtatgaactgccatttaaccctttgtatttggcactgaaacaatcaaaaaaatttttaaattttttttttgattttttcacccccccctttttccattaaacagaggctgctcatctacgatgttggatcatcaaaaacgctggccactattgttcaatttcggcttgtcaacaatgacacggaagcagcaccaccgctaccagcaacagcaacaaacagcacaacgaccacagcgaagcgaaaagcaaccacaatttatccacaagtgcgtcgcgtgtggtttggcaggcctatagatttcaaaaaaaaatcgagggaggcaggttcttttatggtattcccaaaccccgaaaaatctttaaaaaatcattttgtaaaaagattttaggaaaaaatttcgaatttttctaatgcatttcaggaaacctttgagaaacttcgtaattcatgcgatgcattataaaattttgaaaaaatcacaaattttcttttaaatttttttacttaaattttgtttaaaagagttttaaggttttctttttgatttaaaaaaattctgggagagggtggggtggacggtgaaaaactgagaattccattattttccgctcctgcatttgttgcttaaggtggaaacgctcggcgtcggctacaaccgcacactgggcggtcgtcagttgacacttcgactccgggaccaccttgtccgcgcgttcaagcagcagcacccgtcaacgagcaataccgttgaacagaatttgagggcaatggccaaactgatgaaggaggccgaacgcgtcaaacaggttgaattttcagaaaaaaatattagaaaatttgacgaaaagaaaaaaaatttttttttttgattttcagcgacttgttttttttgggaaacatagccagtgggaatgccttctcggtggcgcctatcggcaccgccggtcagaaaatttgaattttaacgacaaaattcaaaaactagtacttttttttggcggaaaacagctacaaaaatttctgtttttttctctcggtcgctcacattagagaaaagcttttttggcccgaattgcaaaaaaaaaatcttcgggttccccctccgaatttttggtttttggttacgacttgaacatggcatcttacaataggagtaagtatcgcaattcctggtaattattcttatgatatttttggtgatttcataaatacgctcttttaaaacccatagattttgtcggcaaacacggaccattacgcccatgtggagagtgtgtttgaggaccgcgacttccgcgtcaaagtcacccgggacgagttggaggcgatgttccaagactttgagcaattccacatggagcccatcaccgacgcgttgcggatggcccaacttacggtggaccattggacgtgttgtgttgatgggtgccggcacacggatgccacgcctacagaccgtccctcgcacatttctccnagggggttggttggcactatttaaacgattgccagagtttggcgacatcggccagctttttttgtgccattgacccattcattttgacccaaaattncaagcctgtcagaaatggggaccggattaaaaaaagcgaaaacaatttttgggcagaaatggaaaaaaa

SEQ ID NO: 7360 - DNA, 6843 bp, Heterodera glycines
agggggaaatttaaaatttacacaatttccttagtgaaatcaatataaaattcaaaaaattttcccggcggcgcctatcagcaccgccggaccgcccgccacccccttccccaaaagccgagacaccccccatgtcccaatcgtccgtcgtatggccattgggctgagtttttaattgatatcaagcaaattaattattgaatttttcatgaattcactactttgctttatcacctttctccaaagttccttccggcgttctgacatttgaagaagtgcttgtcatttatcagtaccattcccatccggatatctatggagtgcccgaattgtacccaatgaaatttctgtgccatggacgtgtttctgattggaacattgccaagggcaacagagcgacatttccaatggaaattgagaaattgtcggaatttgcacgagtgaaagtggggagtaaacgttacagcgatgtcgttcaaataaagggattccaattgaaaataaaggcacaagttaaaatgaatgagcaaaacccagcgaaatgtttgggcatttatctttgttgtgccgcttcagaagatgcagaaaaaggtgattcaaaattaatttaggtaaatggtttattaaatttattaaaatgaaaattggagttgcaaatgttcggcaatattttgaattgtttcgcaaaagagcggcacgaacgatttaacaaggaaattaagttccgatttgtttaatgaagataacagctgtggatttttgtatttcattaacttttctgtgagtggcaaattagcttttttttaattgctcagaaattaaggaattaatggacgtgaccagaggattttacaaaaaagaggaggacaaagtgacattggccattgattttagcgtggaaggacgaggaagaatggaatcagaccgagactcagacaaatccgccgggaaaattgtgatggaaattggcaaattgtcatgacggcaaagaaaaaagtttgcgcatttacctctgttgtaccgcttcagaagatgaagaaggtgattcaaaattaatttagatcgtaccatgtgattatttggagaacaatggcgattctcaagggcaacattgcccaactgtcctctgcccaacttcgtcagcaaattttatccccccccctactgaccccttgcgttcggcgtcatcatgacccgacccaactgaccccttcgccctcctcccactcatttactatgcttcctatatacaaatcatcaaaataattcagtttcgaaatatttctcaaataaaaattattttttttaaggaacaagtaaaatccgtggttcaaataatccgtcagtggacaatccatcagtggaggacaatccgtcagtaatggataatctgtcagtggataatccgtcagtggacaattcgtcagaaaattttttttttgagcaatgatcaaaaattttgcaaaaattaatattaaatttaataaatattttttaatagattcttaacatttctagttacttaacattttaattaattgaccatctcgagaaattaccatttaattcttttaaaaatgattatttcataattaaaaaaaaataaaacaaattagtaattcacattttaacgacttaattaattttcacattattttaaataaatctggggtttttaaaaataaatttgcttatggattaattagtgacggattgtccactgacggattgaccactgacggattgtccggaccccaaatccctccgcagtcatttcttgcagtaattgtcgggttcatttatagcaacatcttttgtgaggcgacggcattggtaacgctgaccaaaacgcaataacaattatttttccaagtatgacatgttttaacagtatcccgcgggattaattccacaatctcacaaatttcgaaatttccaaaaaatgcaggattgcggactgggctcatccaataaaatcctgcgcggtatccaaatcccacaccggtttcatgacaaactcgtacaaaagacgctttggcctaggtttgcctgggcctaggtctaagcataggcaatttcttactgctatgacaaaacgaaaaaagtaatttaaaatccaacttaaaattcatacaaattttattttaagcgaatttaattttctattgcatcgcacgacgaaaaaacttttctccgccgaccattgcttaatttcatctgccacatttggtgaaaatcagcaccaatttcttgggtatatttgagacagaatttggataacaaatttcggtcaaaaattttattgctttcctaccgtttcgatgttttggtggacaaacattttgatggcaaaagcggattaacatttaaaataatatgaatttgccaagattgatggactaaaagcttgtgtgattgtgggtgagaatttttcgtccgctgctcaacaaaatttgctttaatctccttcagatagattaattcaaattcaaaagcattttttaaatttgcttgaatctccttctgattaagtactttaaaaaatgtaaagaattattaactgatgaaagtctcttcctttggcgacatgaaatttgggcaccagaggaaaggggatttgaataaaaataaaacaaaataaatatgtaaaatcttatataaaaatcatcaaatttattaaattttaaaaccctcgtgcttaaaaatttatattttcgtgaaaaattaaaaatgtaaatctgctgacaatcttattatttagtcaatgtgtccgtgacattcactggcgtcgcgataaaaaaacaaaactcatttgtcagtgaatggagtggcgccccgtcactttttgtgctgtggtcaaactgtttcaaaggccgccgtcgccacactgcacattcgtccataatgaccaatcaatttgcaaaaatagcgcggtcaaagctgctctccctccctatccgcggtcagtccattttccatctttttttccattattattttgagtttcgtgctttaaattcccagaaattattttgatcaaaattttgtaatcataaatttaaattacgattattatatgtatttaaaatctttgcatttttatgtatttattgtcccaaaacccacaaaattttctgcgcgcctcacccctgtgatctgtatcgcgatttaatatattagaacgaaaaaacaaaaattagtgagcaaaaacgagatacaccaattgaaatttgtctttaagtgttggagttttcctcattccattgagccgtctccccaatttagcattgcttcattttctattggctaacccatatccatttattttatttcatatgtcatgaaacattatccccctcaccgattagcaatttttttttattaatttaaaacttttgatttttttatttacttgtcccaaattgaaacaaaaaataaattaaacgagatttaaaattattctttgtgctcatctcttatcacattcaagcaatgtttattcaattacatccaaattaatgcatttaaatgatatttattggaaatgaatgaaattatgagtaaatgacattaaaggaataggagggaacaattattaattttgatattaaaattattaataaaattatgattaaatgattttaaaggaatattaagggaacaattattaaatttggaattaatattattaatgaaattatgagtaaatgacataagaggaataggagggaacaattattaattttgatattaaaattattaataaaattatgattaaatgattttaaaggatatgaagggaacaattattaaatttgttattaaatgttatttattatactccgtatcaaccctttaattcgataattagatcttggtcccggcggcttggccagtaaatttcaatgcctctggcttaataattttttattcattgtctgcgtattatgtagtatgtatagtttcgttgcataaaatagagacaactccccaattttcgtttgttaaaactagagcccgggcgcccgccgggcttttgccgagcagcccgccgggcacgataaattttcaaacaacaccggtcccgggccgcccggcaaaatcgggttttttagcttgcccgcccgggccctgtcattttgaccgggctaaaactggcttaaatttcgccaacgaaactgcccaaaaaattaagatttttggaaatttatacaatttcaactgtcgaaaaatagatttttctttgcggcgcctacatataggcaccgtcagagccaaaaatattcaaaattagtctaaaattagcaatttttggtgaaatctcttaaatggatgcattacgtttatttaataatttattattattaaatattttttaaatattaaactataatcagaactggagttttatgtgccaaaaaatttttaatcaaaaaatttgttaaaataatgctcctaattatttgccagattttgaaattcataataaacaatgattttgacttaatttcccgatgagatttttgtcaattaatattttccacccaaattaaattatttttaaattttcagcaatttgtcaaaaaatgtgaaagtttttttgttgctttaataagaaacgaatcatttttggtgagtaccggctaaattccttcttttttttgccggtgatgattttaaaataacaccagggattcgtatgaaattttcaaatccttttttaaaatataatctgtggtcaaaaagggcttttgtcatctaaaaattgttggtttaacttttgaacatattaaaatagcaacaaaaaatcctagttccgttaaattatttttataaattttgtttaattattaaaacacaccggaatatgcatgcaggaaagaagtgcctagctctgtgacaataatgcacccagtgcgctgcgcgagactaaaatttagtaattaaaaacagctaatttctgtttttcaattcctgcctttctttctgcgtagtgttaattttaatggaaaataagcgcaaaagaaagaataaatattcgttgggcagttgtgcttccaaaatattcggcaacattcttcgccggaagctgaaaataatccattattttttaaatatatgaattattaaatggaaaattgcccttttcaaccccgtacattatttaaaataaaatttgcgaattgttttagcaactctaaacaataaattagggatggcatttttatgcaaaaaatcacaaaacggcattaaatatgcacaaaaacggcaattaaaattttgtcattgatttttatttaagaaaaaacaaaacaatttgcttttcatgcttatctgagcgtgccaagtgaacagaagtttacaaaatgccatccctggacaaatggtttttatattcatatgcccaattaatgtttttgtccattttgacactggctctaactgcacccaaatctttgtaaaaacaaatcattactgtagttcaatggaaacggacgacgtcttaaattccaacaaattgcggttgttaaaatattcccagaagtgcagatcacatgctaatgttgccctatttcttgccctggcttcagcaacaataaattgccaaattgtaatctcttcccgaacaccaaaattatagcgttgctcagggcacaaattcttaggagttgagttgctaaacaaaaaatcagttagcgctttctacaataagctctgctgtctcaagctcaggtagttgcatggagtgctgggacgtttcatgagcgctaaaattatcaaagagccgaaaatcgcatgtgatctaagcctagcaaaaaatggtgcaagtaaaaatcgcaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaatcgtaattacgctcaaaaagcttctcaaacaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagctcctcaaacaattttagcgcttccaattccttctacaatcgcctttatacatcccattatgagcgctaaaattatcagagtgccgaaaatcgcatgtgatctaagcctagcaaaaaatggtgtaagtaaaatcgtaattacgctcaaaaagcttctcaaacaattttagcgcttccaattccttctacaatcgcctttatacatcccattatgaacgctaaaattatcagagtgccgaaaatcgcatgtgatctaagcctagcaaaaaatggtgtaagtaaaaatcgtaattacgctcaaaaagcttttcaaacaattttagcgcttacaattccttctacaatcgcctttatacatcccattatgagcgctaaaattatcagagtgccgaaaatcgcatgtgatctaagcctagcaaaaaatggtgtaagtaaaaatcgtaattacgctcaaaaagctcctcaaacattttagcgcttccaattcctctacaatcgcccttatacatcccattatgacgctaaattatc

SEQ ID NO: 7361 - DNA, 1364 bp, Heterodera glycines
  misc_feature (1300)..(1300): n is a, c, g, or t
  misc_feature (1332)..(1332): n is a, c, g, or t
tgaagtttaattttttcagaagtctgatatctgatcatccaatttccagaacttgatttatggcgactttattcagaatcggagtttcaatttcccatttttaagacattaatgtttttcataatgtttttttttcgcggaataatcgggtccttccttcactgaactgataacacaaaaaatcaaatttttatctgataggtgaaaaattttaaactctattaaatggaaatttcaaaaaaaaattaataaattaaaaaataattaaatttgaatgataaaatttagtgacgaagaaagttgtgcaccacgtgaaggccattgtgcacaagaccagttcaagtgccatacatcgggcatttgtataccaggcacatggaaatggtaaataaatatttgttttaaaattattattaattgaattatggttaattcaattaatttttctgtactatgcacgccacctacaatgtaaaacacatcgctcaaatttattttgatgcaaaattaaaactgatttcagttttctcaatttcttcgagtatttttttagtaataaatttttttattattttgaaattggattttaaaatacaaaaaaaatattaataaaattcttttaaaaaactatttttaatttcttacaagaagaaaaaagtcataagaaatttaaaaaaaaatcttttaaagtaattttctgttatgaatgtacaaattaataggtacataggtatgccaaaaattctttaattaattgattatgtcattattattaattacagtgatggccaattggactgtgacgatggaagtgatgagccccgagcgacctgtgaggagatgcacagcacatgccccgctggtcatttccggtgcaacaatggacggtgcattttctcggtgactattgaacaattaattaatttaacatatcttaatttatgttaggtttaattttattcaaaaaacatcaaaattaaaattatttttttaattgcttaaaaaaatttgtaaatcaatttcttaacaaaaatgcattaaaaattcaaaaatttcccggaacctccattttatcttatttttttaaattttcgatagccttttaaactccattatcctgcaaaatttctcaaaaaatttctttaacttccaaacaaatttttggagtttaaatttttgacaatttgcagtttcatcttctggttttctgcatttttcagcttcgagttctagttttactaattgataagagtcattttggtaattaattccaaatttccaattattatttttcatttanaaatacatatcagttaaaagagacaaatcatntacattggatcgagatgattatgtgcccaatt

SEQ ID NO: 7362 - DNA, 6902 bp, Heterodera glycines
  misc_feature (67)..(67): n is a, c, g, or t
gatgaaggtggtcgatgctcacgcggtaagcgttgaaaatcgaggcatgatcaaaaaggatcagttntgtgatactcgagattctcgagcgatttatcagtctcgggtctgatcatgtttatcacattattgatctgattcgattgattattgcagatttgtgtgtggctgatcgtgccgggtgccaatacaaatgccacaattcacccgaaggaccaatctgttcatgtccgttgggcgaacagctgatcaacaaggtcaatcaatttaaaattttggcaaatttaaatgacatcgaaatattatttaattttcttaaaatctcccatctcgtaaatgttgaggatggcaaacaaagttttaaaaataattactatttccaaaagcacgataaattaccgtaatgagagtgaattttaatgagtttccattaaaaatatttgctttttttagacaaaatgtgagccagaaaatgagtgccttgacccaagaacatggtatgtaattttgcaaaaatattacacaccgtatgccaataataatactaccgtattgtgtacagttctcaacactgtacggacgagaagcacggtttccggtgcagttgtgatccggcatatgagcttgagccggacaagcggacctgcaaggtgacagaaaaccgtgcggacatgcgtgtgtacgtgtccaacaggaatcggcacgtttttagtggctattggctatgttaattattaatttaaaaaatcaatttaaataattttattcattttctttttttttcataaatttcttccgatttagcatttattggtcggacagttcgctggagaattggcgcacttttgctgcacaagtgaagaaatgattgattaatataataagcatatacaaaatttcaaatttttttctcgatttcaaatagaaatttttaaaattaacaaaatttattttctttttcaaataataaataatttagttttttgaacctttttaaagagaaaatgcaatttaaaattttcttaacaaattttgctaaaatttctaaaaaaattttcatgcggctcctatcagaatcaccaaaccatcctttgatttttttcaaaattttaccctaagttttaaaattttggaaaatttaaagttttataaaaaataaaataaaaattgagttttgccattaaatacaatcatggtggcacaacatgcaggtggagaatgcggtggcattggcctgggactcagtggacgaccgtatctactggtccgacatccgggacaaacgcatctacagtgccacccggaacggcaccgacgtgcagacattcatcggcatcgggctggacatcacggagggcattgcggtggactgggtgggccgcaacctgtactgggtggactcctcgttgaacaccatcgaaattgccagcctgcaaaagccgggaggtgaaatataaaaaattcaaaaagtgccagaaatcgtgactaggcatgtataaataaattcagtgttttcttggcctttgtccaaaaaatagaggcctagagataaagcatgaaaccatagaatttaaatccctggatccagtgtgacatgcctggtttttcaggacctagacacatgcaagcctacaggctttttttcaaacttacacattttcaagaagaaagaaatcagaaatttttttaaaaatattttctgcgatttttaggaaatttttttgaaaaacttagtaattcatcaaaaattcttttatctttctttatatgcttaatttgtttttcgaacagttcgtgccgttctgctccatgacgacattgatcagccccgagggttggccgtcgacccgcgcgtggcactgatgttttggaccgactggggccaacacccgcgcattgagcgtgccaacatggacggcacgggccgaaccattttggtgaacacaaaaatttattggcccaactcaattgcgctcgacttcaccacaaatcgtgtgtattttgctgactcaaagctggactacatcgactttgtcaattatgacggaaaaggtacggtgtgtgaaagccttactataatcaatgagttttccatccaaaatcaaaaacaaatggattaggattaaaaatgttattcttcaagacatatgacaaatcaggacagattttaaaaataaaaatcatttttaaattgactaactcatgctttttcgaaattaaagttacaacaaaaattaattgcgaaatatttggagaaaaatgggggggggaaacagaatatggaagaataaagagaaatggtaattggaaaattctataaaagaaaaaattaagcaaaggaaagaaaacagcaaaaaaaaaagagaaaagaatggagaaaaaatgaacgaaaaatcggatgaaaattaaaaattgaacgacacttataaacggattaaagagttttggctttttcaacggcgccagaattaagcaaataaataatctgaagaaaaccctgtttttttttttttttgcaggtcgtacccaagttattgcaaacagcaaatttgttcaacacccacacgcaatgtcaatctttgaggacttcatttactacagcgatcggtgcgtttgagtttgttccaagttatccctgaaccctaaatagtgttccacttttttttaatcccgacatttataccaaaaatttccgtcccccggcatctctaatatccggcatttatcccttaaatttcggtcccagtcaaatctccgaaaacccgggaattttttaaaccgaaatccagtcccagaaattttatccatcaattatctccaaatctctgacattttcccaggcatttttccataaaatctcagagtttcagaatttatccctgtcatcggcattttaatttccaaaagctgggatcaaaccctttttcattcatgtcattgattacaacaattcagacgactgcaacgtctgcaactgtatccgaaatacccgaacggcaccaaccaagattatccgtcccacacattctccaaggcacttggcgttgtcactgttcaccccgttttgcagccaaagctgatgacaacaagcgcatgttccgtctcgccaatcccatgctcgcacatttgtgcgcttggcaacaacggcacatacacatgcatttgccctagcggaatggtgctggacacggacaagcaccgctgcgttgctgaccatcgtccgttcctgttgatggtaagttttcttggtggggaaacttggtgtgatcggacaatgtcaaaaaaaaaaaaattttttcatggcacacacacacacacacttattgttattcgacattctcggtcaggactcgaataaggtctctctgttttttggtcttgactcaagaaagtcctgaatattttggtttcggtctcgagtctcgacttgagcaaaggttggtctcagggccaaatatcggtctttcattttggaaagtttgtagtctcgaacggctctaataccagggggaatggcttattaaattcggagaaatctttgttttttagtttttccatcagtttctctcaaatctttttttcaagtatacagtatccgctttgaacttattaaaccaccgtaattactgcaaaataaaaaaattgcctaggtcacgaaagtcatattaaaattagatggattcgagggctgattatttcaaatattactaaaaacaaatttcacaggtattcaaaacgatgatcaccggcacatcgttggccggcggcgcaaaagacagcacggcaaaacaacgtgccgaaatggccggcattacaccaatcagtggcttacagaatgcgcatgatgccgactttgatgcccaaacacagaaattgttccacctggagcatggcagcatggcaaggctggtcatggccacagtgatctcggatgcacgaatttacaaaagtgggtttcttggagtgatggatgcttctaagtagtatttcggcactctaaatactgtattgtatcaggaaaatatggtatgtgttgtgtcgtgcgattggcacaacaaaatattagaatacaatatttattcaaaaagtaaaagtggagaacgaagtgatgagtcagaggaattaatcaataactggtgaaggagcagatgccattgctgctgtgtgtgttgacaaaatgaatgaataaggaaaagaccatgagtgaacgaagtccacttattaaatggacaataattgggtgatacagtataacaataaatgatcatcatttggcgtgaatttaaatatataataaattcactacacaacagtatgtatgattcagtaacagaattaagtaacgttttgcactacgaaacgggaaataaccttatgatattcaggaatattattataatagaggaatacaataatatcacgaatgggaatacagtactattacaatttgtatatttggatgaccaagaaatattagatttccacctaaactgttgatccaggcctcaatttcctgggtcctttccaatttatttttttcgtcaatcaagggttttttaggtctggattttcctgtattttttctgtccaaaaatccaggcctaggtccaatatttgtacaggtccaatctaggcttttttgtctaatatttaaataatttttaagctgaactgctgacaaacaatcgcactcagctgttgacggctcaaattccgaatgacccattttgcatggcgtacgattggaacgggcgcaatttgtacgtcggcaacaaaatttcgcaaactatcgaagttgtgcggacggaaggcgaacaggtggaaattaaaaaatttattaaatatttcatatataaaatttgtaaatatttggaaaaaaatggttctaataaaaactaataatagttgaaataatttctttttttttttttgttttcttcattaatttataaataaattaggaaattttatataaaataatttgcgaaaacaaaatctgatttaagccaatcaaaaaggattcttattttcaaatatgtcctgatttttcagcttgtccttcggaatatgaattttataaaaaaattttctgattcaaaaaaggttatattgcaataatattttattgattttcaataaaaatcatcctctccctctgatcaacaacagttccgggcggtgatcctgcacaatgatcaaacaccgaccgcggttgcgcaacccattgccattgcggtggattctgatcggggcctgctgttttggcttgaccaaggcaagggcggtgtggccacaaaggtggcacgtgccgacatggacggcggcaacccattggtgttggtgaacatcgacctggccgagctggaccacctggcgctggacacggtcaaccaccgggtgtacttcacggaggccaaagctggaagataaggacactaaaactaaaaaaaataatagcttttaagtcaaaatgcccatttcactcttaacagggacaaattcaaaaaaatttaaaaaaccaatttatacaagagccatttcccctaaataataaattattaaaaaatattttttaatatgtacttatttcgatgatttaaaaatttcttcgttaagttgtgcgtttccttgaattttatgtccttgaaaaaaattttttaggttttttttttgcaaaattaaaaaaaagttcattcttttgaaaattaaaatcggtgaataaattgttaaagcaattttaatttcattttacagaaaaaaaaaaattcttattttaaaattttataccatttttttgccatttttcgctttttttgccaatgttgtcattatttaattaaatatttttgggcttttgccactgaaaaccccacacctttctcatcaataacaaaaacacttaattaagggtttttaataattttttcttattcttttaatttttaatgatttgtatttttgcatttttacgatcaccagcgtgtcgtatgaaggacaggacaagcactatttgctgaacgatccggcaaaacagccgcgtgccattgccttcttcaacaaccgcattttgtactccgactcggcatttgacaaaatatttgccggcgaatttgttggcgatgagcaaccgcccgaattttccgaattccgtgccaatgttgaacagttgaacaacctgaaaatcatccaccccagcacggaaaagcatccttggtaaaaaaaaagaagaagaaaatttttgtgttatttgtttaatgtccatggaaaattacttggcttttatatacaagggggaggggttaaccaaaatttttacatttaaaaattcaaaaaaaaaaattggggaaggagggccgaggggggggggggcggcagtgccaacaattgctgccggaagattttgaaaattttgctacgatttattaacagacttccagcaaaaatgtcaattttaaaatttttggaagtttgaatccgtggtgccttagaaaatttttggaattttttcaagaaaatttacttcttgatttggttgagtttcttgcctaatttttaaaataaaatcagaatccctgataaaattctgacagagggtcctgtctttttagggctctactgtcaactaatagccatattaattataatgggcaattaaattttacggataatatatgctatgaaaaagctaggatgagaataatgccatcatgacatgaacaaaataatattattgtcttcttccttacaattttttaccgtaattcatcaatttgtacaccgactttaccgtatcctccacccattttttaagccatgaaaacaacggtaattgtgatcagctctgcattcctggacagcgcggggaaattcacatgcttgtgcggtaccagtttcacgctgga

SEQ ID NO: 7363 - DNA, 1332 bp, Heterodera glycines
attgattttggctgtctttgtccccccgggcgctttctgttcatcaatacagatgagtattttactttatcataatgtgtacttcgtcgtgtgttaataattaattgacaatttgatgatgacggactagcggtgaagaagaagaagaagtggccaattggagcaattagaacattaaaacaattttattatttgttatttttttatgcaacaaatattaataaaaatatatgtttttatttatttatttttattcatttattttacatatttttggggtctattttttataattgaaaaccagaaatatttccttgaaaaattaaaaaagagccccctcccttgaaatactcccctcctcctttgagtgaggttgaaaaatagaggcctaattcattaagtattcttaatttttaatattctaacaagaaaaaaccaaaaattcaagatttgttttttacatttcattttcaaaaaaaacaatttttttttttttttgagaaattcggtttttttttgtaggcaaaaacgaggaaaatggcgggggggggggaggcaaccagcattcacaacagatccccctgattaaccgaatatattttacataaaaaaatattttatgccaaaaatagtcaaacaaatgtctgacgaaattggcaacattttgtcccattacaaatgccaaccccaacaacagtcttcgaccgctgattgtggtggtagtactgtttcggcacgacttatgcctgctgatggtcaaccaccagaagtgccatcgtcgccggttgtgccattggcattggctgcagcacccattgacaattccttccagccaaagcatttaacagcggttgccaatttggacgatttgtcgggcgatgaggagggcaacttggtgcgcaacttgtccgccacggtgtgtatgtgcgtgtggatttggcggtggggttcaactgagccccgccaactgggccccaaccaactcgggcttccggaccaactgggccccgctaactgagcgccaaaaatcattgcttgacaatatgaagcaaaaaatatgactggctcatggtgtcgagttgatccggggcccagttggttgagctatcggaaggcccagttgaccaagtccgttggtttggaattttggaatttggacaagaaaaaagtttttgtctctttcgaatatttaaaaaaaataaaattcgggaaattaaaaaaaatatgcccctttttgtggaaatataatcatttttatatttcagtttttgtacgaaaacaattataagcacttttgagttccttctggccataacttttttaaatttaacg

SEQ ID NO: 7364 - DNA, 3032 bp, Heterodera glycines
caaatttccgttttcaaaatttgctgtaaaaaattcaaatttgcagcgattggcggaaatgcacgcggaacgcgagacaaacaatgccttgcaaccagccccagcagcagcagcgcaacaacaattagcagcagccggccgaagacggctgtccaccgtatgcgaggatggtacgcatttgcatggaaaaccggtggcattgcatgactcacgggtgctggtactgtacacgggaggtgggtgaggaattgctaatatattcgagaggtgaatgaggaatcattactgtatacacaaggctaactggggaattcttactgtagattgtggggcggagcggtggggaataatattatagtaccggcatgtgagaattattattgttcatgggactgggtcatgaattccaagtatacgcttgataggaattacggcacccagttcgcgagggtttttttgtcatgttaattataaaaaaaaccatttttcactcaaaaatgtttttcaggcacaattgggatgcgcgcgtgccatgatggaggtgcggtaaatttaaatacctaatttttacagtgcaattaacttattaaatagggacacccaagagtttgtccacttggcgaaaacaaaaagagctaataccaatagtacaattctaataaattaagagataaaaattgaaaatatttctcaatgtttgattgttctagaaaaaatgaattcatttcaaaaaattccagaattaccaaaaaaaaaatcactaaaaatttagctggttcgttcttttcatacatagaaaatgagatcattttgtttttagtattttcaaaagttaataattattaagaatctctgaatacccctttaaaatgatccgttgttaaattctttcccaaactcttttttttaaatttatattcattattttcaccgacgaatttttgattgcttttgttcggattgttattttcaatttattattatcactttttctataaaaaactcatttttttaaataaaatccatcaaataaagtagggctttaatcccctttccccgcaatttggtccccgtcgttccccggtttggccgggacccctcctgctgcctataagctttaaaaattcaatatcgcgcatagtttacgcgcctgagcagtactatttgccgcgtgccatccgcgacattccgccgctcaacgacaaggagtacgctgatcggatgtacgcggatttgccgctgaagccgctctgtttgccgcccgtgcacgggatgaacaagcgggtggtgtattgggtaaggacggcgaatgaaatcctactcaaaaaaatgcggaatctccgaccttaaccgaagttcgggcaaagaggattttggcaaaattggatttatccgacttttcagttggtcgaatatgaaccgctgttggattcgtccgacatgacttttgacgattggatacgaattgccaaagtttgtacggagaattgatgatgctcgaccgaaaaacttctcaagatcgaagcactaacaatcttccaatggaacaaaccgaattgtactgcccaaatcgcattaaatcgatttactattgcaaattttcggttttttttgtctccagcggccaaaattgatcagacaaaacgagaaagatctaaaaaaatcgaatcataaaaaagcaaaaattaagctagagttattaaattatttttttaatattagcaaaaaaattaattgaataaaaaggaaaatcgcattatttcttatcacttttggcgccggattcccaaaaagccgaaaatttacaattaagcaaatcaactaccttcaacagataaaagaaagtgatttgggcagtcacacttcgggatgctccattataagcaaataaagatgaagatcagggctgcaagcaaatacggattacggaaattacgggggtttttggacccctgttatgacggattacgggtttctttaattgagaaaatcaccgtaaatactgattacggatttccgtaattgaaatcccagttggatatggaaaaacaaaaactaaaaatactgatgagccttaaaagccgagtccttctcaagtcggaagaccggcgagaagactctcgagtatcatttcagcactgaatgttgaatggcactttaaaattggttaaaatttgcaggacattcgcaagtcgtattctgcctacgacggattcgttgtggtcatttttttacatcatttttaattttatttaaatattatttattaaatttgtatatcaatcaaacagctccacggcaccgacacattggcatatacggcatgcgcattgtcatttatgatggaaaacttgggcaaaccggtggtgatcacgggtgcccaggtacttgaatatatatgggtgcccaatatggacaaaatgtacccagaccaactcattttagattgatcaaataattagatcgaacctaaaaaagtattaataattgtaatattaaattaattattatttgcattttatttccaaaataataaatcataacttagctcaaacttattgaaatttgaactgaataataaagaattatgtatctttgaaatctatttaatcatagattgatttctgaaaaaagttatatataaattaaatgtatcatattttatggtcaaaccaaaaatttcagtacgttttatcgcttaaaattctgcaaataaaataaataataattaaatttacatatcaattaattccaaatcatgtcgtatcaatagattttcatattatccaatcacagttaattcatctcttgggattaatttattttcaaatattttagtaaaaataaacaaatttagtctaaagcgaaaattcgcagattccggtggcagaagtccgatcagatgggcgtgaaaatatgatcggtgcactgattgttgcaggcaatttggacattccggaagtgcgtttttaaacatgccaaaattggggagtgtggaaatgttttctttttaattaattttaggtttgtgt

SEQ ID NO: 7365 - DNA, 2030 bp, Heterodera glycines
ccttttcaaaaaatgtaataaatccaaattaatcccacttaaaacggacttttttcataatcaaaatttttaattacatcctaaatttgggaattaattagacaccgcaccaaaaattttatgatttaaaaaatcaattaaatctaaaaatatttaggcttttgcgcggcaaccgttccataaaggtcgtgtcgttgatcatttgggggttatggccaaaaatggtagtttatatgtttgttcaaggtggacaaccacggcctggaggcgtttgacagtccgaacatggcaccgttggccaccttggacatcaccatcaacggcatggctaaccaatcagcgatttttgggcacaaaaaatttttcaaataaattttcagtgaattatgagtccatttttcgcagtggccaacttcggcctttcactgtgcaagaatcgttgtgccgaaatgttgttgtgctacgcattttcccttctatgcccattgaatcggtgcaatttcaaatcttaaaatttttgttacagtaatcgaatacagtaatggaactgatgtcgcaatttttaaaaaatgccctttggcgctgtgtaaaaaatcgtaattttccaacacttagtattaagatgctaaatttttgaaactttgcttagcccacaggctaattcggcatgtaaagcctttcgagttcatttccatattggttacaaaaaagattttattgttgacttttttgcttaaaatcaaaataatttttaatttgtgataaatgcggcactctccccccttgtgcctatgtgccagtggaggataacgaattaaatttttatttgaattaagtcatttttatttattatttcgtaataattaatttttataaatcaaaaaattaaattttaaatttttattattcttgtcactcatctttatatttaaaattcttccccttcaaaatgccataaaaatttttaaaatttaaatgtgccaaattcttctcttttttttctcaatttccatttttttggtccgcgctttgctccgtccgccaacccgtggcgttgtgctgcaggcgtacggctcgggcaacattccgctccgtcgggaggacattctgcaggaaatccgtgccgcggtccaacggggctgtctggtggtgaacgtgtcacagtgcgccaagggacacgtggcggtggattatttgacgggaaaggtggccaaagttagaggggaaagcatatattaagcctgagcaaatccgggccaaaaaatggaaattttagtctttgggctacgatggtggcgctaggcgccgtcggcaaaattttgaaatttcaatgaaatcttcaaaaaaaaggttcctttaaatttaaacttagcttgtttcatttcaatgatttttcgtacataaatttttaaaagcttaaaaaactactcgataaaaaagtcaaatatttttttaaataaacgataaaatcaaaaaggaattaaaacgaaaatttcagaaaaaagaaaaattaattcgtttaagaaaaaaataacttatataaaagtacgataaaataaagtcaagtcaaatatattttttcaaataaacgttaaaaaccaaaaaggattaaaactaaaatttttcgaaaaaataaaaattatttatttgaaggtttttcctgcccaacttacttttttcctaatatttagaaaaaaagtctattttttcaagataaaatattttttattttaattattcttcatgttttttgggtatcattctcgactctcgcggtcaattaattctcggtctttgttttcatgtctcataaaatttcaactctcgagctgcccccaatattttcggcaaattttgtgtttttgttttaaggtattggacgatgccggcgtcattttcggctccgacatgaccaccgaggcggcgttgaccaaattggcctacgttttggcaaaacaggagtggaacattgagcagaaagtagcggtaatgttgtatttaaataaataatttggatataaaaatgtaaa

SEQ ID NO: 7366 - DNA, 1031 bp, Heterodera glycines
caaataattaaaaaatgaggaaaaatacggcgcattttatgctttttatttggtagtaaaacaacggataagaaaaaagttattccaaaattcctgaaaaatttcgaattttcggaaaaaatttcataacttccttcatattaggggtactggcaatatcgaataatgataaaatccgtaatattaagattatttttatgctttttatgaaaaaaccgatttgtcatttttggacaaaatcttttaagaaatacaaccaaaatttaaaaaaaattttctgtcggcgcccccgctttctcccagaagatatttcctaattcgagacgagaaaaagtcgggatcggtactcggaaagatttggaaatgtatttattacactgttctatcttaaattttttttggtgaacatatttttgattaaaaaattgtgaagttaaaaatactaaaaattataaaaaacatattaatttatatgttttatatgcctcaaacaaaaaaaaagcaaaaaattcataattctcgcaaaaaaaatttcgacattttgtcagacttgtcgacactttgtcccaccctccccgaacattgttagatctgccaagacattgtctaaaccgtttaaaaccccattatccctgctctccgaacccatttacccccaaaccccgcactcccagcaaaatccgcccattttgagcagttttccggacaaatgacctgctcaacctggggctagggggccaaattttttttttaaatgttcgcctcggcgagctctacaataatagccaatagcgccgggcctaccaatccaacaaaccaccgcttcccccggcactaactttttaagacccccaaccaccccaggggctaaagggggtccgcccctttcacttaatgctggcgcgccaattttttttttaaaagacgcggcacccctaagagcatcttttcataagcaacacacaaaaccgccccaacacttgaacatatgcaaaaatcgaaaaagtggcaaaaaaaaccaaattcaaaaa

SEQ ID NO: 7367 - DNA, 5917 bp, Heterodera glycines
  misc_feature (82)..(82): n is a, c, g, or t
  misc_feature (4067)..(4067): n is a, c, g, or t
  misc_feature (5268)..(5268): n is a, c, g, or t
tttgaagagcttgagttttatagtccaaaaaatgaccaaattttgccacaaatcttatgtaccgtatatgctctaattatancccatgggggatattttttcaactccctcagaaaaggggggataattagagactgggggattatgatagagggattatttttcaaaacacctcgtagactgggggataattggagactgcgggattaatagagactgggctataattagagcatatacggtatattttcttgataaaatagtgacattctgtcataaaatttcaaaattgtgagtatgaaatcaggacaaaattgggtcactactagagcccgtaaatttcaaatttgcggatcctgttgcaggattggaattcaaaaattttttcaggaccggatccggccggattaatcctgcaaatcatgcattttaaatttgcaggatcccgcgcaggattgcggattcttagaaattttgaaaaaatttgaatgaaatttccaaaaaaatacctgacaagaaattttaggggctggcgagatgcattaaaaaggcgactaagatttttcgaatgggtcagacggtaaaaagagatcggaaatcaaatctattaatggtcaataaatttgactattttttacttttcaaaaaattaattaactgattttgaccaaaaaatgaccaaatgtcacaccttttgactcaattctacaggattaatgtcgatccagtggtgtcgataggcgccgccgggaaattttttttgcaaattctaggtgaaatttgagatgaaaattgaatttattttgattgatttattataaatttattcaaaaattttggcattccgtcttttaacattttcaaagaatgtatgcggatcctgccggatcccgcacaaaaatcaaatttgcggatcctgttgcaggattggaattcaaaattttttgccggaccggatccggccggattattcctgcaatcctgcattttcaaaaaaattcaggattgcggactgggatcctgcaaaatcctgcgcaggatccggtcctgttccgggctctaattaatattgcttatttttgaacaattttaagtttgtgccatatgcaaatttttttaaaacgttataaaaaaaattacatttcttttctcttttcttagcattaaaatatttaacttaaatgtattgaaatagccttaggatgtaatttttaggttttttttcctgagctccttgtggcctggaacgcacgaaaaacttattactgcctattttctaggtttttaacatacataaaaactaaaaaattttgaaaaaatctactttggcgttacaaaatataataaaaaatgaaaatgcaaggaaaaatacacacttaagaatcgatctaaatttttcaaaaaacacccctaagaaccgacccgaaaattttaaaaatacacttgttatccggggttttagaggccgctgatcacgaatctgacatctaattcgaggtcatggaccccaagaaccccatggaaaaaattttcatgactatatatcaaaaaaatttgcaaaacaaaagtgtcccctttttgtttttacttttgataaaattcaaaatcggtaactttccatatagcgccaaatgtacttacatgaacttttcatccctattaatcactaatcatgcttgaagatcattaattaatttatttagcaaataattgctttgtaatggttgaacaaatagttgaatatagagacgatatcactttcgcagtcaaattggatgttttggagaccggcaaagttgttgtgtcgccaaaaaagaatatcggccatcttctctggtgagtaaatttttctttttttttcaataaaatcttaattttaggtccataaaaatcatgaaatacaattcctcaaaacatagtaggcgtaggtttatccgctactatgttcaattcgagcggcaggccgatgggagtcctgcagaatttaaggttttttttcttaagaatttggacaatcgaatgatatttaaaaattaatcgcttttgaacaaaatttatattttgatattttttgaataacaggttaaacaccgttatttattattcagttggatgcttatttggattcatgtgctataacaaaaccggatcgagctcccgaacacgactaccaatacacgtggagttgtgagccgttgcgatttgaaagcatcaaaagcgatgagctgacttggcattctgagtggcgttggatgaacttggacgcacttcgcaatacggaaaacgaatttttggatgaccagggccgaatccatttgtgggcgagggtggacattttcgaactttctaattacgggtaggttttaaacagccctacaactaatctttacgtgtgatttagacgcgctgataagccagacctattaacagtgaatggtcgaactttccgagtgaataaatacgtaatcaaacttcgtgctgaattcattttactatgtttttcagattttggctggcttttccccattttttcgcactttctttttcaaggacggcttcaaagaattccttactcagaacttcgagattcgagaccccgaggtggatgccgacatgtttggtcgtatgctcgacattgttatgactcaagaccaatacgacccggatggtgggtttggaggccatgtttatttacacgaatctcaatctccgacttgacagatgaaactgtggaaggcttgcttcacttagccgacaaatacgaccttgcttgtgtgaaagaagtttgcgagaaattcctcatggattacagtgaacagtcgcgcattttcaaatttcggatggcggaagcttacggacttgtcgccttaaaagtaaggaggacaaaatttttaatctactagtttgtagtgggtttgatcgacgaccgatcctctgtattttattcatttttttccaaaaagcataaaccgttttttcttgcctaaatttgagtgataattaaaaaaatttgcagtgtctgatttttggaaggtgggttgttttcgaaaattaacagtgaagaagctaacacgtttatcccgcgttaaatcggaatgtttgaacatcgttcctctatatttaactatgcattttttgttaccgttcgcaccccttctagcaaattcccccctcttatgctttcctcttacaaattaggcccgtaacaataaaaaggcgagataggttaattgctttattttgtagttaatccatctcaacaatttttttttcattaagggtcaaacattacggagaatggacccgcaggagttttgtgccaattttcttgccaatgtcaacgaattcgccaaactcagcgaaagatccaagcgcacttgggacaggcgcatgggcgacttcagttttggtcgttcttcggcttttccatgttacaactgccggaagcgtcggcgagtgttttcgcccgagccaaacattcatttgtccatcggtgattatacggcacgctcgcgcacagtctcttccactcacacggcaagcattcgcactttgtcccggtcaacttcttacgatggccaagcgagtaacgacgacaattcatccatttaccatccgccaacggaggcctccttttctgcatagcaacaaacgcccagaaccacaaacattgcccctcatagttgggcaccctctgattttgcgtgtgtttttcttagatgcaaagaaagtcaagtcgaatgttcagtgattcatttatttatttctgaaattttgctcgcataattgttcaaacacatttattttgatctaatattccgtattacttaataattttagtgttcactcagaacgagaaaattgtgtattatgataaacgcattgaggaaaaaatttgttgcgactgacgaaggcgcagaaccaaaattgggttagttagtgtataaaataagatcggctaggaaaaagggactcttcgaatggttacttactaaaaaaacagcctttcttttgtacgacttgatttatgatagtattttttggttactcatttaacctccactccnttttgattagcatgcactaatcgtcggacgaacatttctgctaattacccttttcccgctggtgttaacctcgttggagccgaattgcaacggaaatttgccactggcattgattacaacagttgaattttgggaattttctgaaaaaattaccgtattagtgaaaattttgatccgtggcgaccgaaacaccggcaaaacttccctttggagtcggttgcagggaatgccatttcggcatgaagaggagggcgactcgtacacccaaacggaagagattcaggtgggaatctgaaacggcaaagaaaatggccctggagggggggggggattggtaccagggaaggagttccgaggccctaaaaaattgcagaaatcggacttattccccaaaattcagggacaattccctgcataaatttgtatttaaatttattggaccatttgggtgaattaaactccttccgtcaactaatcttttgaggtcgcttcgatcacatggaattatcgtgcccatgatttcgttgtcaaattggacatttgggatgttgtggacaagggacgtcgtgccgacccttcgaccggtgcggcggctcctctcaaattgggattttctcgcaaaaatgcttatcaatcggccaaatgttccgttgacattccctcggctgtccaagaagtggtaaatgagaaattaggcccgaattttttgaatattgttggccaaataacagctgtaagccaccagaattgtcattaaattaatcattttctcttaaattgacttgatttatgcctttttgaagattcaaaacgctgcttgtgatgcgagcactgtgaacgtttacaacggctgtgacggagtcgtcatgttattcgacgtgaccagagattggtcagaggcgggggggggggggaggcgtacaacaaagatcaatcgctcgctgtttttaattaccgcattttcatgtttttctgactgtgttttgtgtaggacctgggcttacatccgtcgcgaattgccctcagtgccggcccatattcccgtgttggtaatggccaacaaaatggacctgatcagtgctgctgatcagccactgccttacaccatcggcgaatgtctccaatttcttcgcgttttcaatgaacggtggggaggagcacacatttaaagggcggggggggagttgaggggccgaatggnttttagcattgggtttcggttaccctcccccctctgttaaatttgacattttaggtgcaaaccctgcccaaatgcatcttcctccgtccgttgtcccccgctccctttgccaattcgatttgtgaaggcgtcgatgaaaagcgcccggggactgaaatttttgtacaatttcttcaacattccattcctaaatgtgcaggttcttgactgacaatgaactttgcttattgctagaaaatgttaatttttaattccagaaaagctttcttaaaaatgcaatggaagcgaatttgagggagctgcgaattgcggaggaagaattggacattttggcgaaagaggaaggacaaaatcccacaaattggcgaagaaaaagcgacgaatcggcggacgaaggaaaaggcgaagagagaaaccgaagacacagtggagaggaagagacggaggaagaaagggaggaggaggaggaagaacacacggaagaggaagagaaagggcatggggagaggcagagacggcaaagggacggagagcggacgtccccagcgaaaagcgcacaattcgccgccgcttctcgcccccgtccctccccctcctcctcgtcctcgtcggaagaagtgccattttcaaattcaaagggacaattcaa

SEQ ID NO: 7368 - DNA, 1051 bp, Heterodera glycines
gtctcgacttatgcggaggattttgacgacggaacgaattaattgccaattataacgatgactcatcggccggacatttggacacaatgtgcaatttgtgatttcacacaaaattattccaaattaattaattggggctaatttaccattagtcagcatttaattccaaccaaatgattccaatgattctaacaataagttgaaattctaattcttttgttccttaaaaagtttattacatataaaaatatgtaaaaaatatcacagaaaaggcgaaaacaaaaacaaattgacaattgccgaataaactttaaatgtggggacccgtttaactacacaaataataacaatgcttgcaatgcattttctgtgatttgatcagtccaataaaaagttttgttttggatttgcagaaataaatttgaagaatgttgcaagctaagcttaagggaatgggtggacaaacgatgcttacactttgttttgccaagtattgcaattctgagattgtcacgacttcccatgctaatgagggaatggaaatggtaaagctgtttcgctcaatcaatcaggcagtagttggtcgagattcgttatcctttgaaagtttttctgatcatttccgagtgaaatgcaatttccgtgcgatggccaattcgactgattccgccgccgaagaatcaaatcaaattgtgttcgaaacacaccgcccaaggggtattcggtggacgagcgcaacccccggcgtgggagtgctatccgccaccaaaagttccgcgatgttcacccgtggcggtgcttggggaagcctttgacggacaatctgcggaaagagtcagtcccaactctcgtggttttgtattcgtcccgtccaacccgaacgattctgtccagagagtgcccttgctggtgtttgttttggcacttttccttttcactttctttcacccgttgcacggttccatttgccgtcttttgttgattctgtggtttgaggggatgttaaaatggcaatgcattttgttttggcacttgcttgtctcagtgttcg

SEQ ID NO: 7369 - DNA, 2658 bp, Heterodera glycines
  misc_feature (2636)..(2637): n is a, c, g, or t
ttacgagtttcgtcgacaagacgatgcttaaaaggcaaacaaaaaaagttgaaggaaaagcaattcgactgattggaggagagtcattagtattaatttgttactttttaaggggacaaatttaaaagcaatgaggaaaccagtttaaacggttagatgaggtgccaattccattcaaatatccttttggagtgctgtttttatcggcacatttgcaaggttatgcgttagtttgccaaatgggcgtggttttggtccgcttcgtcccccttttcccatcccatttcctctctcccccccccctccgttagtccgtccttctcaacctgttcgaccctccttctgcttcggctgtgctgttgcttctcattgcaattgttttccatccgccgtgtgctgctgctcgcctccgaggcgggtctctcctctccgaatgccatttgctgctgtagctgcactgtctgtggctgtggcggcggtgtccctctgctgctgccccctccgccgttggccacacttccggcggcactgttggcgccgtccaaagatcggtccaacagccgcaggcgcaacgtcgacgacgcgttggcacccgcggaggaggcgaagtcggcgcctgcgcccgcctgggagtgttggctggtggtggtggtggcaccacgcgagccgggcggaagcgaagtgttgctttgaatttggcgcaatttgtccgccaatttctgtgcatttggttagcgtattaattaaggagaaggaaagagcagtcaattagcagttaaatgtccgaataaaatttgttaggaaaaggcaaacaattaacagagcgcactttttgggttaattgttgcgaatgaattggtcacagcaacaacagaagcaatggacaatgaatgaatggcatttcccatagattcccatttaatttcgtaaatcgtatgggcatcccaggcaaatttgattttttaggaaatttcgtttttccaatttcgtaaattttttacaaagttgggtttgtaaattttcaaaattatagatatttttagcgaaaatctgtcaaaaaattcatgaaatctgctaaaatagtaaatttggtcatttttatttttgaaaaatcggtttataactaaaaatggggaattagaactcggagttggctccaccccgccctttttgtgttcatctcccgccccggctcaccttcctgaagctggccttgtacacactttctccgctgatcagtccgccttcgcgtgccgagtccgagtcggacacattcagcaacatttgtccgctggcggactcgagctcccgcgaacggcccgcaatgaaataagtgcggattccctggtggggcgcggccttggagaaacccgaaatttagaaaaaaaaacatttggtaattaaacctcctccaaaatgtattggccatccaaaaagttggcggtcgcctcactgacgtggacacgccccgcaacgccggtcgactccatcttcaaaagcgacccgtccctaattgcttcccattgctttacctcattagcgaatgtcacatcgttggagaacacgtcgaatttgaaccgtttggtgccgaccattccgcacatcactttgcccgtgtgaatgcccacccgcatgttcacgtcctggccccggtccaagtcgaactggcgaattgcgatgatcatcgccagacccatctccacgcagttggccgcgtggttgggaatcggctcgggacagccggcgacacagtaataacaatcacctgacaatgagcgggaaatgggaactaattgaccaattaatgactattgcttccactttattacaaatcaattaagtaagtgagcaattaatagtcggctaattgcttacccaatgtgctgattttctccaaattgcatctgccgcacaaataatcgaagcgcccgaacagatcattcagtaaatttaccagctcatcagctgatttgtttgacgacattttcgtaaatcccttaagggtaaaggagaaataaaaatgggaaaattcggaaaaaaagacagaaaatcgacgatcacttgaatatcagcaaaaaggatggacacattgttcatcagattcattgtgaacgggcggaatttgcgcacatttggcacccctaaaaggacaatgccaatgagagaaacgggacgaacgaacgactgacaaataaatggcccaaatcgtaaaaactagagtgaagcgggaccgggccgggaattcccggtcattcgaggtcccggattttgaaaagctcaggtcccggtcccggtagggcaaccgggaaaaacaagcactggtaagaatggggtctgagtgaaaaattagagatgaaaattggagttaaaggaaaaaattaaaaaaatatattaatatattcttcaaaagtgacttttacaattttgcaaatggcttagtggctagtctccttgactttccttcttctttcccctggttcaatccctctacagaaattttaattttcattttgtatattcattggtttcctatcgacaaaatatgatccacttatatatttttcaattgacacatattttatcatttttaaatgaaaatccgtttataacttgagacggataatcccaaaaacganngccttttttgttgaaaatctg

SEQ ID NO: 7370 - DNA, 2820 bp, Heterodera glycines
ttaaagaaatttggtgagataattgatttaagtaaataataagtaagtcaaaaatgctgtgaggaactgaacattggggagagaagccctacacgggcagtgtacaaattcaaccaattccattcactcctccgggggcggggaccaggtttaaaacaacagaaaattggaggggccagcagcaggaagaaaaacaaaaagacacactgacatgagacatccattcgaatttcatttcatttcaacgctcccttttccattcccacgacgacacaccgccgcgaaaggtaaagagaaagggctggatacataaaataatcagcggtagcaaattgcagcagcaactaactgacaaccaattgtgacaaattcaaatttagaaattattgtaatttggtagaaaaggtggataataaaacaaataacaacaataggaagaatgcgaatgatttcaccatccatcatatatccattttttcaatttcttttttgtttttgctttccatttcattccaatgcatcaccattcgtagtatgccttaagttcactttaaggtaaatgtgaaactttcaacatttcactcaatttccattttttattttaattatttgcaaaaacgcaccaattgtctcgcagagcatttcctgcaattgcacttcacttctgagctgtgcttccaacagtttaatgttaacacggatatctttttggagcggttttccagcgtaagtgtctaaacgcagcaaaacaattggagtaaaggcacaatttgtgtataattgcaacaatttttaccaattgcgacggttgccacgtcgtagagaatgtcaaagtacgaagcgacgaacaaattgtgccggaggaagaggaacaacccccgaagttcttgtttgtcgtggttagccagtgcctggccaaggcgattccgaatgcgaatttggccaaacgtcgccacaacgagatcaggcgaagccaggggatttctcatcattttgccgaccaattctctaaacgacccttggcgaagcaggcgatcgtaagcgcctaagcttaactaaaaacaaaaagacataagcgggggtaaataaaattcagaggtaccgaatactgaccttgtccaattgttgttcggtcaattccaatggcacattttccgtgcccaatattcggtcttcgtgcactatttctatgtgcatctgtaattgtttgttctttggtttgtctttgatttgttagctcccaattggtttgtccaccttggcctctgcttcttcccgctccgttttgcttccgtttgtccacccattgtcaatttgtgcgtcaaaacccttcacgtgtttcgactttttccttttaacgctctgcggttggtgtccgatgaccatttctttgtttttttgtgcttcccttcgatacaatgccaatttgttcggcattccgaatgccaaaaattggtcgttgtccgagctgatcgaaagcgacagcacaggccattcaagccgtatcgagtgaactacgtcatatttgccgtcgtcgtccagtcggacgacgttcacacgccgatcgatgccaccggtgagcagacagtcgccgccactggccaaacagagcgaagtgaccttaagggagggaaacgcagttgcaatgagtcgaattaattcttttccaccattttgttgtgtttttcgatgttcgccaacagtttgcccgtgttaaggtcccatagtttgacttgcgtcccaccggcggatgccaaaatttggtcattccgaatgtataaaatgcgctccaccggtgcgccgtggtccaattgttttatgggcactgttggttcggtgcgaatgtcccacactttcactgtgtgatcataggacccttaaagcggcttgtttgatcggccaaccaaccaaaaaagcagcacttgcctgtgatcagaatgtgttccgactcggccgatgcgacccccgtccgaattgcatctgtgtgcgcgttacactcccacaacggcacagcattgggcgcggatgcggctaggtcgaacagttttgttgttccgtcgtctgccatcgaaaacacttttcttccattcgcatcgtaacagaacgcattgacggcacagtgatgggcccggaaagcgaaatttattaatgctctgataaaaaaatcatttggtaatggattcaacagaaacggaaaaattagcagtttgtggaaaatattttacttacagatttgaaggtttcagacacggtgtagaatcttaaaaaattaatattatttaaatcttttataagatttacgcgatacaaattaaggaaatagtaaagttcatgtgatcttgatagaaaatggataatgaaaaggtggtttattgaaaaaaatggtgttaattcgagtgcaggacctataaataaattaatattattttaatcattaaaaatattttagttatataaatgataaatcgaaatgtattaatgctctgataaaaaaatcatttggtaacagaaacggaaaaattagcactttgtggaaaatattttacttacagatttgaaaggttcagacgcggtgtagaatctaaaaaattaatattatttaaatcttttataagatttacgcgatacaaattaaggaaatagtaaagttcatgtgatcttgatagaaaagggaaaatgaaaaggtgggtttattgaaaaaaagggggttaattcaagtggaggacctttaaaataaaataatattattttattcattaaaaaaattttagtttattaaatggaaaatcggaaattatttaatgctcctgaaaaaaaaaa

SEQ ID NO: 7371 - DNA, 2081 bp, Heterodera glycines
  misc_feature (34)..(35): n is a, c, g, or t
  misc_feature (57)..(57): n is a, c, g, or t
  misc_feature (1136)..(1136): n is a, c, g, or t
  misc_feature (2057)..(2057): n is a, c, g, or t
gactcggactgagtgtcgaagaccatcagttcannccgcatgagtgtcactcccttnggattaaaaatgaaatggagggaaggaatcgtggaaatggacaaatacccagccagtgagccatcttttcgaaatttggccgaatttgtccgttctttgaaccgcgagtaaatcgctttgggttcgcatttcaaagggtcaaaagtcgtcatctgacaatgagatcaacatttgctttacagttacaaattaataacaaaacaagggtcaaagtcgctgcacctctttgccactcgttgaggccaaaagagggggcgacagaggggagaagtcgcagctgctcacatggccttgcagctcaaacacagccgactcctaaaacaaagggaccgactgactaccattcccagcattaaaaatgaaatattttctcacaattttccccctttttaactcattaacagcataaatgacccaccgccattcccatccaatatcgctctgcttccgaacatccgaactgtgccgaatcatcgtcctctatccgtacaatcggtttgtaatgggtccgaattctcttcgatgaaatcatcgcccattaattgtcatttgtttttgtaaacagaaaaaaacaaagaaaatgtaatattgttttttttgtcggattaacgtagttattaataaaaattaataataaacaaataacttttattatttagcatttaaaaatcaacaacaaattgcgtcccccttcttcttctgctgttccgtgtcctcttcttcgtcgctttctctctcattttcgaatcgctttcgcttcccaacaacgcccattcgtttgatcattttcctagccatcattgtcttcgaaattggtttctttgaagaaattctcgacaaaatttcttcctgaaaattctcgttttcccttgactataaatcagcgaaatgcttaccttcacatcgacctcagtgatggaattgaacacgtcccttcgcgacaccttcaaaaatggttcttcctcctccatttcgttttggcattgaatatcaaatggattttttccgccgcttccgctcggattgccaagcaaaatttcttcagttttggttgccatttctggcgaagttcccttctncaattcgacatattttcttgtaataattcctttttttctgagaaatctgatccgaggcgtaactaccaacccataagacctggaaaatgtatggtatttaacatttaatattaatggtcccaagaaatgtgtaattcgacaaaggaaaacaacctggaaagtgcatcgaaatcaatgctttgcacatcaaacacttcctaaaattaataaaagtgctgctgtgcatttaattgggatataacaaaaagtaaaaacttttaaaataaataaaacgaaaacttttaagtattcatgaaattgcgcttaccttcaattccgaaaaatagagagcttttgcataagcgattaaactcttaaaacaaaatgttattttttgttttaaatataagtaaatgtcaaccacctgctgagcaaattgcttcaccgatgggaaaggaaccatcaaattggtgattttattacgaacatcaaacactttgttggagtcgactctgaaattaaccaaggtaaaaatggagaaaaaaagacaacaaaaatctatttaaagagaactcacgtcacttttgtgacggggacattcctttgcctgagcaaagcaacaaaaggttcttgggacggcgtaagcataagcatcgcttctccttttcggttcatccgtgccgttctcccaactctaaaaatttattccataaaatccacctcgtaggagaaaaaaagaccataaaagggtgattacctgtgaatgtaatcgtcgaccgtggaaggacagtccatctgcagcacccaatccatcccccggaagtccaagccgcggctggccacgtccgtgcacaccatcgccgcaccaccatcgacagcgttgaacttgttaaagcgttcaatgcgtttgctctgtttcaggtcaccggcaaaggccggtgnaagtaaaggccgggccgcaaatga

SEQ ID NO: 7372 - DNA, 805 bp, Heterodera glycines
gcgtttgctctgtttcaggtcaccccaaaggccgggtgaagtaaaggccgggccgccaaatgagtgaatgtttcagtgatgaaacgagcccttgaaaaggaaaaatcacttaaaaactaaatcaaaagaattcggatgggatgattcatcacctgcttacagcaagtgacaaaaaccaatgttttcttcgtccgattgttcttcagaaatgacctgaaaggattaaagaggaaattaactaacactaagttttgacggatattatcgaaataacaaaggctaccaaagcatgttcagttttgcttcttccatgcacacgaaataactctgcaaaaaaggatggattgaaaataaaaaacaacatttcagaatttcagtgtttggtccgcttcacctgcaccaattgatcgggcgtcgcactgccggagtgttcgtgggccgccacgaagacggggttacgaagcgaaactcggaccaaatcctccgtccgtcgcgtttgggtggcagagaacaacagagtttggcgttctttcggcaaattttcaatgatggcgtcaatcggaaataaaaatcagatttagaatattaatgttcgctgatcagcgacttataattcagtcacctgatgtctaaatcccatgtccaaaattcggtcagcctcgtcgatcaccaacatttgcagctgatcacaactgaaatgttcattctcgtccatgtgttgtaaaagacggccgggcgtacagatgattatattgacggaagacaaccgctgcttttcaaagtcgacgtcagtgccgaaaatggg

SEQ ID NO: 7373 - DNA, 1687 bp, Heterodera glycines
  misc_feature (727)..(727): n is a, c, g, or t
tattattcaatagaatttatccatataatcaaagtattcttttttgattttttgtttgaccacagttttgatgactacataccgtaacgtggttggacttactgaatgagaagcacagaaaatggcgaagagtggtggatggaaagaagcttttttgagtgttttaatcattgcaaaatttttactttaaattcaaaaaagtccaaaatttgtgattttaggaaactttaaaaaaaaaagaattttaaggattgacacaatttgaattttcgaccttttgttcgaattcgggtccgggattcggcattggtcaaaatagatgccggatccatgatcagcgacccaaaaaaccttggaaacacattttcatgacttataaatgcaaaaaatattttttttcaaaaatggggggggggggggacaaactagagtattaccgaaaattgtgccaattttcattaattttttttattccctcttctgattttgttggtccacaacaaaagttggtatatgatcagcagaggacttacaaacatatttggattaattttggtttggttgcttttgaataaaaatttatcattttacaccccctgaattaaagcctttttgtgcctacatattttccattttttaaatggtttaagaaaaattagtggttataggcatcgccaggtgaaaagtgctattggcccaatttattaaataaacagtactttattanaattcattctatcaatttctacttcaaaatttgactttaaatccatttacatgatcttttttccaacaatttcctcatttgtttatatttaccattcttaacagtgatcagagtgatcatcgcaagctctgatcagtttaatttgaccactcatgcatagaaaattgatcataattatcaaaacaatttccccttattttttattatcaattaacataaataataacattgatcaaatgaaatgattgggaaacaggcaggcaacggcagggcattagctgttttttgccccagggcagccaacagattttccccctcaggcatcaaggataaagcatcgtttgtgttgatggggtcatccgctcgctcccatcgcctcattccgagatgaagcacaattatcccctctccccgtaaaaaataaaataaaagtcgcgcatcaaattaagcctcctgcccccgcgctgggcatccccaaattaagcccctccctccgttgataatcccatgaagcagcttgttcaactcctctcacaaaaagcattgtcattatgtgtgtgtgcatcatgtgtgatcgccaaatgtgtactgatcggaccagtccatttcgggttctggtcaaccactctgctcacccctccccgcccaagcttgatcgagatattagcatcattcagaataattctgttatgcaccaccacacacacacacacaaaacaaattccaatcgcgatcagatcggacaaaaataattttagtgggggcggggagagaatgcttcttgtccattatgctttatcctctccagtggtgggtctgttggtgcttcttcttcattcatccttttcatctcggctgactctctgatcagctgttttgggctgctttttcctaatatccaattttggtggtccgtccgttaattgcttttcgttcccatcacattttttgcttcatttt

SEQ ID NO: 7374 - DNA, 3479 bp, Heterodera glycines
  misc_feature (24)..(24): n is a, c, g, or t
ctcaacttttgatcgtaagtgtgntcgagaattggggatggtcgagatcagaattgaaaaaaaaacaactgcgaattgcagaaattctgtggagttttggagagcgaaaatccgatggatttaaatattttatccctccaaaaaatatttacgcataaaaatcaaataaaaatgtctcggaacgtacgagttcccgaaaaagccggctccaactgcagtttacgcgcccaatcaacaactaacctcaatttcattttttttatgatcaatgccgacatttttgttatcaatcgaacatttaagcctatagaattttttgctaaactaagttttctgagttaaaggcaacaaacataaaaaattagttttgattataatcgaaaaaatgctaatttattttcacgttgtaattttttttctcaatgttagcatttactctttttttgaattaaaaattcccttgactttaagctttcgtttgatgccaagaataattaagttatggccgaagaaactgagtatggtcattgattggatgcgtaaactgcagtagagcgaaaaccaaatgccaagtttcattttggcatttgtgccaacatttatttgccaattggcattttaatccacgcaaaaaaaaatggcataactttttgcagttgcttttcttcgcctccacctcgttggcattggtcaaggtggttaagcggcagagtggaaatggtgccgccggcccagcagaggaaacgcatgtcggctttgagggcaatgatccgccgccgagcagcttaaatgagcccatctcagcgatcgggcctgatcagcaggtcaaattaaaatgattgaggaggacaaattttgtttctctttaatctgaaccaagggtgtgcgaatttctcggcattttcgttgcgccccatttttcggcacttttaatttttgtttcattttcgcatttaattgcgggattttttttggctcggtgccgacacttatataaaaaaatgggcaggtcaatgccacgaaaaatcgcaatgagcaaaccgaaatcattttttaaaatgtaattttttttatttggtaatctttgtgccaaaatcccatccctgtctatatccaaattaaaaaaatgagaattttcttcgattttaggccgaggacggaaagggtctcgccgacattgcctacgacacggtggaggaacagtcgcagtcatcggcggcgtccagtagttgggcgacttctccgtccagtaccagtgccgctgcgactgttggcacagtgtcgccgggcattggcgacgctgaaagtgccgccgagactcgactgcaggacaccgccgcgtcagagggcacaccatcggcaacgactgaggaggcgtcgccggtcggagtggaggaagagaacaatgacaacaacaacaattcgcctagcagcagcgacagcggcgacgctgccgccaccgcgtcaacagttgccgaggaagggcagcgactggaggagaccgtggcgaccgccacgacagcgagcagtacagcacgacgaatcgcggctgtggcatcagccgggaagaagcaggacgagcgcaaggggcgcaagaagaccgggctgccaaccgcagcggtggagaccgcggcgaccgatggcacggcgacaacaccggcgacggcacaacaacagcagcagcgcaactgcaactcggaacgccttcggcaactgatcatcgaggtagggaaggcatttggacagccaaataatttaataatttagtttttatgaagtaaattagggttggtcatttaaaaggtgtactaattactagttcgcaagtcttacgagtagtcatagtctaatgggtcagtatcgtttcgattctcagagttattcccgaccttgaatctaagggatgatttactaattgccaaatttagaacatccattcaaagccatccgtggccaagcgccaaattcagtccaaagtggccgaggagatcaacggaaagattgacgtaatatgcgcacgacatgcgttcagttacattgtcaattcaggtcataaaatttttccattaattaattagttgattccataattatttttaaaaattaattatcattaacaaattaattgcatcattagataatttgccatttttgaatagaattgttttgtgaggccgaacataacggagtgatctgcttgtgcttcaaacaacagtgatcaatgatcagccgatgaaaaaacaaacgatcaaagaaatttgataaaattgaatgacactaaatttaatttatgataaaatcacattggataccaaataattttcaaggcctttttataataaaaccattaattaaaaattagcaccggataagcacataccagaaaaatgctggaatttttgcaaaacagattaaaaaattattcgaaattcgagtgctttttaaatattaaacattatacttaatcgtaataatttattaagattattaataaataatacaaaaagtgacattttttgggatttaaatttttttgaaataatttttgcatcaatcaaaaggccaaggaacataaaacatttgcagaaattagaggacaccagtctcgatcatacacaattgaaaacatatttacagtatactcgggcattttgctcctcaaggtgtaggtccatgatatagcccattttcagcgtcatttgcttcacgtaaagccggcacgcattcttttcatcggagagtcggtcacacatcatattaaatccctcaaacaaccgtacaaagctgttaataatctggaatgttcataaattgaagtgaataatgaaccaaatgaaaaaaatggaaatggagtccggaaatccagtcagcactactagggaaaaaattaacacaatttaattaagaatttaaacaaaaatttcataattatcattttttctttaaaaaataatttcccatttagagaagtcaaggtccctcatttccactggatattggcctaatatatatgggatcaacataaactcattgaaattgttaaaatcacttacgcttaacgcctttttgtgaagcaggtgacagaaggcgcaactgattgggccagaattggaaacagttgtgtttgcacgcgggctaaaatatgattttattttattatattttagtttatttatgaattaaataataataaccaaggcccggcgatcagctcacacatgacatcctggccagtcagttcaattgccatggatatggtggatgaaaagagattggtgtcgaaacgttcgcactccgccgaagtgatcggtgacgttttttcatcaatgtgctggcaaattgtttggattaggccaatcccgccgctgtgtgaagcattcaaaaactgaaaacaatagattaaagtcttaaaattagccatatttggtgaagccgctataaaaaattgtcggaagtgcgcctttccctcccccccccca

SEQ ID NO: 7375 - DNA, 2670 bp, Heterodera glycines
ttttcaaatcaacctaaagggcttcaaacaaaaaatatttcaaatttactgacagaatggatgatgaaagaggagcctttgcagaagcacgggcccaatgttccaacaatttgcgcaaccgaatcatcggttctcaaaagtgctgttggggttttgcgtgccacagcaacggtctctggccgttttttcgaccttaaagttagtaaaacaataatttaaataattttcgaaaaattttccgattatcaatttttcattaaatattctgtaaaaaaaatgctgaaattatttttaaagatctttcaaaaaaaaatttgaaaatttttgtttcgatggaaagttcattattttctattttaaatccattttcatacaaattttcggtcaaaagtaaaattgtataacaaaatctcctaaatttttattttaaaatttgctatattcaaaaaaaacctaatagaaaaaattgaaaaattttttaaaacctacgcgactccgagaaccgtgtcaatgatgtcaattgcttgcttaaatcccgctctggcccttttcagattggccacaatgttcgagttgccaccagcagggttggccagtttgattgcgtccgcagcaagtatggcatggtaagctgagaaaattttcattattaattttgataattttggcaatttttatttcaattatttcattaaatttaaatttttcatttaaacctttgtccatttctgccgaatttaactcggcatttgcttcgagaatggcatttaagataaaaaatatggtaatggcgatttttgtaaaatattgcaacattttgaagctgaactggtttaagtgttctaaattagtaaactcatttttttggcaaaaattgattaaattatttcaaagtacaacagaaatgaaagtcgattttgaaggcttttttggtgaattaattttatttttaatgcttttttaaatgaaaaagtagaaaattctgaaaatattggattattttataataaataaaatattgaaaattttgattaatttattgttaatcatatcttttcaactgatttatttcagtcattcataaattaatgccttcttttaaattttttagaaaataaaatggcgaaaaaaggtagccaaaaattttgggtaagaccttcccaatttatgtttctcttaaaaaattgaaaaatattacgaatgaatgaatgatgaattgaataaatgtgaacattgtaaagcttagaaacgattggaaaagcaattattaaaggtcatttgggcaacgagagtaattttatgattatcccccaaagaaaagcaccaaaaaggtcattcattattcgagaaatgtaaattttatcagatgaaaaggcaagaattatagcattttagagggagaaagagaaaggccaaaaaagtgcaaaattgctaaaacaaaccttggcgaaaaatgccaaaatgtgctaaaaactaaaaaattgctaaatctacttcaaaaagtgctaaatcatatggtgctatgcgaaaaattcaagaaaaacgaactaaaacaagtcttttttttttctaaaatgcttaaattgagctccaaagatgttctactgcttataatcccactaaaaaagaatttaaattttaatataaatttaaagcgtaaatttatgatatcaaaatttttcagtgtctaaaaattcgtaataaatttatttattaatattttatgtgatctttttttaaatttcattatgatatgttcgcgcactcatatcaaaaaatttcttttcattttcattcattttcaatttctgatttttttttaaatccaaaaaatacaaaaatatggaaattaaaaggcatcctagaagcaccaaaccaagctaaaaatactatttacattatatttaggccgaagtacttataaatgtgcaaaaaaatatatggaaacatacaaatccaggccctataaaaaataaataaatatatatataaatatgccaaaaaaaagcctcaatatatgtgctaaaactcaaaaagtgccaaaatatttttcttttatgatgacatgtgacaaatttttctgaaaaacgacaatttcagtcagatatttggttttcgggatctcatgaaaaaaaaagaaaattgtttaatttttacttaaattcatttgaattttgataactttaatttctaatctgaaaaatgtatgtgttgctgcaaaacttaattcattttaaataattagttaaataaataattttattgattttggtgatgatcgagcaaatcccatcacatattaatcttaaaagttttccataaattgacaatcaaattttaaattaaatataataattgtaaagattccttcaatttttattcatttaagaaattaattgaatgacaattctgttgttttgtaaaatcctaataaaaaaaatgccaaattggaagcagcaccggaaatatttttggagttcgacttccgattttttcctagatttttgaattggaaagcaattaaaaagctataattaattattttttggatttatttagttttgctttatgctcaacaaccaccgtcggaattatcgccagaaattttggtggaattgcatgataaattcacaaaaataaaaaatgaaataatccaatcaattaaggagg

SEQ ID NO: 7376 - DNA, 2647 bp, Heterodera glycines
ttcataaaaaaaccgaaaatttgtttttgtttgaaaagctgtaaataaaatgcattaaattttctttgccggatttgttgcgaaaaggaaaaaagtatctaggcaaaaaaacaacaacaaaaaacaagtcatgattttttttacgaaaaataccccatttccgcaaaaatcatccaattatctagattactcgccttgtccccgaacacaatggtggccaatttgtccctgtcgatgtcaccgtttttcacaatttcgtccccaaacactttggacaatttctccctcaattccatgttgttcttgtacaactgatggacaagcgtatcgcattcgataaccttttaatagtctaacatttcaactaataatttaatgcttgaaacttttttgaacggtttaactcgcagaaaaaaaacaaataaaaattggttcaattggatgttgttgcattttttaaaatttttgcttggggaaggtgcagaaaaacgttaaaaagccatgtctcgcaactccgaaaatctaattttaaaaaactcgagggggttgggatttgagagaaaaaaacggtctgatttttaaagattgtctgtgttttagcaaaggccattaggaaaatatgtttgcccacctcgcagcccttctccgccaaaaaggtggcaatgtgcgttttgccggatgcaatgcctccggtcagtccgattacgtaatgcgcattggaaatggccgcctttggagggcccggctcagccagcaaagtgccgagcatttccttgcgcttcaaactcgagctgagcttcgtctcgttcagcaccttgtccgcttccgcattcttcaacaactccaccagacaaatgtccaactttttgaagccattctcctgaaaaggggtggaattgaaaatggaaaacattgtaatgtccgctggtttgctcaacaaatttaaattggaatttttgaatttggtgcaaaaattccaaatacccattttttgtaagggatcgaaaacatgggagaaaccgccattaaattgcaccattctcttcgcattgaccgcctcgccgcccttcagtgtctcctcactgacaacaatcgcttggtaatggtcaccaacaatggccggaccatacgcatcataaatgggcactgtttggcattcgatgccttcggaaatgtcgccaatgaattcggtgacggagcggcaacgagtttcgaccggctccatcagttcgtaaagaattttttctggaattttttagaattcaaatttaaaaagccgaaattcattacttttccggttggattgcttttctgcggttttcccgaaaaaagagcgctagcaggacacttaaacattctgtttttggtcaactttccaagcccaacataaatgtattttaaatttctgagattgcacaattcgacatgggcaagaaggccgtactttcattcatttttccgtccgtcactccgcaagtgattcttgtccgtgccgtcattgccgcctcggagagcagcaatttgtgcccgttgtgcaatcggtcgaacgtcccgcccaacacgacatggtcatacggcttttccggaagtttgtgatgggaggtggcaaaagaatccatcttgaaagttggcccattctcttcgcgaagcatcggaaaaatcggatggcttgggtctttgacctgaaaacagcaaattttcaatggcattgaatatgtgccaaatcttttcaagcataaatttacaaactaaaattaaattaattatacaaaaaaatcaaaaacctcgtcatagaaaacccggtcaactgggacgctggtcgttcggttcagaaggactcggagatcaattttcggcgcaatggatgccgcattaatgtaaatggcgggaagaagtgcccggatgacgtccatttgctccaaatgcacgtacaacttttgacgtacttttggcattgttattgccaaaaggcgtttcaatttttgccgtattaattcctcatttccgcgcaggacaagcagaccaatgtcaatggaggggctggccatttctgctgaattcatatctattgttgttagtggtacgggatcggaaacagggttcttgtttggttttccaaggactcaggttcggaaatcaattttttgaggtattcccggcctacaaaaaaagtctaccggcttattttcataaaacaaagtttatctaaaaagaaaagtaaatttccgagcaaatgttacaattgttggtgagaaaaaggcaaagattgctcaagttgcaatcagtcagtttgatctgtctcgcactaattaatacacagtgaaaatagaattttcaaacggaataatttgttagttgatgggcaattaagccacaagggggtggtgagagtttgcccgtcatcggtgggtggccacttacaaaagggggtaattagggacgggggaggggcagtgatttgaagttgcctctccactgctgctgctaatgctgatgacgattattggtcgattcgcttttgttgttcggacggacggacgaatggacacggaaattgttgcaccaagatgcatccgtccgccacaatttgcccaaattccgctgctggagcatcatcagtaactgacgaatttcctctgctgtatgc

SEQ ID NO: 7377 - DNA, 4397 bp, Heterodera glycines
  misc_feature (206)..(206): n is a, c, g, or t
tccccccccccccgaaaattttcctggctacgggcttgttactgaatctaattttactcttctcttcggtatcttttaatccaaatgaaaaatgatgccctttcgttaattactaaaatttcttcagatgacgaggaagaggaggaagagaatgccgggcccacccgaattgacatggaagtggcgcgttgccgcgccaacctcgngcgaggagggcccctactttgtgaagatgcccaactttctgaacgtcgtgtcaaaaaaatttgacccggaaacgtacgaggacgaagtggaggaggacgacgcgctggacgaggagggacggcgaacgcggctcaaagtcaaagtgagccaactgaataatggggccgggaccaaaaaatttgatagtaataggccagcactcacctctcaaatgattttatctataaagtaccccccccccccccgaaaatttcaagaaaaaatttttgaaaaattttcagctactttttttgaaaaattttcaatgaatccaaaaaaccaaaatttcttgaaatatactggccattaaaaattatccgagaatcaagatcaggactcgaagcattgggaaagtgctcttgacaaatcatcccccaattctcagatggaaaacacaattcggtggcgcattgcgcgcgacagtcagggggaggagaagcgcgaaagcaatgccaaaattgtgcgatggtcggacggcaggtggacaaacacttttaaatacaacagaggaaacaattttaaattgcaacccgaattaaaaattgcaaattaacataaaaaattttacttttcgaatatattatactctcatttgtcagccctttattttttgaaattttttaaaaataaaattccccaaggaattggttgggacaattcgtctttgttccatggttcccttatttgtccccactttttcagcatgtccctctatttgggcaaagagatcttcgagattgagaagcagcggctgatggacaacaaccatttgtacacgcgccaagggaccgcgctgcaggcgcaagcgctgttccgtgaaaaactcattttccgcccggtaaacacaccgacaaaatgatagatttttgaagggtttttcttcaaataaagttgacgtggtcaagcggaatggataaaagtcatcccataaaaagtcactgttttattttctctgaagcattccaccgaaacgatgacccatcgcaaaatgacgatgaacatggcggagaagacgaacaaagcgcagaaggtcaaagtgttggcgcaagttggcgacaaccccgaggcagaacgaagggtgggccaaatatggaaacattggcatttttcaatgccaaaactcaccaaagtttgcatattatgtctaggaactcatccggacggaggaggaaaagctgcgggccgcggcgcgtcgcgaggcgcagcagcgacggatcagagaacggccgcgcatggccggactgacgccgggcttcctggagggatacgagtcgggtaaacagtttgggaagagacatttgttagtggacaatcattgattattctgctttttctatggttgataattgtgtgaaaattgtcagtgacaaatgaggcaaaaactaattgccttttttaaaaagcgcccaccattatgcctatgagtttattaagtcgcaaagttttgaactttggattttgtagtttcgctatgattggttttgttttgttttcccaccccctccttttagacgagggcggcgagtcgttggcggccataaaacggcgttaccaacacgcgccgtacagtgcggggggtgcccacgacggcggtgccgccggccgtcgttcgtcgatggcgggcggccgcggcggctcctcggacgaatcagcggaagaagaggagcgcgatcgacgggcgcgcaaggcgataaacgaggcgaagatttacagcgacgacgaggaggaggtgggcggcgcgagcggcacagggccgataaatggcgacggcgcgggcgacgactcggacgcggtgagcagagttgacagacatggcccccaatgggcaaaaacactcccatttattttttccaaaaaattgccgaaaagaatcaaatatttgtaaaaaaataggagccaacacacaacacaaacagcagcagacatcagcctcaacagaagaagaaaattgtcatcgatgaggacgacgaatgacaatggcacagaacagcgaagggagtgacaatcggcgatttccccaaatgggggagggttttttggcagaagtcgaaaaaatgtcaaaatatggttttttgtgctcaaaactttatgattaaaaaacgcggccagactgtatgttcaaattgccttctcagttccaaaaaatcctgaacaacgccccatttttagtgcattttgtctttggttcaaagggtttgactgatttgacaacgacaggttcggaagcagtacctccgatcaccgtataaccagctttacaaactcttgctttcggattggatttggtgcgtgcgagggatttttcgttcggttcgaccactctttgtctaaaatgcaacaaaaagtaaaatgagtttcctgaaactaattatggcagaagatagagcgcccacacccaataacactttgcttttgagtaaaatcctatttattgctccccccccccctcatccgtttctgtgtttggttagtaattttccgtttttttgcgtgtcattcgtcgccccccccccccaaacaaaaagaaacatttgattccatttccataaattatggtgtgactgattgatgactgacattttttgtgtacagatgaaacgtgtaaaaacagcacaagcccaattggtgggtaagacccccggcccaagcattgaaaaaccctccccattttgtcgacgagtcacttatttttccgttcccgaaactctggtataattttgggctttcaattcaaaaaaatttcgccatccctgtgcgtaaatgactaaaaaaggcgacgacgaaagcggcggtgaagcagcggcggcaattcgtgtgctcgtgacgggtggcaccggactggtcgggtcggcaattcgacaggtgctcgtggcgacgggttgtagggatgccgaaatggcacgccaggcctctcaatgatggcaaaatgacaagcctggctgaagatggcacttccatcccccgcccccccatatttattttgtcgttgaattttgaatttgccaaaggtggtgacggaggaggagcagcaacagaagccccagcggttgcaggagcagtggtttttcgtgggcagcagcgagtgcgacctgaccgacttggagcagacgcgggcgcttttccgccgcgttcggccgacgcacgtggtcaatttggcggcaatggtcggcggactgttccacaacttgcgccacaacctccaattctttgtcaagaatttggtgagacagtgccaaaaagaaaaataaatcccacataccgtatccatttgggtttactgtattttttgaaagggatgtctcaatcatgggtgggatgttctattaaagaaaactgtatcttaattaccatatgtcttcccgaaggcgatctgtcaaaatgttctccaatgctgccatgagactgacgtggaacggtgcgtttcgtgcctttccacgtgcattttccccgacaaaacgccgtacccaattgacgagacaatggcacgtgaacaatgaacatttatttatcttaataaattttatcgatcatatggttttatcgtattcctaaattacgactcccttttctctaaaataaagtccctcttttgaggggaattgaaaataaagcaccggggctatatttctggtcaaaaaaagggaaaacagagataaaagtcaaattttagagggtctcaaagaaaagcgtgatttttcaggtacataacggaccgccgcatgacagcaattttggctattcgtacgccaaacgaatgatcggtgagttgcaatgatcagctaaataaattcaaatttccaataaacaaacagatgtactcaaccgcggatatgctcaggagcacaatcgaaagtatcgagaaaaaataaatattttatttttgattaaataattttaaactttctctctccctctctctctctctctctccccgatctctctctaataattaatgcgtcgagattgccgacatttttgaacgagtgttccaaaggtacacttcggcagtgccgtgcaatgtatttggaccgcgtgacaattacaatttggagaacggtaagagaaaacgcaatggacagaagagcacagacaaatctttacggagagggaaaaactgggcaatgcacgaaaatatgaaaataataataaaa

SEQ ID NO: 7378 - DNA, 3822 bp, Heterodera glycines
agaataaactgaaaaatttttaaattaccatcattttttcgcatgcttttttataataaatattaaatgttcatgttgtttttagtgaaaggttttgaccccaaatatttaatcaattttaatttattatttttggtagaattccagaaaatgcaaacaatcgctgaaattaaaaatttcgagattattgaaggcggaagagtttttattgtgagagtgagaattgagaacgtagtacatgtggagtacagggtttgtattaaaaatgaaaaaaatatcagttttttaatgcttgcgttttatgccgtaagggggtgtgttcatgtggcgttgagaaggcactgacaccttatttgaaggtgtctgtggcagatgatactgggattttggaaaatgtggcattttttggtgtacgtgggaagaaaaacggaatggtaatgttttaaagaaaaaataccattctaatttaaattcaggaggagttgagaggattgtctggggccgtgtgcaccatgaaaatcggcgcgagagtgaaagaaatcggagggaagaaggggatctattactctttgattgatattgtcagcctttaaatctataaataaacttgttaattttttcaaataaaaatgttttacttaaaattatttctagtttggttcttgttggtcggaacggaaagttgttgcctttcaaaagaagaaaaagagcaatttaccagtgcccgaagaactgtagaaggcgtatttagagacataattaggttagataacgaagcaaaagaattttctttttctgcacataataccatggttgaagcccaaaatataaaaaataaaaaccctgataaacctggtgtaaatttttggcatagcaaattattagatggagttttaaaaattcatgccctatttgacaaaataaaaaaagaagaaaaaaatatgaaaaatattaaaaaaggtatgcaaaaatgtctagacagaaaagatttaactatgtgtcaagaattagcagaagaggccaaacaatcaatcgaaatagccaaaaattatcggcaagaaattgggcaattttatcgtaccgcttactcgcagccagatttaggtattggagatttggcaaataaactaaaagaaacaatgcgcgaaaaccaaatacggtatgaaaggcaaagacctcaggaagaatttagggatgaatttattgcttataaaatttaagaaaaaaaataaaaattcgagaaaatgaaactgtatgagaatcaaaggttgtgggacataaaccaaaaacaggtgaaaagggaaacaggtgaaaataggtgaaaaggaaacaggtgaaaacaagtgaaaataggtgaaatttcacctaaaaatatatagggacgtgcatttaatggggcatattagagaatgtctcaactagtatcaataaaaagtgccaaaggaaaattttgtgatggttatcgctattacaaacataaaacgaccaagttcaaaatttggtggaaatgtgaacttaattcacatgggtgccagggctggggtttgaaaaggaagggttttttacaatgactcgccgacacaatcatcatccagacactatattgattgaaatcgaagaggatataaaatatcgtaatttttctgcgggggcaaaatgttttttgggtgacaacaagaattagttgatgatgctaagaaaaagccgagactccaaactgaatttagagacaaatttattgcatataaaatataaaagaaaaatttaataaatgaaaaataaaaaaaatgaattctgaaaaatcagaaaaagctaataccattttggtggaagctgcaaaaaaagagacagaaagagcctggagggatgtagcggcgttagcagaagaagttggcgattttgccaaatcttctcgggaaacgcttaatcgtgcaataaaatctagggaaaaagctccgtatgctaatggtgttcgggaattatatcttaaaatgtcagattcaatttgggaaattttcaaaatcatggaccaaatcaatttggagtcagaaaaagccgaatctgcgtggcgtgagttcgagagatgcaaaacatttgaccaggcaacaaagttcgaggaacaatcgcaaaattcattaattgaagcccgaagattacattttgagtcccggagggtgcagagccaaatgttaaattatgaaaatagactccaaacaattgttttgggagcatatgggtatataagaaccaaaaaaaactaaaaggggcgcactcaaaaggtgtttgataatcgattcattttgtcatgaggacttaaaatttggatttacaaaatataaatctaaattttattttaaaaatcctttcataattaatgcagagcaaaattttaaaaatatcctcgcatcaataatcgaaaaaatttataaaaatgaacagggaaaattcaaaagcattctgaagctttcctttggttttgaatcattttattgccctcttagatgccctagcgaaaacacagccgaggctttgttccgacaagtcttattaaaagaagaactatattcgcttttctatcctttggacgatatcataacactagaagtaactataatcccagatgtccacaatagaccaagaaattgaatttattaagaaaaatgttacgaaaaattggaaatttgccggaaaaatacttaaacgatcaaataatcttgaaatctttgcaaataaacttttcaaaggggtgaaaactttctacataacagcatttagtgcacctggaatggaaaatttatatttttcattcttagaaatgctcgaaaaaattcaaaaattacctaaacttattatgcatgagtatggaaaccaagcattagctatgcaaaaattagaaattggactcaaagaaataaatatatttaaatgtcaagaagcagagaatttaacatgtttgaggcacaaaaaagaagttgcgttatgggtaataggaaaaaaagaatttgcgttatgggtaatatgatgatgaaaaaaacgttataaaaaagagaatagtgtaaaaaattttcattataaatgctgagactaatcagaataaagtatcacaaaaaatgacatctttgagcatatctcatcatgctgcgcatcccaatggtttttattttatattatttttataaaaattcaataaattaaaggtatttggacaaaatctttcgaaccaattaatccaaaccatgagttcccaacagtaaaatacttcgaagtcaagcttgtgggacacgggtgattatttttacgttaattttttatgatttaatattagcacatatggaatcggcttttcaacgcgaaagtacggatccggtgaattcgttggatggaacgacgactcgatcggttatgattccatgggagatataattggttaactcattagggtctcaaattcggtactttttgttaatataatttaggcctagaaggctatggtgggccttcagttctcaagtggcacacaatgggggctgaagatgtcgttggggcgggctttttgggcggacgaccttttttcacgctaaacagagacgcctttcgtaatattccccctcccccattaaatttttattttaattttaaggcattgacgaagtgtttttaaatgatagccactttgtctttccgactgtttcgatgatcggcgaaaaaactactgcgatcgttaataccggaccaatattcttgtttaatgttaaaacattatttatgccgttaaccaaataggccccgtaacttttagaaggaagcataaacaaaaatttt

SEQ ID NO: 7379 - DNA, 4211 bp, Heterodera glycines
  misc_feature (20)..(20): n is a, c, g, or t
gttgaggagaaatttcctcnccttggtagctggcataaaaccaaatactttattatttgttgttgttgaataaataatgttgaatttgaccagttttccctttttaaccaaatttggtaaaatgaaaaaaattgtggaaaataaatgtttgtgtttttatttaacaacagttcaatccaaaataaattaggatttatatatttgatcggtaaatttttgtaatccgttaattgccttccgctttattcgttcttcagtacccgatacgaaagaaatgtcaagcttctttatttttgtggttttgagcccatatttttgacgaactaaagaatttgaaacacaatcattttaatggttttcgtcccgatttgtatctaccttggacatatttcggacaggtttcgacgatcttagccatatggtgcgcaattggtcgctttaacattaggtcgaagattgcttcaactgtaaccaattctgtgaattggttactttgttccatgttttcgcaatcctcggattgcacccactcttcaaatccgggccaacctaggatttccatatttttacaattttttattaaattatgaataaattatttgttgatttttgaataaatttacatatacaaaatttttaattatattattaatttatttaaatataagagagacatgagggtgatgggcgcccaaggttcagatatgaacccagggtgaacccgatttcaccctgaaactccaagggtcatttcgttgtgacaacgaagcgaccccaggcgcttcaggggcgagagtagacagaataaaagatatggtttattataaaattattttcattaaaacatttataatttattttataattgattaattctcaaaatatatttttaattcataactttgattaataagaaattcaatagataaaaaacatgccataaaatgaaagaaaataatctctctattattttggtgtacatagacggcatgaactttgctgatcaaatagcgaccgtgctcatccggtgcaattctgctgtctggatttccttcatcaatttgtactgccaacttaaaagacagattgatcatttttattagagcccggtaaaaaattttccggaggcgggagcaagagttaaaacttttctgggacgggagtcccgatcgggaatcccataaaaatcccactgccgttacaatcccgttcaccaaaaaaaaacgggtgcgggaccggaactctcgtaaaaatccccgcgggggtcccaatctccaagctctgattcttatttattatacagaatttcacgattcagttttttatatttcgcttttctaccagtttcggcttggtgcgtttgtttgcgcgttttctttgttgttttgccgtgttttttgcccgcttggatgatgttgaagtggcggtgaaagttgaagaacttctattcccatcgtcaatgtcagactcggcaccaacaagttcaacagttgcaccaatgtcgataaatgccgaattcgcgtcagggtcccagtcaatttgctcttcggtctcatcgatttggaaattttcggcaattggggaccattcgttattctgaacacattacacaaaaatgaataacaataattttattgaaaattttagtgagatttgttaacagattttcagaaaaatgctaatttattatccagaaaaattaggaattttatagaaaacgtatgccattttattttaaaaaaggaaaaatttaacctttttctacccccaccccttccctcccacctctcttcctacgataggataaattttgctcaccaaatcggggttaatttgagcttgactaaaaaacaccaaaaaactgcgaaaaggcattataagggcaccaaaagtctaaaaaaaaaagcattaaaagtatgaaaattccacaaaagatatgaaaaaggaatttaaaatttttttattaagaatttttagggaacaaaacatgtaaacttaatcaaaattgctcatttaaatgattataaaaattttataatgatttttgaataaggaaaaatttaaacataattttttatcaaggaaaaaaaatgaaatttccaatctttaaaaaaatttcatttaatacggggtgtacttttaaattttttaattattacctgaaaaagagaccaaaaacggcaaaatgccaaaaaggcacgaaacacgcaaaaaaaaggaaaaaaaacataataaaagtcaatgttgaaggctcaagccaattggaaaaatgtgattttacttgctaatatattgaaactaatgagccgaaaaaaggctctcaaaaattgagctctaattattataatcattatatctatttttacaaagattctgaaagaaacccgagaaatttcaccgttccgaaaacgggatcgtctggctgaatttgatcgttgatcgccccggagatgccattgacggcttcgtaacgaatcggattggtgatgcatcggatgttgccatggactgtctgaaaaagcgaactcaaattaattagtaccgaaaaatcttacatttctaccaaagaatttagaaaaaatgaaagcaaaaaataccaaaaatgaattaccctaaaaaaattgactcaaaatgatttttttaccggaaaattgagttaaaaataataataccagatactgtcaaaaattttcatttttgttaaacaaatgaaaatcccttcgtccattttttgataccggaatttctctgtagttcaggccgggaatgcgttttagccccccacagcgtgccaaacgacggatgacctgtttggtgatgccttggatgttgtcaagattggtctaaaataagaatagttaacaatgtcccatttggaaaaacttaacaaaaacttcacatttaatcaattaaattttatttaaaagtattagttaccctagaaaatttgtcaaatttaaaataattttctcataaatagttttaaatgaagtggcttggtaaaaactaattaaatttcgatagttattattttttgcaaattattttttactcactttacggtaaccttttgcccctccttttccgcgtccctttcctccgtttccttgtccagacatgttgcagacaattggagagtttaaaaaatttctgatgctaaaataaaaaaattataatacatagattaaacgtcctacaaaacgtaaaatgtaaaaggagaatcatctccgcaacttattgtatttgtgaaggatattcgtcggggggggggggggggtgttgcgaaggacagcgatcgatttgtgcgcaattaggcgttgaaattggggggcaacaactaacaaactgcgcggaagaaaagggtgaaaagtggtgcgagggggaaattgaaatggaatgttaaaaggcagaaagaaaggatgtggaagggtggagggcaggggggggggattttacaccggattaaggattttacaccggattaaggtgccttatactacttgaactgatgattattttgaaatttaagaattgtctttttattttattatgttttttataaaataaatataaaaaatctttataaaataaaagatttacaatttaacatgaatcatagttttatattgtaattaattatattaatatttttttatttacatattttttgtctattaacttttagaatttatttttcaattttttattaatttaataaaatatcatttagtagtcagttttcgttaaaatttttgaatcagtctccatgtgtcaaggaaggaaattttattctgcatttcctgtttccttacatgcaattgagtaccagatgcacacattggatgttattaacggtgctaggtcgatccacaaaaaactcagtgattggtcattttcctgaagcctattgcattactttcggggcaccaaaagtgcctgatccttaacccgactggcccggttaagaacaatttagttgtttttcaagtgctatctcccagaccgggtccggttcaaagctatgcgtgcggtaccaaccggcttttttgtacgctcgatgagctctacaaaacggtatcaatggcatccggctgtatcaactataaatggagaaaattggcgataagtgatgtgaaaaatttaaaaatttgaaatgacatgcgtcccgccgtacattagggttaagtggacggcaccgtgattttgtgaat

SEQ ID NO: 7380 - DNA, 1456 bp, Heterodera glycines
gggttcaaagccccttgcctgtaaaatttataaattatttttttgagttttttatgccgctttcacgaatttgacattcattttgcccaatatcgaatcattaaccccaaatcgaacaatttgaaattttaattattcattcctagactggacggcaccgctttatgctctctctgtcttaaatctcttcccatcacactctattgaaatataaaaaccatcaaatgaaaattttcaataaaaaaactactcaaattcttaccacccactaaaattttgttagggaaaaaattattttttcaaaaacttcgagcttcgtgcttcgaaaacttcggggttttgggcttcgaacttcgtgcttcgaaaaaaattgggcttcgctgtcggcttcggcttcgagtgctaagccgagcttcgcccgtccctgctcagcacccagcactcgttgatcttttacttttccgcacaaggaacaggacgaatggctggggctggatttaacaccctctcatttttgcgttatctctctccccattttatttaccgccaaaagtcattaaaaaaattgtttgtaaattttaaaaattatcggaattttaaaaatagtgttgatattaatgttgatggtataatgtatgttgatgttaaataaatatcaacgtcaatgttaatatttaataaaaacaatgttcgttaagagaaaaatgtagattttcctttctctaatgacaacccaatttgtaaattgaattttgaatttattattaaaaatattaaaatcacactcaacctagagaaaaaaggaaagtttataattggaaatgagaaaatgaaggcctttactttatttatgcatttctgctcgagagtctcgggtctcggctagtgaaaatctcgggctttttggctttgtttcggaattggttttcagggatttgattctgaagctttatcttactccgtccgtttgggttaaaattcccaaatacttttacgaattgtttatttaatttgttttttttattttagaaattttaaagtgactgatcgatttgaaatttgcatttggtttcgctcattttctgctgatcatttcgctctttgtctttgtccgctcagttttttcaattttagcgtcgtgtgccgtcctcgaagaaaacgccgccgtcgatggcacaatatttggggcaaatgcccttgaaagcgatgaactactatatgtgattatattaaaataatcaaattgcagcatataatttgattgatcagcaaaataaaacagcaaaaaattgaatggtctgtaataaattcgttatgcaaatgtataaaatacaaataatcgccccaatttggcattgagtcaatcaacattttaaattacaaatcacaatcactttggaattaataatcgatcggtccaacaacaaaaacaatagccaaaaccatcccccgatca

SEQ ID NO: 7381 - DNA, 2232 bp, Heterodera glycines
  misc_feature (39)..(39): n is a, c, g, or t
  misc_feature (56)..(56): n is a, c, g, or t
ctgagggcaacgcgggcacggcggtggagtggcctcgcntgagaaatgcattttanaacattggaaaaattgtgaaaaagcaatcacaaattgccggtccagcgccggcggcgccaggcactccgggcgcgcccggcttgccgggctttccatgtcgtcctggccgtccctgagggcccggaggtcccggcacgcagcatggtttgcacgcgccaccgccaccagccacgtttgcgcctccggcacggcccaccgacgagccagaggggccggcgccagaaggcgcgcctgctgcatgcgcttcgtagccggcctggcgcgccgttcggtttccgtgcgcgacgaatggtgcatttttcagcacctcaacctcgcgaaagatgtcggaggaagagccctgtgaaaacaatgtaattgaattcattttttattcggtggacacaaaattatgacataattccatcaaatttcggtatttcgaataagaaaaaaaggaaattaaaattatcaaaattagaaaatataattaaaaatagacaaaatcacaaaattttgattggttgtaattttcgtagaccgaaaaaagttttattttactcggagttatttatgcccctgttttagaccacccaaacgttaacacgatcttggtttggcaaattcaatgtatagcgattaaattcaaaaaattaaaatattttaattttagaaaactaattttacaaaaattgaaatgccaaatttgccggaaattccgctgatcaattttcgaataatcctaatgggcaaggaagaagtgattaatgggccaaaatcactaaaggattgatttagcccctaacagctttagttggttttttttttattagactcagtttttctcatattttgagtctccaaaagaaaaattttttgcttatgaccataaatttttgtctaaatattattttactttcgaaatcattcaatgtcaaaaacactaggcatggacggagttcaatcactcatttcccaatacccaaatttttacggccataaaaaatttctcggaaagtcacagtaattgcccgaattcacctggcacaacaccatgtcctggttgagctgtcgccgcacatggctcacatagttgtacatcagcggcagcgtaatgaacgccgccaccaccgaggccagcgagaaggtcagcgcggaataggcgacaaatttgtacgccttcacttgcgtgtcgtaattcataatgtgtggcaccggttgttttataataatcaatggattagcccgcctttgaagggataattaaggataattaatcgccttttacgctcattaataatgtcccatgatggaagcttcaatatggtaatgacccattaaaaaaggaggatttttttttattcccaaccagtggacggacggctgctttaattgaaaattacagtaatcgatgatacagtatttcaagggcaaatattgtaacggtaaatgaaaaagaaataacaaaaatgtcccaaataatgattataagattttgagaaagattaaagaaattattgagaaaattaaatttattgataagattaataaacaaaatttattgtttttttaggaaattcaaaaaatgattttattagccctattaaaaaataaaaaagattatcaggattatatgtacacattgttgctccacataaatgtgcacttgttggaattgggaaaagtgcgcgctgtgttttttgccccgagggtatttggcggaggcaccctttttgcttcttcctcttaattggcccttattagccccactatgggattggaataagtgtgctatgtgttcttttgctgctgatgcttgctgagtctcagaatggacggatccctccctatttataggggggagaagccgatggagggatagggggagggcaactccaatcagaggcccaaccgaacggggcggggacgggggagaagcgggggacctgctggctgactactgattgattatgattgcttttaggcttcactacttcatccggattctttcgtccatttttttgctgcttcatccctcagcttttctcgctccacgccccctttaactcctcccattcgtccatccgccaccgccgccgtaggacaaaaacagcagcaacaacaacaacaacatcaacacctgtactaactctaaatggagtatgataattatgcttatgctgataatgatctgca

SEQ ID NO: 7382 - DNA, 1184 bp, Heterodera glycines
  misc_feature (1068)..(1068): n is a, c, g, or t
agcgcccgcgttttgcttgagggcatttgcgcgaacatttggcgcacaattcactgtcggcaaatgaatgaatgcttacttcaccggcaggcaagtgataagcatctcttctccccgcccctgtgttccccgcggcgcgggtgggcgctgcatttttcctgttctctctcattccgcttcgtgatccgtccggcttcatccattggcggctgctgctgccgatgcccccggcacttttccttattcatcccctcgggcagcagcaccacacagaagcagatggactcggcttatgcttgtgtttttttttatttgccgttctgttgctctgcttcttcttttttcttgttttgtttaccatacactcatttgcccccgtctcatccctttgcgctatttgttgttcggactgactttgcacttgcactctaatggaggcgttaatgggcgaacgataattgagttaatgattgaattttgcaaaaaaaaaaaaataattcttgaatttacttttgcactctttatttgacattatcgccgttaattataatggtttttgctacataatttaataatttaaataaatttcaaatatattttgctaaattataaaatatctttttttaattacaattaattttaaatgataattattttgctgaataataaaatattacaattattttaattaataatttatttctaattataattgaaataaattatttgaaatattttgctaaatgataaaatattacaattattttttaattaataatttatttctaattataattgaaataaattatttgaaatattttgctaaatgataaaatattacaattattttttaattaataatttatttctaattataattgaaataaattatttgaaatatttgctaaatgataaaatattacaattattttttaattaataatttatttctaattataattgaaataaattatttgaaatatttgctaaatgataaaatattacaattattttttaattaataatttatttctaattataattgaaataaattatttgaaatattcntgctaaatgataaaatattacaattatttttttaattaataatttatttctaattaaattttataaaagttaattcttcgtataatctattctataaatgtttgggattttttcac

SEQ ID NO: 7383 - DNA, 1503 bp, Heterodera glycines
  misc_feature (1469)..(1469): n is a, c, g, or t
agatcagcaaaatgccaaaacgaaaagtggtggtaacaattcaccaaaaatttaaaaaaatatattttttaagaaaatcaaaatttctaatcaatggcggagaatggcatacaaatgtggcacaaaacaaaatgttcttacataccaaattatagtagtcggaatgtgtgtgtgtgtgttttggcatagtgtttgttggcaacaattcaagaattgatcattgatcaattgaaaatcaattactacaattggcgatcaatccaaaaaaattcgggcaatacggagaatttcggcacaatcagtcccctaatttccgtgatcaatcagttggtgccgacaaattcgttgtcggggaacagaagcaccgagtcaacaacgccggacccttcgcaaacaccgccctggttcaagttggccggcttaaattgagcaattgaaattacaaaacttagtcctaccgtattcttccctagccgaaatttactcattagtctaacccagggttctcagttttttttaattcagggcaaaaggcttgaatttcgagttttcaatcaaataaattaaaattttttgtgtcaacggttttacgaattttttttttttttttgcttttcataaagttttgcggcgcggtggccggcggtgccgaaaggcaccagtggaaaagtaagttaaatttttcgcagttttgccaaaaataatcacattttaaaatttttaaatcttttaataacaattactgtaaaaaataaaattttcacaaaattggctagcccttaaaaaacagcccacttagggactctgtggtcaaaatcaatgcttctatgggccaattttaattaattgtttaataaaaagagagaattataagcaattaattaaagaatacttatacagttgttaaatactacaatagacgccttttcgttctggtaaaatattacagtattcctccttccgctaccgtatcataatagcctgcccaatttacactgtcatttaatgaccaattaatattaccttgcttcgggacaagtagccttcggccgaattccacaacactttgccgttggaactatccgcgatgatggagccgtagatgcccaactcgctgaccacgttttccaagtaaggcacttggaaggggcgcatcaagtaattctgaaagggataaattaataaattattttgtgaaatatatttaaatttttttgattaaaattcgagtctctcactaataaatttcattatgcaattaaaaaaatgtattgccatgtaactttttgtaaattatcaaattgatatgagctaaaaaagtagccgattaaatattttttgtaaattaagcgctttcaacaaaaaaaaaatcgattcccatttaattttgtgagtttagattctaagccactcaaaaattttcaaatttttcatttatcaaatagaggggaaggagttggtctgacagntaactaacgaggactaaagcggaggggggggggg

SEQ ID NO: 7384 - DNA, 8832 bp, Heterodera glycines
  misc_feature (2421)..(2421): n is a, c, g, or t
  misc_feature (2442)..(2442): n is a, c, g, or t
gaaccaactgaaagaaacaatgcagagcatttactatccgtcttgtttggagacgagggatggaaaaaagttaacttgagaattcttaagcaaatcattgaaggtgtagagttacaatatcatccaaattttgaaagattcaaagcggtttttacccatccgagaattgaatttatctctttttcgcctcagctcggctatgtcttgggttttgaaaaacctcaaaatgtaaggaataatgaaattgctaaatatggaagtgatctccgtggtggatttgcaagctttgccgtctacgcaaaaggtctaaccgagaatatgattgtaggaaattcgttgagctcgctccttcgtgttgtatcagtgtcgggggcggtaccaggcgcgtacacggaaaaaatttacgactcaccgctttatgcacgtgttttgccaaaagaagcatcagaaattgaaattgaattgcgaactatgaccgacggacgactggtaccattttcctatggtacagtgctgatcgtattaatatttaagaaggtgataaatttttaaatcattcattttttgttaacattcttaattgataaaatggtacacactctttatgacacttcggtttcgggctatgatgcattttttgtgcaaaatggttgtggaatcggggaagattcctcctaccaagtttttcgaggagcgccaccatttcagcgagggtggggctcagcacagacgggtgcaggaataggggatatttttcgtggtctctggcgctttttcctaccattaattcgcagagccggagataccgtagcagatgaaacaattcagactggaaaacgttttataaatcgagtaatcgatgaaaagcctggcttgaagggaacagtagagacattggcaactgagagtaaacggggagcggacaatgttttagagaaggtaggatttcggcgctaatttggcacaggaggacgaagaaagcatataaaagctaacaattcctccattctatcacatcaaacgataattggaaaaacaataacaaagccattaattaaaagcaaaaagaggcttcgatcagacgcgtttgggctttattaaaaaaatgacatttcacaaaattgacgcgagtagcatcgattcgattaccaacgccgtggacttttttagtatacctccgacaaatgtcaccgtgtcatcttcaaaggttttcgagattttgctgagtaatccactcaccgacacaccttaccattttaaaatacactcgagccaaaattacattgatctgtcaaaatgttacattttgaccgaatttcgaatgcgaaaattgacatcaccaaatggtgaatggggatatttggatgctactgatcaggttgtaccgatacaactgatcggacacacgttcatacgagacatgaaaattgcaataaatggtcgtgaaattttcaactctaattcactgatggcatacaaaacttatctttctcatgagctttcgcaatcacttgaagctaaagtttcgcatttaactgctgctggatatgaccgtgaagatgctaacaatttacaaaacgcaaattccgaagggttcaaaagtagaagacaacggtatttgggaggtcgaacagcacaatacattgcaaaaatcgatgccgatctgttcaatgtgccccaatatttgattaatcattgcgaaattgacataacgatacaaccccatgacgacaattttttgttaattgacacattagaccccccgggtcaaccatatagcattgagcttgttggattgaaactctactgcaaaaaagtcagtcttatggatggcttggctcttgagttggcgaaaaaattggaaatgaaaccagcacggtatgctgtacgaaaaacaatgatgaaagcactgttcataagcccagggcgctatgaatttaatgcaaacttgttcatggaccaagttccacgccgcgtaacaatgggtcttgtggcaaactcagattatgtggggaacatcaaaaggagtccattcaactttcagcactttaatgtacgtgagttgagtgttgtggccaatggtcgctcctatccccaggccccgtatgacattgactatgaaaattggaaatttgtccgcccctacaatgacacgcaagaggcgcttggttttgccaactctacatatggaaatggaattgattatttttcttttttgcacactcattgtatttatgtgtttaacatgactaatagtggagatgatcatggcggtttgttcgacctgatcaaaaagggatgtacagcagtgaacataaaattcaaaaagccagtgcccgatgggggaattacactgatagttatgggagaagcagactccatctactttttagataaaaacagaacgattgcaactgatancaccatttgatttcaaaaaanatgtttcatttattctttattgtcttgttttttcaccaattgtttgtttgattgttgaagaaggaataaaagctgaggaaattccccaatataatgagtggaaaagacttttggggtttaaaaattcttcagaaattcaaaaaaatactacaaaagcaacgctcgcctccactttagttaaaaatgtttcaacaacccgaaaaacgacaacccaaaattcaacaataaaaataaaagttactacaacaagtatagaaacaagcagtgccttaaaacaacaacaacagcatcatgataactttaatttcccctttgtacccctctgcaaagaattaccaaaagaggcaaatgtctatgcgcatattttttgttggtctatgatcatcctttttgccttgtccgtcatcagcctcatcatctatcagcttcgttcaattctttggcttaagctaactttaacggaaaagggcaataaggcaaatggacagcaatcagattaccaaaatattgatgtcttcagagaaaacaagccggacgttccttggatgcttcccatgcgaccaattacctgacccaaattcattaagatttccttgctcattgattgttaatttagatgctcatcaatttcccggttctcactgggtcgcaatgtttgcatatggattaaagaagaaagtaatttattttgacagtctagcgctaccgataaacggatcaattggtagctcctttctcacttcatttcccggagcggtgtataaccaaaaagtctttcagtccatttcatcaaagtcatgtcatttttgcatttgtttttactttttatcatcaggttccacatttgatcaatttctaaataaatttaatcatttaaatagtcccgaattgtatgttcaacattttgttcacaattttccaataaaactttaaagaaatgactcttttttttttcattgtataattaggtctatttcacaaacgaaaggaatgaaaagtaaagtaaacacaaggtaccgtctagtgtctagcaccactggctgccgaatggacctaaccaatctgcaatgacccattgaacgctgattggctgaatatccattcacccattatttatataaccctttcctcctgcacaaatttaggtgtatgttgtgaaaaggccagaagaaggtcaatttactcgtatttccaatgggtgtttactttccacacagctattgcaaatgatgattggtcgtcgtccccttctcatttgtagatcccgctgaaatctcggcggacattgagaaaggaccggggaaggtcaatatattcgtatttccaatggatgtttaccttccactcgcaaatgatgattggtcgatgggcatttcccttttcatttgtagcttccgcagaaatgttgaatgatgattggatgaaagagtagaatggtcttatgactaatattgttggtcctttctgcataaaattgtgaaacaataattctgtttatatgtcttaatagtttccggtataaaaaagaatagaatatgctatgaattcattttattattggaaataataaaaaagtattttagcaaaataaataaaataaaatgccaaattctcctcctccatctaaacgtccccgccgcttttttattgaagagttgctccgtgagccattcaatcagctttcgccaccgcgcaaatcaccaaaagattacgtaaaactgctcaactccgaaactgagcttgtcccaaaatttcaatggctgaaaaataagtcgaactttatcatcgagaatgtgcctgctgatccagaagcccttctaattggaatatttcaagaatgcatggatgaggcaatgaacgaaagccgcgtgaaaggaattaaaccaacccatctgggctgcaccatttccagtcaactgctaacatcagacatttggatcccaattcggcagcttactcctgacaccatcaacacaattctaaaccgatttaacgacgttgcgcaaagcaaaaagcaggatggagtgacactttggggcgagccctttactgtgtcagtaactacagtcaaccggaatgggctgccagagaaaagacaattaaaagggggagcagcacgtaaactggcaccagtcaatcacaaaatacatcaacaatgccttattaaggtgtataatacttaggttttgttgaatataaattatttaagatagaaaatgctgataattactgcttgttttacgcgatgcaagcaacaatggtccgcacagttggtaccatgacacgtcaacatttttacgattatctgcatggaatcaagacaatgatagggaagctgcagagagaaacaacagaaatgatgaatgctgtaaatgctccgctcaacctcctcaattatgatgcagaaatttatgttccgcgaatcatcgattggtggaatgacgaaaaatttgcgaggcagtggaaattcaaggcgtttattttcggatcagcagggcattacaagccattgtttaaatatggggcggatgactacgatgtgtcaattctgctgtattttgatgagggacactttaacggtgtgcagaaaaatggcaatttgtttgggagaccgtattgtctgagctgtgaaaaaacttatgatcgtccaaagcagcacaccaaaagttgtaaagcccgctgcataaaatggtataaaaaaacgtaatagcaaataaaaattctctattttattagctcccaaatgggaccgctttttccttgtaaaccaatcgatggatttcgtcaaaaatgcagcgactgcaataaaatgttcttcaaccaagtctgctatcagcatcatctttccctaaacttttgtaaaacgagcaaggaatgcaaacattgcggtgtggtgtgggacttgaacaacaataccaaaaatggaagagaggtaggttttgttttttcatcaaattttttgctttaaggaattgttttttttaagggtcacaaatgcaacgaaagatggtgtgaaaattgtcaaatttttcatgaatttgagcgaggctgctttataagaccgcttgaaccgaaccacaagaaggaaacaatgggatggcgtctggttacttttgacttggaaacaacacaacacacgcctatcgacccggattttccggaaaaacggaagcatcaagtcaatttcgtgaccgcaaaagtcgcgtgtccggattgtatttcatcagggagatggaaagagagtttgcgtggcaaattctgcaacgtttgtggctatcaccgaacagtcacattcagccagatgccttttcatgagacaacagtcgacaaacaaaatattgaccgtcaccctttggttgcatttgtgaaatggatactttacaagctgccaaaacaatacgacactattgcttactcacattttggagggcgattcgacatggtcttggtctttcgagaattattattggaaggattcaacccttcaatgattaaaaagggaaatcgattgtttgagatgaaagcaagtttttttttattgattaacgtaaataatcgtgtatttgtaggtgaaaagcaggaaaaagatgaacccaaatgtgactttccgagactcgtggaacttaattcctgggccactggcatcgatggtcccaatgttcggtttggatgtgcaggacaagcccttttttcctcacctggcaaaccggcctgaaaattatggatgcaatctcttccctaccaaagctgactatttggcagacggaatgaacatcgcaaagagaaaagaattcgacaaatggtatcaagagaacagaaatgcaccctttctgcttgatgaatcattggccaggtaaaaaaagtaaaaatttttaaaataaaacacattttagctactgcaaaaatgatgtcgatattttgatggctggtttaattgctttccgctctgaatttttggagatgacaaaaagatccgccggggcagatggaaaagctgatcgggctgcatacaccaccccacacaacggaattgatccaatacggcactgtattactatcgcttcagcatgtatgcggcattttcggacaaaccacttgaaaccagcacacttggctctcgtaccagaaaagggatatgacagttgcggggataatcaaagcgatttggcactcaattttatggagtggtatgcggaaaagtttgatgttcaaattcaaaatgcatattcagccaatggcgaaaaaaggtagaatttgtcgaaaatacaaaaaaatgggcaccaattttaagggttggaaatttccgtcttgatggatggattgaatctcagcaaaaggggctcgagatccatgggtgcatttggcacgcatgttccaactgttatccggatgataacgaagtgctgccttgcggcaaaacagcagggcgaattcgcgagaaaaacaaacgacgaatggaaatcattttggaacaagtcccaaacgttgagattttttggcaatgcgagattgagacaatgttggcaaaggacaagcaaatgaggaaaaaattcgacgaatataccggtgacgggggaccaatcgatatccgggcatcattcatgggaggaagaactggggctctgaagctttttcacgaggcagcggaagggcagaaaatcagctattatgacgtcacaagcctctaccctttcataaagtctattaattttcgttttttccttatcaattttttcagttttacaacggattacccaattggtcatcccactcttcacgtcccgtgtgaagaagttgattggcgacggccagaggacaatccatacccattggccattctcaaagtgttcgtcattccgccccgaaaaattgatgtgccagttttgccggtcaaagttgatgatcgattatgttttccgctgtgcatgaaatgctgcaaaaagttccccaatggtgccgtaaagctgtcttacagttgcaactggatttgatgagacaatccggggcaatgtcgaggccgaggagcaatttatcgcggaatgcaacgaacaattcggaattcaaattgaccgtactaaaatggtcacgaacaaaggaaagagagccttggccaaacttgccgtcaacaatttatgtatcaattttcaattttattttttgcatattttaaatataggggggaggttctctcttcgaaactttggcctttcacaaactcatatcacggacgatccatctgagctcgccaattatcttgacaacaagaaaatcgaagttacggggcttgacatgctgacaccagacagaatattaatcagctaccaacagaaaaaggactggattaaggagcatccgtgctcaaatgtggtaatctcccttttcaccacttcggcagcccgattacacctactaaaagcaatgcaaaaagttgtgcgtacgcctggttgtgtccttttgtacaccggtaaaaaaatataattatccaacaaaaatcatattttattttaagataccgattcattgatttacgcccacccaattggcttgaaccctctcaagactggaccccatttgggtcaatttacagatgaatttccagaggtcaaatttttaaatttaattttttaattcaattttttatttttagcacgaaattttggaatttgtgagcggagggtcaaaacaatatgggttgaaacttcgtcgcaatgactctgaccaaattgaacacgttttgaagctcagagggatcacactaaactatgatgtaacagaaaatcagggacttcgctatgacacattcaaagatagtgttatcaaatttgcccgtgagggaaaagttactcccataaaagcagtgtacccaaatttcctccgtcctaccgtaaaagaaggcattgttacttccgcccctatgcaaaagacatacaaaccatatgtagggaaagggattgtttgctcacatgatttccgggtacttgattttggttatatttcaccataattttgtaaaataaattgaattattataaatttattgcttgaaaattttaaataattcaaaagaagacacaatttgaaaaaaattaagactgagaagaggtcaattttggctggaaaagggaagaattagtgaagagaagatacaatttctgaaatattagtaaattgaaaatgaaaattttaaaatgagttaaaagaagatacaatttggaaaaaactaagcttgagaagaggtcatttttagctggaaatgtgaagaattagtgaagagaagatacaatttctaaaatattagaaaaaagaagatcaaactataatctaccataacgaatacccatcactttgactgcattcattgcgcccatttcgcattattgacatgtcaga

SEQ ID NO: 7385 - DNA, 4139 bp, Heterodera glycines
  misc_feature (60)..(60): n is a, c, g, or t
aaaaatgtcacacgtataaaattcataagttgtctcagtttcaccgaaattaatattccnttgtatcatccaatagcactaggtgttctctattcaaatataaatttatgtagaaagaaaaaagttattatcataaaagtaaaaaaaaaattgggtcagaatgttttgtccataccttttttgaaattcaataaagtttttaatatggaatattaatagagcatttcttagagctatcgaaattccattaaagttggaattctgactgtagattttttgtacttttatggccataattttttataattgaaaaaaaatttcgaaccgcttggcggatttatgaaacaacccaagacgaaaattttgcattaaaaatgatcaactgatttatatggaaaaacatggagatattcgaggatcggaactttttcaaattcaagaacaaagatcgacaatgagtccgagaatggagaaagaaaccgaggcgccaaaaaccaagaaaactgaccttttcaaatattcacggtgccacaaaagaaaggttgggcccccgtgggcggaagggattaagctgggattgcagtggaagaaggacagccggtcgtactcgtgggaaccgtaaccgttcttcatttggagccacgcgttgtgctaaatggcaaaaccgcctaatttctgcagaatcgggcaaagcccggcctccatcacaaaatatatcagcaatctccgagacccgttcattgtttttttgaattttagtcttttttggcatcccaaatgcagtgatgttggagtcatggcatattgtacaaaaaaagtcttttggcaaatgcctgaacctgtaaaggcattctctggtcgaattaatagaaactctttaaaaacattaaaaacataataataatttaaatgatttaatttttgattacttgaaacaatcaatttttatcgcttcatgaacaaattttaaatcagacagaaatttagtcattggtgcctgtacctcctgtaacgtttactgatattttttcaggtttaacctgtatctatttttctatataaaaattttttccggtctctgatccagataaaactcggttcctatttattacttttgagtttaaacagtttccatgcagctgtacagtggcaatacattagctaaagcctatataaaatcaatgctcttacaaatcgctctcgctgatcatcgctgagcatacggtactccattcgcttacaccgtgccaaactcttatccggctcgcccgactgtcgttttggtctgctggtctcaaacagttgagttgccgcttttgccgtcgagatgcactgatctaaaaacaagttaaaactctaaatttatttatggtttcaaaaatttcataaaaaaattctcatgttttgaacaataaataaaaagtattcctaaaatgtttttttaattataatatttttgcaaattctattagatttctcaattttcttgcctttcatgtatttgcataagcagctggtgtttaagcatccgtaccgttccgaggccaccgacggcggcggttgggctgctttttctgccggagtcgctttccgatgggttggcaaacctttaatggtaatttcttatctgtcgcatattttttcttgaaaaataacaattaacaaaagctattaaataataaataaaatctataaataagcggaccaagcccttgtgacggcggtggcaattccttcgctggcacaattcgcccttctctttccgcctaaattttcacttttcgttctcgactgtagtagttttaaggttaaactctatattttgtaaggatacaaaaaaattttatcattttattttcgacataatttatactttgtgaaaacgaattaatatatacccatagttttttttttacttttttgttcctgggagctaaacaattcaaattttgtttttcgagaaaaagataattgttttttttgaaaaataaaaacaaaaacaaatcagacatctttgcacacccaaccttccccttgtgccactaccgtaccttccgtgcctcttgccaccattgcagcctcattatgcatgcttggcgtaaatctggcgccattcttttgcatacggtataatctacagtcaacggtggtagtgttgtgggctgtgtgccaccactgctgctgctttcctcgatgcatgtggccaccgtgtgccgaagatatacagtaatgcagaaaaacaacaacaagacgaagagaatggtttggtcaaattggattttggcacgcaatttacccattttgaacaattttttatgccgaaatcattgataagaattattttagttaagaatcaatggaatatttgggtgattacccaatgaaattctttataattcggaaaaataaaaatatattttaaatttttgtttgaattaaagtattcccgtgttacaatatttcctccccttcccggtatggccatgaattaccattttttcatggcttttagaataaaaattctttggaattatggcatttcaattaataaaaattgtaaaaggaacgaaaaacatttcatatgtcttactaaaatgttgttgaagattgggcaaaacattctttgccaaccgacagaattcacagtttcaagcactaaaaacctttgagcggcggttggcccatttttgagtcatttcatttattcggtggtggctttgctttttggtgataaagcattaaaatgttgtctgatttaggctgatgagtcattcattccctttttacatttattgtttcataaaattactttttctatttaatattaaataacatttgttgggcatgcattaatcatgaagtgaacaaacattacaaatgaataaaatatttcaatcaatcaatcatttaaatcatttatacgcaaaagcttgacgcggaaaaataaagaaaaaatgaaattatatcaaaacaatcaattggtcacttttggagttgggtggcaaagaaatcaacaaatcaaatccaacggtgccgcgtcgttgcgcgaaaaccgcaaaaatgagtattttgcgaaaaccgcaaaaaagggcgttgcgcgaaaaccgcaaaaattttataattaatttatttaaatgttattaagcaaattaatcaaataaaattattttataattaatttatttaaagtaaatccctaataaatataatctataatcaagcatttaattcaatcaatttggatccatgattgcttgaaaatgtccccgctcaaagtagataaagttgatttaattctcttgcttagtcaattcagcagtaggattatctaaatctatttaatacttaacataacttattataatattaaataataaagctaataatttaaaatgctggttcatcagaaataggattataatcaaacattccatcaccatttatttatgttaagagtcataatccatattttagtcattctctaggattaacgacctaccatttggattgcggctttatggcacgccaaagaatttcttcttagtaaattttttacgagtttgacctcttgggtactaaaaaatctatgaattttgaacaatcgtcataaattttttaataaaaaattccaatagtttcaatcatatcggaaagagcaaattctgtttcttcaaagatgttggtgcataaaaaccgccatccatgcttttttgctaaatccgccaaatgggctataaccagcgtatttcctgaattctcctttcatttcctaaatctgccatcaaaagaatataaaattaaaatatggataaaattatatatatttttatcatttgagtaaatatattacagtcgagatttccctagttgtttgtcaaaaaaaataaatctatgaatgttatacaaatgttttattatttgagataaatttgcctaataatttaaaaaaatcaattataaaataattttatttgattaatttgcttaataacatttaaataaattaattataaaatttttgcggttttcgcgcaacgcccttttatgcggttttcgcgaaatacccatttttgcgggtttcgcgcaacgacgcggcaccgttcgaataaagaacgaattgtatctagcattggttgagc

SEQ ID NO: 7386 - DNA, 3056 bp, Heterodera glycines
  misc_feature (23)..(23): n is a, c, g, or t
  misc_feature (125)..(125): n is a, c, g, or t
aattgtcattttgctcttaatgnttgatttggctgatctggtttttgtttgttttgactgatcaatgagtgactaatcacttttccctttttcccaccttcgccatgccgtgttgcacattcttntaagtcaccattgtccaacatttcttgacttttgttcacaatcccctcttggcgcatttctgccactttcgccaccatttggcttatttttacccatttttgagtgcatttgtcgctgtcacattgctgcttctgctgtttgttgaccatatctgacaatttgttgaatgaaattttgttgaaaatcgtgccgtcccgtgcgtagtccgtgcggaacagctcggccgggtagcatttgccggccaaatactccaaaacgcccgccgctgtcatccgtctttgaggcataacatccaacaaattcttcaaaaaaaaaaaattaaaaatttttaggttttgtcataggtcttctaaaatcgaaataaatttgtggcaaattttaaaaaggtcttcaaaaaatgacataaataattaaagttgctattattttagaagttttcattaattttaagtttagtttacaaaaaatggtttttgtggcatttaaatcttaatatatttctgaaaaattttggttttatcaatctcctaaaatgccgagctcagcagtttttttatttttgtttcctgtcaaacccagactttgcttgtttaagaatattaaaaagcgcattttaatgaaagtttgttatttgactgactgtgatgagaacggcaagccgagggaaatttaaccaaattcggagaatgcttttcactgttttgacagaggaagttagccaacgcaaatcgtacacaaatcgctttggctttggccattttgctttaatatcggtcgatttgccactgtaaacgggcacaatgtcaaagagtttcttagcaattgccaactaaaattcaatcagatttaaaggataaaaattaaaattattaaatataattattaaaagaaagaattaaaacgatcgtgttcttaatgagtatcatttgcatcattatcattatcattaacatccccgcccccttaaattatccaacaaactaatcaattacccgtaaagtttcttcgtttgcgtcggggaactcctttttgaccattctcacaaaaatgatttcataagtaattacacccattgaccacatgtccgcttttgaagagcactaaattttttaaggaataaaataaaaatataattttaatacaaaatcttttaaacttttttaatttaaaattaaaattttcctgtatttgctcacctttcttctgtaactttctgggctcgaatacaacggtgagtacagcggatttttgggcactcttcggtagtcagcccgcttgtaatgtgccaaccttttcctccataatccccaccgaattttccccgggatcggttcggctccgtcaaaatcgatcagtttcagcaattcctcagactcaccgctctccacatcaacagttggcacgtacaaaaaattgtgtggcttcacatccaaatgcatcgcaactgtttgggtggtgaatgaatattcgagagtctcggtttgagactctctcaatgaacttttcaaagtttttgaatttgtgtcgcgaatttcggtcatggataaaaaaattttgcccaaaaagcctcaaagccatataaaaaggtttaaaaattccttctaaagtattttttaggtcattttaaaatttataaaaattccttctaaaataatgaattataaatcccttttaaattcattaatttgtttttgcgccctaacttagagcataactttatacgaattataaaacttaaatataaaaaaataactaaagaatgattaaaagcatgtcatctgattgtgtttttgtaattttagttttttttttgggctttgaacgaatttcccataaaattagctttgacacaaaggcttattcacagaattcagaacaattaataactaattaccctgatgcatttcctcgattggcacaaccaattgtctggtcatctgcagcagttgctgctcagatttgtctttgtcgttatcgcttatagcattttcgtcgttgtataaacgttcgtcaaacccttcggcgcccttctccattaatatcagtgcgcgctttgaccgccttctttctgttctggttctgagtaatccgcttaacagaattaaaatagaatcagtaatattccaagctgaattaagagcaataataaattgaaaatttttattttttattaaattgcacttggcatttgcttatttgttagcttcgtagcataataatttttatgtgtattctctttgcttgaaaaactatttaattccccatcaataattatttttgaacatttaaataatttgcattttaatgattgttgccttactaatcgtatattttcagcagatgccttcttttcgtctcgtccaatttttcgatcatttttattacttttatcgaatttcgaaaacctttgtttgatatgctttcacttcctctgcccagcctaatctcttttaccgccaagcattgcttctcaggaattccatccgcttttccatttttggcaaaagcaacataaaccttttaggtgtatttacaaaagttttattaattgattttttttattttttaaattttattttgtgtgtctacagtaatttttttaacggatgaaaagcacatgtttttggctggtgatctcgaactgggtttggtcatgtttcattttttttgatttgaagtctatcttccttgaaaatgagttgaaagttccgattttacgccttactggtcccagtcaatcaatgtttcggttttttctaaaatcttgttcccgaccagtcaggggtgtgcgaaatttcgtgtcgttttcgtgtcctccccttttttcgtcactttttgagtatcttttcgtgtttcgttttcgtcggtcaaaaatttttttttgtttcattttcgtatttaaaaatcttaaattttcgtttctttttcgt

SEQ ID NO: 7387 - DNA, 2114 bp, Heterodera glycines
  misc_feature (2104)..(2104): n is a, c, g, or t
ccttttaggtgtatttacaaaagttttattaattgatttttgttattttttaaattttattttgtgtgtctacagtaattttttttaacggatgaaaagcacatgtttttggctggtgatctcgaactgggtttggtcatgtttcattttttttgatttgaagtctatctttgaaaatgagttgaaagttccgattttacgccttactggtcccagtcaatcaatgtttcggttttttctaaaatcttgttcccgaccagtcaggggtgtgcgaaatttcgtgtcgttttcgtgtcctccccttttttcgtcactttttgagtatcttttcgttttcgtcggtcaaaaaatttttttgtttcattttcgtatttaaaaatcttaaattttcgtttctttttcgtttttggattttaaattttcgtttcgtgtttcgtgaaaaataaatattttagtttcgttttcgaaaattattagttttttgtttttcgcacacctctgagcccgactaaccagaatacataactccgatatcagagtatttatacactttttgaggtttttagagggtcaattgagtatttatgtattttctttttgaattagtttttattattgtaaattaattgacctttccaaatccaccacttcccaattcgtcgtttttatttgttaagatttcttttctccttccatcttttagcgacttgaaggaaatgcttttgaattcttttgaatgtttaaaataatcacaattttctaaattttttgaattaaattttttttatttttataaaatgccttttgtcgacgccgccgaattgtccattaattctccgcttccatttgcttttgtgtcgtctttttcatataattgtttcgcattaattagtttgtcttttaatgaaattgaggcgatgaaaaataatattaaaatttttattaggaataaattcatttttaatatattttttaaaattaaatgcaataagcaataaataaatatatttaatgattttttcaattgatttctctatgcttttatttgctatttcatcactttggcttctctttcagtgtttatttttccattattaatgaattacgcatgaaatttttattgataataaaataaatccattccaaaatcattttcgtattgacatttaaagcggcattaattaattagattcagagaacgcccaaaatgattcagttaaattgctccaatccatcgtaattccaagcaggacaaatgtgaacaatcagcaggcgaatcatttttaattgactttgtcggaagttgtttttcgatattaaaacttgaattcgcctatacagaagtaaagtttcaaattctcccggtggcgcctattggcaccgccggaccctccccacgccccaagccgaaatccttgggacttcctgcaccggcacgctcacaagcgccgctgctcccaaaattctaataaaattttcaaaattttaagtttagtctaaaagctcaaaatgggaggattattgaaaattgatgaaaacatttttgttaagaattgcttttatttaattgtgtttttaaaaatttacttatttttatcttacggcaaaattattttgcacctttataattttcaataaaattcaaaactggtcattttgcatatagtgtaaatttcgccataatttaaaaaagccatgtcagtaccccgaaaatttgggtcagtaccccgaaatctgggcaaatctgaaaccagaacatttatatttttgccagatttaaacacacctttaaaatagggaaaatctgataaatcaggatatttggaccttcaaaaattaaatttattaatactcgacttttatcgttgactataataatacaataatttattttaaaattttataaaattatgcattaattatccctaaataatataagaattaataaataattcgttattataactttttataacacttgattgcccatttggcctggctgttgtttttgctgctgtttctgctcgatttcaccaatgaaaaatatttaagaatttcgctaaaaaaataatttatttacaaaaaaaatttcatattataccanagtcgtttta

SEQ ID NO: 7388 - DNA, 1806 bp, Heterodera glycines
attttgggtttactttactatgctggcccatgaaaacatgcagtttttccggtgccaaatttttgtgaattttcattcggcgcgtcataagcggattgtttggtggcaaatgcaaacaaattttgtgttattcgaatgcgctcggcgggttcgacatttccaaatgtatcaacaaagggtctatctccactctctggcgaggtatggccagccaaagcagagtggggcataaacaagaattttttaatctttggtatttcctctattttgtgcctgctctacatttatgtcttgtgccaatatgcctattgcaacagaaatttattcagctttcccgacaaattgttgagataattattctagacgatttttttatatctcaatgcttaactatcgcatttttgtttggcaactggtagaaattggcagtgaaaaaaagtttgtttgtaactatttacaataaaaatttatgtagcatttctaaaaaggatgtaaaaataagttcttgcgtaatatttttatattgtgtgttgaagaatttgagtctgcttctgatgcaagtggaaaatttttcagcttttctcgaaaagttttttcccagaaaaaggatgggacaaataaaaaactaaacatctctcatgacaatttaaattcccttacattttgggtttactttactatgctggcccatgaaaaaatgcagtttttccggtgccaaatttttgtgaattttcattcggcgcgtcataagcggattgtttggtggcaaatgcaaacaaattttgtgttattcgaatgcactaggcgggctcgacatttccaaatgtatcaacaaagggtctatctccactctctggcgaggtatggccagccaaagcagagtggggcataaacaagaattttttaatctttggtatttcctctattttgtgcctgctctacatttatgtcttgtgccaatatgcctattgcaacagaaatttattcagctttcccgacaaattgttgagataattattgtgagtgggaaatgtttgtgttcaaattgatccatcgttttttttaattttcagatttgcaaggggagagcagcaagacggacgaggacctgccgatgagcagtgttccctattttccgatggtgcccgactcaatgattgcggaggagcacatggaagagcggtccaaaaagttggagaaatggctgcggtcgatgctcaaagtgccggtcaatcgcgaataccacgaaatggtcaaaaagcaaccttatttttaattcttaatatcattcggtagctcagaatgtctttattaccctgccaatttcaaaaaaaattgttaacttttcgaaaagttatgactaaaaaatctggaaaacttgattttttaaaaatttattttgccagaacttttttgaaagttaacgagtttttttgaaattttacaggctaatagagaacacttagggctatcggctaaatatcaataattaaaaatttggttattcttgagcaaagtattaattatctttcgtcaaaaaatccttttgatggttttttattacgacatagcactgaacaccacttaatattttgcgattttagctaattttttaagaaaaatgggattatgggggttccaccaggaaaattttttggactttttaatgaatttgttaagaaaatttccaaaatttgcgacccctcaacctcgctgcgaaccctctcgcgccacctcttttacaccggccatccttcgctgcgaaccccccccccccctcgctggcccctttgcgagcgagggggg

SEQ ID NO: 7389 - DNA, 3690 bp, Heterodera glycines
caggccgatctctataaaatttcccctcttttttgtctacagtgtgctcgacttgcgctgccaccgtgaggaggacacccaggactgggtggacaccatcaaacgcgtgtggaagagaccggacagatttggctgcaccgaaaacggtacaactcctcctttccgcagcggctcagttcgtactgccaatggttcgtcgacgcaaaagactgctgggagaaggtggcctcgctcatcgaaatggcgcgcgaggagattttcatcgccgattggtggctgagcccggaaatatttttgcgccgaccgatggccgagggaaattattggcggttggactgtgcgctgaagcgacgcgcggagaagggcattcgcattttcattctcatctacaaagagatggagatggcactcggactgaagagtctgtactcgaaaaagcatttgcaggagttgcacccgaacataaaggcgagtcggaccaacggaatgatggacgaatcgccaaattctaaatttggatcattgggaaatgttttattttaccccttttcaataaggtattttatcaggagtgcatgcacccaaaatctcaccgcctgaattcaaaatctgattcatggttttctgaatttgaatttttattgcttttaggttatacggcacccggaccattatttgggcagcggaacattcttctgggcccaccacgagaagctgctgatcattgaccagctcattgccttcgtcggaggcatcgatttttgctacggccgctgggacgacagccaacacatgctcaccgacttgggctccgtggtgttcgagccacgctcggagcagaacgaagtggtaaagaaaggcgaaaatgcgcaacgtaaaacaacagaagcaacaacaacaatcatttaggaaccaattccgaaggacaacggaaaagtgacggaggacggacagaattggcagcaaattcaccgtcgtaccgagcacataatcgacgaggagaggggccacaaaattggcgagaaaacgactgagacgataagcaaaccctcggcggaaaatggttcagaaacacatataaaattgtctgatttggtgccaattatgcgtattaattaccaggggacggaaccatgcgactgaaagaggcatttgcgacgcaaaaacagccaaagttgagagaagtgatgcaacgcgcggtggacagagtgcgcgcgggacggcgagagagtgcggacggcaacagagacacacagacaccgcaacaaatgcagagacaacgccattccgcggacggaacggcagagaaaacagagattgtggtggagaacggacggccgatggtccgcttttccaacttcaccagcaatttgtccgcgttggaggagcaccaaacgacgaacattttggacacgagcgaaggggggacgacaccaacaacaagcgaaacgtaaacttttaagggacacgggagtaggtagggccggacccaatttcagggtactgaaattttggatcgaaaatacatgagcatggttttcgaattttagcgatttttcgtgaatttgaactctaaaataactttaggttacttttcgaaactgttgcttattgttatagaagataaaaattactttttatttttaaatatttacttttctgtttagttaaaattactacaaaacaagctattaaaagcgttagtccgaacttctgacattttcggggtcggaattaccgaaaaatttgggtttcaaacacatacaaatttgtaagttacatctaacgcagccgctggggaccaacaaatgccgcaggggaaattataaatacggaaaattaatgcataaatttaagacaatcaaaagcgccttctgggccgaagggaatgacgacgccgacggggaacgcgcaagttatgatggagccgaagcagaacaccctcatacgacgagcactgaacaatttgaagcccgaaaaggcgcggcggcgctggcgtttggccatgcaaccgtcggaggaaacggcggatgaatacatagtcaagtacatacattttttagggggggggggggggggtttggcgtaatatgcgtgcgattggttcagctactgccgactccaagagaccaaagtggacatgtcggggctgcaaggggccggcaaattgtggccaggcaaagactacgtgaactttgtgcacaaggattttgttgacgtcgacctggcctttaacggtctttgataagcaacgattttccaaacaaaaacccaatttaagacttcatcaatcgctacgacaccccgcgaatgccgtggcacgacattcactccgttgtttacgggtccgcggcgagagacgtcgcgcggcatttcatccagcgatggaacgcagcaaaggtggacagtttatggcaccgattcattcccaaccgaaattcggaatgcatgccctttttgcagactgagaagctgaagagcgacaacagatacccctacctgttgcccaagtcgtacaattccatccgcgtgcctcgcgtgctgttcggcgaaaacactcagcgagtggaggtccaagtgcttcgctcctgcgcccattggtcctcactaatcgacaaaacggaggacagcattcagcaggcgtacctctcgctgatcgccaacgcacgacactatgtgtacattgaaaaccaattctttgtgtcgatgataaacagcgcggacgtgggaaacggtaaaatgctttagtgggttacggtgttcggatgcccctcttttctgataattcagtggaagaaagcatagttttaagtcagataaaaattacatttactttttaagagatttgccgcgttttgtgcgaccgcatcatccgagcgtacaggtggccatttttaaatcatttattttttaattaaatgctcctaattaattcattttgagggagaaggagacctttcgcgtgttcgtgctcattccgctgttacccggcttcgagggcgacatcggcgccacttcgtattcggcgctgctcgccgtgctccactggacaatgctttccatcgccaagggcgaccactcgctcatccaaaatctgcagagggcgggcgttgaaaatgtgcagaattacatcactttttgttcacttcgaacgcattctcaactctacggcaaatcggtaaaaaaaagagggaaaatggggaggattgacccgtgcccgaacggaacgaatgaatgtatgatcaaatttctgacatttttgaaggtcaccgagttggtttacatccactcaaaactgatgattgtggacgatgtgcacacaatcatcggaagtgcgaacatcaacgaccgttctcaggcggggaaccgcgactcggaggcaattctttggcatttttggtcaattaattaattgattgtctaattgattgggagtaaatgaaaatggaccaaaagcaatggctaactgactgtttcaaggtctgtttgctgatcaccgatcacgaatttgtcgacggccgaatgaatggccaaccgttccgtgcgggcaaattcgcgtcctctctccgaatgcgactgatgcgtgaacacttgggtctgttggagcaatcgcttccgaagacttcgccggagagagcagccgaaattaaaggcatcgatcctgacatgtccatctgtattcgaggacca

SEQ ID NO: 7390 - DNA, 2936 bp, Heterodera glycines
ccccccccccccgcatcgcaaaatttggatcacagagcgatgccgcgaagaatacttagtgttttatggatcaacagaaccggcaacaacaggtggaagtgaatttttgtaaagttgtctttcgttttatggcaaacaaatcgcccctcgggggacaaaggcaaaaaaaggggtgaccgcctcaattccgagagaaagggagggcatttgttggataaagtcaatcgaaatgctgctaaactcacaaaattcagcacattttctccgaaaacattcgtcgctgtccgtcggtgcgtttaattccgtcgctttgctcagtttcaacccgaccaaatcggagatttgcttctgcgccagtcgaatacgtcggaacggagccgtggcggaagaacaattttccctttcgcttttacccctttcgttttttcgactttcgtttcgggcgtccaaaaatgccaaagcgacgagacgagctgaaaatgggaaagtgtcaaatggaagtggtgatttgtgagttggttggtccatttgaggggtcgttttccccaaaaacccggggggtctgtccgaatgcgtcaccaattcacacttccatcattcattgtggtccatcgctcaaagtgccaaagtccgccacttcccccccccctctcccatttctcttcctcattccttgtcgcctgtgtttgtcctttggattctcttccctctctcatcccctgcggggtcatctcccccattccgccggcaatgagttgagttaattcaattccttcccctcttcccccccccccccctctcattgctttccttttcaaaatgcgcagggattagggcaaactgagggaaaaagtgccgataagtgaagggacgaaagaagaaaatttgagcaaaaagaggagatgagcaaaaaaggaaaacaaaaagtaacgtttaaaaagggaaaaaaatgaaaaattggacgattaaatgccaaagtcggaggatgacacaccgtaaagcgcgggaaaatcctctgcaaattgttggggcagaacgatggccagagaatgattgttcggcagtttggaagtgggaggcagcggaggaaaaggggccgaaattggtggcaaattctcgtagactttttccaccgcactgatgttgacgaattgggtccgatcatcatcatcctccactaaatcaattgcgatcactttttagcaaaagattccttttcaatctcctctccgatcacttatcaaatcaatcccaacttccatcctccctgatcagtccacggtccctccctccccaatttctttcctctccatcacttcgtcttcctcctccgatcagtccccactcacatttctcttccattccgctgtcactgttgcaattggtccttttcctcccgctgtcgtcctcttctcttccttccttctcattctgatcacttcctttgctccctccgattggttccattggtaaattggtgtactgttgtctttgttcgtccccataactttcgcttttcctcttcatcagtgcatccctcttcattttgtgcttcatccttatccgtctcagcaccgtgtaatgacggcccgagggcgagaaattattagccgaaggatcactcggccgaggcaaaagttgaggagaaaacatttggcaattgaggccaaccgcaggagaagcaggaggaggaaggaaatctcgaaatggagaaagaattatgaaaaaatataaatgaataaatgatcagtatggctccaatttttaggtgctaaaaatgggaaaatacgtaccaaaaagtttcaaatttaggggtgtaaaatcataaaattttatccaaaaagcaacaaaattaagctaaatcagtaatgagatacataatttttaaattcaaaaaaatttgacaagaaaaaaaagaataaattttgtagatgaatttttgagaaaatttttcatttcttttcttaggggggggggtatatcttttaaaattttttgggtcgcttcttaagagtgtgttattcgtttttattgcattttgttaataaattttgagcaaaacaataaatagttgaaatagttttttcaaaatttttttagggttttaggtgcgaacaataaaaaactagaaaatagttgctaacaactcgaaaactagcttaacaataacaaccgaaaaaacatgtttttcgtccgtttcaggccatagggagctcagaaaaaaataggtaaaaaactaaaaattggagccctaatgatcagcaccaattaccattgatcactgatcatttggtcaataatcagtgataagaatggtatataagtgatcaaaaagtcactaataccaaaacattaagtgataatggtcaaatgatcaatcactgatcagcggcgatcacttgtccctaatccttcccatggcttttctttctttactcactttccgtttcattgcttccggcggaattcctccgaaagtccaacagaattggcgagctgcacttctcatcgtccatttgctgctgcttttcctcctccaatgccatttcggttttccccaaatgatcaaattccatgtccaaaaatgccctctccgtcgttttgctgtgccgtttcgctccgcgcaaatgctttggccgacggattgcgttaaaataatcgtcaatttgaagttgctgctgtttctgttggcattttgcccgtttttggcgctgtttattattcccatgccgttgctgttggttatcatcgctgggcttaggtcgaaaatacaccgaagtttcgtctaaaaggcgaaagtgacagagcaaatcctcctgacttgactttggcgtggaacacgaggccaacatttctgaatttcctttgccttcaaatggaatttttagtgccatttcacgtgccattcattacctctctctctctcccgctttccc

SEQ ID NO: 7391 - DNA, 1207 bp, Heterodera glycines
cccctctctccccctttcccccccccctctctaccccctcgttttcttccttccccctccccactctctcccttcccttccttccttcccgctcccactctctccctatctctcttcccttcccgcactctttcccacctcttctgtcccagtcccatttcattctcgacggtgtcagcacttctcttcggtggacgattcgcttctgaaacttcttctcctcttccgcttcggtgtccgattgggtgaaattccgggaggagaaagtggacgaactttgggaagagatggagtggggacgcacggtggagaaggaactgtaggggaacatcagcagagcagcggaggaagaagaacacgaggaaggacgacgattaataagggcacggaagaatgggcattggaagggacaaagtcgagaggaacagactgaaagtgggggaaatcagccaaaaagtggaaaccatcggatggaggggtgggaaaagaatcaaaaagggggaggggaagataagataccgtggggagggattgtcgagagtgcggtgagattggaccttcaggaactttttgatggtcgatgagacggtcaaggggaggggactaatggtccataagtgatagaggccaattaagtgagcaatcaggcggaattgaaaaacacaaatggaagcgaatgggggaaaagtggcgatggagaaggacactctcgaacggacaccacaaaaaagaaatggatgtaggaaaatgatgaaacggatgaatgagagaaattgggaggaatagacaaaatgggaaggatgataggctgatgaacaaaaaatgggaaaacaaaacaaatttgaagggaattatgctaaatgcataaaaaagggataaatggacaattgggttgtttggcaaaaagtgccaacaaataaatgatgaaaaaatcggaattaagcgacaattaaatggaaatgatgatgggagagatgggatgaacaaccggaagaatgggcaaataatgaaaggggggaggaaggaatgggggagaagaggggggaagatggaagggagggaggggcagaagggagtgccaattgcagaacccaagtcagaagagctcaacaacatccccgcctagcatttatattggttgggttgggcgtggcaaaagaaattgagagaaatgtggaaaacagagggggggggggggattggagga

SEQ ID NO: 7392 - DNA, 978 bp, Heterodera glycines
tttacatggaaaagttaggacctaatcatatacccatatgatgttggagcaaatattcgaattaacgaacagctgatggatggtcaaaaatggccatcagagcaaacgctgtgggcattgtaagcttattgcctttttaattgcttttatgctcgggcgatgtccatttgaatgtccggaagggattagctcggaagtgacaggtgccgagaaacaaagcgggcactaatccccgaggaaaagcggaggaagggaagtgagccgggattatcgcatgcggagaacaaatgggattggggaagggggaggaagggacagcgaagtgggcataatgaagaatgaaaagtgggggtggggcaaccgacaggggaggaaatgagacacgggtgatcgttttgaaatgccaaaatttgaatttatggacgacgtgcgacaggtgggcgggaggggggaggaagatcattttccaaatatgccgtcgtcaccctctccaccccgtccgccagtggatcattttcctcccgactcaccaatatttccattgaaattaatgaatttgcccatctgttcccattgggcaaaggtgccaaattgaaataacaaaagtcattttgctttaactgacttttgttactttctttgtttgctcagctgttgctgcgcatttgaggaagggcgaaattggtacggaaaaggaggacagacaaaccggcaacagaacattttgccaagaatggcacactgacaaaaaaaggtgagaggggaatcaaaaattgagacaaaaagacggatagaagaataataagaacgaaaaggacatcagcagcagggcagagagagaggagtttaaattcaaacgcaacaaaatgatttatgaattgctaattaagtgacgggcaaattggcgccaaatggcaaatttcaaatttgtgcccatgattgcattaatacctgctgaccgacaaataaatcttaatc

SEQ ID NO: 7393 - DNA, 278 bp, Heterodera glycines
aaagaagagagggagagaaaggaagagagggggggaattaaaaggagaaaagaagagagggagagaaaggaagagaggggggtaattaaaaggagaaaagaagagagggagagaaaggaagagaggggggaaattaaaaggagaaaagaagagagggagagaaaggaagagagggggggggaattaaaaggagaaaagaagagagggagagaaaggaagagaggggggggggaattaaaaggagaaaagaagagagggagagaaaggaagagaggggg

SEQ ID NO: 7394 - DNA, 1342 bp, Heterodera glycines
atcctgaaatagcacttttacagtatactcaagatgacttctaataaaaattattcgttagttttttaatagaaaaacgttttttgtcaatttaaaaatttttatattcacaaaagctaaatataatttatattaatgtagaaaacacaaatatttgttttataaattgttaatttcataaattatttattagatttaacttttaaaagaatttttattttttttatatttctttcataaatcctaaattgttcttcatcccttctaattacaagtttatggaaggaagaaaacggcactttcttgcagccaaaaattagaaataattttttcggtacaattaccgaaaaaatatttatctaataaaataggaaaatgactaaatcaaattaataaattcaattcaacttttaaaaatttttcgccttcggcatcgccggactaaatattgaaattcttttgtttttcatcataatctcaaaatcaaaatttaaagggaagtcaatttcgagtcattattatgtgaaagttcaacgaataaatgagaatttgaaaaagatgttttttacatttttattatttattgcaataaaataatgctctgctttataaaattggtaatttgccaattaatatttaatacatttaattaatcaaataaataaaagaacacccaaatatagattaaaaatggtcgataacttagcatttaataaatgaatttaaattatatttttattttcataatattgatttaaaaatgattttaaaagtttaaatatttgtcgatttaaaaacaatttttatacttataaaatggaatatcgatggcttttcgtcgtcccccccccccccgaaatattgttgtacttttttttaatcataaaatgctggcctgtcatttttatgttatttttgactaatatacaattttattatttgtttgccaatcagtcatatcggagaaaaacatttatttcaccaatttttccactttttaagtatttttcttccatccagaatttttgttactaatgccattttctaaacttttatttgtcaatcagtcacattcgtcgaaacatttacgttgccattttcacgcatattaattatttcacaaattaatgtgttactaatggcatgggtgtgagagcaaaagccaaaacaggcctttaaaaggcgcacaaattgaagcgccaaatcattcattcattccgctcaaaagtgccatcgatttcctccccacaaaaagcatcaaattctcgattctcggaaaaatgaagccaacattcaacttcaacctttttgcatccgtctttcttgtgctttgtgtggtaag

SEQ ID NO: 7395 - DNA, 1939 bp, Heterodera glycines
tttcttcaaaatcaggcatgtaatcaccccatttgcgttggaactggcaacttgtcactcaaacgatggtcgtgggacggtcgtcattgtaaggtacaacaagcaatcaaacaatttaatggatgagataagcaccggctttccccattttctgatttttatttatttaagcaattcatctacaaagggcagggcggcaacacaaacaatttcccatcaaagaagcattgtgtccaagtgtgcaaggtgaaattgcgcggcacgatctatgagaaaggcaccaaaggggagggattgtttaattgagaaaacgagaaatggcgagagagtgtatgggaaaaggaaggagacataagagaacagacagttagagatcgatgagagattggttgccccttcctcctcctgttaatgggataataataataaatttaaaaaatcaccaaaagtgaaaaaaatgagataaaattattaataatgtgattggtacggtacgtctccatgccgtcccttaccctcggcaggggcttttttaagcccagatccccaagacacgtccatgatgtgaggggtggatattggaattattgctaattaattgcccaattttttcagccatgaatgagccgtggaaagaaggtgcagcgtgaagagaccagcaaaagaagaaaagcgaagaaattcaaagaaatttttgaaaaataaaatttaccgctaatagttaaaatgattttggtggaataaacaaaaaatttgcgtctgtccaaataaaaaatttttttttctgacaaatacggaaaatagagcgaatcaatcacaacaatcaatcagtcccccatttctgatcacatcgcatcccatctagctcaatcgctgtgcttagatgttgctagccatccattttttgtttggcattgcgcaccacggcataatatttctaaataaaaaaatagcgttttcgtgaaatatcaatattaaattaaaaaaatatttttaattaaaatacacacttcgccgtcactgaacaatccaaaatatggtgacaatgatgcgtcctttgctttcaaaccgaaattgaaaaatttctcgtcgtcaattttttcaatgacgaattcagcactacgttcagcagagggcagcaaagagtcggagaatgaattctaaataaattaataaaataataaaaaaggaattattaaaaaaaatacatttaaatcggagatatataattagccaaaagcaaacaatttatatatataattagccaaaatcaaataatttcccatttttgttataaaaataaaccattcaaaataattctctccctagcggtccaatttcggcaccggtggacataaaatttcattttttcggtgccatttttctgtaaaattggcggtccgcaaaattttcccaccagaatttcacaggcggacgtcgtctgctgctggccgcttcgcttctccatcatctccttgaacatgttcattccgaacacctcaatgccatttgttgtcttgtcaccgcgtctctcgccgaacgatttgcaaatgctttggcgcatgccaagtttaaattggcgttctgttcctccgtccgcatccgccattgttggcgcctcggggctgaacaagcagcccaacaatgtgccaacaaagcgtttccggtacatttcggttggcaccggtgacacaacttcctgagagtttatgaattccgtctttaatctggtttggcattcccttgttaatcgattttgtccaaaataatcaaaatagataaattaattttattacatttaaaattaggcgttatacataagatagaaatggaaatttaaaaaaagcttttctttcttatgctttaatggcaatccatttttttcatgcttttttaaatcttttgctaaatttttaatacgacccaaactggttaaacc

SEQ ID NO: 7396 - DNA, 1704 bp, Heterodera glycines
tgcagacaaaggtggctttctgttcatatttcgtgtctgctgccggctgtcttttgcagtgtgggcaaattgcgcggattgcgcaattttttgtgccaattgttgtgtccacggattcgtcgttgctgccacctgtgctgttgttgttgttgttgttgccggattcgttggttgggggtccatgaattggacaacccaaaccaagcgcactgtagtcattcagtccattggtggcaaggtactgtaattcgaatttttaaagaaaatttcaagaaaaaattttgaaaattatttagcgatttttcatattttttgatgaaatacaaagtttttttcaataaatttctccaaaaaatcggcagaaaatttttcttcttgaaattttcttaaatttagaatttttttttttgagaaatttcggtttgaaattttttaatttttcggggaggggatgcaattcccctggtccccgaccaaataagtcaccctctaaatcttaaaaatgtttctttaaaaattaaaattaaacaaaattttctgtatttttcaaatgcttacgtgcgcgtcttgcttcactctgtcggccaattgtctatacgcttccgcagacaattgcgcgaaaactcttttttccctttctgtaatacagtacccgacgcacaaggagaaaatcaagcggcgcttcaaccgttccgaagttgtttacaactatgtgcagcgtccatgtacgttttctggacggtgtaaaaattatttttgaattgttgcacttttttatgggtgcatattttcatcatcctcaaaaagggaacttttatttttccaaaaaaaaagaaagaaaaatatgttattttcctgaatttctcgttgaaaaaatattttgattcaattttttgaattttcggtggaaaaaaaataaacaaattaattgcctcttaacacggagactgaacttgttaataaattatgattttttatttcccaaaaaagtgacgggtctgtatttttccccttaaattttacattttttacaattcgcttttttttaattgcccctcccctccctttgccactgtcagtcctccactgctcctgggagaaggaggaggcgcgttcccgccacgtggactttgcctgcccaattgtgaagagcaagtccaacccgagtttggcttccgccgcctccgaccctttgccgcaggtgccattttcagaggagacaatttttttgaaatatgtgccgttttcttacaattttcaaaaaagagtgatttatcgcttttaaaagtaaattcaacaaagcatttgagtgctttttaagcctgcgccgttgcaaaacaacatcaacaatgggtgggcggcggagaatggtgccggcgaacattcggccaatttccagcaacggccgacgaatgacaacgacgggagcagcggaaatgagaatgaggccggtcaccacccaccaccgccctactcctcctcacagcaccaccaccattcccaacaaccgttgttcctcaatgtcggctcggcaccacccaactacggtcacaacggcaacagtaacaacattggcacaacgccgcagcaactaccgtaccatttgatcaataatggggcaggcggcacacagacgacggtgagtggtgctgaagtgatggggaccgggacaccactggaacgacgcggattttccgggatata

SEQ ID NO: 7397 - DNA, 3149 bp, Heterodera glycines
tgcatttttaagcgtcaaccattgcgctctccgcccgcaatcgtgcagaattcggcagcggatgattgaggcttaatggtttctgatgatatttttcaatttccactctcttctgtctcattgtgttcctttgacgcatttattttctatgcattcgtaaattgaaacttgtcataaatgaagcaaaagccattgaaggcatgtccgcgtattgatgggccaataattaagcataataatactggatggttgactaattagccgaataattagacatagaatggaatgcgctcgcagatcacccggaacagaacgcaggagaaaacaattttctattttatttcatactttgtttacactttttgaaataaagtgagtcatcattttgtgacttttgaaaacaaaaaaaatcgaaaaatggaagggggagcaaagcacgctattaccattgttcgttctggtgtgtgatatgaatcactatttcccattttggtgtcttttccgtatgcatttgtaattgaaacttatcaaaagaaaaagcatggataaaatgaattttcttttcgaaaaaataataaagtaaaatacgtacaggttaaatgtttaagaaattaagattaagcagaagattgatcatccacacttttctccgtttttcgtttaatcgctttcactttcttcctcgaattttccgttgaatgctctcccattcgccatttcgtccaacccaaccttccaaatctgatcatccgccgaattccaatggaaagactaaataaaaaccaaaatcactgccagcgtagtggaccgattagagtacgctacactctcccccatgtcgtctctcttcccccgaaaaaataagttaatttttcaacaaaaaactaaaaatttctaggaaaaaatagaaaaattttaatagccaatttgcgtcgctgatgggggcggctactgggccccataaaagcaaaccctgaccagcataaaccggtacccatcattttatacattaattcgtgaatttaaaaaaattgaaaaattttatgtttggcttgaatctggctggatccatgcttggatttcgtaggtcagtacccaggccatttttggcaaccgggattttatccagaaatccaggaccatgccttttttaaaatgcacaatgttcatgacatatgttaagttttcgcaataattttgctgtccgaagatttgatcaaacaaaaaaagatatttttacaaaaaaaaaaaaaattattttagctaattaaacgggacgaagatgaattaaaaatatctcacgaccagggacgataattatacgggggaggggctgatcccgggagaaacgagctgctcccgaccgactaggcaaaccgtgtaattgcgtccataaaacccataaattaatttccaactttttgtgccattatatgccaaaaggtaatggccaagttttgattgtaaaatttcccgcatttgcgagtttatttccctccggttcgcaatacctttttcgcaccattgccctttccgaccgattcaatgcgaacggatgggcaatgtttcgcgacgaatgcttccagttgattgggtgtgtccaacgcgttttcgcgaatgactggtccaaacaaacacaacaacaactcaaggagatcgtcgcgcttaattcgcaaccaaataatggccacggaaatgcaaaataacaaacctccatattacgacggctaaacatcgtctcgttgatcagtgtggccatcgatgtagaattcccaaaaaccttggaaaatattaaaaatttggcaaaatcaattcgaattttgtgcccatattctctatctggtgagaaaagaaccgttcaagagaaagattaattttgtgcggccaaattaattaaggccaactgtagagttgacttggtcttctattctgttcttaatttctgggtccaggtattttcggaaacctggatttttcctaaaccaagaggcaaaattccttcagcggtatctttctgcaccattcgctaaccatggacgttttgtcgagttggatggacgtgttggaagtgctcggtgtttttacgggctcagcggacgtgttggaagtgttgttggacgttttgtcgagatgaatggacattttggaactgtcagattcgagtttgatgattttttttttactagttggtttgcccttctcaagacgcacaagtctttgccgattcgcttcgcccaatgtcagttgccggtgctggtgctgcaatcggccatttgagtccagcacctgttgtaacgggtaaagtgagtacgggcaccagccgaaagttccaaaatgccaaagattttttttttttgcatattcatagtctttctgacaatgagctcacaaacgaatggtccggtggtgtcggcaggcggacaaaaaaattttgcaaaatgatttaaaaaaaggaaaatgacccttgcctggcaaaaatatttactttccgttccaatgcttcgtccaaaaacagcctttgcgtggtgttcgggtcaaccacagtcagcgacaggttgtcaaaaaagccaatttcgacggcctttgccagtgacattggttcgcgcattccgtgcaaatgcaccgtcccgttttccgtgttcaaaatcctttcaacaatcgcctttccgacgttgtaaccatgtaatggcacttcgatggtgccattgttttcgttgtaagcgcccatcaccgcctaaacgaaaaaaatggcataaaaactaacataacctatgcaaatttttaaatttagaccatttcaaaagtttcacttttggcctcttttaaaaaagcacccgacaaactggtaatgccatttttaatcctggccaggtttatgcaattattcctttcttaattcgggccctggcaattcaagggcatcttttgttcttattattttctttacaaactttgtgtccatttcctcgctctttttgttcgtttggcgccttgccagtcgtttctcccttattttaataaaaaatgatcaaattagaaggaaaaaacgcatgtttacaaaaaattcacccgacaaaatgtaattcgatatttaaaacaaatatgtaaattgaagtgtgggcaaactacgacaccggagataccctaac

SEQ ID NO: 7398 - DNA, 4781 bp, Heterodera glycines
  misc_feature (8)..(8): n is a, c, g, or t
aatgattntgaatgaaaaaattagtaagaagaaaaaggccgtagaagatgagtgaagttgagaaaattgaaagaaggaatggaggaaaataaatggaatagacggaaatggatggaagaaaaaacggagaaagagagagagaaaacatagtagggaatggaagaaaaaggaaaaaggaagaaagagcaaagaaggagtgatggatgagaggaaaatggttggcggaagagaaagtacggaagacaagagaaaggggaaaaagagagagagaaggaaatggacggaagaggaagaaaaagaaatgatggaagaggggaatgaggggagggaagagaaagtgaggaagaaaaaggaaattggaagagagagagagggagagaggggaatggacggaagaggaagaaaaagaagtgatgaaagagaggaatgagcggcgggaagaggaagtgaggaaggaaaaggaatgaatggaagaggagaaatcagggaggtggggaaggaatggaggatcttccgccgccgtcttcacctcctcccccgcccaattcgtctgtccgtcccctcgggggaggggtggggtcaacgcccaacgccgccctcccccaacagcagcagacaatgtgaataaaccaagcaagcaaatgacccctacacttctgctgctgttgatgatgaccaccccctccccccattgaacttttttatttgttagcacagcaaaatttttaccaaaagcgtcgtcagagagggggggggggctagcaaaaaaaaaaaattgaaaatttcaccaaaaattggaaattttaaatgcaaaaatggcctaacaaatagcaaaatgaacagatcagggacccaacccaagttttcagttaaaattaagccatttccaatccattttgttgttttccttaattaaacatgaaattctcatagaaattgggggctcacaaaaaaaagagaaaattttttccaaaaagtggaaattttaaatgcaaaaatggcctaacaaatcggaaaatgataccccacagggactcaacccaagttttaagttttaaaattaaaccattttcaatttttggcttaattaaaacataaaattctctcagaaattggaattgctcctcctcagctgtcctcctccaacttgaagttgttcataattgggttggttctcttttctctctctctccgtttgcatttgctgtgctgtggtgaagtggacgaacgcatgcacacatttattatttgcggatgagtgaatttgagatttgtctttataccatccaaaaatgaaaaaaacggaagaggaagcggaaaattgaaatttttgtaaatgccgattataaataaaaagcacagtgatcgctgatcgaaaatttttttgtcaaaaaaaaactccaggattcaggtgggatccgatttagaattttgttacaaaggtccggaattcgtcccaagaatcagtggatcaacaaatccaggaaattttctgaaataagaatgggatgggatgtgctcaagcattggcacacaccagacagcaccaccatttgttgtttatagcctgggacaaaatcaggcatttccgcggcaaatttttttttggcatgaaaaatacgaaaaaatgaatttcttacattaatttgctcccccgagggcttccgggattacttttatttccgtaaaaaatttatgggtctcactcattgtgtgctgctgctgtgcacataatgatggactcccgcccgcgagcatacaatgcgcaatttttttttgacgccgacgaactttgaagtacacacattttcacaacagcgcagaatttgggtcgactcaattttgacgcccgggggaaaaatccgccgataattgcgactgcgccgacaattgaaaaaaagggtggcatggagcataataaaagcccatcaaaagtttgttgggaaaaattcaaaaaatgtattggacattttttggcaccggtagggacagcaggggggggaccgtaccgtagttgttttgttactcaatacagtaatatacccgtgtatttacaaaggaaggtccccaggtgtccgtgggatttccgaatgaaatttggtgggtggatagagcacccacaggttcttaagaaaagtgattttattttttgcggaatgaacccgagtgccgagttatgacgtgccaaagttttttagtgaataaataaattaaaatttatttgcgccttcatcaggtctctaatggcgcagcggtagtgagctagtcctcgttatttaagctcacaggttcggatccctgacatgcaaactcattttttaattttatttttgcctttttatgcaaaagtaaataatcaaatatgtttttttatgaactgattttttttaccattttaacatataagatattcaataaaaatattagataaaattatatctttaacagaaaggtgtgtatcttttaaattaaattattgcgtctttatctttaatgatttttttgggtgttaatgaaataaaataaaataactatttcataaaaaatatttttaataatagactgcaccagaaaagcaaaaataaaaattgtaaaaatgtattagcatgcagaggattcgaacctgagacacaaaataaatttaactaacgcactacctctacaccaatagatgcttgtggtgtagtgaagtaattatttcttttctttaattagaaaaaaccaaaaactttggcacgtcataactcggcactcgggttcattccgcaaaaaataaaatcacttttcttaagaacctgtgggtgctctatccacccaccaaatttcattcggaaatcccacggacacctggggaccttcctttgttagtgttattcagtgcaatatttatactgtactttatattattgtatggactggggaggtattttccctgttttcaagaaaaaattttcaaaatttttcgaaaattatgagcaattttcttggcaaattgcattaaaattcccaaaaaaatttttacccctatttagcatattttttgaaaatttaagtcaaaaatggcaaaaattggacatgttttggcgaaaaacggctacaaattcatggttttctccatagagaccaaaattttaaaataacacttgaggaaaatattcatggaccgaagagcaaaaaattcggctcccccctccggaattttttttgttttctggctacaggcctttgggggggggtgcattttcgggaacagttacataattattgttgcagtagttcatgtgctctctattttccgaaatccgacgaaaattgcccgccccccaaaaaaaatttgtttttagagaaaatctgtccaacaaatccatgcgcattcattcatcacatagaagagcacttcacaaacatcgaccacggaagcaagcaattcattcattcatttcgctggtgaagtggtcgccgcgggcgggcgggcgatggtcatcgaaatccatcgaaatccgaccaaataaattggaaaagtgttaaagaaagagcccagcaaatcgatgcacagtgatggacaaaacaaaagcaatgtgcttggggatcggattagaaagaaaagtgtgaagcaattattggatggttgaaattgtgagggggattttcaaggactggcaattgcgagggttttatgaataggcaatgacggattttttaaggacatccaaagataggcaattgcggactttgtttaaggctagagcttgcgggttttaaggacatttcaaggacaaggcattttggattttaaaaacatttcaaggacaaatttttttggatttctagacatttcaaggacaaggaattttggatttttaaagacgggtctgtatcgttttggcgccgccgttttggcgccagcccaagttttcggactataacttttttatttgttatccttataccacctaatcgttggtcatcactcgacccgcttaatgtgtctagaccactctgagagaatagatggtttgagatttgtactgaacaaccttattggtcacaagatgccagtgccattgtcgaggctgttgttgtccgcttgctgcccacgcgccaattttcatcccttttctcaaacatattttatgtgttatatgtatgcttttcgtttgccccccgtggggccccggaaatgaagcggaaaaagccgcaattttgtccacgtctattttgcccgtcccagggcggaccgccggcggggcggcgatggcaaattttttattttttgatcaaaatttattttaaaaaaccttttttcgaaaaactcgaaatttaaaatattaaaatgcaaaataaattgtaaaattgtcatttttgcgatgaaagaaatgaatgttgtgatttaaatttggaaagcttttctctaagataattaagagaaattaaaaaaagtctcagtttttccattttaatttggaatttttatattataatattattaaaatcttgctttttcatttctttttttttacgaattttttagtttacttttacccataaaattgaaatgataaacgattatcgtcggcgggcgtctttaagtcccagcacaaataaatttgggcatttatccaaggcactaaattggtatttggccttcccaaatggcaataacgcattttttaaaaggaatatatgaaaatatatttttatttccatttattttttaaaccatttttaaaaataatattttattatatttccgaaaattatttttttatcaaattttgttt

SEQ ID NO: 7399 - DNA, 897 bp, Heterodera glycines
ctacaaaatttcaaaaaattttgttaagtttcaaaagagttaggtccaaatatgctcaaaacccaagattttttgagttcctctagtcataacttttttgaaatttgacgaaattttttgaaattttgtagtctgatagagaacacttagggctatcgaaagatatcaaaaatttggttacttttgaaccaagttataaataatttttcatcaaatcatattgatggttttttaaataaagactccacccccttttaactcattcattaattgtcaagaaatgacaaatgggacagggagagaagcaaaagcattctcttgacctttcctctcggcaaaaaatgggatggaatgcccacttgaaaatggactttttgtggccaaatggtgcaaaagagcaaaatgaacgatggccaaaaggtgtcgaaatgcatttgcccccgggggtgacactttgcccgcctcctttttctctgattaagtgcgaaaaatgtgatggatcattttacaattattggcacagggtgaaccgaacgggccgagctcccccaatgatttgtggggtgagaaatttgggacgaaaacagcagaaaatgaggggatggatggcacacccagaaaaatgatgggtggcaccgcttggtgcacttgagtttccccagcacattagaaattgaacttcaaaaatttttcgaagggggggggggtagcaaaagaaggaagtaccgaaaatgattccaaatttattttttaaaatagttttttgaatgcaaatgtttttttaaatttagagatggaaaaccccgtaatcgagattggtagggatcgggtgcccaaccaagagaattagtgggggaatcagtgcttttcctgttacaacaaagttacgaaattcag

SEQ ID NO: 7400 - DNA, 4832 bp, Heterodera glycines
atcatttttattctgcttcaaatgttatgagcgcccttggcgaagggcggggaggagtctcctgcgggtcaacatgttcagcgcttattgtcgagatccgtcttgcgccaatcaaatgctgtcgccatgttcggtgcagcgccacgcttacggatgatacggtattttcgaaaccgtgacgcatttgatgccgccgttttgccgcccgcagtgccaccaccaaaccccatttgccgatcaccgagcaggaccgggtggtggttctgctgcgctgccgtcgttgttgccatcacttcgtccataccgtagcccctcggcatggcggcggcggttgcggcaccgttcggcacaaatgccatcgacgtcgaatgcggtacggtagtaacaaagtcgtcgtcatcgtactcccttccgatgacaccaccgttggaaagcatcgctgtggctgatggcggcagtacagtgtcgtcgtcgccaatgtcaccgtactcctcctctcccactccgaccgcggacacaccgtttgacagcatagcgatcgccggcggcacattaccaccagcactgacttctccaccatcatggtcgatgctgtataatgcaatgttctttcccgacgtttcgttcgagttcggaggaaaaaatttttaaagaaaattttacaaaaaaaatttttgaattttttttgcgcttttttcaaatttgcatgagttaataaattttctcataacttaattaaaaaatttgcttaggatttttgaaaaaaagaaaattttggcttgaaatttaaaaaaaaaattttagggggtaagaacgtagtgcacccgaaatatgatcgtcgcccgagtgtctgcttttacctgccactgtacgcgtcgaattccgccgctgcggtgccgtcgttgtcctccgccggctgctgctgttgttgctggcgcatggcctcccattgtgccatgtcaaactgcatcatgtaaaggcgtgcctggcggtccaactgttgcagaatcacccattcctaaagcaaaacatggccaattcaaagaatgggaagcaattattttcctctttattttaaaaaaaaaactaactgaattttttgatcagcatttcttaaaggggtttttgctagtaaccccaaaaaatgtttgaatttaatttttcggggtttgaagtctttctttgaaagaaaatagccaaatttaaagaaattaaacaacaatttgatcaaaaaaaaaaatttttttttttctaaataacaaaaaatttaactgttttaattttactgattcgtaatgctctctctctctctctttacctttttcaccgggtagcattgcgggtgatgagccgggaagcaatcgccttggatatcaccgtccttcatcgtcaactttggccgatattcatcctgcaaaagggaataaataaaaaaatttttaaattttccttgaaatttttattttttttttgccgcgacattcattatgtctcggcgatgttacggcgacaaccttttggggtgcatcataaaattttgaaaaaagcactataaaaatttctcaatttttttttcttataatttcatataatttgaaaggaccatttcattttttcctaaaagaggctgtttttaaagtctaaaaatggtataatttttaaaaaataaataaaatattcaattatttattacatttgtgtaacgcatcagcgactcgcagcgcgaacagcgaaagtacagtgtgtcgccctcccggttctgggtggtcatacggtactggcggaccatgccccagttgtgctcctcctcgggcgggcatggaatggacaaaatggtggcactagaaattgcgcgacagttgcaactcaacgcgaccggacgaatggaatctgagggaaaaatggcaaaaacacatatatcagagaacgcactggcaattaaaaaataatttttttttttttaatttctttaaattgttcctcatttttaaattggggtgatatgggttcagcacacaaccaccttcgctttcgaaaattaaaatttcacagaaattttcaaaaaaaaacagaaaacttttttataggaaaatctaaagaatttttttttttttgcgatttctcaaaatattattttgaatcaattaacaattattttttcaaaactgttccaaaaatcacacaatttcaaaatatcgttagaaaataattattataatttctttgaaaatttttagtaaaaaaatttttaaaaaattcgggggggggggcaagctgattccaaataatgtagtcatcattcacaccaattttatagaaaaaaataaaaaattatctaataaatttaatttttgggttgaaatttgggaaaaatgtccaaaaacaaacaaaatgtcgtagactctgtccggctgagcgcgaatgtactgctcgtcaaagccgtagtgttccatgcagaagtcgttcaggttggggggcgccgtgtgctgcatttgttcagcaaatgacggcgacttgaccattccgacagccgattcgtccccgataaattcgtcgtatggcctcaaaaagggagcggaaattaaatgaagttataattacgggtaattttaagagtattaaaaaattcttgaaaaaaacggatacaaattgccaaaaaataacagtaaatcgattgggagaaatgcgccaaaaatacggtattcattttaaattttcaaaaaatagtaaaaaaaattattgttttgtctgtatgaaaaaactcgtccgctcgcacatcgaaaactatttccatcaaaaattaatttatttttattttttttcaaaaatttttcaataaaattattaaaaagtcattgataaaatatttcatttattttcaaaaattaaaaattttttctttaccttttcatgcctttacgcttcggttgcacaatggcggcggcatcgtcgtcattttgttgtgccgacatcggaccaacgcagggcgcaaattcgcgctcaagcaacatgtccaacccgtggtaatccaacacggttggcatctgtcaataatgacatacacagttgaaatagaaaaaaattttaaaaaagttttttttttttttttgaattatttataaaaatgaaaattgcagtttgagtgccaattttgtttccaacattctcaacgcaattaatttaatttaaaaaaaattctaatttttgccaattttttgccatcgctcaaagattctttgatggtatttatgtttaatttcaattttactataattaatttaaaaaaagtgctttttacttccgtaaatttattttcaaatttcagatttgctagtattctgaatgtgagcattgttccaattcaataggttttttatttaaaaaaatgaaaaatttcatattttttttcttgtcattttaaacggtgcatttcaatattgtaaaacgtattttttaactgacccccacttcgtacgaaaccaattgcttcggttgtcctcgccttggacgtcgcgggtcatcaccaacaagatggacacgcaaagcgggatcctcctaaaaaaatgtgccaacaacagcaaaatatacataatgagcaatatattgtatttctatcattatttacacttatttgcttttcaatttaatcggaatttcaaaaaaaaactgttgggtttcgattcagttcagttttcattttggatttttcggacattttcccttttctcatttttgcccaaaacatttcctttgccattcatccacaaatccatcactcaatttgacccattttcccatttctctttggccaaccattttgtaatgtcactcgcttggcccctcccattatgtcagtatttaagctccccaattgcctctcgcttttaaccattcttttcccattctcatcctgacccttactcatctcacactaaaccaatttactttacttttcatcctttttcctttgcttaattcttaaacacaaataaaccaatcgcattcccccttttgtgggcatttggaaaagttaatatttggtgaaagttggaattaaataaggcacatcggagtctaagcttagtcaaatacacaacaatttttggtgccacgacccgggagaaggtcaaaaggctaagcaagactagatgaagcagttcagctgtggtaaaggctctgtgcctaaaccaaatccatcaaatttgagctggtcttagttgtgtactaccagccaggctgtttgtgccaatcaccaaatttaaaggagctggtcaagtgtgttttctagccgagctgttgtgctgaaaaaaggactaaatgtcttcaaaaaaaagtgttttaaaacaaaaaaaaagaattttggaaaatggctgagcaaaattcttttaattctcaaaagggcgaaaatgtggtcctacagggacaaattggttcggatttcgatccaattttctttacccctgaggagaaccaaaatctgaacaatgtactgactcgaatgcgaacattcgaatccgctatttgccgtcaatttcgtaaattggagcgagaatttgcagagttgaaaattgtggctcaccaatcagatgataccgatcgaatggtcaaaattgaacggtcaataattgatttggaggatcgagaagaaatggacaattttcaaatggaagaaaaagtgataaaaatggcagaaaaggctgaaactctcgaaatacggcaaaatgcatttgaaagattgaccaaagtcaaatttaacaaggtggtggagaaaatgaaagtggaaatggcgaaaaataacagaaaacattgacgttttgaaaataagagtggaa

SEQ ID NO: 7401 - DNA, 793 bp, Heterodera glycines
agacgtgccattattgtttaacccaccaccaaatgtgccggtaattttgggtcgttttaggttgcgttttctcaaatgaccaagtgtattttttaggaaattcgtgtgggaccaaatcatgatgggcattttttccaatgccgctgagagttttgccgcaaattatacatccgccaccaaatgtgccggtaattttgggtcgtttttggttgttttttctcaaattcccaagtgcatttttcaggcatttcgggtccaaccagttcaacaaccgataccactgagagacgtgccgctatttgtcaacccaccaccaaatgtgccggtaattttggctctctttttgttgctctttcaaaatcccgagtctttttttcaggccgttcgggtccaaccagtgtaacaaccgataccgctgcgagacgtgccattatttgttaacccaccaccaaatgtgccggtaattttgggtcgtttttggttgcgttttctcaaattcccaagtgtattttttaggaaattcgtgtgggaccaaatcatgatgggcaacaaccaatgccgctgagagttttgccgcaaattatacatcggccaccaaatgtgccggtaattttgggtcgtttttggttgttttttctcaaattcccaagtgcatttttcaggcatttcgggtccaaccagttcaacaaccgataccactgagagacgtgccgctatttgtcaacccaccaccaaatgtgccggtaattttggctctctttttggtgctctttcaaaatcccgagtccttttt

SEQ ID NO: 7402 - DNA, 1256 bp, Heterodera glycines
  misc_feature (56)..(57): n is a, c, g, or t
atttatagactttactttttgtgttttatttcgcatttaataaggtgtgtcgaacnnggtaattctttcatatattatacccccccccccctttttttgaaattcgccacaattatgccctgcccgctccccgccgaactgatcaaggaaataattgatgctattccccctccaaaaacacaccggcttctgctagtaaattttgttttggcatcctttgttaaatgtcggttctattccatgatgagaagattgtttcgctcagatcatttattaatgccaacgttatttgatgaaaacggagaagaaacaaaggcaattggccatggaattgatggaaaaggcagggataagcacggatgacaaaacttttggtacccaacaccttgaggctgtacaaaaattttgggactcccaatactcgggcaactttcgcatcgtcacttttgaaatagtaaccaaattcgctggaaaaaatatcccgttacttatttttagaagacccgacttaagccaattttcaagggagaaggtgttcgaagaaatgagatttgtgtgataagagatggggaccacttggatggattaaaatcggtgtcctggtttttctgtgttcgcaacttttgcgtgggttgtgaagtgacgtacgatcgacctgaaagacacagaatggagtgtaaggaaaaatgcaagaagtgctgtagaatgggattcgggttcccatgtgcggatgtgtgcgataagattcactgcgaggagtgcaaccgcaacttctataacaacgaatgttttgaagcgcacaagaaggcggcttgtaacgagtataataaatgtgaaaaatgtggagaagtctaccaaacaggttcgaaacacgtctgcggggaaaagttttgtagactttgtaaagttttccacccaggacggcaatgcttcatcaaaaaaattcaagttcgaccgcagaaagcatatataattgtggcatacgacctggagacgactgtagatgggggagaacaccggcctaatcttgttagtgtggcactaacatgcagcatttgtgcgggagaagagagggaatgtgaaatttgtgaagggcccaagaaaatcacatggtcagtagcggatggttttgacccaatgagcgagtttgtcgtttggataatgggttttcaacgatttgagacggttgcttttgcccactatgccgggaggttcgattcccactttgtcttgtccgagctaacaaagaaggaaat

SEQ ID NO: 7403 - DNA, 5180 bp, Heterodera glycines
tttatttgacttttttaaactttttacttattttcacttcccttgttacaatatcttttctttacaaatgtgtaaatcttatttctttttcaataaaaattcgtaaatttcaggtattttgtcttttaaattgttcaaaatcaatggcccgtctcgaacctgcaccatatatatttgtgcgtttcttttattaaccacttaatttttagtggtaatttctaaatttagatgataaaatcgattctgcatgatgctgggccgcttcaaaagcacgaactggttaaaaaaatattggagacctacaaactgaaatcgaaaaaacacgtaataatgacaatttttttatatattttatttaaatcttatttaatttgtttaggttaattcccgcgtcaaaaaaaactctgcggacatacgttgggaatggtgagctcgaagtagaggctggaagatattcggtggccgcatcgggcggtggtgataaatgaatggtttgaacggttccattttgttattttccatttgttaattgttaataaaaaattgaaaaatattttaacggaaagccaaaatgtttaatgagaaaatggggaaaacgggagaccaaagaattgattaaatgaaagtttatttagtttcgcaaataacaaaaagattagcaactttttatttttttccaaataacaaaaaagataataataataataaagattaaaaatagtgatgccaaatgtaacaaaaagtttatacaaaatgaaaatacaaaatatgacaaaaagaaatataatatctgcaaaataagataataataatgataataaagattaaaaataattatgccacgtgtaacaaaaagcttatacaaatgaaaatacaaaatatgacaaaaagaaatataatatctgcaaaataagataataataatgataataaagattaaaaatagtgatgccaaatgtaacaaaaaaacaagataaaatataatatctgcaaaaaacattatgaaaatttaaataaaaaagcaaagaataaattatggaaaaaagaaaaaatagtggtaccccttgtcttggactgatcctcaactgggttcattatgcattaccaccatgtccgagctgggctcgtccctctcagcgaaggtgcgcatgggggacgttcgaaggcgtgaaccccaaacacgccatcccccgagggggcttaactcgaacaccagcgctgagagagcgaaccgagcgcataaccactacgccacggaacactttgatgacgaaaaataaatgcggaatttgaaagtaattttttcgagatcaaaatcggagatagtgtgcgggcggcgacggagggagggggggggcattaggagaggggagggggcagcaaaaatggaaaattggaaaacgggggatcaaataattgattcaatatgatgtttaattattttcacaaatagcaaaaaagattaataaatttttattgttttcttccacataacaaaaacattagcgattgggaataatgcgaaaaggcgcgagaaatttttccattcttccatatccataaaaaatcaattagatggaaaagtgtgaccgtgagatatgggtttaggtgcgggtatgcagcggggcatctttatacccttgcatgtatgactgtcaataacaccctcccccccccccataggttttcaccattaaatttcacctcttttcaccgcttttttcacctcttttcaccgtttttttcatctattgaagaaaattccggccccgtgtgtacaccggtttcgcgcgatggttcgtggtggggcgggcggggttgggggttggggcaattttagggcaaaaaaatgtactaaccactactgtcctcgttctttcgctgttcacctttttttgttgcgggctgcgctatgtgtacattgagacggacattgtcaagctgtgggtttcaggttggtgtaaaaatttaaaaaaatatatttgaccgggttggacaccgtccgtcagtttttaataaatttaaagggaaaattggaaaaaaaacgaatgaattttttgggtaatttttgaatcttgcatggttttcttattaaaaatcctatgaaaatttctttttttccacacggcattgccgaaaaatgccatcagagaacccaaattttgcaatttcagtccaaaagtgcccataaaacgttgaatttttttctaattttttagagggtggtcgtctgaacgaggagctgaattttctgtccactctgcagcaggagagccgccaacgtcgtcaaaatgcgacaaaacggcacagcgacgaggacgaaccgacaaccgcggcatatgagcaacggcactttttgcccgaggatatggacgaacggttgttcgaaattccggaggacgaagcgcccatttcatcgtatcaggtgggaatgggggtgcgggaggtgcccaaaaaaaaacgaaagttttagagaatttcgaaaccttcccccaattttccaaaaaatagtatttgccgcacttaaaccaatccaaatccgggaaaataattaagatatttaaaaattaggtctttttcctcatattgaatgtttgtaaaaaaaattttagaaaaaaatcatgaaattttgaaaatttttcgtttttttttgaaaattttcaaaaatgcaaaaagtgattttgcatttgccttttatctgcactgaatttaaaatttacgccttttcaggtgctcatccaaacggcggaccattcgacgccctcgcgaaatgtgctgaccaaaaaggagttgctgcgccatgtgcagctgatgcttgaaatcacgcagctcagtgtccacaaatttggattgtacggtttttttggcaaatttcttaaattttctgatgccaaattattgcgttttcaaaaatttacggttttttttaattttctgccaaaattaagcggcaaaatttcggatggtttcataaaagtgtacctgtttttcatacatttttttcaaaatagtctataatttttccataattctgaatttaattactaaattttattgccagaaattggacgctggacgacatttgcttcaagccgggcgccctggacatcagccccgactcgatggcctatgtgctgaagccgaccctggagcggctgatcccgtgcatttggatttcgcccattgactgcttttttgagggcgcgaaaccactgtattaattttgaaattacttcagaaaattcttgcaagaacccaaacgctttcaaaaattgagaaaatttttgatttcctgctggcaaatcctcttggaattttgaaaatcatacaaaatattgtttttttttaaatattggggaggtaagaaagattcacgctctttaaaacccaaaaaaatccgataaattttgaatttttgcaataaattttttaacccctcccttttttaaagcggtccgtcgcccccaattgacatacaaaacattccgttgggtcccctgctgcaactgatggtggacgacattccggaccaggtcagctggaccaacctggacccggagcacgtggtcagtcaagtgaccgccaccttcgacctgggcaccatgcgcaacttcttcatgcgagtacgtctcggatttttggaaatgtttttttcaaaaaaaatgtcggctggtaaaaaatgcaaaaaagaaatgttttttctcttttttgaagtttgaaatttaaaattttccttaaatgctcataaaactgataaaaaaaatcattcggacaggttcccctcgagaaaatttttaaaaaatttaaaacttctggattaaaaagatttttcttgctttttgaaaaatgcctgtagacattatttcattcattttccagtccggcatcggcaaaggctacttggaacggttgtgcatcgacccgcttgacccggcatgtccaccgacggcaccgaatcactacggcggcaccgtgttgtgcgatgcaattcggcattttgagcagcgaattgttggcgtcggacaaatgaccaaccggacaattgtggacattttggcgccgtacaaatccgtcgacggcacaaacaatgccgggaacaaacagaagaagcagaacacatcgccattcgacattttgcaagcattttgtgagtattgtttaagggtttatgtgtaaattcgatggaaaaagggcagagaatggagaggaggatgagagacagtaccataaaaggagcaaagagagagtaagagattgggaaaagagtgcgacaaaaataaagttgttaatagagaggggcgatagacttttggtctggaaaggaaaagaatataagacaaaaagaaataggatagcaattctagagagagagagggtgaattgagaatatcgaacaagagagagtatagggaaaaggtgagagagagcgagagagttcggctagtttataagggaatggagagaaagaaagggagagttcggcatggagaaagacgagacggaaagagagaaagaattaggtacagagaaatattgagttaaagacagagagagagagagagtaaaaatagggagttggtggaggttgaaaaacttcttttttaattttgggttgaatttcagttggtgacgctgatagtggcgctggtgctgataagtctggccagtcgagcaatgccaccgcaaccaacacctcttccacatgttccgtgcacaaaacggcattcatgcgttggctgtcccacaacttggagacgttcgggggccaattcccggcccatttgttgccccgtttccccaactatggccaagtgatgcgccacgggtgccgcggcgttgcctccagcgtcatgaaatggccggccagaatggttatttaaagaattccgtaaatttaataaaattatccccaacattagagtccggaacaggaccggatccttggcacgatctaaaaaatgggttcggggtcagagtctggataaacatcagagtctggataaacaacagactttttaatcctgaaatcgtccaggtgcaattcccgaatcaagatgctgaaattttttttaaattccgaactgcccaatatccgcatattgtttccgaaccaaaactaaaatgatttttaaaaatgttgactcgcataagtcctcgaaatttggtaattttctggctca

SEQ ID NO: 7404 - DNA, 898 bp, Heterodera glycines
cgcttcctccgtccgtcattcttccgcttcgcactccctacttcgtctccactgatccccgccgcaggttcgctgtggcactgatcatcggccattggaatgtgcctaaacaatgatcggttgtattcctctcttcccttccctttccgtctgatcgtttggccaccgcccctcccaccgttcttcaaaaagcatcatcatcgtacactccgctgctgatgagcagtcgtattggctttgttcgcccgaagtgaatagctcttcgctgagtgtcggggactgaactggggataactgagaatggcattggcacgattaaaataaaaaataaattatccaagcaaagatttggaatttggaaattcggtcgacctgatcgccatgcttcatcttcacaagctctttcaaatgttgagaacgaatgtggcgactccaattggaagccgaaatgaatttcagacaaaaaaggcaaaggccattcgcagggcgacgaacgatcgaccgacgctcagggaaaaattctaaatttggaagggaccaccggtaaattgttttgcaattgtcaaaacgcaccgggcgttttgcttttcgcttggctcattcgtttggggagaaaaagtgagaagagtcagtcgaagcaaaaaacaaattaaatgtatgtattgcttaattaataataatttttattatatttatatatagtaaaaaaatatataataatttacggtaaaacggagggcaatgagaagaaaacaatgaaagataaataaaggtaatgattacatacatgagtaccatggtgatgtgtaaaataaagaggatgagaagggagggaagagagggcatagagaggaaacgaaagggaggagggggaagggagggatgagtgaagagaacg

SEQ ID NO: 7405 - DNA, 4149 bp, Heterodera glycines
gagaggcaaagagaggcgagagaacgcggacagacgactgacccccgtgggcgagggaagtgaaaagagaccttccgccgatttctcatctcttcccttctgttgacgaaaaagcatttgctaatatcagcttcatcatcggcttatcttatcacttctatttctaaggcttacaattggtgaaaagtgagtattaccgaaaaatatggtgaatagaaaaccaattacctagttaatgtaattatatataataagataattagttaatccgacctgcaaaaacaacaaacttttaaagaaagcatgcctaactaaatgaaaaaaaccattaacaaatctttattatgcatgaattacataatttacatatactcttgttgcaaatttggtaatttggttatttgcatcgtttaaaaattaagcataagaattggccaaggcattcatcgacttcgttcttcgaatcagttcgcaccaatgcaattttaaatattatgggagaaaaggcttcttttatcgaaatatttataaataaagtaaaatgcgcatccaacgaatttcatttggaaatcccacggacacctggggaccttcctttgtcagtttggagaccgggtgggatcgggattctgcaggcttttcttgggaccctggatcccgcaggatttgggatttctacctcgggatcgggatccctcccgaccaatcccgcgggattggagtcactttgattttagaacataaagcttaaagcttttaaaagcaatcaatttttggtccaaagcctcttcaacagaatttctaaagaaaaagtcgaatttttgcttgtaaagaatggctacaaaaattttgttaaaatttcttcacagtataaaaagcttaatcacacttcttaacacgatatacatgcaaatagccaatgacgtagcagggagagggggaggggaggctaagggaccatagccctccacccccgtaaacgaaaaatggaaatttttttattgaaaaacgagaacctttttaaaaaaggtcagttttttcttaagaaaatgcaatagagttcgctctcgatcaattataaaagctatataaaagcaaagacccggggttgatcgggatttagtcgggatccctccgacatcagcagttgtccggtctctaacacaatttcgcaaattgcgtcggaattaaatcaaataaatttttgaaataaatatttgcaaataattgttaattcataaaaatgatctctctgacaatttttgtttgcttttttgcgcttttgagcagtgattttcctgtcaatgcttccgtcctttggcaaacacttcagagggatggcaaagacaaaaacaaaaaatgcttaaagcacgctgaacagtttaagcataacataacaatttattaaaatgaaaattattttcgtcaaaatattcactgccggcactttgttggcaatgctaacggtggcggtaatcgtcacaaaattttactttatcgaggaatgggaggagagaagggacggcggaggacgccatcgaaacaggcaaaacgaaaagaaaaacttttagggataaaaaaacaattaatggtcataaaagattaaaggggtgtgtgtcatttacggcactcgtttaatgctcgatcagtgttggcttgcttctgatcagtgatcacccattgttgccctcctcagcaattgcactttggtcaccgcctttttcacgctcgccttcgccccatcctccgcctcgccggcccaacgccaattgcttggccaatggcacgccatgttccgacccattcttcacctccgtcttccaatggtcatttttaccgattccgttacgacgccatttgtgaccgctgtccgacaatccgtccaaatgcaaaaccaaacgcgggtctgacgagtacaattaaaatgatagctgtattagctaaattgctatcatttactggatctaatttttagatttggaatatttccttgtcggaactacccttgtggcgaaatttctctctgttccaagctatcattgacgagcatcagaatgtgcaacaatttggacaggcagcccaaaccgtcaaaatgggaaatctttcgttggaatcgcgcattttggccaactccaagtcgtatttcctcctcaatgcttcggtaatggaaatttccaaatcactcgtttttctttctgttggcctttcacagacagaaaatccgttcaattcgactgcttttgcttggatggacccctcttatgggcacggcaagccgagctttttcccggccaaattcgaatggcacccgaaattcccaccgggcaaaatttcactgctcaaagtttaattgaatttttttaatggttaatgggtctaattgaagttggcacctctcaacgcttccatcttcctttttgacaccgacgatttataccataaccatgaactaaatcttttaagcaccgaattcatggcaggagacaggtacggtaaaggaaaaaatacggtaaaatagaaaaaggatttaaatttcattgactgataagcaaagggaatgagcagaaactgagtttattttcgaaactcagcaaaagcattgaacaattccatcggttatttaccgggaaattatttgacgaggtaatggacgaccaaatctttgacgaggacgaccaagtcagttcaaaacacttcatctattactagtattaaatcgttttttcaggcacttttactttctctgatcaaggaaaggccttctctctttaacattgttcagggagaatggttcaacgcttttcatcttttttaactttttttaatgtctcttattgtttacaagcaatgtacacatagaaatgtgatcaatatgatttttatttttcatcggtttaattattcaccgaaattttacaaacattcatcaataatgccaacaaatgtgaaaatgaaaagactataattgagggagttttgtttcacttttcaattgtacacttttgttttttatactaattgctgggaatttattctctgcttcccttctactcatagaacaactttaaaaaatgaaagattatttcacatgtcgacagtttgcatttgtccgtccgttgagtgtttggtttttgttgaaaaagcaccgccaaaatggcgaagtgaggaaactcatcgccatggcacaccaatcgccaactgacgagacgaattcgccaaacactccctgcgaagtgaagaggacgaaagtttgcccgtcgcggtattggccgtcgattaaataatatttgggcagtgtcatatgatggcggaacccgtttttgcggtagaaaacgatggccgaatggttgtcactaagaacatgcaggaaaatcagttttgaagccaagggaactgaaaaagtggagacaaagcataaaaacgccaacaaatgaccatgcgaagagaaactcgggtccgagcttaaaatggtccaaaaaatcttattctgatcaaagcgacctgaaaacctcattggaacaagattttataactttgttgttaaacaatgtcaacatcaaagtttagccccaattaatttcaatcgttaaattgaatggatcattggatgacccctaatgacccaccgctgtaatcagtgatcagatggtttagcaacagcgtaccaatgcccctccgtctatacctatcggagacagccaaactgaacaaattaaaattaattcatttggaaagtgaaaggaatagcaaaaggcaaaacacctgagaatataaatggcagaagcatttgggtctttgtacaaatttcggtccttaaaaaattaaaatgtttttggagtgacaaacatttgataattacataatttgttttaatgaaattgacaagtcaaaatatggaataaaaaaacacctcatattcgcactcgaaaatttgtttccgttgagcaacaattaacgcggttaacaaatcgtcactaaaccaatgataaaatgggaaggaaagttgtgacaaaaggcaaccgaaagaggccgaaactgatgaattggccagcaaccacagatttgttccaagccaagggataatccagcggaaatgccttgctgaaaagacggtgcttattacaaatgtttggcaattcgaaatgaaaa

SEQ ID NO: 7406 - DNA, 2232 bp, Heterodera glycines
ttcgaagacatcgtcaaagtccttctcaaccaaattgcgccctgccagcagccgtcctcgtcgggaaagtgtcccaacggaggcgaggtcatcaaccaatgcgtgaccaaaaagcgaaatggctaacaataagcagccacttcagcgtcagtttgtgcaattaccattcgaataatgcatttattactttggaaaacccaatattccttaaagaaattgttgattaatttaaaaatgccatggaaaatgggcaaaaatattaaaatcataaaaaatgaattaataatgaaaagacaaaatttgcattcaacaaacgacacacatttggtacaatgttcaacaaagagtcggcagggaacgaaagagatggaataatatgtcgttgaaaactgggagattaagctcaaaatgaaacacgtaaaattcgataagtatggaaagagttggggacaaatcggcgaatgatatgagcgattggcaagacaacggaaatggattatattttggtaacaaatggaaaaatcgaaatcctaaacaaattggcaatcacattaaatggactcaaagctaaaatccgtcccatttccccacactttgtctcacaatcagtgacaaacgtccgaagtgaaacattcgacttgttcaggcgcccctcctccgtcaccacaggccggacaaacacagcgacttggaggcgcacatttgacattggcgaacagccaatggccaaagccggcaccaagcacaacggcagcagtcaaataggtgttgaaggtcatctgggaaggggggtcagtctcggaaaacaaacgtttaaattaccgaaataagcatcaaccaataggccctaaagtggaaaattatgaaaatttagcgataaatttactgtcttacaatacaagttggaaaatgtagattagtgtttcgaacattcggcaagttgatggaggaaactcacggcttatataactcatcaaccaacttaaagtgccaatttaactcggctcttacgaacaaataagcaaaagtgtgcggtacgtccaacggttgatcgtcatgttgggactgatcggcgccggtcggacaacagttggcgcataaacttgctgctgactgccaattgtgtttttcagtgaatcgtcggcagtgccatcgcacgcgttgcaaccgctggcggacgaatttgtgacggcggccgtcgccttttcaatgagtgccgcttccacgccatgctgactccgccggaatttgccacgaacggcgtccattgatatgcaaccggacgatttttgactaacagaagtcttaaatgattttaatggataaagaaaagggagacaaatggagtcgaaagatacccaaagttggaaataaacgcggaaccatttggcaccttcgtacagaacggccatcataaacaccaaaatcagcgagaaaaacagccctaaaaggaaaaataaatgtaccaatagaaggtggcaatatttatttcccccttaagcataccataaaatgtttcggttctccaaaagtcgaaaagaatcacttcccgaaagcctccgtggaaaaacattttcatggcgtggccatggtcgtggtggtgatggccatgagaatggactgaaatgaacgctgtaaattaaaacaatacgaattcaagtagagtgattatgactttaatgtaccacaaaagagcaaaaaacatagtgcaaagcgcttatatctttttcatgactatcgcaagacaaattttaccattcaaatccggaagagaatttacaattccgtcgattgggttggccggcggcagtgaagtggtcgaaatttgaacgtgggattcgtgatgatgggcatggttatggttacggccatccatctgacagaaaatcaaaaaaaataaataaataaatcactaaagtcagcccgaactacaaaatgagaagaaacagtttgcctgtgacaataaataattgactcaaaatcgattaggaatcgtttattattaattaccaaaataatgtattatttagtttaaacaatatttattcaccaaaatatttctgaaaaaaggaacaagacaatggaaaatggaaattgagatgggtgggtaacaaaataataggagaaatgaaaagaacaatatgaaactaaaaaacaacagggtaaaatgtaaatcatttattttttagtggaagcgttttttcaactttcttagcgcgttttcatacaact

SEQ ID NO: 7407 - DNA, 1499 bp, Heterodera glycines
ccaatgcttttgtgaatatctgtcaatatttgcaaatccttccgcccctctcacaatggctgacgcctttcgtgagttgtaagcgccgatttccgtccaacggcaatttcttcagctgatctaaattgtcaaagattccttggtcaagggtggagatgaagtcgtagtccaagtacaactgatgcaatctctgtcccaatttggccgtgagtaaatcgctgtaaaattttgaaaataaatttaatgctttgtggcagtgattctctggcattttgttttactagctgatctgttcgctgtcaattttgttgtgcgtcaacatcagcacttgcaatttggcgaacttatcaaaagttgccggttcaatgtcggaaattaaattggacgaaaggtccaaagacaaaacatttgtctctttgccgggcaaaattttgtcctaaatttaaatttttattgactcccattgaatcgaaaaatgaatctctctccttgagtaaatattttatgaagttgtgctccatgtgcaccaccgaaggcgaaaaattcgccggcaaatcggcgtccgttgtggtcaaattctgagacacacacaaaaggtcacttcgaccgccgttcgattcgcagtggcaaatttccgtttgattctctgaatttaaaaatattaaaaacaatttttaaaccaaaattaaacgaaccccctggggcggtgccggcggttgagcacagtttgaggcgtttcgccttcgcccatttgccctcttcccagtcgctgtagtccaattcttctttggtcgcgtcataactgtcatcctcaaaggatttccgtcccctaattgtcaccgtaattattcaaaaatagtgaaatgtgagtgaaccaatgctctccacggtattcggacaatgtgccaacaacaacaacggcctttcctttgctgccgtcacttgcaaaagcgacggtagttaatgaggtaattaaaaggatttgttggaaaaacatttcacgtaaaaatgaaaagagagagttaataatagtaaaagaataactgaaagaaaccaccaagcaaaggcatttgcatattgaagttaatcatttcctaaactaaaaagggttggaccccccccgtctaattaatgtctaattaattaatgatcattagttatcgatttgcctattttattacatatttggccattatgaatttgctgcttttcgaattgataagaaaggtaaaaagagatgcgagcagaggcagcggagaaaaagggaaagagaggcggagactgacaaatgaatgctttttaaaaataattattaggacgcagattatttatttaaatatttattatgcagctttattttaatgagaaagaagcaaaaaaacatcatttatctgaaattattcaaaaatttacaataaaaaatattttaacttttttgatctttattgaatgaagagaagaaggaggaggaagacaaacggaagaggattcaatctttt

SEQ ID NO: 7408 - DNA, 5174 bp, Heterodera glycines
ccatatgtatgccaagtgtttttaatgttaaaatacataaataaggttggacaatatttatccaccaaaaaatcggactaaagtttatatttttttgtgggggggtccggtcaccaacacagtgatttcaaatcttcataaattttcaaatttcccggcgctggcctaccgaccaccaactcttatgtcgccgtggagccaactagctgagctaactcgccatggccaactcgacgcaccttgttttacggcttactcgtagcctttttttcgataattagggctaccactttaggcacaaaaaatcacaaaaaagcacctatgtaaaaagaagaaaaaacaatcgcaaaataggcataaatagacataaaatcctcgaataggcactaaaaaagacaaataaaaatttttattaacgctttttaggtagcaaatcacctaaaaactaaatgaaaaaaacaattttggctttatatttcaattgtaaatgaatattaaatattttagtttttaaaccaaaaattttacaaagaaaaaaattttttaagggaattaattttagcgaaattttttttcttagggggtatattttctgaaattttttggggggtgtgtaaatgtagagaaacaaaaacaaacaaaaaaaagaacaaatttgatttaacgccagcaaatttctgtaaaacgtttttttaaagaatacggtatatgtaccaaaaacccatatggtctcttgtcagtggggaaaagtctcacaatcagcgatatgcgcttttttgttattctgtccttcctattctttttccccgaagaattttttgaaacttttcccgatttcaaggccattttggcagccatgaaggaatgatctgttcaacaatttgtgcaaatgttaatattgtagcttaatagcataaaaattaggtacttttccgtttttggcctatatctcaaaattttttaaaaatgtcaacaaagggcgcgctgaagggatactttttgtaccattctcatagcattaatttgcttagcgatcaagaattttatgaattatgacattgcgccccggacatttatcgtcttgttgatatattttttaattttgagctgtatgcccaaaacggaaagtatgaaattatttcatactgtatttatagtaaaatgttcaatattttaaagtttaaatttctttatgggttaaattattgggattggttgaaaatttagtagaaaaggttttaattctagtgaaaaataaataattagggctgggatttttaggtgctaaaaatcccaaaataggtactaaaataggtgctaaaaaagtgcataggtgctaaaaacccccgaaaaggccaaaataggtgcgaaaataggtgttaaaaattggaaaaatccagtgtctttatgtacaaacattccaaaagcgactaattttttatcaatttcgcccacacaattgcaattggtcaagaaaacaaataataaatacatattgtggacgaatttttgggaaaattttttgtttcttaggggaatattttctgaaattttggtcaatctttaggggtatatttaaaaacaattttttggacaggttcttagggggtgtgtttttcaattttattgcatttttgctatgaaatttctggaaaaaggccaaaatacgtgctaaaactcgaaaaatgccaaaataggtgctattgaccgaaaagccagttttaggtaattttaggtgctaaaaagtcgctctaaatcaaaattgttcggagaaaatgctatttttgggcttctctcatcataactaagccgcaaaaaaaataggtaaaaacctaaaaatttaggggcctatttttcaattttttgtattttccttaagaatttttctgggaaaatcccaaaataggtgctaaaaattcgaaaaatgccaaaataggttgtaaactattttaggtgccaaaacgccaaaatagttaggtgctaaaaagtcgctctaaatcgaaaattgttaagagaaaatgctatttttgggcttctctcatcataactaagccgcaaaaaaataggtaaaaacctaaaaatcccatccctagttattactaatttttaatttacattttcggggcgatttaaattttgttttttagtttttgttcatattaattctcaattatcgaataaattcctttgatggcttctttcgtaaagcttttcaaaaggaaaacttcaaagcagggttcactgtccgatcctttcaattcagcggaaatgccttctaactcatcaataaatgttatggtaacgaaaatatgttcttatcagttaatatattttttaagcacgatggaaaacagattagaacagcatcattccgaacaaacagaaaaccaaacgcgcaaaagtacgaatgttgcaaagaaacaagaacaaatggtggggaaaaacaatgggccaatgccacggagtacagccaccacaagtgatttataaataatcttttgttttaattcttttcacttcctttgggtctccgtattcggtgtttactgagccaaaaatgggccgttctgcccgttcttgcccggtgggtcctcccagcaaagaaacggattatcggatgcgaaattcccataatttctctcctccatttggtgttcaaccgacaattcacgagcgaagcggaagctacgagaatttcacggcgtcgcaattgcagcaattttggggagcgaagcaaagtgaacgagaggaagtggggaaagagaacgagagaggggcagagagagaaagaaacgccgagaggagcgaagaggaaaagccgcaccaaaaaaggcaacggccgcagagagtcgacggaatggcaacgcacgggaatttagcaaaaaggcaggccaatttaggcaaaagcacataataatataaagaccgaaaaagaaatttgccctttttgtccacccgaatttcgttttactatcagttggatgggttgaggtgtcggtgccacggagttcattcatctgcgcattgttttcatcagtatccccagcagcagccgttatcgacctcggagtattggtcgaatgatccgagtccaattggcgagagtcagtcccaccaccggcacttccgcgtttcacaagggataagcaatggaatgcgaggggaaatgacgatggcaatggtcggtttggagatggccagagaggagagcagttcagaggatggggacaactcatcggatgaccaggaaatatcccccacggctttgctacaggcaacaaccgcaaaaaatgcataaatttaaaatggcatttcagttttggcaacaacaagttaggatgctgaaacgcgaattaaaatcatccagagaaactacagaaaagtaaagtctgacaaacgcgacccttcaaataggacacgtaaataaaggaatctgcacatttttctatcattttccgactcaaaacaatcctcgaagataaatcaaaacgacgctttgtatttgctattattttaggtaccggaataaatatttacgactcaaaaccaaaacggacgaactgagcaatgaattaacgcgtgaaaaagaaagggtcggtccttttggaaaggaattgactaaactctgattcattttagaatatttggttgttcaatcagttgatagcaacaaatgataagatgactcggctcaattgggctcacatttacttcagaggcactcaaacgcagcaaaatccgctaacaatgaacgcaactgaaatcgccgagaacgaacccttcggaccgattaaagacgagcggttggaagacgggagaaagttggggaaaggtaacgaattgcaaaaggcagacaattggtacttttgcgattgacacagcctattgtttatgatataattagaaattaattaatttatttcatgccaaaaaacagagaaaagcgaggacaattctcaacaccggtcgacggccggggaagtccaagctgaactttcatcggacgattttgacgacaaatcggcaacgatgcgtgaggggatttgcagaattgagaatgagcatggttgtcaaataatggcccaacaacaaaaatcgcaaccgcagtcgatgagaacgccgacgcccgtcccgtcgagcaatgccaacgattccccaaacggacttttaatgggcaattttctctgcgcgccgccttttcttaacttcaattccttccacaacatacaacaaattcaaaaccaacttcacgtggaagtggccagaggaggtcaattgaacaatgcgcgcaattcaaactctcgtctgatcagcccgccaataaaaaaaggcgtgagaaaggtgccgaaagtggcgcgggaatttcgacactgaatttttaattcctcagacgtacaaaagtaattcacctttggctatcgaaaaggacgaaaacgaagagcaattgaagcacgaggaagaggaggaggacaacaacagtctgaccggtattgatttggaagaggacggtccaattgtaattccattggacgcattctgtcatcaacaaatcgaaaatagcagcaaagggacggaggaggggggaaaagagtcactcaatgggcggacgacgagggggtaaaaaaacgcaaattgggaggccaatgccaaaaacggggcgcgcaatttcagtgtgaagtcgcttcttcgaaattgccgctcttccgaagaccttcgcttctctgctgacaatgaaaggggaacgatggttggctcagcagtgggcagcagttccgaagatgacctcagaatgtggaagaaacagttgcgcagcagaggcaagacaatggacgggaattgaaagaatcgcctaatttacatttattattcgtcaggcgacagagtcctttttcgcccgtcaagaaaaactgtacgtttgggatattttaattttgagattgtcagactccttcagctgttttctggcgtaatcggaaatgaaaaagggccaaacaaatattttcgccgttttggtcagcctgagcgggaggcactcgccaaatttgattatttatgtggtgaacgcactgatgtgagtggactaatgagcagtccggagaaaataaatggttgagataataaataagaatgagaagaaattgtgtcatttataaattttttcgccgatcctttcc

SEQ ID NO: 7409 - DNA, 1421 bp, Heterodera glycines
cgtgccaggtgaattcgacagtgagtgatttcgacactaaactattttgctttttttcactgtctgcgtgtgatttcgacagcgagtgaattcgacaataagtgatctcgacagcatcagaaaaattgtgaattcgaccgtaccaggtgttttcgacagtggttgatttcgacagtgattggtttcgacagtactttttattttactgtacatatgaattaatattaatatacaattagcatatacaaaatttataattgaagtaatataaaaaaagattggtaaaggatttttttgtcaaaaatttttctttttcactttttctatacaaatatctcctgatagactgtagtcaaaaatacaacaaatttcctagataaaattcttgattcgtgtgggaaaatctgttaccagatgccaagtttgaatgccaagatgcaaaccttcaggctcttgaagcagaatttgaaactcgcaaaagccctctacaatatataagagcatgtgcttatcatttaaattcaaaatttaacgagacttatgcctagggctaatatttatagttttttcactatttttttccttagctcctcgtagcctgaaatgcacgaaaaacatgttttttttttctgctgttgttaagctacttttcgagttattagcacctattttctaggtttttattattagcacctaaaacctaaaaaaaaatttaaaaactatttcacgtattttggcgttttgcccaaaatttgttaacaaaaatgcaataaaaacgaaaaatagacccctaagaatcgacccaaaatttttttcaaaaaatacacccctaagaatcgacccgaaaattttcaaaaacacacccctgagaaatgaaaaatttctcaaaaattcatcttcaaaatttatttattttcttgttagaatttttaattttgaaaattatatattttgaaggaaattttcaattttacacccctaattttggaactttttggcacctattttgggggttttttaaaacctaaaacctacctattttggcagtttttagcacctaaaaatatcatccctaattatgacttttgggaatttttagtctccaaattgagttaatattaattttttaattttgaaattgtcaggcgattgttcgaagagataaattgatatagtttttgaaaaccaaataaaactgaatccctttggcgctgcttgcaaagagccctcttttgaattttatcaaaaagtaaaaacaaaaggggggacccttttggtttacaaattttttttaatctatgatcatgaaaatttggccccgggtgtttttggggcccttgatcacgaatctgtcaactattttgaccaattcctatttcttaaccttatttcttaacctaaatttgaacaaaaaatcataa

SEQ ID NO: 7410 - DNA, 6254 bp, Heterodera glycines
catcagttacttcagcttgtgagtcatccgaactttgttccttttcaagattccattcgtcggtaggcgcttcttgagaaaaaaaattttttttttttggcacattgccaattcaaatttatttacgcattgatgttgatgccgatgtgcttgcggcgtttgcctctttttcctcccatgcacgaactttttcctcagaacgctcaaccctttttataaaatacttgcatgcatgagttgggctacaaaaattctctccttctactttttcagaatcgtttccatggaatcttcctcgaaatcgacaacgtcagacgcattgtcatcgattcctaattctttttccatttttgcatacttttgttcgagcgcatttaacctgttatatgagagtactgctttggcacattttttttgtaattaccagttttcacgcttctctcctcgtgcatggatcattgctccaagcaatgaggttgcggttccatcgaaagagtgccgtcgctttcggccactgcttgactcctcatcggatgtgaaagttgagtgagtaacagcgacctccgtcttagcttttaccgtgtcggcaacgtttgtcgttgtttcttctccttcatcatttttcatgttggccgcttgttcaacgtttttacgggatgccattttcttttattcaatatactagtttatcattataacgcattaaatatctgccattttcctaggcatttccaccacaaataccagtaaaaaaaaaaaaattttttacatttacatattcagaatcactcgaaaccaaaaggaagaacgctcagattttcttttattatccccttctggcagactggaagatagcgcttcaactgctctcttgtcactatccgactgctcttggtcggttgtattttgtcatagctaaacaccgccgggcgctctccatgacggccatagtttaacactttctgtttgaagtgctcaaactggagcgcttgactattctgcacatcaaatgttattccgcgaattttttgtacatatttgcattcgccggtactctcatccaccatttttagggcatactgtttggcacctttgtacacaaatagaggctcaacattaacttggtaaaaaaattcattaatcaatcacctccacaaacgaagctacggatcgcgaatcccacatattcctgagacatttgtcccataaattcacccgtctgaattggaacatggtcgcaccgatgcttcacaattacactatcagtgtcctaaacaaaaggtgttggaaactcaaccgggagggactatagaccaaccgtataaagtagctcagcaccctctgccctatccacctggttcatgtaatcaagaagtttgaggcgggcgcagcctttaatttaccgtttttaaactttatccgccatttttgttaaatgtttactggttgtccataaactgagaacaatgttgcttgtagcatgctcatcaataaaattcttcttctgtttgtaggacacacgaataacatcgtcagtaagaggaattattgcagaaatttcctgagcaagataaaaaagaaattagacccagttaattaataacgaagcgatgaactcacaactttatgatcaagcgcaagcttataaaattcttgtggctttagtataacacgatttgcacctagctcatttctcatgctgaatttccccctaaaatggctgattctgtccaatttagttggagaaaaacacaccataaactgtttagcatcagctttgcaatgaaacgtaggccggggtttcttcgcacatgtgttaaatccaactcaacagtgtatcgcctcatatattcatctgcgaacatttgtttctgcagttccgtttgaacgccatccgggaatccgcttgattcaacctgttttaaaatttttcacgtacatagaagataaataaaataaaccttcaacttaatcataagtcgaacataatctttaaaaatttggtcgctccttaagggattatatgatgaaaaaattatttgctcatcatcgctataccattcctcataatgccacgcgcgccagaatcggtccactcggtatccgctgtccagtgcacggcccaactcaacatgtgtgtaggtgcctgtgtaagcacgctgttcgtccgaatgattgcacttatggtgtcttcttgtgccaagcgccctaaatttgccagcgcatcggtgacaacaactgaacagcagtctctaatccaatttcacaggtaaaattggtatgtgaagtccgcgaggcggtatgactcgcactcgataaaggccgcggtagagaagggcggctgacgaacgcctgcagacagaggtgcattgaacaaaaaacaacaacaactaaccaatcaatgacaatttgttcaacagacgggtagataattttaggtatacctactggatattcggcatcgtagttcacctgttgaatttcaagaatgtatccgtctcattatatctattttctcacccacggatacaaactgacgatatcatagacgcaaattttttcaccttctgatggctcagaaaaaagtttcaaaggccctgttctacctgaacatacatacatgcgcgttcatataactaactctattttcattgaacttattattattattttgggaaataatttttgtttcttagcttatttgtttgttcacctccacagtaagccgcgcgtggatcgaccggaccgcgctcgtttccgagatcactgaagaattcacgcatttcggcgtttcggtagtctgacagcattgaattgatctcacactcctatacaatttttaattgcttattatttttaaaatgcgaaagataaaattttaaaaatttaattgtacgcacccaaatttcctccacctctatacaatgaccctgctcgtccggctcacgaagctgagtcaaccgatcctgggttgactcgttaagttcacgacacgttcttccatcaaccaatttgtcatttgggtcatagcaacgttcacaaccgtgccaaaagctttaatgatgaggattatagtcctttctgaataagacatctttaccatcctaacacttcgatgcatttattccgctcttcaatccatccatcaagtttaaagtttttcatgagtttttcacggccgtttccagcatgctgtatgaatactccgtctgttttggctctccaatccaggtatttaatagccttaatgtgaaaaaccggtgtacgccgcaaattaaatatttattcattcaccaaaacactggctcggtcatttcgctcataaccagcctcgggaacaatggccaactggtcttttttcatgaacagagcacgaaaaatgttcatgcatacgctaaacggtggcgccgatgctcgataatgttttttaccacccacctggcaatcgtgcaactgatcggcaacacatcaaaaccgttggttatctcatcgcatcaaaatttgacgaaatttcagaacggatttcatcagaatttcggtgtcattaagacagtaaatgcgtaactgatccggtaaaaagaagggtgtttcgccagttctccacgtacctttgttgagccaatttatcacattacaatttttgcttaaactcattaccattgctcaaacttatctagctttgcctgtttcatcgacccgggaaagtaatgttctctggctggcaaattttcgagtcggatagtataattttccctataatttttttgatcattttccagccattttcagcaattacaattccaattgggacaaccttcgattgtagccatagggaaaaaatggtttatccgcacaatcaaggctaaaggtacttttcagtccgtcgagccgaattgggaacagaagacatgagtcccgccatgttaggagcgaatttccgcgtgagtgttgcaaacgaaactcaaaagtcttgaatgggctggagctgatcaatgccgtaagcattcatggcttctcgaatgcccgctccattcagcaaacgctcagcggatgagcgcatcaacgcccgattggttaacagtagacgaaatgcttcttggccttcacaaaaatcttgcagcaacgttagctgtgccatattttgttgcggttgttgtcgggcttgtgtccattctttgaacagtaccgggtcgtgataagcacgggagccaattaatgcgtagaaaagacagtaattgtcgtcccagttacagatccgtatacggtgtttctcgttgtatccccaaaattgatggggaaaatgtcgaggtcgagcgccagcaggaggcgcaaagcaggtgactgtgacttgaattgcttcgctcaacaaaagggtgcgcttgtccattcccgctccttcctcatctccagcatcgtctccatcactttggccaagtttatcgagctcagccataagcacgtcgcaagtgttttgttccagtggacgaagtgggagcacaattggctcgtacaaccctgtaaagcagaggaaatgtggatgataattaatgaatggacgaattagcgcacacctctgccatgcaaactgatgccaatcttggcaacaggacgtccactttgtttttgcgtgttatcaacagcctgcctgattagcatctcaaacgcggagcgtaaggcttcctcaggttcctcaacgctagcgttcagcacaaattctgtgacatgacgcgacagggaaaagcgttccaatttgtgcacatggtaagcagtttgttcaaatagcggagcgttttggctctgccaatgtgccgcctcactttctacatctctgctacttggtccctctcctaattgtaggcggcgttgatcctgagttatttgagaagaggaggagacgcctgcttgttcttctgcgtcatcggcgtcgtcgtcctccgatgggatgtttttgttcaaaaaaacttactgaacggaaattccagcgtcttttcatgctataactattgctggtcatgttatttatattattattatgaaaataagtgtgcgaattaaaatatataaataatggatgttcgtaatgacgtgtcattaagaataaaaaattacacattacaattttattgtctccaaaaagaatgtctaattctatgctttaacacagtgctccatgaacttgtatgggatcggatcatagtgtccgcccgctcaatcattcttttcgatactggccccttgcttggacgatgtcgaatgccccataaattgtatttcttcatcataagcatcagagacctttttagcagctccttctgactctaatgttttcatcttctttttatcgccaccgtcctcatcctcctccatgtcgtcatttgcagcgattgtgagaatgatccagtcaaaatcttggccttcaaattcacctttagcctcctaagagcacgaaaaatgcagttttttcctgatggcaatgacagtacactgacctttatattcagcttaacaaccacttgttggtccagttttttttctaatatttttgctaaagtatccggctcgttgtcgcccatctatctcatcaatcgcgacggccttcaactgcaaaaatttttcagcagcagtcgaaaaaacggttgcgtattgtgtgcattcaggatccaagcaatccgccagttcgatgcgaagaaaaagattttttaatgggatttttgccgtgtgaccgcacgccgcacaatggcgattatcgtccaattttcgtcggcaaaacatgccccgtgatttcaaagggcacgcctaagaaacgctgattttacgtaaaatgaaaaaaaatgaaaaatacacctctaaaaatcgatttaaaattttataaaaagacaccccccccaaaaaatcgacgcaaaaatttttaaattcctttgagatggaaatttttctcaaaaatgcactttcttggcaaggttttttaatttaaaaattatttttaggtaccaattttggttttcgctattaacaatcctagccctaatcattttcaaatgcaacgcgcgaataaaaattattttgcttactttttggctaaaaattatgtcactattcgttcctatatcgcacttttttcccactgtttatcactattttggcattttactcactattttcgttaattatttgagatttttcgtcactaaaaagtcacggccctagttaaagatgagaaaaatttttgtagatagtgccgaaaaaacaaatta

SEQ ID NO: 7411 - DNA, 2234 bp, Heterodera glycines
attgtctgctcactcttgcatttcaaatatttaattcatcattattcacccgatttaattaatttaatttttgtgaattttggaaaatgaaacccatcatttgtgatggatgtgtcacataccgccgatcacattgctcgtcggcagtgccatcatccgcacatctcacgcggcgccgccgccaatgcatcggtgcccaggcgacgcacggctcagcgcagcaccgccttaccctgatgaggagccatggtgttacttttaaaagcattaagtgataattaaaatacactaattatatttgtttaagggggggagtcatttcggccatgtggaaaggaaaaaggaaaggaaaaataaaaacttatgtatataatttgaatttccagcagatgggaattctacttttctgggcacgtatttgaaaaaaacgcatttcggacttgtaaatttgcatttccgctaattaaaaaggcgagataaaagccgtacgattagcctaaattctaatcgtaattttttcggaaataaaaaaatatctgaacattagaagtaaaaataatgaatgttcagaggagacaaatgattattaaattaattattaaactaaaaaaacaattaaaacattttcaaaaagagagagaaaaaattaggcaaagttaagttaatcagggaaagactttgattgatcattttgtcaaaatacgatttttacaattaaacgcatttgttttaattaaatgtcaaattctttaaattaaaaccgagttttacacactcaaaagtccaatcttcaaaattcaattgatggtaccaaagagcaaaagaaattattttcaaaaatatgaaaaatacattttttgttgaagtcaaaaatttaggtttaagtcttttactattattatttaaaagaaattgacagaccttaaataaaattatcgtagataatggggtccgatcactaatccaattatattaattgatcagaaaagcggtgtttaattggtcagctactaattatttttcgctcaaaaaaatatgaacgatgaaaaaaaggattgggctgaagatttttttgtaacatattcaattccttcacctcttacagaaaactgatcagcaagaatgggtctgatcacttttgtcaataatattggattattattgtctgatcactcttgcatttcaattattttaattcaaatattatttcaccgtttaattaattattgtctgtcttaattttggaaaatgaaagccagcatttgtgatggtcacataccgccgatcacattgctcaacggcagtgcaattgtgcgtgtcttcggcagtgccatcgtccgcacgtcgcacacggcgccgccgccaatgcgccggcttaagcgcggcaccacttcactttatttgttagagggattaggtatatgaaaaatgtagcatttgattgaaatgtatagataaatatgtgtatgaatggggagggggggggcgtttcggccacggggaacggaaaaagcaaattaaaaagtatttgcattcgtggcacggatcattcatccccaactcaatccatatccattcataattcatccaacgcgatgcgggtccgatgggggcttgtttcggtttatcttcctttctatttttccccgtttctatttttccccgtatcgattttacccccgtttcggttttaatccaaattcgattttaccccgtcagtgccgtcatccgcacgtcgcacgcggcgccgccgccaatgcatcggtgccaggcgacgcacggctcagcgcagcaccgccttaccctgatgaggagccatggtgttaattttaagagcattaagtgataattaaaaagcactaatgggggaggggggagagcggaacaagacaaaatttcaccaccgaattttttttttatttttaaacttagaaatcatataagaatccaaaaaaattttataggtaaattccataaaaatttctagaaaagttttgaaaaattgatgactaattttttttgaaactttatttttttgaaaatttttccaaaaatctcttaaaaatttttaaaaaatttttaaattcagcgaccgaattttggggtgcacccggcgagggtgcagttcgtttcggccataggcaaaaaaaggaaaatgaaaaatttcggagttccaaatttgcagtttcatcatttaaaaaagtggggatacgacacgactcccaaacgattag

SEQ ID NO: 7412 - DNA, 2685 bp, Heterodera glycines
  misc_feature (53)..(53): n is a, c, g, or t
tatccgcttatttgattagataaaataatttcatgcttaaaaaatggcacttntagaaaacgctctaaagcccattatggcatttttaaatcaaggtgcgatcaagacgggagattaaataataggggtaaaatctagtggattccactaatacattatgcatatttgtatttaatataaaataaatcggcgatttgtcacttttacgaaacgcccatagtggcacttttacgaaacgcccaaagtggcctttttacgaaacgccctggcacttttacgaaacgcacattttggcactttttacgaaatgcccaatttggcacttttacgaaacgcccaaagtggcactttttacgaaacgacccagcacgctcccaaacgattagccgcaatttttttacactttaattttctcggaaaaaatgaacatattgaagaaagaaagaaggatggatgatgatgatcaatgaatgttcagcagaggagacaaatgctgcataaataaatgatttggttgaaatgagaaaagattttttacaacatttcggtggcaagtggccgtagggggggggggacacgttttgctaattgttttcattcatcccctacggggacaaaaagttgaaaaatgatggaagaatgaaaaacggaatgaatgcaaatgttggcattggattaatttttccatcagttgaataagttccttccgggaactttgaaatccagtgacgatttaacacagcgtttgatttggctgctttaggcatttaaatatataaagaaattttctaaatgcttaagaaacgtaaagtagtcaacttttaaggtgcattttcagattttcttgtattttttcttacgatttttctcaaaaatgccaaaatatgtgctaaaaaatccaaaatagcccaaatatgtgcgatatgtttttatgtgccaaaacgccaaaatatgtgtttcggacaacacttttaaaatatgatccattgttcctgtggcctagtcgctgttctcattaattggtttccctctttactcagatatcgatggcatttgtccttatttgtaagggctgtataatctgtgaaattcaaaaaatcctaagtaataaaaaatttgtcccaattttagcctaacgtcctcattttttccttgtttgtaaaaataacaaaatgaaactcttcggggacaagtggccctaggggggcggggggagaacttttgctaattgtttttattcatccccctcgggggataaaaagttggaaaatggtggaagatggaaaaacggaataaatgcaaatgttggcattcacaaagggacgaatgaaaatgcacagaacagagggaggccaattcaaaaatagaaaatgaatcaatttatagaacaaagttttgtaaaaaaaaatgtttgtgaaaattattatgttttagccaaaatttaaaaaaaacaatattttacaaaaaattaaaagagatttttcatttatttttggttattataaaatttaattaatttaattttgtaatgctcgagaatgtccgtcttttctgttctcgaaaacacctaaatctcctctatcagttctcgggaaatccaaaatctcagaaatcgtattttaacacagacggcaaatccctcctacccactgcatgcccacgattaacaacggttattggaacgaaaattcacaggtcggcacttccattttgaaatccgggattgaaacccgaaaatgtcggaatccgaggcgaaactttttcttacattcaaaagttggaaattttcgttaaatactaaactcggatggtcgaattgcattcagttgtagcaaaataaacaaaaaaataatatacacaaaaatgaaaattttagggccgttgggtcaaatagaagcatttttggatctgagtaagcttctgaaggcatctgtatttctcggctaacatcccatcatttggcaaccctccggacggattacagtacgctaaatgaaaaaattctaaagaaaatcaatcaagtaaaatttacgtcgacaatggtcgaagccggactcaaaaacgccaaatgcttggcaacaggcggtggcgtccttgaaaaattgaaaatcttttttcaatttcatgcgaaaaagaggcgggtataaaaaagtcattatgccaattagcgctaaaaataacaatttaaaaaatcactaaacaatgttttgtttcgttaattttttactttttcagaagtgatttttttaattggtccccctttttttacctcatttccactagcgcatacctaaatttaaacttggtcataatttgttcatttttgcctcattttctcaccatcatttcaccgacgcgactcaccggacacccttacagtaggagggaaggggttggattagtgtcagtggatactgtatacgctttgttttttcttacttccggtcagcacggccaattgtatctgaaaaaggcaaaatgaaaatggtaagagattttatagattttcaagaatagataaaaattttaaaatcaaaatatgggataatattttacgctaatcctaattaacaaaaaatttaccgtgcccaagttctgatcatagctgcacagttgttggcacccgtcgccgagtcgggcacaacaattacgaaatcgctaagaaaaagacgtttttgtaattac

SEQ ID NO: 7413 - DNA, 1884 bp, Heterodera glycines
ggcaccgggccaaagccggcttgcggaaagaattcatccggctgttgctgctggttgtagaagccaccaaagctggtggtctgttgttgttgtggcgcagcaaattgtccaccctgacgctgatcagccggcacaaactgttggccaccgccttgctgattttgtggcacaaattgctgcccaccctgatcgcccggcggcacaaattggccaaactggccggactgtgccacaaattggccgccttgctgctgctgctgattttgatagggaagcggcccaaattggccaccagctggcacgaattggccgccttgattttggtgatcggctggcacgaattggccaccaccgccttgctgcccattttggaacggcagttgttgctggtggtggtaatggttttgttcagcagcaccggctccaaaatcagtgccatattggtttctgaacgccttttgacgccctaaaacaattttagtttatttattataattgaaaattttttcagtatttattggaataaactatttttgacactattcctttatgatctaaaaccggatcaccagaattccaaaataatggtgcctttccatgtacatcagaccaaccagggctcccggaaaatgcgtcagtagaaaatgttgtcagtgaaaattttattgtcataaaaactagttccttggggtttcgaggtcattgatcacgaacccatgtatccatttgggccagctccgaaccccagacccgaactcgaacaaaaaaccgaatgttaaaattttcgtagttttagcatttatggtccaaatggcataaatgatctcatattgagggattggtgcctttcagtttgtttccgtgtatttacataaacttattttgaaccgaaaacttaaggctacagaattttattttaaaatgtttgtatcactgacgcactttccggtcacgccaaccagtgtttggaattcaaaaattaaaaaccttattggatccacaaaaaaaaaagtttgggataaaatggaaaaataaatcatcctttttttcttgatcaatataagaatgttaattctttaaatttattccaccattgttattgttgttgtttacaccccgtgagttcacttggcgttgatgttgtctctgttgtgctgctggtactgcttcaccaactctttgttgcggtgctccgccaactgaggaagggaagggcaattgttgcgcgaatggcactttgacttgcgcttggccaaatgcccttgcgtccggcacttgtgccgactgttgtgcctgcaattaataacaccaatggtcagcagaagtgatcaaacagaaaattgtggcgaatatgttaacagtcaatttcgactgatcgcaatgctagccgagacgttaacagggttttgatcagatggacactaattatttaataatttaaaataaatcagtttgaatttataaaaaaaaaatttccgaccttttattaaaaattataaaatcagaatttcgacgtccaaaattttttcggaaattaaaaattgggattccgactgttccgtgccatcactgatccaaactattgagtaagctttcgaaaagggattgttagttactgattagaaatttttgaatgaaattgacttctgctgaccgtagtgatgaaaagtttgttgccaatgggcccacagacggcacacgccccggggcacatttcggcgatgaacggcacccggcaatgagagcattttgcgcgaatgcaacttggcaaatcggcaccaactgaggccggcgcatgccaaatgaaaccaagcaaaatgagtaccagtgccattagtatagagcaaaaaaagtgccaataatttgaattcatcgccttttaat

SEQ ID NO: 7414 - DNA, 1213 bp, Heterodera glycines
taaaaaaactgctgccggagataattttaacattttagcgaacatttttaaaaaaatatacaaatttaaatttttaaaaaaataaaacaaaaatttttattcaaatttaattaaaaaacaattttataacttttcaactattaataaaagtataacacgaaaaaacttggttaacacagttataaacaatttcacagaatatttccttcaaatttttatgacaccatgcaaaattcgcaatgccagcagcagaactttcaaatggcatcacaattacacaatgggtgaatgaatggaatgaatgaatgaacgatttatgtattggcgttgtgttttgttcggatttgtgtggcgaactgctggcggcgctgcacagttttccgcctcgcaaaagccgagagcattttgcgcgcaatttagccgccgcgccgcgccgtcatttgaatgtggcgccattttgggtgcgcaaaacgaccggatttaccccccccccccggtgaaatgcgccgtttccgccgctctgaaggggaaaatgacgatgataaatccttgccacctctgctgctgcacaatttagctgctataaacttcatgcttttttttgttgcttaaaaagagcagcaatggaaaacggtcacgccaatttgtaggagaaaagggggaaaagtatattttattaaaaaaaggataaaaaaatgttacgaaaataatttaccatatttgctctttttatgtgccagtctccattaaactgccggtctctaattatctacccctttctgaggaggttgaaaaataatataccatggcacataaaaagagcaaatatggtatttcatttaaaataaatgatcaggataagtaaggcaagtagagctattgctaacaagcaattaaactatttataaaaaggttgcaacatgaataccgtaaaaaagtttaattttagcattttatttatattttgtgcctgcaaatttttgcgattattggaaagctattaaaacttgataagagtttttgaatggtgacaattttataaaatttcatttaattgaaataaaagttgtgccttattaaatttgcctgaacaaagcttgcgggacagtgttggcctgattgtgatttaaagagtgcttataagtaggaggaatacaagcttgcccacgggctaagcctgaccgccctaccacctctttaacgcgttaatgag

SEQ ID NO: 7415 - DNA, 931 bp, Heterodera glycines
  misc_feature (23)..(23): n is a, c, g, or t
catcttttacataatgcatattntggaaattaaaactccgtttttgatattacttctttttcatttatttttgagaatttctcggaataagatattattagcttttatatattttttgatgtcaaaagaagttcaattttttaagaaaataactatttatattgtttcttttgtaatgagttaccttaattttattagattatttaattattcttgacggatgtagtagtcacaaaggacgaatgcgcagttcttatggagaaatgttaatagtaattttttatactttaattatttcatttgtttttaaatttattttaacatgttaattatatttttaattcaagtaattggtatttttataaatagatcaaaaagaataaattatttatatttatttatacatttatatttaaataaataaattatttattattgtattatcaatgaattattttaacatttaattaactatttcatgctgaagatatgttcgagagaattttaaaaatttaaaatataaagcatctatttttagtattcgtcaacttagtttattttattattgtagatgatttatctcatttattcttgtcgctgtcggtaagaatcggtagggttgatgtaccttataaaaatttaaatttctataaaaaaaaataacaaaaagtctttatattcatcattaaatagtaaataaaaaagattaataaatcggtttttttataaaatagaaatatgtagcattcgaaaaaagaattttaaatagaaaataaaaataacgaattggttttcaaaaatactttaaaatccagataaataataattagtaatctccattcataaataaaaacaataatattttaatgattatatattgtaaaaagtcaaatttttcatcattttattttttaattttaatattaaaaaa

SEQ ID NO: 7416 - DNA, 3521 bp, Heterodera glycines
taattactctcgtttcttttccagcaaaatctcttcagcttctacactctatcattggtttagttctgcttcttaatataaatctattaatctgttaacaacgaaaagccttctcccctctctctctcctctgttgtccctttctcctctctcattctctctctgtttctctctcttctatatctctctctctacccctcactctcgtctttctcctctatttcctctctctctttctctctttctttctctttcacttttgctctatcttttcatatgagttcaaactttatagaatattattctaatttatataagtaaaaaatatcttttatttttaattcattatttttagtcaaattttttggtttttatatttaaaaaagaaagaaactttaaaacaataaatttttatcagaaataggaaatttttaaattcttgtcaattaataagatataaggtagaaaaaaccaaaagaaaatgaataaaaaatatacgatcaaaataaaaattttaaaatttaaatcaaaatctttcattcaattcaaatttaaaaaaattaacccaaggacgagaaaaatgttcttatttgaaaatgttagcaataatatccaaagaaataattatttagattaaaagaaatatgatttctttctatgctaattaaattaattaaaaaagaaattgaattctttttaaatttgaaaatgtgaaaaaacatttttataaattattagtaataaaataaccataattattggagcattcaaaacagaaatgtaatcggagatgatacatttttaaggtgtaaaaataagataggatttaaagaaacatttttttaatatttgagatttaaaatcatcaaattttaaaatgttaaactactccaaattaatttgagagcaatgaaaaattatctaattaaaagatcaacacgattataaagaaaatatgacatacataataaattttcaattaatagcttaaaactcaaaaagattgaaaaaaacaacaaaataaaataaaaagagttaaattttagataaaatcttttagcaaattgcactctacttttaatagtttcccacggcttctatcggcaccgccggatcccccccccccattcagcatacaaaatttagtgtttccagcagcaggacctttttatgaaaattttgagattgtaaaattcaatgtctctttaggcactttattccaacaaatggaatttttgggtcaaaatatttattttacaattaattcaaaaaatttattaaataaaaattaaattttcagtctcccattatcaaattaactttttataaaaacataaatagaataatggatttaaaattcatttatttaatttagagaagaaaaaagataaaaaaataataaaacggaataccaagcacaagcaaaaagtgaagtgccatatattaagtagcatataaaaatattaactatttaaacatcaacaaaatcaaaaattcatttaaaaaattaaaaaatatatttaccaaattaagttgtaaagttaataatttatactattttggtatatttataaaatattttgtttccataaatttagttcaactatagtaaaaattaaaaagaaatgactggaatattttataaatttataaatattatttttaaatgatattataaaataaagattattcatatatttcatctttgaaaaatagaaaaattctgatctgaattagatcgggtttttcacttaaatttaattttgcatttcaattcatataattaattatgaaaaaaccaaaagaaatgtattaaattttaattattattattattatttctacataaagaataatttataattaaaggataataattatgaaatacggttaatcaatctcattgtcaaaaaaaagaaattaaaaatggattatcctaatataaatataattataattacataaaaacaataaattaaaagttaaacgataaaatgcgatcgtctctggcatgtctaatttgacgtccgcgcaagaataaaacataaattacttaataaaataaactaagtcagcttttaataaaaaaacaaataaaataaaataaagatgctctattgttttaaaaattgaaatttaaaaaattaagaaaataaaggaagataaataacctgaaaattataaagattttgttcaaacaaatagaagaaaaattgttcaaacataatttaaagtttaaaaaatttcaacttacgcaaaattaatcgtataagcgatattattttaaacggacacattaggtggtgaggttaaaacaaaaaatattattatctacaataatattataatttatggagattttacaatttataatttcaaaaattgtaaaaaacgtacaatttaaaaaattatttcttctaaattttttttaaaattataattatataattttaaagaggcatatattaattataaaatattggacacacaaaaaaatagttgaaataaatttattatgcatatataatatactttaaaatacctaaaaattagcatacttaaaaacaattgactcgcttggcaatttgcattagaggtcggacgggaccgggatcccgcattgattgaattcgggatcccgatctctggatccatccctatcgtttttccaaaatcttcgtgattgatcgtgcttcgggctggatcttaatcggaatctttcccgaccaatttgccaatcccgagggatcccctttcgacaaaatttttttgtgcttgtgaaaactctttctcggggttttggggtccccctccctgatcacgaatctgacatatatacaaaaggattatggctcgacgcaattacagattatggattccataattacggctttggacccaattatacggatgatgagttatagattttctaatctactaattacgaatttatgtaattgaaaatccaattacgtgcaacactgtttcagatgaaaaatttattaatttattcagaatgaaaatattatttagacaaagttcagaatattttagaaagcaaataataatatttcttagttgaattacaaataaatatctttttgaatttgaaacacaaaaagctacaacaaaaaatgtgtttcaaaaatttgaataaaataattataattctaattatcattctcttgaacaaaaagattaattttatttaactatataaattatcatttcaaaaatataaaaataagacttaattataaatttaaaagtgcgtgaggagtacaacaaaaaatagagatagaagagcatgaaaatgatagaaggaattaagaaaaattatttattaaaaatgaagttttttaaataaattaacaaataaaaaagttaactgttaaaagttcatttaattaacataaaatccgtaactaattgcaacttaaagaagtttaatttaatgaatttagcattatctaattcatacgcagggattgcattccgaggccccacaaaattttcggaaa

SEQ ID NO: 7417 - DNA, 1604 bp, Heterodera glycines
  misc_feature (26)..(26): n is a, c, g, or t
  misc_feature (58)..(58): n is a, c, g, or t
atataaaatatgataataaaaaaatntaaaatttataactttcccataaatataaatntaaaaatatattcaaatcaaaagataattaatgtaaagatgaaaataaatataaaataaatcatttttataaaatgacgacatataaaaccaaaacagaatttatattaattaatgtaccttagtataaataaatttgttttaattattagcgttaaaataaatataaggaatgtatgtcattatttatttagttattaaaaaaataacaattatatataaaacttttgatatgattattaaagtaaaattaatattaaaacaaattaaaaaacatatttaataaatataaaaaactaataattatctgaacattaataataatattaaaatagaggtacgaacacaaataaacatctgaaaaaaggacaagaaaatataaataaatcaattaataacaaattattaagtctctaatgtgaataaacataatgttaaatttgaaagcaataacctgaacttatcaaaaaattttaaaataaatcaaataaaattaaaattaacaaattacataagcattttactcattttttttatataaaggataatgatgatgaaaatgtagttaattcacctcatagtagacgaaaaaaaaaatttaaaattggttgattatcttaaaaataaatattaatttttatttatgaaaaccaataataaagaaactgaagcctcggaaataaaaacattatgaaaaaataaaatatttatggaaaaggattactaaataaaaataaaataaaatagatgcgttattaatttaataaaatgaaattctttcggctaaatagaaaaaataaaaataataaattatttttgcctaaaattctaaaaataaatgaaaaaaagtaatattaaaaacatcattttgatcaaaattctcaaaaataaagtttatttggatttattttatttcaaattaatgaagaaaatttttcaataaaaaggcaatcattagatatttaataaaattaagaattgttttaaaaagaataaattgaaacaagattataaatatgaatattacataagataagaaataaatgattgttatttcattccgagcaattttttagcacacaaaaaaaaatattttggacattatgctaataagaaaaattttgggcttttcgggattcttcttacttagtaaatattttggcaattttttaattggagttttttttgaaaaattagttttttgtcaatcaaattcttcccaaaatgaccacaaattgttcaaaaataattcgtcggccctttcggcacctgtagcgtgttaaaaataagaaataaatgtacaattgagtcaaatttcataacctttttttattattacagaagcctaaagctaccaaaaattgaaatggataaaatgacacttttttgcaaaaaattcactaattttggcagtttggtttcaaatttaaaaatcattaaatttaagttcaagaaaccatttacattcaatagagaatttaatataaaaaatgaaaatattgctcatagaaagcatttatagttcaaatttttaaattatagatact

SEQ ID NO: 7418 - DNA, 1757 bp, Heterodera glycines
ggccttctccttctaatgcctgcggaaatacaaatttttgtttggggcaaaatgaattacggtagaaaaaatggaaaggacacggtaattaggatgggagacatcacagcacaaaatgaacaatggagaagcgaaatggacatataaaagtacggtagaggaaggggaaggggtacggttgtgatattactgggaagtacggtggaatagaagtcttgtattgttgtcagagagatggggttacggtaacatatttggaaatacgatatgacttaaattaggaggaagaaacaaaaattgggagcggttcaaatgaaaaaatggaatttgcattgccttacagttaggttgaatacggtaaaaaaatgcaaagaggggaaacagggattacggtacgaatcacaaagggacatgctgtggagtttgtgtacccaaaaatactgtggaattggaaggtctatggtattgaggacgaaaaatgacagggaaaatttcggtgaaaattatggttgaaagataaaaagaattacggtagagtttctatccaagtcaacttgggtgaaacacaatgaagcaaacagcatgaagcattacggtgtaacttttctgtccaaggggggggggatacggtggaataaagcggaagataaactggaaggaatacggtagaatttccaagtaaacttggtcaaaaagcacagaattaaatacagtgaagattacggtgcaaaatataatgggtgggtaacatacggtaataaacagtaaacttttcagtaaaacatgctaattctgattatcaattatctcaatcacacatatcgttaaaattaaggagggaaataaataatatctaatgccatatattctctttgtttctttttcttgcccattgatcagacccattatcgatcaatataattgcctcccctgatcagtgtgatcagaaactgagccgacgtgctcgatcagcaacgccgcctatcgcacttgcccgtccgcatacaattgccattttggcaatgcttcctccgccgtcgtcgttgttggcaccctgtttctgatcggcaccaaatccatgttgatcatcatgatcaccctcagcatcattagcatctttttgaggagtgccttgtggtggtgccggattttccatgccattgccatccgccggtttgttggcactttcattgccattgttgctttctgccgttatttcggtgccatcatccgttttttgttgcgccgtttcgcattcatcattgccattctgttgctgttcattttttggcgccgtcaaatgtccatttaaatgtgcgccgttgccattgccaacatcggttgaaccttaaaaagggatgcaaaaattttaaaatgataaataaaatttaggatgccatccccgacaatttgggggcccggaattgtcggggagtgccagggtttggcaaaaagagagcggggatttggggtcggatttagcctagacgtaaatagattctgatcggattataagggtttcaaaaattcctaaaaaaattgaaaaaaaaaccaaaaaatttgcatttaaaaaaaaaattttcgttgctaataaaattgtaaatctgatgacaattagcttgacatgagaagccaggcactagcaaaaatttcttcagaatttatgaaaaaaatgacaattgaaaattgggtccaaactttttagctttttaaaaatttcctacaaaattttttagggaatatttactgatcagtaa

SEQ ID NO: 7419 - DNA, 2782 bp, Heterodera glycines
aattttgatattttataaatatttctttccagatttcattaattttcaaaaataaaaattccactactgaatttaaggacaaatttcttcctttgtcacaaattgtgcttcaaaaaaatcaggacaaatttcccggaactcagatggaaatgtccttttatgtgttgattgtgaactgtccggtgtatgtcagtttttttttctcaaatttactaaaatttaattgttcattaattactttcttgtcccattttcggccgaatttgctcgcgattcggccccgccgctctgtttgttgggcttgggctggttgtgttgcggcggttgtttctgtttggagaccaccaccaactcaatggtgccaccattttgggctgtcgccggtgtcttcgtcgtagtcgacgacaccgacagaatggcatccgaatttatttggcattttgttgttggcggcccagataagaagtttttcagttgctcacattcgatcagaggggcaattttctcatcgctgtcaacctgaaaattgtagcgcacaaattttgatcaaatttattagggttggattaagaaactaatgcattaaaccaagaatcttcgaatcagtttcagactaatcaagaaaaaagacaacaaactgagcagcagaaagatcaaaaaagaagaaatggttgaaaaatgatcaaaccaaaaattattttttccatttttattgatcagaaataggtggtgattaaaaaagcagactgatcaaggacagaactgatcataaaatgctattgatcaatcataaactgctagtgatcagcattaataaaagcagtctgatcaaatactgaactgatcatgaaatgctagtgatcagcattattattcgtattgctcaccgtctccttgtactgctcgacgtccgtctgctgttcctcggttgacacgtccacatcatccgcaatgtcgtcatcatcatccgcatcctcatcatcctcttcaacattggtcgtcgtcgtcctcctcctcgtcctcctcgtccgtgtaaatgccgaccaccgatcgggcagtccatttgctggtgattctgcagcttcaaatgtgtgaggggtaattcataattgggagactaaaaaccataaaaattccgctatttttagccaaaaacagcaaagcatttgaacaaccccaaaaaattcaaaaattttattgattttatgaagaattaattaaattttaaaatctaaatccgaggccgaaccgaacttcgtctgatggatctgagcctggatttggggcttttagggtccactgtgttttggtttttcggcattgtctagaaaaaccgagacgaaaaattgaaaaactcgatctcaaaatttgaatgcctccctcacgaagaattcagcaaccaaaaaaaagtgttcctaatcattaattatctgctggccatcttccaaatcactgatcagaggctatcaaaccgggactgatcagagatgatcaggggatagctattcccaaattagtgccaaattcaaatatcgcgcacctttcgctgtgagaacgtgccccgtgtttggcgcaatggctgcgacggatttggacagaaattgatgccagaagcaggatgattttggtggttttcgaccgatgaagacacttcctcgttgctgcccatcattttcacgccgttaattgtccaacgaaaatttgaaaggaaaaattggaatttttaatttaaaaaacgcataaaaattaaactaaatgtatttttaatatatttttcccgattaatttatactttatacacaaagtcttactgtctttttctaaaccctaccgaatcgaaaccgggaatttttttgagatttttgccaaaattttaaaaatttaagaaaaattaggtctactgctggtagggaatttctaaaacttttggtcaatctaaccgaaaaaacaatttttctcgggttggtttccgattttttagccgctatttacggaaatttcccggacaaattcatttaaaagcaaaaaaaaaattaaaaaatttgccccataaaaattgagtttcacttattcgcagccgccaatttgttcagtgccgagccaaaaccgccaaaataggcgttcataatgtgctgcttgcgctgttttgcacgcgacgccggtgttgtcaatggcaccatgcgattggcactgttactcagcggaagcatcggctgattgcggacgccggtgccggcgtacagcgacacggtggagccatgatggaatgccaaatcgactgaatgtcaaacaaaaatttttatgaaatgaaaatgaccaaaagccggctgtttggcataaaaatagaaaaattaaaacttggcatttgagaataagaatctgaagcgaaaaaccaagttgtcttgaacttttgaaaagccaaaactacaagcaaataaaaataagagctgattaaatattttaaaaatttgatgataaattatccatccgttattttattataaatgaacaaaatcaatgtttagcaagaatttctttcttaaattatatttaaaaattttattttattaacttttgctcaaaatactcaacaaacttttcatcgaaattgttttttatttttaattataaaatatattaacaaatttaaacaaattctcacgatggtctctgtccatggccatccgttgctcggccaatgaactgctcgaatgttttcgtgcaaattgcatcatattctgcaggtgttgttgttgctgttgtactgcttgaactcctcctc

SEQ ID NO: 7420 - DNA, 3276 bp, Heterodera glycines
  misc_feature (1070)..(1070): n is a, c, g, or t
ctgatcaatgttttctcgaattctctgataagttaaagattgataagactaaggtcaggaccaggacgagaatttgggaattggatcagtacaggactccagattaaaatctctatttttgtgaccaaccagtgacgcatttgctttttctggctttggaatcggaatcagaatttggggaattggactaagaatggcaagtgtgcaatgtgtgaaacatatgcaatcaaattttcctctactatctgatcagtttaacatctgatcattaatgacctcaaaattcaaaaagttccatgacaaagtgaccaatgttgatttttaatcatcaatgtgttaatgacctaattgcctcgttaataaatctgcaccatatccaaattttcatttctggtcaacaggtgaaatttttaattacataatcaaaaaacgtaatcagttaatgcgtaaaattttttatttgacacttttaacaggttcgaattgcttctctctgctgctgatcagcccgccccctacaatctgtccgaacaatcatcggcaaatcagatcacaagcatcgggcccaccttctgctgctgttgctgctgatcatcatcatgctgttgctattgcctccggcaccgttttcttccgccgccgacggtacgcgcccgcctccgccgccgcctccgatgatgatgtcattgttgttgccgccgccgaaatctaccgcatcgtccacgaccaccgcgttgttggacgcgtaaaattgatacgaactgttggaaggggttgcgcgaagctctccgccggtgccaccagcgcaataaatgcgacgcccaattcgaccttaggggacgggcaaagtggaaatgttgaaatttaaaattttggctttaattaatcgcgatcgcttaattggaatattgattttttaggaaaacaaagcttgaattgacaacaaaattaataatcaaaacttaagttttttacacctataaaattctatttgaacaattcacgaagagttgatcactcaatttatatatttgatcactcaatttattgatttgatcaccaatttatgnataaggcatttcggaccgattctgttcacttttccctttgtcagacgaaactatcgaatgcccactaattatgatcattttaaaatgctatctcgcaaatacagctgctgatcagcctctataataaaatttaatcccatttttggcgtccaacttggcgatatgccattgtgggagttcggcagactgctcaagctggtgttgtggtggtggctgaaccggtgatggttcgggtctcgcttcacaaatggtggacgccgttgcacaaactgttgttgttgttgttgctgctgctgttgttgttgttgctgttgttgctgatgttgttgtgccatgccgtcggtcaacgcgtccagcttggactcgatgaagtacagtttgctgttcagctgcgtgtgcaacagttccatgcggccaagcacattgcgctccaatttctgttaaaaaacaaaaattttagcaatttaaattcgtaaaattgaaaaaactcggacaaatttagaggaaatcggcctggattggatccaggcctggatttttcctggatccaggcccaggtccatttttggcaacttgggtttttcctgaacctggggtttcctgggtttttgtccagaaaatccagatccaggcccaacatggaaccaagggccagttccaggtccaggcttttttcaaaatgccgatctcatctcttctatgagtatattcagtgacattccaacacccaaacccagtcttaaatctaaaatttattgcatatgttttcaaattttaaactaaaatcttgtaaaaattaagtgcctttgttttgatcgaaatttcttatagcaattccttgaaattaattttatctcccaaaaattgaaattatttaaaatttggttactgtacccgcatttcggtcaatgtccgttgctcaagctccaacaaggctcggttcatgttcatattttttaataatacaataataaattatttgtgttgcttaattatttttaaataaggaaaatttctcaaaattttttttagcgaattagaggttaattttatttaaatattttcattaaaaacatttattataagacttttttaattgtgagatttggtcaggggcttgaaaataaatttggcctaatatttatacaaaaatgtcgaaaaaatctttggctctaagagtaaaaataaaagtcttcggattgtccttccgaaatttttttcgggcctatgggcctgcgcgtgccctgcatgtcccccccccccctgctcgaatgaaaccatcaaccttccacggttttggtcgggaattctcgactcgctaagtgccgttccaataatattttgccaatttggttggagaaatttgaacctcccagcaggagaatacattatcgcatttttgttctatttttacaaagaaatgctttatttgctctcttttagtttgctgtttccaacactcgtacagttttgggttatttgaatatttgccgttcactttcaatgtttggcattgtgacacgtaatattttagttgtaaacgaaattaatttaaatatttctagggtttttccgaaaaaggacatttccgaaagtccagcaggcaatgcttatcggcagaaaaggaattgaaaaattgattaagatttaaataaaaacagttaaaaaaacttaaacattaaaggaccaaatcctgtgcaaatgcccaagtgttggactgacgcaagagcatttaaggacaggtttattttttcaaggcagtctttgttttgcgttaattgctcacaaatctggactctattaattaattagattacagcctactactaatgaggaatggtgggtacactggaaattgacaatgcattgaaatttcgttttttaatcctatttttacctctctaatgaccaatatttggaaaaacttttttttgcgctttgatcagcgattttcgggttcccattcactctctctcgagtgttatcctccttccttcctgttcgagattggatcgggagagttcagcagaaggcgacgaaatttgtttccctttttgggagtgatcgagatcaaatcgggattctcgctgcaaaaaagaagtgctaccagcagcagagaacttgtttttgtgttgttggtattagtgggatcaacagcggaattgggtgaaatcggatatatcggatcggattctcgagacttgcc

SEQ ID NO: 7421 - DNA, 2427 bp, Heterodera glycines
  misc_feature (52)..(52): n is a, c, g, or t
  misc_feature (56)..(56): n is a, c, g, or t
  misc_feature (764)..(764): n is a, c, g, or t
  misc_feature (2114)..(2114): n is a, c, g, or t
attcagtatattgtcacgtaatacaaatttgggatcaaaaaacatacaacancatntgttcgtccagtacatcggattatgaatttaaacaatcactagaaaaaatattagaaaaaagcatatataaaagaatcaggatttttaaaacaattctaaaactacaatattctaactttctagtagtcttaccactacggttaccacaggaaaatacaattgacgttctgttagaacagcctatattttcaactttttaccgttagatgataccgtaatttttgaaataacaattgttaattttaataatgacaacaattgaccaaaaaatcaattttataaaggcacaagtcgaaacggcttggaaaatgggcagaaaattagttagagaagcagatagtttggtattttattcctatgagctttcgaaaattgctgagttttatatcagaggaaatgactcacgaaatgatttattatttgatgaattcttgaaatcggttcgaaaaacttggatgctttttcagaatatttaacaagaatataaaaatactgcctttgcaatgagtgggattgagaattgtctaaaaacaaaaaatttagttatttgccaacgatcagagaatatagcaaaacaaagcgaagaattttttgaaaactatcaaaaccaactcgcgaatgttagaattgatttagaaaattaattcaaaaaatacgtgagcctaaaaaaatagcgcgagaaatattctttacaccctaccgtaagnggggaggttcaaaataaataaggtttatgaaatatattatgcacccaataatatacatcgacaattaaatgaaaaattttagtccatatagaagagataaaatattcaaacagatcttagttcgttaaaaaacctaaataaaaaaattaaaagtgagtagcatagaatatttccaataatgtatagttcaaagaaaataatactaattcaaaagaaaatgaaaaataatgatatgaaaataaaaaaattgtggtaccccttgtcttggactggtcctcaactgggttcattatgcattaccaccatatccgagctgggctcgtccctctcagcaaaggtgcgcatgtggacgttcgaaggcgggaaccccaaacacgccatcccccgagggggcttaactcgaacaccagcactgagagagcgaaccgagcgcataaccactacgccacggaacgctttgggtgcgaagaataaatgtacaatttgaaagagattttttactagatcaaaatcggatataatgggctggcggtggagggggggaggtgggcagaaggaagggtgggggcaaaaataatggaattggaaaacgggggaccaaagaattgattgaagatgtttaattattttcacaaataacgaaaagattagcaaattcttattataatcaattacatgaaaaaggggtggaccaagatatgggtttaggtggaggtatgaagcggggcgtctttatacccttgcatgtatgactggctgtcaataacaccctccccctataagttttttcacccttaaatttcaccttgatccctgcgttttttcacctcttttcaccatgttttttcattattgtgaaatgtttttttcacaagccccgttctaaatttcgacagttttcgaatatatttattgtccttaattttgcattaattttcgcgcatttggatttgtccttaaatttgatttttgtcgttcgatttatctcttttactttgtcatcgattaaagggaccatctccgaaaaagaggatgtcatcgcacacacatacatatccgagcagatttttattttacatttttttatttttaacagaaacaaatagatataaaccttagcttagataagggtaaaattctatgattttttaaaaaattttatgatataaaatagagaaaaaatataaaataataatacaaaatcattatttcatattcctttatttaccgcactaaaaattgccgtggccaaaagagaacagaggggtaaattttttaattcaaaaagtttttctaaaatgtgattttatttgggtcatagatatgggggggggggggggtttaacaaanacatttcctaaacttttcttcgattcataatgatatgtgcattaatcaaaaattgataactttcacttggatcactattttgggacacgcaaaaaaagaagcgacgcgcgcatcggtgcgaaatgtacccggcaataccaataggctggagtttttgcattaaattagtggcaggggtctcttctttacattttaattgcttttctttgcttttgcaattactctttttctctaattctctcgtctctcctatgatgaatgcgcatctctctgcccagggggggggggcagatttttatccctatactactcc

SEQ ID NO: 7422 - DNA, 2359 bp, Heterodera glycines
  misc_feature (24)..(24): n is a, c, g, or t
  misc_feature (69)..(69): n is a, c, g, or t
  misc_feature (88)..(89): n is a, c, g, or t
  misc_feature (2303)..(2303): n is a, c, g, or t
  misc_feature (2305)..(2305): n is a, c, g, or t
aaaaaagatataaagatataattngctacagtaattcaaataatttaatctgaaaaattcacgaataanttcattcaaaattgtattnntagtcaattctataaaaaggttatttaatattaataaaataaatttaagaaatcataaaaaaagaaaaaaattctaaatataaataaacaaaaataaaagaagaataaatggagcagataccataattgacatatggagataaaaagtatataacagaattaccaactaactaaaacaccttatggagacattaaaaaaactacccctcaggacatgaaatttaaattataaagctaattaacaaataaatatacaattagaaattgaataaaaaattaatcattaaaattatattctacacattctgcaatcgaatttttttatgtttgttctttaaaaaatatatcaaaatacgaactgaaaaaatttactataaattaaataatatttttccgttttttgatttcttgttaaacaaaaattttaacataccattcaaataaacaaaataaataatgatattcattgtaaaaaacaataaaaaaattttattcactattattcaaccattaagttattttaaaacatatttttatcaagaaatatttttaaaaattgagacgttggtatttctataaatgcatatgtataattgaatattttattaaaaataacttaaaaatgaaatgaataatttaagataaataaactaataaatttctgattatagcaaataaaatgaaagctttaacaattaaaagtctagtcgattatatcactcgacaaaattaagttaatagaattaagcactattcaattgcactttgagaaaattaattttttttaacttataatttttaacaatctttaatcttaaatttaattataattaattaaaaataagagatttaatgaaaatacaaaatcaatttaatatgcgatttgccctattgagctattaatatgtgattcctattagctattaattcttataaataaaaaataattaatgagaattgatgttgaacaatacgatcgttaatgagaattcgttaaaataagttaaggtatgaacttaaatcttcattgggataatcgcccaatgaatcaaaatattcaatttctgtcggcaaaacagcaatccagtgttcaagtatcgtgcccgcccggtcggtattcgccacaaaacagtatggaaaatgcctgttccttctatttaggcatcttgtcggaagcaaaaacgccgataaaatattttcgggttgtcggatgtttggatagaaatatttcaatctcatgagaattcatcatatgcttccgtcgctactgagcacacgattagcattaatagataaaatcgaatcaaattcccccagaacgattatctcatacccgccatcctttataggctcattaaattgcaccttgatgctggtcgttccgtttcgaatcaattcaaaaccgggggtgtcctctagagtagaggtcatcgggataaaataagcaccaaccgtttacaaatttttgtatattgatcgacattgttcattaaccgtcgtccatcccgagtcccgtatacatgtcaacaaatgctcgaatgtatttgtttcgatcaaaattaagagaatagggtgacccggggaatatgtttccattcgcttcgacactgatagagcgtatttttgcatgttcaaagacgaagggtgactctttaggatttccggtatacgcaccggttgaaacaaacccggcgattaaacgtctcggaacaatgcttgtaaaaacattgtgcgagagatcagaagtgccccgtgggatgaaaagacttctgatctcaatttttctcatcggatatttggccggggtggtttgtagctgattgcttattacgttatttaatgcttgggtaacatctactgtttttatataaattctaatatcgtgtatgttaatatgatatgtgtgcgggttcgctatgactgcatttccggaaacatatgacggtgcaataattagaaaatcatcggtattacgatgtatgctaaaaattacatcagagttattaagcaaaagattgggctaacggccgagattaaaattaagtttcaccatggtctcacattgggcccatcagcaaaacgtgacgctctgtttttaagccgctatttgtgtaatcatcctggtcgacatcgtcgacataatagcaggacgcttcacaaagaccctttttgacatctttctgaaatccccattcagtcatcatatatgccttnanacgcatagtaaataccagaaatcatagattcgacaccggaaattgacacgttta

SEQ ID NO: 7423 - DNA, 3427 bp, Heterodera glycines
ggacaatgagatcattaaagagaatccgttcaaataagttaagatatgggcttaaatctccattgggataatcgcccaatgaatcaaaatattcaatttctgtcggcgaatttacaaaacaggcgacccagtgttcccctatcgtgcccgcccgatcggtattcgccacaaaacagtaaggaaaatgcctgtccttaaatttgggcaccctgtcggaagcaaaaacccctataaaatattttcgggttgtcggatgtttggatagaaatatttcaatctcgtgagaattcatcatatgcttccgtcgctactgagcacccgattagcattaatagataaaatcgaatcaaattcccccagaactatcatctcatacccgccgtcctttataggctcattaaactgcaccttgatgctggtcgttccgtttcgaatcaattcaaaaccgggggtgtcctctagagtagaggtcatcgggatgacgaagaaacaccaaccgtttacaaatttttgtatattgatcgacattgttctttcaccgtcgtccatcccgagtcccgtatacatgtccacaaaagcgcgaatgtatttgtttctatcaaaattaagagaatagggtgacccggggaatatgtttccattcgcttcgacactgatagagcgtattttggcatgttcaaagacgaagggtgactctttaggatttccggtatacgcaccggttgaaacaaacccgacgattaaacgtctcggaacaatgctggtaaaaacattgtgtgaaagatcagaagtgccacgcgggatgaaaagactcctgatctcaatttttctcataggatatttggccgaggtggtttgtagctgattgcttattacattatttaatgactgggtaacatctactgtttttacataaattctaatatcatgtatgttaatacgatatgtgtgcgggttcgctatgactgcatttccggaaacatatggcggtgccataattagaaaatcatcggtattacgatgtatgctaaaaatcacgtcagagttattaagcaaaagattgggctgacggccgagatcaaaattaagtttcaccatggtctcacatttggccccatcagcaaaacgtgacgctctgtttttaaagccactgtttgtgtaatcattctggtcgacatcatcgacataatagcaggacgcttcacatagaccctttttgacatcttctgaaaatcccaattcagtcatcatatatgccctaaacgcatagtaaataccggaatcataagattcgacaccggaaattgacacctttaatgttttgacaaagctgtgcccaaaattttgaatgacaccgacgtgttggtcagcttcactgtccttggtaattggaatccaattgcttttgtcttttctctctattgaagttgacaaatagagaaaagttttattgaggtcacaaaactgattatctgaaaaaagtctaaatatatacggtccagattgatttattgctgaaagtggcagcaattcccgaatactggatttattaattgcaacgttcgtcggggggatatcgaaaagtgaaaggcccccctcgagaccgtcctcactcgccgtgtcgattttcttgagagttgtcattttttaactttttgtattatttattccatttatacctttagatgaaacttaactgatcatatacttgttttcggttcttattagtgatcagagacctttttcctttcccacattgttgtaacttatcggtaaggttagtcaacacctgtgttgaatgttccctcatggaatcccttaaatcgcgaccctgggcgatgtcactcagaactctctgcccagcggcgagccccgcgtgtcctgcactcgaggcaatatttctcgcaatagggatcaagaaacgtgccacattaccgaggaaaccgactccccgttgatacttgcttccgacaaagtattgtttctgtcctcttccatgttggggagtgataaaagatgaccaatcgaccgacttgggatcgaaaaacacatgtgtcatttcttaaaatatacttttcttaaaagagaatacaacttcccagtgaaatttaacgaattcgccaaacggtgtgtgaatttcaattgtaatttctgaaattcgtttcgactgtagacgatgaaaatactcggtgctatatataacttcactaatcgatcctgggtcatcgacgacgttaactattcttaagagtggggccatctggttgccgataattgtgtttttgattaaatttggtgcataaatgtatagctgccttacacctcccgttcccaataatagtttatgcgattattggaatagtcttttttcataatcgacaatcaatctcatgcaaagatgaaagtggattccttcacgataaatttgaggttgttgttacttttgtgtttattttaaaaaataatgatttgatataacttttcatattattattcttgcattcaatcatttgtttcttgcccgcaggcaagggtgaagattagtgttatttatttaaaatattaatatgtattaacaaattatttataaaattactttttaatatttaaaggcatatagtagtagattttaggctaataatttaaactaattaataaattaagtatgattgtttatattctggtataattaaacataatggataaattatttatatgaagaacaaatattgaaatgaaaaaataattaatattgtttatagcaaaaattaataaatactcaaatccaattataaataatattaagtaaaaatttaatttttctaacttgtccatatatgctacaatgtccaaccttatgtcggagcgtttatttctattctattttttgcttttttaaaaaaaataataagtaaaactgttttgaagtaatcaaaatatcgctattttcttttgttaattaattaatgtttctccttttttctctttgaatttcatatttttgtatatttgattcgttctccaacaaacaattttttctgtacacattacatgtattaattttaagataatttatcaaacaaataaaaaacaaattcggtgtcttaattatggcgccaataaattttgtccttagaaatttgttataaaatttaatttttaaaactttaaccaaacacaagcaaaatctttaaaataataactagagtgaagcgggtccgggaacgggccgggaattcacggtcaaccaaggtcccggttcccggtcttttgtattattttcacttaaaataattaaaatttaatttattgaattttttaaaatttttttttgaatttttcaaatttcccggttggtcccggttaccggtcccgaagaaaatcgagatcccggtcccgttcccggcttctcaggtcacggcaagtc

SEQ ID NO: 7424 - DNA, 1357 bp, Heterodera glycines
gtatatttttagaatttgtcgtcaaattgaccaatgttttatttcaaattatcaaaaatggttaaatttctgctcacttcgttggtttcgctctccgcgtattggccggggccggaaagcattgctcggatggtcttcgaaatcagggcatgctcctgcaaaaggaggacaatgaatgaatgaatgaatggattggtgtcattttattgttttatattcactgagcagcgaccataaatttgcattaaaaatatttttacaataaaatttttgattttttgcgcaatattaggaaaaatttgtaaagaatgtccgtccgctgatgtcaaaaatctctgagaaaattcaattttttttgaagcaatttgagcttatctgatggcatttttttaaagatactttaaaataaacacaaaagtaattttcgttggatttttttcaaattttttcaaatttctttaaattttttggttttttaggtatttctaaatctcgaaatgccatgagcctccgccccaccaacactttccattgtacgtactcaactccggtggcggtcccactcactttgcggatgacaaattcatgtccgtcactgctcaccagcatcacatagcacgcgtcggggccctcgcagccgccgaacaccgccaatttgtcggttgcgccactgctggagccactggtgctgctgttgtgggccaacaaatcgctgctgctcataattaattaattatcccttggatgggggataaagaatcaaaatttaatggaaacataaaggtaattaatctgcatagaaaaagcattaaaaaaacaaattatgggtgaaaaattgaaatttatacataatttaaaattacattttataattatatagcaattgggcaatttgagggtagaaattaaggcaaaaataaatggctttagatttagttagatgacgtggtggagagactttgccgatcaaagctttgcccgtcccttcaatcgcccggcccagtcgaccaagtcgcgcatgtccagcagggcacgttccaacgcattggcaaatctgatttcggaaaaataaaaaataatctttttattgcttatggggcattccacttcgatacacacaaatggaatgacattttggcttttcaatgccattttaaagtcattaataaatgtttctatccaaggcgccgctgtgaattttttttttgaaaaatttaatgaattttgagaaatttggaatgaaattagaaaatgccatttcaatgaaacatttaacggcgatggatggcgggtggtggcatttaaaatttttagaaatcttaaaactccgaacccctcccattgtatcatccactcc

SEQ ID NO: 7425 - DNA, 1848 bp, Heterodera glycines
ggtttatgttgtcggatcatcttcctcatccctagatcgatctgtcttatcgagagctatcattgtttccatattcgtggagattggtccgagagaataaaacatcgtattaagcaagatattccagacccataataaaaccctaaaagattggcagattaggcacttaaaactattaaaattatacaaaaaagactggtcttttccatttttggccaaatgggacttaccgccaaatgtttgcctcctatttaagcaagttcctttggcttggtgatgctaaaatcgtgggatccgttttgaagtttacacgacctttaagcttctttattgcatgtcattctatggctttaaggctttttattactttgtaaagtttaacaaatttaattaagttttaaaaagcgtctaaaactcgacaaatttattaatcagaaattttgcgatatgttaaaatatctgctatttttaaagcttcgtgtaaaccgtaatagtgagccctattttggtgatgcaagttgtgtgtgccctctttttgcaaaaaataaatcatttttcgagatgagattgcgggttttgagggtcgacgaatccaattttgacattcttcggcccgttccgaacccgaaccaaatgtcgaaaatttaatttggaactaactgatttactgactatgaaaccttctttttccactcaaaagaaaaatttttttttttaaaaaatcgtaatttaaaaacaaaaaatttatttaaaagaaaatttcaagtttttgaaaaaatttttggaaaaactaattgctagtatagcaattcatcataaaaatagctatagatttttatttttttttgaacatttgtgtttgaaaattaaaaaaaaattggagaggaaaacgagctcggggtggaaataaaggtacccgaggaattatccttgtcattatacttatgattttggaaaataacaattccccccccccaatttgcccaccgttcatcacttcgccagtgtagcgtttgtgcccgacaatggccgcctccatcagtccgtccacaatggtgccaatggacatggtcgtcttggccggcattttggccaccgcctccacaaagtgtttggacgccatggttggcagtcggacggtgtccgtccgtccgtcggcgaaccgtcgcagcgaacccgtctcataggcaggcgcatgggagccatggaggcggaagaaggccaattggagggccacctgaacagtgagtgaatggagtggggggaaatgcgtggcacaatcaaagggacagagagaattcggcatattttttaaccatggcaggtgtcatatttacaggaaacggattttctaggattttaccgaaattctcctgaaattccccttatctttgcttaaatttcaatttttgtaaagaatcaaaacaaaaataaaaaattcagaaaagagattttctctctcacaattagtaattttttttcgattttcttaaagctaaaaaattttgctatgtttatacatacaaatttaaatgtaagtacattcattaaaattcaaaaaaaaaaatttgtatttaaaaaacaaaaaatgctttaaaaatcagttcccacaaatccgaatcccaatgcctttgaatgagtatcaaaatgttaatgggttaaaatttcgcacataactgaatccacgagtcggggctgaacagcgcagttttcggcacatttttgccaaagtgattgaatttcagcgatcggacctccaaatttttgatggcactgaatcaaatttattttttggaaaattaatgcagaaaagacactcaatcaaaatcacctgtcaaatcgctcgga

SEQ ID NO: 7426 - DNA, 3461 bp, Heterodera glycines
tcgataaaaaacatataactgcatttaaattttttacagtgaaatggaatttttttcttttggcagcccccagcaccaggaagggactaaggaaatttcgggttccgttcaaaagttcaaaaacttctgtatgagtttagaatggttcggttagcttcgccgtcactggcaccgacagaaatggacccacacccattttgtgacaaacaaatgccaaatgactggccatataaattcgggaaaaatcccgaagcctcccccgcccttcctcacaactgctcgcagatgaagtccaacagcatggccagcggtgggccctccgccggcgtgtgctcatacgttatgccaccgtagccacactcgttcaaatggaactgcaacgtcttgtcaaaccagcggttgttggcattctgtcgcgtgccgccgccgtgcaacgcctgggccatgttccggtcgtcggggtcgaactgcaacgacgccgaggcagaaccaccgtcctcggcatgctcaaagtgacggtccaacgacatgacgaacagcgcgtcctccaccaggccaagttccgtcggatccctctctgaatggtgccgtgccggataattttgaaggattttcggaaaaatttatacaaatttttaggaaaattttagtgaggtagatcttggaggtggtaccaacaaagaaaatcgaaaattttcagcaaaaataaaaagccctcaatcccggggaccgtcccaataaacaaaaaactttccacgaattcgtgcataaaccgtggcccacatttcccggccatcgcttgacacaatgttgatggcccgtgccttcttcccctgctgttggtcagcgagtgccatcacatggcccaactgtgccaccaattggccaatggtcaacggattgccagccccgtcgtacaccggcacatggaaagtctatgagaaaaaaggaagcaaaattacaatggaaattataccatttgtgggatagtttaccgataggtccttttttggttggaaaacaaatttttttttaaatttttcattgttaatattgcttcaaggcaaaacaccttattatgtgtttattggatataattcaggcaatttgtgaccgtacgtcaggtcgattcaatggtatttatgaaagtaattttaacaataaaaatgtgaaaaaaagaaacattttggacctaaactatattactagtagtaccataacaccatcaccaaaaccaattagaaaggtcgactttttgttttattgtaatataaaacccataaaatttttgaaaaaaaccaagtataattctatgacttttaagttttcatttgataccatgaacatgaatgtagacattgctcaagaaaaaaactatggccaattaaattgaaaattagtcatttatcggacccataaagtgcccgtgagaccccgccaccccatggatttttcgtcctccgcccgcccactcacacgtccgtctcgggtgaccaaaatgtgccgtgcccaactcggccggtccttgccataccgaattgtgtccgtgccatggcccgggatccgagtggtgccgaacattagtctgtactgactcatgtcgaagggcacgccgcccgggcctttgtccaccggtaactgatcgctgaacgaatgaaaaaatttaaaagcaaaaaattaaaagttaaaatgccaccgaatattttgagaatttataaaatcgcagaaaaagcaagacatttgctccattttacataatctgtgagaaaagtataatcaaacttgatgattttgtggtggtatttgagcgccgcttggaccattttggccgcgcattgcaattgcgcctcagtgccgggcacggcgaagtcgaatttgggaaaagtgatgcccggactggtcacaattggcagcggagtccgtgccgccaaataagcaacgttcagccaccacggagtgagctaaacgaactgacaagtcacagaatatggacacatagactgtattaagatgtttgctggaaccccaggcggtactcatgcaatgaggatatcatccgtacaattttcgaatttatttttcctgtaccaataatatcctcatgggcaagatgccaatgaggatattatccatacaaattttttaattttatttttgttcgagttcggaacaggggttcgaaattggcaaaaatgggtgctgtattcgtgatcagcgacctcaaaaaccccttaaaacttattttcattaatctctaaaacacgtttattggcatctgaaaatgtatattaaaagtatccagtaaactgcatgagtaccccccaggcccgtaaccaaaaaaaatttcgggagggacaattttttttgctctttgagccaaaattttttctcccgtgtaattttaaaactgtcgacgccggagagcaaaaacaggaaatcgtaaccgcctttcaccaaaaaaggacaaatttttaccctaatttgaattaaaatgggactggaatcccatcgggaacaacgccgatagcgataattgcgactaataacctcgaatttgttaaaaatgttaaaacagaggtatttaatcaaattgtaaataaactcacccaattaaccaatttgcgccctctttgttcaagtaagcgttgcaattcattggcttctttgctctccagaaaacaattgacaagcttaaaagggaagggttttttacggattgtccggtctaattgtaagacaacttttctataattttttccaggattccggaaaatcaaatttcacagccctactttatgtacaatacgcaattattttcatttaattggttatttggctttggtcttgctcacattgacggttgtgctaaactccgcttcggataggaggggttcagcaaatttgagaaatttttctgttgtctgtgccaatggagggaccggcagagaagggagagtttgtggtggaggcggcgatgtattgaacagctctacaaacgaattaatcatcattttgttctcggcatacacacgacctctgctgcttcccccggcatgcgatgagcgcaacagaattttgtaccaagcggggcaaatttgtttactttttgagaacacattgcggtacatagcgatggtcatttgtagtgcggagaatgaatggacaaattaatttaaggattagctcactatgagtcaagtccagtgtcagacaaaattgttcataacgccaaatagcgtaattggcgtaatttttgcgcgctaattcaaaatttacactggtaaatgtttttttttttgcacaatttattttgatgatcagccataactcgcttcattcccaactaaaccgaacaaatttgatatctaaaataagtttttgaaaaggagaatttttttcaaagcgaatggctaagcaatttgacatctcagaaaaaagttgttggagtttcaaatttttat

SEQ ID NO: 7427 - DNA, 2169 bp, Heterodera glycines
tttcatcctcagaggatggtgaatggcatagttcaatctcaccagccaattcccaggctgaaaatcgagagctttttgcttttgtcgaggttaaagaggcgcttcattgttgtcgagggacggattcgaatatgcttttgaaaaagactcggcaatggtcgaaggtgtagaatattggagatgccctcatgtaagcgctaattttcgagctgtacacacctattatttaagcgccccccatattgtcccggtcgcatttatgtccactctcgttggcatgaaagaggcgaattacgattcaaattaggatggaccaaaaatgaaaaccattctcacaatgaaattttggacaaaaacaaagtaaacaaaaaaaagaattttttatttatatttatcccaaaaattaggtacgaaatgcggctgagcgtttgaggcaactagccagagaagctcatccgcttcaaactagggatgccatagatgaagcaagggccgcactgtctgctgaagctcgtgttactgccccttcttcttctgccatgggaaaagtttttcggcgtgccaagcgtaaagctgccgaactacagggtgaccagggattggactcagttaatcctttggaaatgattgtgcctaattatttggagccaataattttactgaatgagaacatcgaaattgccggtcaacaacgaaaacttattgcctttgccacacaagcctcactccgaatgcttggtacttaccgcagtgaaatttcaatcgacggcacttttaaagtaagtcggagttttttaattacctaattaatattataataacagacagctccgaagggatttggacaactatttaccgttcatactgtaattgactcctgtgccattccttgtgtgtttgcctgtttaccaacgaaacacatgcaaggataccttcgcgtttttgatgcattgcgaatccgaatcggaaactggtttcctcaaaaagtaatgacggactttgaagttgcaattacggcgatgggtgtgatgggtggctgagagctttggatcgaaaatgataatttggctcaaagacaggcattgttcacgattgaggcaattccgttttgtctttttcattaaataattttattaagttatggaaccaaactgctcgcatccaaaatggactatcgagaactaataattcattggaaggctggcatcaaatatgggggtctctcttagccaggaaacccccatttagcatttttgtgaggcgaatgagaaaagaatttgagcgttgggagaacatcgtcgaagatttcgaaaattcacctgccaacggcattcgtggaaaagggctcaaaagaaaagcaatttatgtccaacaggatcgtaatttgcaacgtgtttttgctgaatttctgcagcgtgctgacgacccactccgttatctccgtaccgtctcatatcatttagcagaaatttgaattttatttttaaaaatttaattttattgtcgaaacggtcattgtcgaaacgtcattgtcgaaacggtattgtcgaaagggtcattggcgaaacggtcattgtcgaaatgtccgggagccggattagaaatatgttttatgaaatacgaaataccctccacctctgccgaggccaaaatttttacggaaaaaatgcttataaaatttttcttaaacgatcattattgcttttcaccgtggtgcgacttttggggatttgcaacttggggacccgacatttggggacccgacatttggggatcccgacatttggggacccgacatttggggatcccgacatttggggacccgacatttggggatcccgattggggacccgacatttggggatcccgacatttggggacccgacatttggggatcccgacatttggggacccgacatttggggatcccgacatttggggacccgacatttggggacccgacttttggggacccgacatttggggatcccgacatttggggatcccgacatttggggacccgacttttggggacccgacatttggggatcccgacatttggggacccgacttttggggatccgacagttagggatcccgacatttggggacccgacttttggggatccgacatttggggatcccgacatttggggacccgacatttgg

SEQ ID NO: 7428 - DNA, 2918 bp, Heterodera glycines
aaattattatgaaatttaaagaaaaaatataattgactatttttttaaaatttacattatctatcgtctattgtgtataattttgaatagtaaagaaagaagacaaaatgagacgaatctattagaaatccaaaattcaattcagttaatgtagtgtccttttttcacccattaggcaaaattttttgattctcaaaggataagatatgaatggcatcatagctcaagaagttcagccaattcatggctaaaaatcgggagcttattggatttgcctaggttaggtaagtcaaaaagacttcattgttattgaggaacagataaattcgaacacgctcttgaaagactcggcgatggtcgaaaatgtcgaatatttttaatgcctcataaacgcaaaattcgaaaactaaaaaagcaattcccataatgttatcttgaaaaaaaaagaaaaaaaaactattttatattgatcccaaatcctcatccatctcatatcattcagcagaaatttgaattttatttgaaaaaatatatttatatggatcctaaaagttccgaaatgacataaaaaataatattacctaattgtccaaactgtgattttgagccaatttttaagaaaacaaatgatttttagggttcaccgcgggacccacgcgtttcggcgacagctcgtttttccacgatagcttttttctttggcatccatccaacaatcttggtatcattcgaaagcttttaacatgctctattagtcctgtcaaaagcgaaaatattttcaagcctggaaaaatttttattaagaaaaaacaaaaaaaatttcgacttttcgcaatttcatgtataccaataaatggaatttttaatttttcgaaaagttttttcaaaaaaacagtaaacaaatgctaacaaatgagcaattcatcctcatctcccactcatccagctctacatcatctattatgtacgtcattattaggggtcggaaaaatatgtttgggtttttcaatattttttaaatattataagtagagcctggatttttagacatatgcctttttttgttgctaacttgctatggcctaatactcacgaaaaacgagtttttaacttggtttgaagcttttagcttgattttttttgtgccttttttttgccttttttgcaattttggtgcctatttcatgcctttttttgttgaaaaaatggaaaaaaatttttcttgacaaaatttttgtttaaaaaattcaatatttgttaagaaaatattagaaaagaaatgcacctcatttgcaactgcattcagtgaaatttttttgctcattttttttgctgacaattatatcactaaaatgtcactatttcggactcttttcattattatgtcactattttggcactttttcgtcactattttagttaactattttgagatttttcgtcactaaaagtcggggccctagataaaacataggagaaaaaaaatttggtccgaagagtaaaaaaaaaagatcttttggaaaatgttttgctaatttgacaaataattattgacgcaaatgttgatttttgctgactttttccaatttttcgtgcattttttgacgttttagttcgttttttatgccttttttcacatttttcgtgcctatttggtgccaatttttagaaattttcgtgcctaaaagtccgggctctaattataaccatttttagaaatttcacgtaaaaccccctttctgaggaggttgaaaaataatccccccggggtgataaaagagcaaatacggtaacttttttgctaattgtctaatcccgaagcaatagcttagaaaaagcttctaaatagattaagctttcgaaggacaccaacaatgttggatttggtttacaaggtaaaaagttatagctaaaaacatgctggcgccgaaacggagtgacccttaaccgccgtggaaaattttgaaaatcattgatattacgccataaaattataaattttttgaagaatttaagaaatcagaacaaaattggggcactctctccaaatctgaacatttctggcaaatccgaacagatccacaccctggtttcgcggcgcctaaacgctcgtctctccccctaaaattattacccgcgggaacaaattttaaaaaatagcgttgatattaatgttatggatagggttcccaaaaatatggataacgaaatatggacataaaatggcaaaaatatggacataaattttccgaattgaagggtaattcttccaaattttattcaaattaattaaattttactaacaataagatatgtacatataaaaatggttaaatatggtataaaaaatcattttaaaagaaaaaaacacgctacagcttaaaatttactcattttgcgaaaattttcgcttttttgcttatttttaatataaattaaccaatttttaagaaaaattaaatttaaatgtcgttttctgaaattttttcagtctttagggtaaaaaatgtcaatttacctgttgggggtcgttctaatagaggttttttagggccaccaaactttggacataagaattgatgctaatggtaaaaattttcgactagacaatatgcaagccttcgtcgaagattttgaaaatcttgatcctttgatttaccttcgagagtgctcattcattttcattttagctccaattattaattgtttttaaaaaattatggtactgtcgaaatcaatcattgtcgaattcgcaatttttttgataatggtcgaaatcacctggcatggctgtgcctttttggtttggttgcagtatgggtctatgatattttaaaaataaagagaaatattttcatggtataaaatttctactatttaaattcattaaaaaaatcaaacaatataaaactctccta

SEQ ID NO: 7429 - DNA, 1976 bp, Heterodera glycines
accatggtattggcatccaagtacaattcagaataatttttctctgctaattattttttaaaaaaaacttcaaatattgtgtaaaaataagtgtcaaaattatttgatgggctaaaatttgaaaatagggatttttaggttcgagcacctaaaataggaattctagggtcgaatggggggcttgaaaaggaagaattttcgcgctacaaatatgtttttcgtgcttttctcattgatttaaggatgtagaaaaataagtaaaaatctaaaaatcaatccgctccctaacggtttagcattttgattaatattttttgttcccaaaattgaatttaaatttgattccatttttgtacagaatcatcatcgactgttgcgtcgacgatgacgaccagcgaagggaaagcgacggcgatcacttcgcccggccccccggggttggacgagggcgactcaccgccccaggcgccaacagaacaacagcagaagggcggaccacagcagaaggagaaggacgagaaagagttgcactctctgctgaacaaagaaaaggcacgcgcctgtgagtggtgagttcgtgaaattcgggtcaagaaaggtcggattgttcggttctcgagtttcgggcggcaaccctattttggaatacaacccacttccaaatttatttgcacaattcttttatgataaggtcgtcaatctccgctgtcccgatcattggcaccattctgctgatgttcttctttttccaatgcacatcagcaatgcaaacgaacacggcgggcacggagggcaaacagtgtgtgatgcgcgggatttgtggaaaggatggtgaactgcgtcagaattgccggtcagtaagtcagtcagtcggtggtgtatgtgtgtgcgcatgtgtcaaagtgcaaaaaattcagttaaaacacaattcaaaactaaaaattagaaaatttgttttcggctgggctcgaggtgattttttgtaaactttttgccaaaaataacaaaattttcagtgtttttaattaaaaataatgtgttttatttcaatttcttcaacgatttcattaaataaaatatttttaacggtctggaaatagcgaaaatgataataaaataataattaaaattcaaagtatctaaatatcggtcgaagcattgctttttcctcactacttaaatcgatttcttaattccatgatattctacgggtttccgggtggtggccgattcttggacatgggagcacagcaacaggatgtaaatttcatgaaaatgcttatttttttattcagttcggagttgaaagggcctcaaaaaccgaaaatttgcccattctcgacagaggcaactaagtgaaacaattgcacagttggttaaaaatgggctttttgtgccaagggttcagatccgcttgcctgtaaatctttttaaaattattttggattttttgagttcgggtcagggttctgaattagtcgaagtgaatgtcaaatgcttgatcattggtcccaaaacttcgtgaaacaatttttaaaaatatttgcagccaagtggaatcgaactcatggcccaaaaacccattttaaccaaccgtgcaactcagttttcttatttccctctgacgagagtcaaaaaacgaatggttattgagccttttactaatccttaactaaaaattgctgattttttatgtatatttcttttcatatactttttttttaaaacagtgatcttaattttcaaatttttccaaaatttatgtacctaataacttttctttttaagatagaaaattttttacgaacctcatgccgtaaaaaaactggaattattttcatttttggagggggctttaattcagggggctttattgtcaccccccccccttcaaaaggggggctttatttcagaggggggctctaattcagggggggggggctataatgcaataaatacggtataataatatcatt

SEQ ID NO: 7430 - DNA, 2407 bp, Heterodera glycines
  misc_feature (21)..(21): n is a, c, g, or t
tgcaggtctaaaaaattaacncgctaatgggagaaagtttatagctatagaagcgggtcaatttggcgcgccggtctaggcgctttaattttttttttttaaatggacgcgccaaacaatgagcggacatgcaaaaacccgcaccaaacttgccaattcccgaatatttagccgattcccgaatatttatgtatatgttttatttataaataaatgaggcaattcccttgggtttggaaataaataattaattaatttgttggcattacgcaaaacagttgttgctcatcagcacgatcgccacaatcatcatatccgtcacataaatcagcaggctgtaaatatatgtatattaaaaaaaagaaataagtaataatgtaaaaattgaatttgtatatacagtatgctcactattacagtaactatttcaaataatagtaatccttttaaatgatataggattcatatgttaaaatatgttttctctcaaaattacagttattaacctttttaataataaaggaaatacaggatttttttgttcaatatacaatatatttttctttcataccgtacctgtatgcaaatgtttgtgttcgggcacttcttgcgcaccccgcgacaatcaataggcagtccaggacacgttttggcattctcatccgacacttcctggtcatggcaatcattgtggccgtcacaaacgcgtgaactgttgatgcaatgcccattcatgcaggcaaatgaacctgatgaatttttgggagtggggtaattaattaattaattggttcgagagtattgaaacagtgaattcgactatagaatccggatgggacagggaccccgtcgggctttcctcgtcctgatgccgacttgaggatcctgacaacatatcgggattcaaatcccggggatttgaatcacggtatgcccaccgagtcgagattttaaattcgtttgaccctcctcaattaattatcatcccatcattaaacattgaatcacctggcgggcacaccgtgttgaccaccattgccgtgcccgtgccaatgccgccgcttccgctgccgccgccttcctggcccgttttttgagtgggcaagctgcaatcaatttcgtcggaccggtcgccacagtcgttgaccccgttgcagcgcaactgttcctgcacgcagcgcctgtttgcgcacagatagtacgtctcggggcagaagcgcacaaaacagtagctgggcgcttcgtccgacccgtccgcgcagtccgcccgcgcgtcacacgttttgtccagcgcaatgcagtggccgtccgacgcgcattggaaattgtacgggccttcgcagctgacgcgtgccgcttcgttcggcacacattgggtggcaatgtcttcgcccggctgcttcacctgacaataagtgatcagtgtaaaaattgccaagagataccattttgtgactcgatgccaagaccctcgagcatttttctaatttaaaatttaagaaactcactaaaaaaatttatcggacgggcgcttattgacccagcaagtaccagacaagtttattttttaaaattcagcctaaattcgttctcgattcccttcgttccctcaaaaaacaaaaacaaatagaaagataaaagtctaattttgagaaaattggagttaaaaaaaatttctgacttttttgaagtattggatgaggagaggactaaaatattgatactacctagttaacttaaaattttaagtaaggaaaacaaaaaattttaatgatatttggaaattctagaaaatgttaaaattttggaaattatggttttttttctgaaatacattctcccagctacagaaattacccacattggcatttatttgtgccattgaaaatgatgataagcacccaccaattgataggtgtcattacagctgcactgcactttatgtgccggagtgcccatatcatcggagatcacatgacaaatctgatcacatccaccgttgtttttggcacacaaatgactggtccgctcattgcaccttttaattaggctcagtaatgtcaataagttggtgattaaacaaaaatcggtcaattaatcgatcggtaattacccagtaaatgtcaattagtcggtaattaaaaataatccgttaattaatcgataaaattaaataaaatacgttgaatcaactcttttttaccattgattacgcgttttgatgtctgattcgctggcaaaaatgcgcacagttcccggcaagcgatgatcaggtgccacactttcgtagaaattgcccgtgaatttgttcatgcggaaaatgccattggacaacggatcactgaggtacagccaattctcccaaatgtccatggattttgctctcaatccaacgccttaatgggat

SEQ ID NO: 7431 - DNA, 4808 bp, Heterodera glycines
  misc_feature (68)..(68): n is a, c, g, or t
  misc_feature (4806)..(4806): n is a, c, g, or t
gcgccatctgtctcactctacccctctcccctttcttcttcctctctcgctctctctctttctctccnccgcctcccaacgtgccaattgtgcgccgatttgtgccatcataattggccgattcgatgctcaaccgattcacatccgaccagtatatgcgctgctcatggccgtccaccgtgagcgcggccgcaaggctcagctcctcgcggatgatcacgcgtcggttgccgcccgccatgttggcacgctcaatgcgcggctcgtaggcaccgcccgttaccttgaaaatttgagagcaaatttaaaagaaaataaaaaaaaaaaaatttatttagcaaaagtggaaggaagggttttgaaataatttttctaaaatgaataaataataatgaatactagggatgcgatttttagttaaatacctaaaatttttgcgcacttgtaacgttgagataagcataaaaaacgagtttttagcttggtttggagcttctacacccacttttataatacctatttttacctatttgggggtttttctacctattacctaggtacctatttttatacctatttcggcatttttgttacctattttaaggattttcaaaaaattcttaacaaaaatgcaataaaatcaaaaaatatacccataagaatcgaccaaaaaaattttcaaaaatgcaccctaagaattggaaaaatttctcaaaaatttctcccaaaatttatttatttttttcaattgacaaaatttttaatttaaaatgtcaatattatctaagaaaatattaatatatttaaattttcgtttacaaagagatatgtagaaccaaaattttccctctttgtttgcttttttccactaaaaaatcgttaataaaaattttatttacctattttggtacctattttggaatttttgtacctatttaatacctattttgagatttatttttacctatttaagtacctattctgggatttttcttacctaaaaatcgcatccctaatgaatacaattcaaaaaagaattgaaaaccaatttatttattattttacaattttcttataagatttctctaatgaaccacaaaacaaaatttttaatagcaacaattcttttttaataattatattaagatgtgtaccaaataaattgctgaatattaaatgcaattttgtagtcatgaaatcccaatgattaagaaaaacctaaaatatttttattttatggaattttttttagaataaaccaaattctctccaattaaaaattattaaaatatttgtaattaaagtatttaaatcgtgatttgatgtccgagatttagtctcagtcacacaagtctcggcaaattttcggtatatctcgtgcatcattactaaaatcaccaccttatagccgctgtccgaccagaacacatagccagcacacgggtccaatgccaacgcatatgtccaatcaccggtggcaattgtcacaacttaattaattaaggcgtcaaagtacaactatttttcctttggggataattgatagaaaataattaatttaattaaagtagccaacatccattaattaaaattaaatataattgtgattctattaaattaattgtactaacgataaaaaaaactcactatggtctcctcgcgtgtcgtaggcgtaaatttttcctaaaaatattttaatggaaattgcataggtaaattaaattgcgacaaaaaaattccattaattttttttatgttttgacaacgatgacttatttttagtaagcaatttaaaaaaaaattattcaaattattataaacaattgttgaaatgttcgacagttttaagtcgttcaaattatttcttctataaaaaaatagaaattctcaaacatatattttttgtttctgaataatttatttattttttaattttatgaatagtgaaatttataaatttaattttaataaaaaatttggcactatatggaaagtgacagtttttgaaacaaaaggggggacccttttgttttgcaaaatttttttaagataaaaaaccatgatcattttttatccggggttttaaaggtcgctaatcacgaatctgacatgtattttgactaatttctaatccctaacccgaactcgaataaaaatcgaaattttgaatttttaaaattatgattttttgttcaaatttagattaggaaatcggaattgatcaaaataattgaaggattcgtgatcggggaccccaaaaactccagagaataaatttttatgactatcacaaaaaaaattttgcaaaataaaagggtccccccttttgaaaaacttttcaaaactggtcactttccatatagtgccaaaacacccccccccccattggactttcgggctttatgtgtagggatttggctgattatgagcattgttttctgacccctgagatttgagaaaactatatatcatattaaaacgctgccccaatgagtgagtgaataaaacgctttttctctatatcaaacaaagagagaggcgtttgaaatattttgcttttttttttttatttaaatttttagcagaaaaattacttatttgttatttaaattaataattggattaataaatttagataattaaatacaaaatgactttaattataactcgttgtttaaccttcttttccattttattcagtgctctgcccttagctgctcaaaacggagcatgcaatgtaatggcccgatttttaaaacttaataacaatttaaataactaaaataaataaaaaagcaaagaaaaaagtgtaattggtgttattaatgagcattttatgtttaagcaaaaaaggcttaccaagtttcataaaaaacaaataagctccatgaaaattgttccgaatgattttgctatcttaaaatattatgaccataaattaagaatcattgaatttaaaatatccttgtttatttatgtgtaatctatttaaaaaaattgtcattttttgcggcatttcacctactaaatccaatcttttttataaactaataataaacaatattattataatattccctcatattttcaatcagtgctcttcttccgaacaaattggccaattgcgttgcgccgggtgcgagccgacctgcgacaacccaatgcccgaaatttgcacgcaaatgcactgcttttgctcgtgcgattgtgtgccgggaatgctgcgcaattcgcagacggaccaatgcgtttggcctgcccaatgccaatcagaaaagaattgagaacggcacaaaaacaattgttaaggtgacagaaatggcactttctttgattcgaattgattaatttttgcaaaaacaaattaaatgaaaaatgcctaatgacttttaattcgtcaactttttataattgaaaacatttaaaaattcatttccattgcgcttgcaattgtttgaagtgtatatttgcttcttcattcggttgactttttacaatgctcggctttcgaacgcggctgacatatttgataaatcgaatatacaccacaagggtgaccagagaatgcaggaaaagcaactgaaaaatgggaatttgttttataaacttaccgtatgctttattgtcagtttatttctgtctctaccataccgtattcgccatatggtaataggagacgtaattggcggttgaaagcatttgccggtaggcgcgaaggaccagcacaataacattgtatatgggataaatcaatgcgtaaagcaagtccatcgggaagatcagcatcatggagagggtgttttcgttgatttggtacttcagactgaggttgtactcagtcgatgggccattcccgacccggtttagccttttgttcagcaaataaatgcgccaatcgcacaatgccgtcgcaacgaccaaaagcatcgtgaaaagcatggcccaaaaaatcaggttggcattgtaatcggaggtcaagtaaacgacgccttgggggtggccagagatttgagggtcggcaagtgccaagccgacaatgcacgccaaatacagcaaagaagcaagccactgaattgggatatttcaaaatggttaattaataaccgaaacaattaacagcaattggtaaaacagacaatggcgcagatgattgcgatgatcagtttcgggcccatctgctcataattgtgcacctaattaattatccaagcaagtgtctccttttttgtatgtgaatatccttctcatttggtactcagagattgtgtccctaatctctcaaatgaatgctttttgccttttttatgaatgtttttttgggatggaaccaaacaaagaaagcctggggcattttgcgaagtttctcaccaaaaacaatgctcgaatgcgttcgaaagtaacagcgaaatggagagacggataagcgacggaatacacttggtaagggcccataaaaacggggaccatccaaacggggctcagcagatcacacgtactggtgtaaaagaagagaagcaactgaattttttaattttggaaaatgatgtcatcattttttattaattaataattcattaattaataattaattaactattacccgatatcgcaaaaagtagacgaaccaagtcagagaatggaagaagtaaaggacgaggatgttgatgaacaggatcttaaactcattaatgtgcgagcgcattttaatatttgtaattaaattgcattttttcaataaaatacccttaagtttccgtggatggaaattcaaagtttgaaatattgacgaaccaaaataacaatcanaa

SEQ ID NO: 7432 - DNA, 3273 bp, Heterodera glycines
ctgtgcccacaaatttcccttaagtggagaaaataggctttatttgcgatgttatgatgttttaaaattatgtaccgctttttggcatttttatttgtatgccatgaaagaactcatgaaattggtcgtggtgtgggctgaactctaccgtaccacaaaaatttttttttttaaatataccgtatgactggtgcattttcattaacacaatttaattttgaatagatatttttttttgttctttatttcactgttttgaacaatcgacacttcttttcttggttttgtgcatcgctatttcccatctttggcatttttaaattttgttttcacattttttacccacttttggcattttgtccatattatttgccttcacttcctttctatcaccaaaagccaaaaagttgttattttgagggcagcagaagatcctttttcaagctaagagatcccccgaggggggggggcacttttcctcctttcattcattattatgtgtgtgccggtactgttgtgccaatattcacaggactgtttgtccacaacggcacggctcggctcccgcagtgtgccaaaagtactgcccactctcgccgagccttgccattgttgtgggtgccaaaaaacattttggatgatgcgacaaaaagtggcaaaagccaattttccagaaatatgacacccatgaaggccatatttttacaaaaatgttttcttttacaataatttcatgtaaatgatagacaagccaaaattggaaataaaattaaaatccaaaactttttatttttcgaaaaaaaattcatcgtttttaggctaaagaattttgttccaagcatccagcaatttcttaaatttaaatcaattctaagtaaaaattttaaattttgtccccatatatttttcgtgaatttccccgatgagctttttcagaatttttggcacgcaaaattttgaggtttttaaaaataaacttttatgctaaaacatatgacccacctaaaaattggtgtgaatttttcgtaaattccggcattaatcaccttattatctaaattctctgaattttttccaccataaataggctaatttcagacaaatgaatacaattcgtaaaatttttgttaattcattttagatccctaatgttctctattagccctcaaaatttcaaaaatttcgcttgactttcaaaaagttatggccagaggaggtttttcaaattttatttagggttcctccccgaccccgagctccccggtccccgaccccgatccctgacatttttgggcctattccccgtcccgacccccgacatgtcgctccccgaggtccccggcccccgactttttgccccccgactccccgacactaattcagggaatcggggaccccgagcattgttaaaatttaaaaagttaattcaacaacgaagaggggaaaggttgaaaatttatgaaattttgaacaattttcttaataaaattagttaaaaattccaaaaaactttttggcggcgcctatcagcgacgccgcccccccccccccaaaactccaattttttttttgcaaaaaattgtcccaaaattgctaaaataggtatttttaggaaaaatctgttaataaattaaaaattttcaaaaaaattttcctcgcggctcccaacagcatcgcccccatcccccttctgctgtagcccatagtttttttgaaaaagagcgccgcaaaaaaatggtggtcaaattcgatgttcagacggattcgcaaaaatttcggttaaacccagggtttctatcgaaaatttttcaaaatcaggacatcgggcccaaaaaatcagattttggagtcgaaaatcaggactttttgcaaaattgcttcaatggaggtagtccggcggtgccgacaggcgccgccggaaattttttttgatttgttaacagattttcaccaaaaaggccattttttaaattaaatccaatgccataaaatttcaaaattattgagtttttttttaagaaatcggaataatttcgtcgctaccccaaaatcagaacattcttataaataagaacaaatggaagccctggtttaaaggcgccagcttggactcactcatactggcgctaacgaaatcagatgattaaagtgaaaaaagggaagatttacgagtagtgaaaaagaaaaaaatttattttttgtgttaaaataaaatccccggcccccgactttttgcccccgagggctcggggcttaaccctagttgatatgatttgaaaatttcgattacgcaaatttacgccaattttttttcttaaatagtccctgactatttaaaccggttttaatgtgatttgttaacagaatttgcccacaaaaatggccaaattttgcaattttaagcaaaaattttaagaaaataaaggatttttagggtacagcggtgccgataggcgccgccgggggaaaaattgagaattttgaccatattattagcagattttcattaaaaaattctttattttgtggttttttggaaaatttaacaaaaaaccacaaaagcctcaaaatttctgaaaaaaccacaaaaagcctcattttgaaaatttagcctcattgacctatctaaaaaccacaaaatgaggctaaagcctcatatctacgaaccctggataaaaatcaatgattttcggcaaaggcgcagaattatggtcccgatgggaaaaaatagtaaaagtataaaaagcattttttctggggtagaaaaatacgctgatcacgaatctgagctcagcttttgaaaaatcattgattttgtctacatatgactttttatcaagtacttgattttttcaaagttttaatcttctgtaaaaattttctttccattgaatttgaggtattcttgtttattgtcaataaagaaaaagtccacaaaagggaaaaatccgcttacattgaggacaaaacattaattaaaaaatgtcctcaagaaagcgcaaaacaattaaaacgagatcaccgccaaaaaatatatatataatgtgaatcaaataaataaataaaaagtcaaatattgaccaaatcacttttaattttaatgaactaaaaattcgactttaatttttttccggtctattttacaggaatagagatagttttaattttatttttaaattgatttaatgagtttatttcaatgagccttttatcgagttggttccaaattttagttacccgccccgcaaaaggtataaattttttgcctaattt

SEQ ID NO: 7433 - DNA, 2811 bp, Heterodera glycines
taaataaaaaatcacgaatttgacgcaaaaattctcatctaatttgccgttttcgttgacacaaattgaccgaaccctgtgttaattgtacaatagtaataatattatataaattttatttgtttaaaaattttattatatgcacacataaaataatataatataattgattaccattaatgaagaaatgaatcattgcagcatcatatgatatgtatatgaattggcataatccaaaaaattatgggctttttttcggcaaatattactccaattttattcgcattagcatttattccaattcttctttccacactaataatgagactctccaaatctaaatcattttttattcaaagttataactttagttatgaaaaatttaaaaaatttttcgaaaattgttgaaaggggggagaaggagtgagtgaagcggcggctaaattttatttttttttattgaaatttttcaattttttgagcactgaaaaaattatttaaaaaattcctctcataaatatttgcttgaattttttcaacccattttgaaatttttaaggcaaaaaaagaagctttgaaggatgtcaattaccgaaaaaattgacgaagagatagtaaaactgaagcaaacaaaaaaaaaacaatttttaaaattcgagcttttggaaaaatcggcgaaataaaattttaaattattaattattcctattaaaattagtttttgattaatttcaactaattttgaacatttaagcatcattcataactttttgtataatcatttttatagcattttgaaaaaatgtttccgtattttgttacgcctctcctactaattaccctaattattccaacatttgtcgtcgtaaattcaaagtcgtttggtaacatcagcgacaaatacaccattcatcctccaggcccctaccatattgttgttgttttctatgttgccggtaattttgagtattgtactgtagattgtttcatttcaatcatttaaaaataaaaaactacggtaattttaattcgtaaacattttattttaaattttttgttctgttccatttgcgcgaatttgtggatgttcccaaaaaaaaaaaaattttttttccacgtaattaagaaatccatccggctctaaacacataatccgagttggaatccgtaatttttaaataaaagtgtcatacttttgaactgacagtgaactgtaatgcagtagggacgtgtcaaaatgccaatttccgacatttttgggcacggaattccgatttttaatatttttttgaggttgtcggcacataccccagaattccgacttccgagttctgaatttttttttttttggcacggatttctgacttatcaaagcgagtttttagcacataaataatgttttggacttttagctgacaaaaaatgttttctgctttttagcaaatattttggcgatttttggcaaatataaatccgggctctggtggattaaacaaatttaattttttagatggccatcagaaagaatttccatttgcaactgatgagaacggcagaatcaaattgtcatttaatgagaaagtgttgaaaaaacgtgccaacattgacaaagaggacaaaaatcttcactcatacatagcatttttcgaacggtaggaccctagcaaaattagtacataccattcgaaagcctctgatgggataagcccaaaaaagggaactttttgagccggtttataactcgaaaaacagtgaaaaacatgggacaaatgagtcccagtgaaaatggaacccacttcagtaccaatgaaataattaatggaagcacaaaaaagggtgctgctgggtcgtttcgttaaaaatgccactatgcgcatttcatgcaagtgccaaacaaagaaatttttcgagaaaaaatcgacatacaaaaatttccacgtacatactatgtgtatgaaaagtctataaaataatatagaaatttaatcgttttaaaaatcccccccccccccccggtttaagtaaggagatccgagatgacggctccaccgtcaaaatagcggttcatttgcgcaacagtgcaaatgaggagcgacttttgcatcccttcgaaatgtttaagtataatgaagcacatgagactgaattggttcgaacatttggcaattatgcccttttcatgaaggaccgaaagtataatgagtgtcgattgcacgaagtgtttcaaatcatgtttgatcgtcttccattgctgacggtaatcatcattagggatgcaatttttagtttttttcactatttttttgctgttaactcccagtgacctgaaaagcacgaaaaacatggcttttttggtggttgttaagctagttttcgagttattagagcctattttctagttttttatttttagcacttcaaaaatttttgaaaaaaaaattcttttttttaacaattttggcgttttgccaaaaatttataacaaaaatgcaataaaaacgaaaaataaaacacccctaagaatcgacccaaaaactttcaaaaatatattccaaagaaatgaaaaattttctcaaaaatttatttatttattttcttgatagattttaaaaaattttcgtttgtgattcgggaccaagagccaaaaagccgagattttgttataaatttttctggccagcggtgtcgattagtcggcctgaaagaattagaagtttttgccaactcttttttgtccaagaacaattccgtaattacggaattatttttccaattacggaataatccgtaaatactttattgcctcacagc

SEQ ID NO: 7434 - DNA, 4627 bp, Heterodera glycines
  misc_feature (13)..(13): n is a, c, g, or t
  misc_feature (29)..(30): n is a, c, g, or t
  misc_feature (87)..(87): n is a, c, g, or t
agtcttgacgacngctgccagtcgacgcnntaaaacgagccccatcagctccattcttgggattgtgaacgttcccgaagccttctntggcttaagtcgggatttggccatgatgagacgggagagaatgctcccgtccactccttctgatcggagatatgctgcagcggcatataacgaagtgcgcgcacaatacacgcagcctcggagtactgaaaacattaggcctatttttgtgcgccaaacagctattcattcgcatctaagtgctatgcgtttaccacccatccaacagccggttgtggcaatagatttccctgagcagtttgtccagagaaatacccaaactaacatgccgcaaccacctttctatggcaatcaacgccaaaatgaaaatttgcaccaaaatttacaacgagttgctggcaacgaagtacaataaagaggagtgcatataaacccaggaaattttccggaaagggttaatgctccaaatgccgatgcttttcatatgcgacgggaaatgcatgatttagttctgacacaagcaattaaaagcttggataatttctcttattcaatgacgttgaattcactcccagagctgaaagggaatacaggctcagatgcggttcgagcatttttccgtcattttgatgttgcaactgaagaatggccagaggctaagcgccttagcgcacttaggtcaaagtgttcaggccgtgctgaacgcgctttttctcgccgaaataatgaaaggattgacgatttggcagatcgggtctcttccctagtcagaaaggcttaccctggcttgttggagcatctttatgatgattactcaatccgtcattttatcagagcacttcagaaccccgaacttgcactcactcttgaattagcccgtagaccatcaatgatttttgatgagtttgtagcattagctgctcgggccgaagcaactcaaaaggcgtcaaagatttcattgcaaaaacaacgaaatataccaaatttccaagaccataatcagtctgttcactaaaatccccggccaatgcaacagactttccgcaatgaaaattttccgcggatcagtcagagtcaaaaccgacaaaattgttacaattgtggtcgtttcgggcattttgcccgacaatgcaattaccctcggcaagttagaactgaaaatgctaacattggtactccagcgactggtgccaacaaaacatcagtcgaagtgcctaaagacacgtcacagccacaatacaacaaaccgctaccgttttcaagaaattatctccgtcaaaattttcttgttgaacaacaagaaaatcctccaccgacgtcacaaaattttttgattggaggaatttcaatgagtaatgatgaattggagaaactttttgaaagagacaaaagcgttgaagctgaaaatagtcgagcaaagttgttgaatgtctctgttggtaaaatcgtggtcattaaagtttctgtttgtgatttatcagccacggccatgttggacggaggagcacaagtttcacttgtgtcctttgcttttttctcgaaaattatgactgagaaaaacctcgataaaattcaactttgtccgacccggaaaagcactcaagttgttgacataaacgggaaaacagtagagtatgttggagtcgtgtcattgccaattgtcagaaaaaatactgaagtttggatcagatttcatgtgacaaaagcgtcatttggttatgaatttctttttggcaccaacgcattggctcgtttgaatttcaagctctatgatgggcaaaaccaagaaatgataagtttcacagaggttgacagtgaagaaaaaaactcggtacatgttatctatagaacaactttattaccgcaagccacgactttggttgaattggctagtccaatgaattttaaaggggaaaacgtggctgttttcccaaattcagaaaaagaaataaagattgagccaacactcacggtttccgaaaaaggaaaactgattgtaccaatcaccaatttttcctctcttccgataacattggaaaaggatacacatgtcggaaatatcgaattggttgaaaattttggcgaaacggaggacttttttctgtctccgttaattgcgtattgtcgtcaacaaaacgagccgagccttgctcaaatgagtgagcaaaatgcgaacaagttggacactatgagagaaatttgggtgccaaaaataaaaaatctgaaagagggccaaatccgaaatttggatgaattagtccgccaattcgaaaatatttttgccttatatatgaccatgagttaacgcaaacaagtttggtggagcataacatcgatacaggaagcgcagcgccagttaaaaatcgaatgagacccgtcccatatgcttatcgggaaaaagttgcggaaatgttgcgagattatttgggccgtggaatcattaaatcatccatttcgccatgggcgagtccaattgttttggtgccaaaacgcgacggaagtttgcgattttgcgttgattacaggggaattaatgcagtaacgaaaaaagatgcatttcctctgcccaatattgactatatcctaatggcgataggtggaaaaaagttcttttcaacactcgattttatgtctggatactggcaaattcgcatgagtgaagactcggttcaaaaaactgccttcacaactgaatttgggcttcacgaattcaccgttctaccatttggtttgtgtaatgctgtcgcaacatatcaacgattcatgacaagacttttcaacgaaatggttaatgatttcgttttcatttatgttgacgatattttggtggcgtctgagacttgggatgcacatctgaaacacttggagcaagtttttgagcgagtcgagcaggctgagttgaaattgaaaattgacaaatgtcgttttgctgccgaagaattaccctttttgggtcatatcctaacaacaaatgggataaaaatggacgcggataaaattcgtccaattcttgaacttccacttccttcctcaaaaaaacaattgcagtcatttcttggattcatgacatactaccgtaaattcatttacggatttggatctttggctgcgccactcttccatctcattaaagaaaatacaccttttgtaatgggcaaaaaagaacagaaaattgttaattttttgaaaagaaaagtgttagaagatgttgtgttgtattttccggactttaaagtagctgcggaaaatgcgttgaggcgatttatcattttgacggatgccagtaaatttggaatctcagcagttctctgccagcaggacgaacttaaaaatgttcgcccgatatactttgcttctcgccaatgcaataaatataagagtaaatactgtcctactgaactcgaagcactggcaatccgttttggaactcgaaaattttcacaattcattacgggtattccatgccgtgtgatcaccgatcataaagcattaattcccatgtttcgaagtaaaaaggaaacgggaaatgcaagagtcgatcgatggctgatggaagtgaacgctcgttaccaattatctgttgaatatcagccagggaagcagaacgtggttgctgaccttctatctcgagttggaaaacagtcagacacagaaaaaatggaaaatttgttagatgattgtccgtctgaggtagttgttatcaaaaaattgtctatcaaagaaattaagacaaatgctgacattgagaaactggaccgaaaagagtgggttgaacagaccaaaagcagtgagttaaaaggcatttatgagtttttcgagaaaagagaaactccacaaagcattaacgaggcacaaagtttaatggacaaaatcaataattttgctctgattgaacaacttttgtatttcgttgatcaaaagacagggagggtcctttcgtttgttcgtgcctgaaaaatacagaaaagaactgatcaaaagaaggcacgaaggaaaatgcgcagggcatttaagcggaaaaaagttgtggagacaactttgtgaattatatttctggccaaacatgatgaatgactgcttaaaattcgcattgagctgtcggatttgtgcccattccagtaagcctcggaaaaatgagccaccgatgcaaatagtgaagtctttagagccactagaattagtgtgtcttgtatactttccattggaccatcagagtcagaaaaccgttatgtgcttgtggccattgatcacttcactaaatatctcattgctgttcccctaaccaacaaaaacagtgaaactgtcgcgcgcgcatttgtaaacgaatttattctcgtatttggcactccgaaacgtctccatagcgatagagggggtgaatttgtgaatgaaactttggcggaaatctcaaaattgcttggtgttaaaaaaactgtaacgtccggttacgatccacaggctaacggagtaacggaacgcgcaaatcagaccatattaaatatgctgagaaaatcaaccgggtcaaattggagttgggacgaaagacttccgtttattgtgttttgtattaatacacgccatcggaggtgacaggtttttc

SEQ ID NO: 7435 - DNA, 740 bp, Heterodera glycines
  misc_feature (716)..(716): n is a, c, g, or t
ctccacccgtacccccctcccccgccgctgtccaaccacacaatgccttccacccaactaatcccattttgggaggaagtgattggaatgaagcgacgacgaccttgtggaggaaggaaaaaggtggcaggggaggagggaatgtgcgcgcggcatcggccaccatcagatttattgttggaatataaaggcaggagggggatatatggcgttgggaaaacattcgtaattcaaaggaacaattgaatttacaaactatgacaatgcaattggaaatattgtgcgaaatcatgggtatcacaaatatcacattaatttggggagccattagctcgtggaatcaaaaaatctttcatctccttcttttatcccttttcaagtgctcagttttattgtgccaacagaggaagcaatttcatgttttttcgccagtgcgtttagcctttcctgcaattggccgtgcaattcggccaaattgtcgcgaaaaacgccaaagttttcacagacgagaacacctgttaaacttgtcattagactctgtcagaaaggggaagaggaagggtatacaattttttagtgattcttggatgacttccgccaaaaggtcgctacacgaacttccctccagaaattggtccatcagctcaaaaagatgtgaaagcaaatcggcaaaagagtccaatctgaaaaacggacaataattaacattcgcatanatattcttttttttttgcctgcta

SEQ ID NO: 7436 - DNA, 3239 bp, Heterodera glycines
  misc_feature (29)..(29): n is a, c, g, or t
  misc_feature (44)..(44): n is a, c, g, or t
  misc_feature (67)..(67): n is a, c, g, or t
  misc_feature (3202)..(3202): n is a, c, g, or t
tcgttgctttgaaatcgtaattcccttcncattcgatcctttcncattccctcctaccacaccatcncagtcaaaatcccctaaattgacaccaaattcgacagctgattggtttacaatgtgtgaagatggtacaaacaagtttttttaatttgtcgcggtgggaaagaccacgctttcacctgtaaagatgcgtccatgtaacagttggacagtctttcgtgctcccccaccgcccgctctccttcccctatgtgttgctgttctgtgacattattcgttccattttgatcattatttggcactgaaaattgcttcgagtgattgtcgttggttagtatttgagcagacggaggagtcgccggaagtttcattggggcacatcttacaatgagcagatttttgatttacgaatttaactgccaactcactttcctccatccagactggcttcaaccattgttcgaagacacctcgtgaattgggcaaaattcgatggcgttatatgcgccgcatcacgggccaaaaacgtcaaaatttcacagacttttagaaaagcggctggatcgtgtcgggataaattgaatgccagtacgatagtgccacgtttgaaaaccgaagaacagtttttgggaaggggcggtgggggcaactgaaagggatagccaacatatgtaagcatcaaccagccgaacagttgtttttcaactaataatagcgcctgaaacacacctcgaccatttctgccccgtcgatttcgtcgcggtaagcggccgcgccgacagattccaaaagtatgaaaaacatttcccaatgttcgctcgcgtgtaaattggcagcatttgcgcggaggagctgatggagaccgaaagcaatttgacgggagaacagaaacaattcgggtggtcgaagtgccaacagttcacagcccatgaaatggagcacttcgtcggcacaattgctggcgcggtcctggacagtctgctgattggaaaccagtgaatctgaaataaaaatccaatttataaacaaaaattaacgtttcaatttgtttattatcgatgccctgcctttgttcgtcacgtcgccccgttgttgcttgtgctgtttgtcgtcgtccattgggtccaccacaatcaccacgcatttgttttgtccggcaatgatttgctgcgattgcttttgtcttgccaaattcggtgctatcaccgcttccgaagtttgtttccccttttcaattggagttggtgtgaaatgttgtcctaaacggaagagattccgattggcaattcggacaatggacacgacggcacgctccatcagttgttggttgtgtgggaagtgggaaagcaaagtgcgcaggtggtcgcgcaccggagaccacacttgggccagcctgtctcgattctccagcacaatgttcgtctggaattattaccttttcagtaaaaaattaagtgttgaaacccaccatcaattcaagcaaaaagaccatcgcctcttcctcttccggtgacagtttcaccaccgatggcccattttgctgaaggccgttgttcgagtggtggggcgaagtgcggtcgtcagaagtcgactcaatggaaagtgtggaacccgccgcctgacgaagcagcggttgttgctcagtgccgtctgtcggtgcgcggcgaagcatttcggcagggggcacagcgacattggacaagtcgacgaaggagtcctcgtcttaatggctaacactttccacataattccaaagggtacgctacattatgttaccccaccgcacaataagataatcaaaattgtcatatatttttcggcagtgcctgtcggtattgtgccggacccctttgtgtcttcccttattcgttcgcaccagcgcttttcatacgtttattttcgacctgtcaaccaaccttggctttcgtgttgtgagtgttgctgttggttatcttgttgatgatgtgtcggtccgtgcaaagtgcagagaatgggtgccacggtgaaagaacaatggatgatggaattgactaactcagtgagcgaagaactggccaaatagcgactgtccagcacaatttgctcagggtgacactcggcaactgtattagcagccaactgaaattggaatttggaagactcgatatgaaataaaggtgcaacaaatattgggttgttccataaatattgttatatctaaacttcattgttaagcttgagaatatgagatgtttgttgcgcgtgtttttgttattttttgtactttttaggctttagaaagctgtaacaattcgaaagtttgtcaactaaccgaataggacaatgattatgaaacgacctaatctaagtgattgtttctagccttgctcaactccttctcttgctcgttttgtggtcggctttgccccgattctccgccgccggtggctgaactgcccgtaagtccgagccaactgaggagtccgctctcttcctttttcggtgcagtcggacggcgtttgaagcaatgtttaagcgaaacgaagccggacagctccacaaaatcttccaattggacaagaggagacggcagaagattagctttgagcatgtaaagaagacaatccaacacattcatccatccctaaatggaaaaggacggactaaacactgtaaaatgtgcgcctgttcgaagcggtctactgaaaaggaacagaacttctcgaaggttgtccccgtattgatgcaccaggtcgaacatcgcccgtgccgccatttgtgcctttttattctcgccaaatgcaagtgccatttcctctgatgaattccactgcttccaatgtcgtgctgtgtcattgattttggccgaagttgtgccattaaacgctagtcgggagtgaagcggttgtgaggacggtggcgaattgagcggcggattcgcagtgtccacggggggagacgcagcgcgactctttggcttttgctgttgaagccccggcggagaggcagaagagcgactgttgtcgctgccagcggcttcggaggggcagacatggcattcctcagaagttggagtcatttccgaattagcagactcacaacaaaaagcaaaattgactaacacttcagaagagtacaacccaaaagtaaatgatattggcaatgtacgaatacccaaattaaggacacgaatataacaaataaggcaataattccatcnaatccgagcaaacatttaatgacaatgagcatctaat

SEQ ID NO: 7437 - DNA, 1159 bp, Heterodera glycines
tttattgaagaatgatgagtgggagcaaattgaagaactagttggggttttgaaatgtgctgaagaggcaacaaaaaggttcacggaggagccaatttcgtttgtccttcctcaagcaagatcactacacgatgagttgtacgaaatgaaaattgtcaacaggactgtggagacaatcagaacgacactttactatgcgtttgaacggcgcttttttgagctagcgaacaagaagtaaaaaaattatacttggttttcattaatgtttggtcttagggaatatgctctggctacttttttggatgtgcggttcaaagacaaagtgctgactgaaaattccgcaacttttcgcgccagagtcactgtctggatcaaaaatgaattgaaagaattggacattgataatgacttcgaggaactacaacaaaatgaatttgtccgtcctgtaatttcaccccagcccgaaaatctgccagccaaacgacgaatgtcattttttgaacgtcttaaagaatattacaggcgcgaacacaagtgaacagggtgatttttcgtctcttaaaattaattttataatgaatttaaggtctccaaacatcgcaagacgatgacattgaaaaagaaattaaagaatttctctcagtggaaattgcgaacccagaagcaaacccgcttgatgaatggaagaaaatagctccccgattttcaatccttgccaaatttgcagaaaaatatctttcagcacccgccaccagtgtcccaagtgaacaaacattcaaagtcgcccgtgatgtttttgattatcgccgttccaaattatcacccgaaacggcagaacaacttatttttttgaacaagtctcttccccagatgaattacaattattgaaactatttttttgtgtatttttattaaacttgttatataatttctatatagttgatgaaatttgtgggtttttttcccaaattaacatgtaaaaattaaaatttataccaacccggaacccggtcccgggcccggcaatttgaaaacccgggttgaccgggctaaccgggttgaccgggttttgagaggccgggcccggaacccggttgattctggaaaaatcagcccggcccggcccggcatttttggaaattccggtctctagtaaaaa

SEQ ID NO: 7438 - DNA, 3280 bp, Heterodera glycines
tcccccattttccatttgcccatggtggcatttctgttggcccaacctcagcccttcgccccttttggtcgtctccgtctgctttttgtgccctttcggcgtaggtgcgttctcaaactgttgctgttcgtcctcctcctccttttgcttctccgtctgctcatttcccccaattccgactctcttccgatcacaagggatgtgttcatcttcgccagcttcctctacaaaaacaccaccaccaggtgactgtgactcgtgcctcgagggttcttcctttctcttcggctaattggcttttcgtcccttacgaagtctgtccgcctctgtccacgactccgtggccgtccttttcctggccaaccgtaacgacaacttcccttatttacgctgcgctctctccaatggctcctccacgcgtccgatgcctcctgcccaactgttccatcttgactatgtcgccgtctgcaaactgatcattttcgtcgcctggtgcaacttcccgcccaattcctttcccgcaaatgctcaaaaagtgttcgtcgacttgggcacgcaagtgctggctgatcagtcattgagagagcgatacacacggccaatccttcacaaagtgagacggtcaaagacttgcaaagcaaccaaaacgccaaatttggtcagattcacgttcaaaaagcgaatgaaacaccgcgaaagttggtgatgtgcatcagcaggtaaacgaacgaactgcttggaattgttggacaaaagaaagccccgatttgcagaatattcgccttcgaaaagtgggaactgctcattgtggcaatggaagtgtacaagcgattaggtgtcgatttggtgagtatcgattggaaatgcgaaagggcaggcgggtactgtaggcttacaaccgagagtacggtactcacacgcattactcccgtccgaaggtggtaacccacgtgtattccgcactgacgcctgtctttgaactgatcagagcctacgaaacggagggtcggctggcaatacgaaaggtagggaaaggcacaacaaaaaatgaacaaattaccctaatcggccaataaaaaaaagaagggaaaagcgttcattccaaatgcaatgattatttttaccaatgtttgtttgtgcttttcccaaagggggttaagcttcccttcctgcgccatctgatgaacttcgaccccgatcgtcagctcgaatactccggccaattggccatggcccacgaatgtttctacgaatttcgtcagagtgccagcttcatctcgctggtcgactgggacgaccttctgatcaccaccaatttcccttctctgcccgacgcgtttttcgccgctgcgcaaaaatacccaaattcggcctatttcttagtcaacaaattggaaagcggcattcacaaaagcgcagtccaaagtcggcacattccaatcgcttctcttccctcaaaatccctcctttgctcagatcgatcgcccgccaattttcggctcgaaaatctcctccaaaattcagtgttcactaaaagagcgtataacagcgagaaaatggtaagggtttgagtcgaatggaacttaattaacatttgtttgttttgggtaattcgtccgtcgcgagtcgacggcttttggattcatttcacgcgacattatgcgaataaatacgaagcaccggtccaattgcccattggaaatgcgaccattttgcacctttcgaaagaggtgacacccgaaaaattgaagagcctttcgaaatcctttctatttcctgacagatcagtggaacggaaatggcatacaaagagaatgttttgtccgccctttggcactcgccaaatgcctccgaaaaagcgaacgcattttttgccaacaaaaccgtgggaagggtaagcgaataaaacggaacgaaaacgggggaagggatttcctccccaattcgtcatcttttcatgtcttggctcatcagattatgcgctcgctgccctctcgcctgtactatttcgcctccatccgtcactgctccctcttcctcaacgcttaccccgaccttttccctcctccgccctgtctctcctattccctgtgctcattcccacaaatttctgtcccatgcactgtcgccaaaacgcattttcacacgacaagcattgaacccacaagagtttatcgggttcacgttcgacaatggtcccgtttcgagaaaagatcacagggatgtttcgacagaaaataatttcgcaaggatatcatatattgtgttttgtgcattttctcgctgaattcgttccattcggaaatcaaaaatttcgttaattcgatagctttccacgttctttctgattacaattcatcattccttcccggctgttctccattcgcaacttggctcttttgttgttgctgatttacaatcgattccattggtgtcactgattttttgactgtcgaattgcccacaatggcggaagtgttttcacgataaaagttgaccaattgtgtgccgattaaatactgaaatgtttgatggaaaataatttagaaccaacaaatgctgtccaaattgacgaaagaatgaaagttcggcacaatccttacagaaatgcccaaggggaagagaggaagagacaacaaatatcaaaatacaaacagcaaaacaaacaaacaaaaaccctacccaatattcattattagagtagcaaaacaaagcaccttgtcgttacgaattttctgggccaaaagtttgagcttttgccattgccatgtgattaaagcacagaaacaaatggagccgagcagaaacggataagcaaatcgtatcacaatgatttgttcctcgcgtgaagcatctgaaaacacagaataaaatagtgataaaatattttgatattaaaatttgggaaaagaaaaaaatttaaatcgcttaccgacaaaaaagaggagaaaattgctgagaacgtaaggaaacgcgatcagaaaagtgagtgtattcacaattgggaacaccaggttcgtgtaaaggtctcgcaaacggatgttccaaatgccatcggcgtaaatcttaaaaacaaacagtgacaacccagcacatgtgcgttgttggacctgttcaaaagccgtcttcagccaccagtcggggcccatcaaaacggaagcacaaacaattttgaagtggacaacacccatggcccattctttccaggggaagaaaagcggcgattggaaaatggccacgcgaagaggagaaatgacgagcattggaagtaaaggccgag

SEQ ID NO: 7439 - DNA, 3006 bp, Heterodera glycines
tagagattcgatggatgacgaggccatgaataaaaatggcgaccaaaccagtcaaaatcgaaataggaagttcgaaaaatgcaatctttccagacccaaagccgatggtagacagaattccagaaccaatttgagcagggaagtacactaaactgagggtcatcgacaaattggcaattaattggaccaacggaaaacgatgttgaacacaatgttgagtgaaattgtccaaaacacgtgctcaataaaagcaaaagagccgtccaaacccaaaagtttttgccatgtgagctcatccacaaaacgttgctgctgcgggtcaatttcggctgccgccgcgtctccgccattgtgcgcttgttggccttggtcggccggttgattttggttggccacaagcgcagcttgaacaggttggtagaattggagagggcggagttggcgattttggggaagttggtcaagctggttttcagcttctgtttgatcattagcatcagtcgaatcggaagttgccgccgaagtggacggaccaaaagaactcatttgttcagtgggagttagcccattgtaagcattttcgttctttccatccccatgttcttctgcatccgcttctgcactttgcccggcattgtcaggcggttggtctaagattcggttgatattaaattatgtgaatgggtatttttctcactttggtgttgttgatgctcaacaattggttggtcctcgttcaaatgtaaaagatgggcaggtcctccaatctgttaaaaactcattaagaattgaaatccacaaaattgtaccattatttgttcacgaagccaaacgagggaaataaaagtgcatagaaaaatagtgacgactaaagaaccccgggcgatgtcaattgcgacattttcagttgagaatagttggaaaatgcgggaggagaaaaaagcggtcataaggccagagaagacgagccgatggatgcgagccgccattaacggcacaatgcctaaaatgggacgaaaattgccataataacaaaatgcacttggagtggagaccgagccaacagcaagcgaccatcgcataagtcagagccaaccgcatgaagttggccaatatgagaaagacgcctgacaatgaaagatggaaagtggcaactgcaaaacacaagccaacccctgagtaagtcgaaaatgggaagcctttcgggcatatccggccgataaagtggacgaaaagagaatttgtggttgcacaattcgcaaacatccttcttgctgtacttaagccactgtagcagacaatcctggtgcacgtactttatgctgccagtgcctaaattgtcaattaacaaattttgaaattgaaaagccaattagttacaaaggcacggatggtataaaacgtcgttccccgacaatcgacaaacacggcagatatctgtattcagaaagaatttggcgctaattaaggctatttttgaaacttattagaaacaaaagggggaacctttttggttgccaaattttatttaaaaaatcggaaaatataacggtagcatgaatctgacatcgacttcgaccacttaacacttttttcctcatgtagaaataatttttaccggtaaacctaaaaagtgccccctttggtttttgttaaatttttaatagttatgcgttacccctttctccctgtccatcctcttcctcatgtgcgttcattatgttttccattattctatccttcagacttttttcttttctttgaacttgcgtcgaacttgactcagcagctaaagacgaagttgccgatgtttcttgttcattcatcgtcctaaattaggtcaaacaaagacagattttgtataaataatattataatacttaaatttatgtgaattcgataagtatgaggaaatgcaattattcacacgcatttagggtgtaattaatttaagtaccgagaccgcattttgatgcaaatgcctttttttctgcgcactagtttcgatatattaatcataaataacacattttccacttgatttgagtcttctacgttgacttttattatgccttttttttgcctttttcgggattttcgtgccttaaattccttttttggcattttgccgttttggtgcctttttggcgttttttccggaacattccattaaaaatggaataaaaatcgggaaaataaacccctaagaaatgacttgaaaaattttcagaaaacaaaacattataaaatatttaataattatttatgaccaaaattaagtttttggttaagttttacgtgttttggcaccctaaaaaaccttagaaaaaatttttttgaatgccttttttcatgcctttttcgggattttcgtgccttttttgcggtctctattaattactagggctgcaacagggacgtatccaggatttgggcttggggggggggggggggtaccgatccgaaaagtcaattcttaggggtgtattttttaaaatttttcgcccgattcttaggggtgtattttttaaaatttttcgcccgattcttaggggtgtattttttaaaatttttcgcccgattcttaggggtgtatttttgaaaattcttcgcccgattcttaggggtgtatttttgaaaaactttcgcccgaacgaccttttttttttttgctcataccagcgacgctgggaaaataggggtgtatttgaaacgataaattagcattttttccatcgtttacacaatggattttgaaatttagctattttgactgcttttgctccgcccctggcgaaaggaaatgaagaaattgaagacagagaaaatgtttctttgtaatttggcgttggaatttaaaattaatatgttgctttcgttatgataatttggcgttaatttaaatttggcattcctttttctctctggggcgctggttggtcttgttgggggggggggggtaccacctctctttttcccttaccgacgggggtcttgggggggggg
